United States Patent 9,567,581 (SELECTIVE REACTIVATION OF GENES ON THE INACTIVE X CHROMOSOME) - sequence listing, part 60

SEQ ID NO: 7816 - DNA, 1445 bp, artificial
  synthetic oligonucleotide
tttgggagggactttaagtagtttaatgaataaatgaggcaatgtggtataattataaggaggcagaggccctatatgctgaggacttccaagttaatcttgtggttacatttgacttgcctaggcctgtgtgactttataccagtataaccaaaggcttgctggacatttctacccgatgaccccagacatctcacagtcaacattccaacctataatctgtcttcttgcctctcaaatcttttttctcctcagtcataacttggatagtggcaccatcatgtatgccatctccccctccctcctctggaacatcagtcagcgcacagtcctgtcagtttgttctcctaaatgtctctcgcgtctgtctttttctttctacctccattgatgtggccttggttcaggtcctcattatcttatctctatctagactactgcaaatgcttcttcctcctccctgactccctgatcttattccctaaagaccacctccctccttccaaacaggcaaatgctgttctctctctctttctggatccagaagtcagtaagggctgccagtgtgcagaagtagctggaaccttactaacatatattcaaagattgcagagacatatgatttcttcaagattaatttcctttttgtttttctgctgtgaatccaatggaataagttattaaaatgcttcaagcttctgaaggaaagcatggaaacatgccagcaggaacaacataaaggtttcctttattttcctctagcatctatctgtgatggacgatgtgaccatgattcttcacttaaatatggaattctggaatatcataaaatcccagagcgtcagggctgggcaaagccagtctggatcctatgtctgaggctgagagaagggaagggctttatttaacatcacaaggccagttagctgtggaagtaggactcagacccagttctctgtattactcaagtgatcatgaggcttcatttagatgcattgttaaaacatttggcagctctgtgacccatcccccacatgaccgtggcatgacttccttcatctgatcattttttgcttctcttaagcctgagtgctaatcagtgtgattagaaagaaaggaacccattagctggtttgctccccaagttgaatattccaattaaaccatatttttgtggttttgtgtttatttttatttttacccttctctttacaataataaaagatgggaaaaatccaggacataataaagtgacatatgctttagtggtgattttcaaatggggtaccttagagcaccagggctttcttggagttgccttggggcctcttatatgtatcactcattgaggtgccaagtgaacagggccctgggctggcaacccccgtttcagccagacagctgtgtttgtatctgttttatatggacttacactaccattggat

SEQ ID NO: 7817 - DNA, 490 bp, artificial
  synthetic oligonucleotide
ggagtgacacaaacattcagaccatagcaaatactatttcaaagtgacaaaagcatgcagagggtatcatgggaataaagagaaggttcctttcccagcctggagtggaaatgaatggtcagagaagacttcaggaagaggtgatgcttgggctaagtcctaaagggtaaagaggtgtttacatagtaaaaagtggcgggggcgggtggaagtgtgtgtttaagctgagggcaaaccctcaggaattgctctgcagttcctatactgtccagtactggtaagagttctgatcagatttgatagccatacatgaaatgtggactcagtgtttgtttgtagcccaccagatgtgttgagaacactgtggataagtgcatattttagtgcttctgtaaagccctagaaagtaaatattttaggctttgaaggccatgaggtctcttttgcaactatgcaactatgcagtgctatctcatcacagatttaattt

SEQ ID NO: 7818 - DNA, 1769 bp, artificial
  synthetic oligonucleotide
gcttctcttcatcattagcactgacccaaaactgaatggcctgagactcagccatgtactgtgccgtagcttaaaaaagaagctgggaaagtgagtaactggtgtttttttcagctttctcaaacctgggaagagtgaagatggtgggcagtcaaaaaaaggatagatatccaccataagcccaaagcaggattgtgtggcattggtgcaactggcccatatatgcctatatggctggcaggaaagagctggcagaggattagaggggtgcaaacactcacacccatgtcctccaaggccatgcactaagatccctcatcttgtggtgtgggaatcttgggaagaagttgtccattttaagttttttctccagttgcctctctcaccgcatctcctacccatctgaaggtttatatacctcttgggaccaataaaccaatttgccacagacttcatacagagctccttgcctaccacacaaatcccagcccatatccttgctgttgtgcctttgagcacatgcagtggcttcctagggcttttctccagtatcaatggctaaactcaggagcttctcttgtttatgagagtgtcaagtcccagccctacaagtggagcagttgtcttttgtgaagctttggaaggcttcagagcaggacacacagttagaagtcctgtgccccttctatagtaagtgatttcagccaacgctggggctttggtgtttactgtgatgtttatgttcttatttgatttcttggcattcagaatcctcattaatatacatttgtgcctccctgtggaaacaaaggatcgtattctgtctgtatgtgctcacatttctttatttagcctggcacctgccttcttccccagcatctgtgttgttcccttgcaaatctccagagcttacaattcttagaaaaaatgatttctctctaggaagatttctatctttctctggaactatccttaagggctaagctcttgtgtcacaggcaggtgagctgcatcacccactccagcaggtggggccgctgcacatcccccagtcactggttctataggcccctctgagcagaggtaggcatcccaggccagtgactgctgcttctgtggaccctcttatgtcaagccccaaaagtttccaaggatgactcacatgcaaaaatttgtcacctgcattgggcagtatggtggtttataccagttgggctccaggccagctctgagcaagagggaaggtgtcactggagtattcatgagtggctgctgctcaccaggctccaagagagctggcccttgggttttaggagttagggggaatgaatgagactgtctctaaatagccctcaggagctgggccctgagccaggggacttcctggatggattactggactacaatctagatgatgggcatttggggccatccctcataagcatccactggggtctgggagcatactgtcagcctggccacttgttcacatctttatctctggaggtgacacagaggagacagcattgggtgattatgtcaagccaagctagagtcagccagacctgtaattatatcctagcttcaccacttacgtactttctgactttgggcaggttgcctctcttatctcagtctcttatctcctcatatgggaaatggaagggttcgatgagaatgtacttcacacacctagggcagttcctggcttatagtaggtgcataataatcaagatccattgttataaaaataacactgaacttgactg

SEQ ID NO: 7819 - DNA, 1106 bp, artificial
  synthetic oligonucleotide
tctctcagcaggacataaagtgcatgtgtgtttctggtactgctgtgtattttctgatgctgaataaatggatgagcagaagactaacatccaacaatgaaaatgctgggctaccattgggtgcctacaatacattgaacatttttaccactttgttttaattgatacacaaaaagcatccccacaaggtagatgttattattatcctcattttataggtatttaagtcaagaccagagttaaataatttcacctaagtcatacagctactaagtgaagagtggctattgaaacttaggtctggctgactctaagatcttctctcttccacgccatactctctctggtgtcccccggaactttcctgccctgctgtctggaccccagtgcctggagctctggctctgccctaggaatcttggaggaaaccactgaatgaggcaggaggaaggaagatggagcagcagaaagagcctgagttgtgagctggcctcagcctcatcactctgacccttccaggtctccagtggcacaaatgggtgctcaggccaaataaagtctgtgaaacctacagatttcaaaaagtagtttctatacagttcagtaatacctcaattattccaaaatcatgtaattggtgacctaactgaatcagaaagtcatcaacctcagaacagcgtctgaagagctgaaatagcctgaagtctcctgcccttccttcaccagggagctcggcaggttcatatgcagtttgtggcttcacgcccacatgtctagcaagctctgctgccagttctctcagcctgtagcacatagaagcagcaaattagaaagagagggccagagctactggaagtgaggctggcagacatcacaaatggccactgacagtgacagaggaagcagcaatattatacaaagtaggttcgaatgcaagaggttcagccatgtgggatcatttattataacgacaaagagcctgacaatgctagataaatgagatgttactggacttcctctgccaactttgaattctcaagttacctactgaaagaactaaacatgtccttctggacctgagcacttgcctaagactcaggaatatt

SEQ ID NO: 7820 - DNA, 1068 bp, artificial
  synthetic oligonucleotide
ctctcagggctgtgggcttcccagcgacccctcttcttgaagaacaccaacctcaggtaggatcttgcatgtgcttagaagaggtaagggattttagggaatcaatgcctgaatgggttctgactgcacagctaagggagttcctgccatctggtttctgttatgcaaatctgtataaccaaatcagggtcacctttccatggggtctcagggtggtagtgagaagggtgctttctcaggatgaggagctggactcactcattgccttccccacattactgtggtcagttgtcccctgctaaagctctagtcattagctgtcagaaacatctagaaatttccttggacttccaaaggtgaattgacaaaggacagcagctcatagcattgcccagcagaatggcttgatggtcaggggcattccctgagattgaaatgcagcttctaccaagggcctccttcctgcctcccttgtctagaccaggaattcatttcagagctatttccctcgtgttgacattgcccccactcccttgtcaaaacaagtaaaaaatcaaaaggtagataaacataattttaaattgtaaaataagttagaagataacatcctgaaaggaaaatggattgactggcaaaaaacaaacagaaccaataacaaagacaatgaccagaagacaacactcccacatggggcccaaagaggtgagtggccacagttctgggcagcaattgccctgtggccagctagggctaagctgaaatttctgcaaggtcctctgcaagaggtattttccaaggtttgggggctacagattcaggactagaggtaggggtcccacttcaggacagagatatggggaccctggtggttcactcagctgttctttctgcccacaatggcaatgcccactaagccatgagcttggccttcctcttcccatggctagcccctaagccttttattgcatttcaggtccccatcagaaatttcagcagggctcccgcctcttctcagatgctctctcaggcacctctgacccaacaggccaatgtctggaagtggttagt

SEQ ID NO: 7821 - DNA, 817 bp, artificial
  synthetic oligonucleotide
gatatcactaatcaatcacagtctccccctgagctttgccaggacctcagaatcctttcaagctcagtagtcccagaagtggcccaaggagtgacttattgaatgaatgaatgactcaaaactgtacctctgagcttccctattccaatctttgggaaatgcctgattcttgacagtatgtctgtgaggcaaatacttcagatttccggtagtataatctctaatattcaggatttaagttggatttaagttggcatatatgcaccaattaaatagagagctgccaaatactgccacagggtctgcatgcagtcatctcactgccaattccttcaggagataataacgtatgcatattttatggactcaaataagagattcacttatttctgtaatgagattccattacagctggtttgcagaagcccccataaagtcagggaaatgcaccatagaaaataaactccagaaatttccaggcttggcatatctatgtatgtacatttggggttgggtatggcaagagggtcatacatgtggactaaaacgaaggttgataaatgagggagggagaatgtatttaaccccattaacttcattcaggtttttcttaatgtcatatatattgtcttaattctgtaactgctggtggaagatagggccataaaccattctgagtaccagggaaaagtcaggcttcagtaaaaaaaattgcctgcagaatatagggatggctttaaagaaacagaaaagtgtgattcataaacaggaaaaaacaagcagtagaaattgtttttaaaggaacttagatgttaga

SEQ ID NO: 7822 - DNA, 1315 bp, artificial
  synthetic oligonucleotide
cctcttcccctcccccaagcccatgctgttacttatggcctctgttgttagctggtgggccttctgttgtacttaaatctctatctgctcccccacactccccactagcctgccaccagagtatggacaaggcacacatgctttccctcttccagcccacatcttggtgcccaggtctgacactgccaacagcagacattcagaggctaaaaacaaactttcctcagccatctgcctcctagaaaggaggactgggtgctttatcttttatgcatacttgtgttatgcacttattgggtgtgaggtttggagctcccacagaagggagggcacagccgctgacatgaaggaatttcaaaccagcagggaggtcgccacatcacagtatggtgtgtggcagccactgcccaggattccctaacctggaagtgcctcagaagaaagagtctgggtttgtttcacttcctgctggatccccagtgcaacacttggcaaaggcaggcaggagctggggctgtccaacctcgttcctatgtgggaatgcacctcaaagatcaagaagcagggctctggcaagatcaaggttgtaggaggccattcccagcctcctcctgctcttcagcccactccatgagcagtgcctctggcagctattgcctccggcagctgttgcctccaccacgcccttcttccacattcagctgaagggcttccccctgggagcaagacatacatacccagccgtgggcgtgggggcacatataacagtctggacaccaataagccagatccagagggctttatgatcctttcatatgtgttctttcagtctcatagccattctgccaggcagaggatattaaacctccacatgaggaaactgaggttaagcaaggctaagcccctcactccagatcacagggctagaaagtggtggtggaggactggaatttgaacacatgtttggctgagtcctgaatagtgcctcagtcatggactcccatgggaccacttccttccaatttgccggggtagctaaagcccctgggaggacccagcaagtgccaaccaaataggcaaacatcttggtgatgcctaagggagggaagatgcagcaagctaggtggaaaggtctgagagcacctagcatccatttcttcttaggtcaacactggtcaccagaattagccttccagttgcttcgtcacatggaggctaaataactttatggctctcttctccagctgaagaatgaggatggggcagatctagctgcggtgtcctgagtgactgccttgtccaggacagggccctc

SEQ ID NO: 7823 - DNA, 670 bp, artificial
  synthetic oligonucleotide
agactaaggagagaaacaaggtggttcattctgtgtgagggatgggattcctgctctgagtgtttcagattttggtgagttgtttgtttgttgaaggtggcctgcctctggatggttgttttgttttgttttcacctattttccaaagcagattggggagagactgcttttgactaaaaatatttctaagagcaaattgcttttgccagcagtttatgtcctgcctccacctggttgccgtgacagcagctggtattcttgaagggacattcaggtattgggtatcaagagatggaagggagcactagcaagaaaaaatatcaagtactttgtctcaattgtcacattattttacttcagaaaatacaaataaattaatctaacaggccattgggttcagatagaagaaactgtacctgcagtaaggacacaagagctccaggactgaaagggctccctgttggtgaggctacttgctcctgctggagaagcaagggcctctgcagtccctgggtcttccctccatgccctaggaacagcaatgggcaaatccttcaactttaagatctgagaaatggctgattccatgagaggatttgcctgtgccaaaagggagctgcaggtggatagcaccgggcattggggtgccctagactgggcttcagaatca

SEQ ID NO: 7824 - DNA, 1067 bp, artificial
  synthetic oligonucleotide
taaaatggtttattgtggtaaaacatacataacattttactattaggatggtgcaaaagtcattgtgatctttgcagttactttaaaaaaaaaaaaaaaaatggcaaaaaccgcaattacttttgcaccaacctaatatttttagccatttttttggcatacaggtcagtggcataagtgccttcacgttgttgtgcaaccatcaccaccatccatcaccagaaatcttcatctttccaaaccgaaattctgtccccattaaacactaactccccatcccctgttccccagcccatggcacccatcattctactttccttctctatgaatttgacagccctttggacctcctgtgagtgaaatcacacaggatttatccctttgtgactggctcatttcacttagcataatgtccgcaagcatcatccatggtgtagcatatgtcaggaatgtccttcctttttaagactgaatagtattccatgtatggatacaccacattttgtttatccagttatctgttgatggacatttggcactcctctggagccttcccaagtgaggctcttttatataaggagtctggtggtggggggagagagagcagatataggtaagagaagagagggaagtagggcaccagtccacccaagcgctcatctccctttccctgcctgtcacccccagttctgaagctttgccttcgctggggaggaaggaagcagagaggctcttgggaaagaaggatggcaggctaagaagtcagaagcccttcacacctttctctccaaccaggcagcagcaactccctgtgagtcttactgaaagatagctgctgtgctcctccccatcctagaagcaattccacaaaaacccacccttcaaaccttgatctgagaagctttgaggagagtgatttgcctgctaatcacagagcaacttggtggggacaggaaggcttccacatgcatgtctttgcaaaggtctttagtgcttagcaagctgatactgaggcaggaatgatgagaacaaccgttcccaatgtcagtgcatgttaagtacaattg

SEQ ID NO: 7825 - DNA, 1746 bp, artificial
  synthetic oligonucleotide
ccagtgccataataggccccagacagcccaaagatggtgaaaggacacctgaagatttgattcaggagtgccctttgaggcaattcactttaattctttgtagcccaatgccagcacaggacagggctgactggcatgactgtggcctgctgttgggagtctcctctggagacaagggagccagccccaccccatgccttacctctccccaacaccatgcctcctgcccaggaccgtttttatgaacaccctaggagcaggaaatgagatggcatgagacagcaattctacaaagtggtctttttctcctggccactctctagagaggctggcagggtgaggggagaggaaatgcaatttcaattgctcctgagagtcatgtaagaaatttaagactattgggaagtgctggggaggaggctactggttgaatggtcgagttagggaaaggggtccttaaatggagcaaaaaacaccctgttaggctaaaatgtaaatactaaccttttcattaataaacactcaatgaaatgaataatttagtccactggcaccttttgttttaatcctgagtggaaagactgtggcagctcttaacaaatggcccccagtgacttcctctgtggccaggacatgctccaaatggtgggctctgcccccacccaagcctgctgcattcccaattaacacttttcaaaatgaaatttagggtgcttttcttccttcttcctaatgaggtttcttccttccctgctgtctcgctacaaagcttgattctgtctgagtgtgttcatatggtgctctagtgcgttatctgaccttgattggtgtttggggagccggttaaatagattacatgggggttaccttggcaactgtcttcactgatttagcaatgcggttcattcttggacacaggactctcggcaactctgcgatcccactgctgtgcgttaatcattaacaccaagttggacatcggctctgccaggcagcagccaggagcaagactggggacgagctgccttgaagtctttttagctatgactaaggaggtcaccacatggatccctaagtgtggggccacaggagaaggcgatggcaagactccatcctgaggtctgtctgtcccttttcccatagtgttaaaaggagttgagagatcacttggcttgttccattgggttacagatgggcttgctgtggggatgctatgctcttcttccctcagctggcaaggtagccatgctagctgtgacccatggtcagttggtatctcctctggccccatagggctgcatgaaagcaaaaacaggctctgaggcatggaggctctggccccttgctcactgtgtgactttgggtaagtcacttcacctcccagagtcttgattttcttttccatatataacatgggaaatcagtagtgccttccttctagccctggtgaggagacataaagcagctgacgcagaagaggcactcaatcaatgctgatggttattattacctggctccgtggctaaccgagtgagctcctagtcattgtgtattagattaagttatttaatctgaagccaaaactcaccctctgtcaaaataataattatatctattttatgggtaaggctgagactctggctaagtagttcaggttgcatgctggtcagagcaaagccagcatcagaattcaagtcaagctcatccttctctgaggcttcagagctgcatctacctgggaacaat

SEQ ID NO: 7826 - DNA, 670 bp, artificial
  synthetic oligonucleotide
cagaggctgggacatcatgggcaggtgaggtgagagccaatggagagccagtaggaaatagactggaagttctgttgtgtgggcacataatccaggagtcagaggctcagctacatccagtctagccccttcctactgagcagctttgacttcctgatgtgtagagtggggctggaaaccctgcctgacaggcttgtgggaaggatttcaattatgtagaaatatgctgcatatgggaatgcatgctgccagtttgagaggtaacagccaataaatcacccaaggaatctactttgagcccctgctacactcactaagttgggctgcaagagaagatatgtcccatggccagaggggcagaagattctaggcagaggtgagagcagctcactcactttctggattgatgagaagtttttggcttgggcaggggctttgagttctttggaattcccttctccctttcccttggtatgacagtgtgtgatggtttgagctggtgctgagctggagtcattcttgggtggggctctgagttgagtaacccagaggtccagccttccccatagttggctttgcagcacttttccccattcctgtccccaggaattgcaccttccccaaggattgggctttcttttttgttaatctgaaattatcagatatagtc

SEQ ID NO: 7827 - DNA, 454 bp, artificial
  synthetic oligonucleotide
aaatattgtcttgggctctgcttccaggacacccaaagagatgatacatgaaaaaagaaaaggatacaaatgtgtatatatagtaaagaaactatgtatggaaatatgccaaaatgttaacagagttctttctggaagagggaattatgggtgattctcccccttgacttctttgtttctgcttttctgtttttgtctaaatagtctccatcagcatgcttggataatcagaaacagtgatgtatacagcagaacaataaagggttaaatgagttaaaagcaaattgctcttggagataagagggggaagtgagtcattatccttgaggtaattcaagaggacttattcatggaggagggggcatttgatttgccacatagaagaatggatgggggcagacagctggggaggacattccaaattgcagaaacaatgtgacaaaaatcacaaaag

SEQ ID NO: 7828 - DNA, 1593 bp, artificial
  synthetic oligonucleotide
cttttatccaccctccacaggattttttttattttctcagtagactatttctccttctctccctcaattttaagatcaacaactaaatcaggttcagggccatcaacataattaatgccatttttggtgggctctgaggtttggagtgttgtcactcctgactagcccttcactgtgagcaggattctggtccagaagccaagttgaggctgtcagtggctgtggcattaggtgaggccccttggagggggtggccctaaccgcagcctccgtcttaagcagacgccctccagaagcttggaggcttcccaagccggaagcccccatccaccttccagggcagccttggagctggctcttccaatgggctccaggaaaacctgcttccgcagcttgcaactgaagtgctcatcttggggatccaagcggggcttcttgtttctagctgttgtcagttggatgacatggggggcaggctcctcttgtctctcaatttctagctcctaggcccctgagcagcacagatatggccagtcacctgattccaggggagctgagaagtggggctttcaccacagccagtcctgctcctccttcctgtgccccgttagtagtatgactaagtgacaattacctaactctcccatttgaagttgggatagaaaatgttgtggctgaagtatttctatttctcactttccaagctcgccagggcatccgcatgtaagagctctcactctatttctggctgggtgcttagtgaatgaaacaggatattctgccaacttcagagcacaccttttatcatgcactgcgagatcggctgacttgcctatcctctccccaatccccccagtcagcaatatgccagctcccagcgggtggagagcaggaagtcactgagctagccgacttgtatggggctcctaaattcccctgaagcaagggcagagaacacacttccttcgatgacaagagacctgaatgctgataatgggagtttcctgcctgcttggcttctagctttctctcattctccttgggcattgagcagggagcagagatctgggcttttgcatggtaccccaacccctggctggctcttctcccttctccttgctagccaagagtgccaattcagagcctcttcttccttataacagatgcaatgcttctaaagcctagtatagctctgtcacgaatgagttgtgtggtctttggacaaaacatttcacctctcttgcctccatttgctcatctgtgaaagggaagaaatacctacctcactggattttgtagaataatagtgagactccattgggcacatggacctcaatccacaccttttgtcttcaaattgaaatgcttcataatgcctatttaagtctactatagaccgtatgctgtactcaggctgtcttgagagctgagacatgagcagctgcattggaagatatttattatgagatgacatcatattcttgcatgcaaaggtcagcccatggttgggattcctgcctttgttgttttctaccttgggagtttcagggtcattacccacatccatctgggtttgccaagcttgggctgtag

SEQ ID NO: 7829 - DNA, 3721 bp, artificial
  synthetic oligonucleotide
tgtggaagcatctgtctcccaacccacccctggccttctcctcccagatgcaagttgggtgagatggaagcacatggctccctctcctgctgtggctggtttccctgtgggggtatcatgcgaaggcaaagatgacgtggccatccatgtgaactgaggtgcctctcagccactgcccttgtcacaggctggcaattgtcagtgctaatctgagtagctgggaaataagacttgtgttaacactttgtgttattcaaacaggtctttcaggggccagtgaagaaattcactttgccacacttgctgccatgccagcaggctaattgtgtgttgcttgtgcctgctattgaatcaggtctctttggctgttcgactcataaatcagggccaacaatcccagccaacagggagagccagctgctgctaagcaagagctgcaggccccaccttaatctgacattgacccagttaggtgaccttgggcgaaagccctatccttttctgagtcttagtgtccaggtctgctggggccttgggacacagatgttgcaaactccctgggtttcaaggaatatgatgggacagagaggctgtttagccacagcagttccatgtgttctgtgagctcactgccccagaggcattctggccaaaatttggggatcaatgcccaggcaggggtgctagaaaaagcatcactgctggagctgcaggccactggaagatgctgacacccaggctggcccaggggagtcagtgatggaagtcagtgatggaaggtaagtcagtgatggaaggtgagtccagcctgatctagaatagcaccttccttccccagcactgaatggctgcagaggaatctgccctccaatctgggaaattccatcccttcagcagcagttggggagcacacagcccagagtccagcaggcctgaagccagtccttgtgctatcacatctcctctgggtgaacataggcataatcctcgtctgtaaaataggcattatagtaagagctttccaaaaccatggagactgttctatgaatcaagggagacaatcagtggcaaccccagagcacaatgcctggcatacagtaagagcttaagagccaattcctttctggatcggtttcctagggctgctgtaacaaattacctccaacttggtggcttaaaacaacacacatttatgctcttactgctctggatatcagaagtctgaaatgggtcacactgggctaaaatcagggcaccagcaggctgtgttccttctgaaggctctaagggagaatctgtttcctcgccttttccagcttctagaggccacctgtgttccttggcttgtggcctttcctcaaatcactccactctcttgcttccatcctcacatctcctgctactgacactgaccctactgtgcccctctcatgattacattaggactcatccggataatccaggatgatctcgccatgtcaagagtcttgatttaattctacctgcagagtcccctttgccttggaaggtaacatactcccaggctctggggtgtggggagaggcattgttctaccaaccacatcttctctcctctctctagggttcctattcctgatcaggccagtttggagcaaactcagggggctcagagccagaagagcccttagaggccacctattgtgtttggctctgtctattccagctccctggctagactgtcagcccctgaatgcaaggacacaaactagtcttgttcactgcttaatgctcacctccataccacctcagcacagagaatggacagagtcagcacttggtacatctgtgccaatttcatgttgtggaatgaacttgaagacactaaatagatgcctcctgaccctcaaaattcactatcccccaccccgtttaaaaagagtagcaactggtttatctgtttcgttttaaaaagttatcaggatggcgaaactggcccagagagaggaatggacttgcccaaagccacaggaactagcatgcatcccaggcttccaccatcctagagcaagttgtgcttcccattgacactcattttgtaaatgagacctgtgtggttcaggaggttgtacagctgacaggcagcagaacctgggtgtacaccagggctttttgcctcctagatcaagagaacctgagttctctgaccacagcatgctagaggccacaaccaacaggaacacaggaatgaggacagacaagtgcccttggggaggctcaggctggcgactaccccatgcagaggaagtgcacggaacttgatctgggagaaagaaggctgcctgctggctaccaccctgagtctgccctgaccccagcccctctcacaggctctgaggccccagcacatcattactctccctgggctgctcacagcctgtcatccccaccttagcatgggccctggtgacatgcaggtggcagtggctcagcactgccaaaggggcacagcaagggttgccacctgcagttcactcacacacaaatacacatgtgtgtgcacacactcgcacgtgtacattcacacgcgtacacatgcacacacacactctcatatgtacctcccctcccccaccccacacacgggcagattcaaggctgcctaccctcccttttccccaggattgcagtagctgcctcctctgcccccatattgtgcccctttgccggcactcccgggctcgtggcagtgggggtggggaagcacaagcagaaatgaaagtacagattttgatccatcctcatcaggaacggctgtcccatctaggagtccccggacaggattttccatgcctttctgaaagggccactcagagtctcagcctgtgcagtgaataggacactaagcatctgttctagactttgcttccgttcatggagtggaggcttttgactgtttgccaggagcagagaggcctggggtgctgtggaaagtggggctcaatgttcatatgctgtgtgcattcatttgtgggcatgtgcatttatgtgtgagtgtgcccctgggcatgcttctggctttgggcacgtctgtgtgttgacaaatgaatatgtgtgtgtgtgtgtgtgtgtgtgtgtgtgtgtgtgtgtgtatgcctgtctgttggtatgtgtgcatgtgtgtacatacgcatatgtgtgtgcatgtgtgtatgtgtctccatgtgtgtctgcacattgcctgtctcagtcggcttggctgctataacaacgtaccatagactgggtggctgaaacaacacatttattcctcacaattctggaagctgggaagtccaagatcaaggtgccagcagattcagttcctggtgagaggtctcgttctgtcttgcagacagctgccttttcactgtgtcctcacacggcagaaggagacagtgagctctagtctcgcttccttttcttataaggacactattccattgtgggtccccatcctcatggccttacctaactttaattatctcccaagggccccacctccaaatacaatcacattggggtcagggctttaacatgaattttgaggtggacacatttagttcatggcagtgcccgtgtgtgtgtgcgcgcgtgtgtgtgtcaaacaatcagcagctctaccatgctgctgccaccatcgtcccctctggatttcctgaatgaggttatcttctgccttctccagatctaagcacttggat

SEQ ID NO: 7830 - DNA, 4636 bp, artificial
  synthetic oligonucleotide
tgtcggagcagacgcggcgttcccgggttgtgctcagcccctgcagctgccatcggctggagaagtccaggttaggaaacgcatccggggaggggatcctagagaaggggcgcagccaaatacccgggaggtgggataggtgggaggggagtcgctggactcggcgccagggcagatggtggacagggcgcgctggcccgcccggcagttcccaaggaacctatgttcctgcagaagccgcaggtgtccgtcttgggataactgcggagggagccaatccagcccagcttgggcgggagcatcgcgtgccctggtccagtggaacgggagactggccagcgagcctggactctgagctaagcgtactggcgggcgacgccgacagcgtccgcgctaagggtgggggactgggaagtggggagtggggcactcggccgggatggagagaatgcagttcactaactgccacctgagagccctggtccccgctgccgccacagcgggtctgtttggcagtcagggcgcgagctggtgagcggatgcgtgggcggagggactggcgctacccacccagcagccacccactgcaggtgagtgcccctcccagggcgaggggaggagaagggcctggccgctagccctagggtcaggctctggtgaaaatgggaagggggatgggggctgaataggctactttgtgatgagactcccgtccctgtgacacttcagggtcctctggggatctgtcattcctcttgcaagctctcttgttctctggtccctctcctcctctccttatttcctcctctcctctcctctcctctcatctcctctcctctcctctcccttcatcgtgtctctacctctatctccgccggtgcctctctcggtatctgtctctcagtctctgccttctctgtgtctcgtacggtctcctgtctttcttggtctctcggtcctgagcgctctctcgccctgtcactgatgaccgctggcttttggctctccgtgctcgctcttcgtgtgtcccggccacgcacggctcaccagctcgttttccccagacgcggaaagtctaccttcggcgtgcgggtttcccaagcgcgccgggccccgcctgcggccctccggcgggctctgtctgctggaggcgctccgctaaccctgctgtcgcctctttccaccagcgcaccgcctaggcaagccagctgacgccgggggcacagaccaccctccactgagtgcggagcagccaaggtgagtgcaccgatgccccttccgcccctccgatccctccccagctgccctggttcgagccgactggagaaatgaggctgcaacagcgaagccagcctgcggccgctttctcctctaaagactggtgggagggcccgggaggcccctcgggcggccgcagctctttggctgcccgctgccccatcccggagtggaaaccctgagtttccaggcttcgggctggcggggtcgcgggcagggcagcgcggcttcccctttaaggccggagccgctcgtcgccgtgagtgtgagggtgtgtgagtgtgcggcgtgcgtgtctcctcctccccgagtgacacagcagtgagaaatgcctatcagtaacttaaacccccgaaactccaccttccgggcgcgcggcgcggagccgggcggtgggaatggagcgagcagattgaggccgccactgcagcgccgccagcatgaacttggccgcgagctgaagcggccggcggcgggcgggcgcgggggcaccggccgctagccagggggtgatctgcaacagggctgggttccttggcggccgcctgagtccaggctgcccgcgccggcggccgcccgcccctcggacactgcccccgccgccgccggagctctgcagcacggtaaggctgagggcgggtgcaggaagtctgactgttctgggggttccggggtacacttgtagcccccagttatggtccccatcgctgaggatcggggtcccaggggtgcttcgagtcggtagaccctaaagtttgctctgagcacacggcccacctggcgctgcgggcggccacccccttctcgaaccagcccggctgggctgggcgcagctcgaaacgccggagaccacggcctttggctcggcgcccgtcgggcgtctgaaatccggcggggacagccacgtaccggggaggaaaggtagaagggcgcaagctcctcgggctacgctgggctactgggaggctcccactctgtcccagcacccccgggtcgcttgcagcctgggtgtcaccggcgacggtgccttcacatgccagctgcctgagcccaggccagtaggcagtgggcgctggatgaaggatttccccaccccaacgctgtttgccgcctctgagcgagagtgtggagtgtgcgcgccgaatccgctgccctgcactccctcccctgccaactcctgggaagcgcagcccggagctgagctggtgttcagggcagcccggactgggttcctgcggagcagccccggcgcccctgcgtcagagtccgcgcttcaggttccccagcatccgcgcgacgacagagctgggcgcccggcgccggctagcgcgggcgggaagccccccggagcgccgccaaatacttttctcggccagttggcttggccaggctccgtcccaatgcagtgtgtccgaagcctcctggaaagctggagatgtcgtctgattctgatccgtgattaaattcggactgagcagacactaataggattagcctgccagaaagctcggccctgaagccatcggaacctgtgcaaacacgcgcctcgggctggagcattcactcccgccccgccgcgcttctgcagctgggtgcggctgacctgggcacccggagtgtgggtgtgtgtgagcgggcgggagcacagcgtggctgggggacgtggggagaaggggctgcttttgctggggtggcttgtcgttgttgtttggcaccacggtgccccccgggggcgcggtccccacggtgaacgtgctgctcacgggtaggcaaacccaggccggctccgggacattgtctgcaagggcgagcgagccgagcttactagaggcggctgcgctggaacaaaggcgcaaagtctccctgagaccaagcaattttgaaagagttggctagggagagggcctgggtctcccggggtagacccccgcgggaattgcgccgcccccagcggccccggcccgcgcctggggaattgtgttccctggttgcggtgagccggcgagcgacatcgcagcggcgcggcccagctcttggcaggcgtgggttgccgcccgagtgcccaccggccgggcggggtcgaccgtgcacccgccggggcttcccggccgccaccgcagctctgggcccctggaggccgcgcagcttctttccttccctccctcccacctcttcttgtctttatagatcccccctccctcccacccccgccgccgccgccgccaacaatccgctttataaaaagcccctttgtttcccaggaggctggagagagggaaggggaaaagggacgcagaggcagagggcgggggcggctgtctccaagtggtttcgagccgctcgggacaggagggcaagtgtaggcgatgggggagggggctgtgtttcgaggaccctctgtgggaacccacgaaggcgcacggagcctcagccccggccctcgctgcacgcccggcctgccagccctggacaccctaaatcctggcggccgggacggccgagtggactgcactgcgagctggcgggcgcgcgcagaggccctaggctgcaagcgctccgcggggtgggcagacgcgactcgccgatgcgctcgccgggctcgggcatagggggcgccctttccttggtttcgctttgcagcgggcgcccctcgccgccggagctcagggcagctgtcgcgcccgccggtggctaagacggaggcggcagctcggaggcttaggccacccgcgtctggctacacgcctcatttcttcccgcgccctcctgccacaccctccgccccaccacacacaagggctcaaactctccgagcgccctttgtttggaggcgcggaggcagtgggagccgccacctccggggttcgtgtagcctaggcgggcagtgaggatgagcgtgctactctggactgcgcgctggcctgctgcctctgcacctaacccagcgcctgacactaaagctgccagctttagttagattgaccatttagcgggtccttgtcccttataactgcccccctaaaactttcgagaaccagggcttgcactgaggaatgtcaaatataatgttagaagtaacctttcgccattctgttggcctgctccgcccctgtgccccaaagtggtcggtgtctctcatagagtttgttcgggaagggaatactgaaaagaaaaaagtgacaaataaggaaagtgggcggggcccaggctcaggctggtgggtctcccaagcgaagtcagattccacccgctctctggccgcctccgcccctcctacttccatttaatctgatgtcgacgttttatttgtgcctttttgcatatctttctcctactcccctcccctcccatctctgga

SEQ ID NO: 7831 - DNA, 1989 bp, artificial
  synthetic oligonucleotide
agctgtcaggacagttagtcagggggttctccatggaggtaagaaacagtagcttgtgttataggatatttacatgccaagattggaggtgcatagtcctgtggggtcctgctcccaaattaccagcccagggctgctgaagccccaagagcattttcttccagaggtggagacagaagcaaaagagttgggttaccttatttccctgcctccacccccccagctctggttgctttctttctccccttcacagagcctccctggtttccttcaaacctcgagttttctcctaaaatctgacatctttataacatccaaagcaatcagatatgaaacagttcaaaaatattccccccgggggagggaatagcaaggggcctccctggctgtaggcactgagctcccagagtaaaggcttccagagacagggcctaaggagggtttgggagcaagaagcaaaaagctctttgcaaagtttaggagagctttccttgcccagattggctatcttgagcctccctgaggccccagcttcagactactccctcccttcctcggcctgcaagagggtgggctcttcatacccctggaggaggaccccccacccacccaccaaggcaactcagtcctgcccggctgccctctgacctggacacagccagtgcccctttctgcacagcccagttggagcctcccagacccccatttccttggtgggcaggtggggtaagctaccttaccctcccatgtgccctgctgcttgttctgccaagtaaataaccagtaagtggattttgggaaaggccattttcttaaggctgagaattgttccctgaggttcagagaaggatggagtggaccaggtgatatcatcttgttggaagagggcctagcaggccagccgttgattttttcccctttcttccacctgtgcgagtacctagacactagaccacagggacagttttctgctgattttggaagagatcattggaggccacagcacctgagctagttaatggcatccaggtcaaaaaggcctggtggccccagcttgtgttcacctgtgagaggaaagtgtgggtctttggagcataaagacaggaaaaaaacaaagtcaagtaattctgaacacattgaggaattccaagttcttggtccaattgtcccagctccaccctcaccccacaagtaatgcatttctattttttcctgcatttgaatccgaaattccactctcagcttcggcagcgtgctgtgacagagtggggaggaggaagacaggacccagctctgccttcctttctgtggctatgccagtcagttgaccattgcacctgtacatagttagcacaggtgcaccacctcacctgcaaactcagatgttgaaagatggagaatcttacagctggaagagtaaaaccccatgattttacagaagaggaaactgaggcccagagaagcgtctgactttcctatggggacatagtaaagggagcccaaagttgacagaaccctggtctctagttctcagtcaagtgtagaacatccattttgcacccatgtgtgagcagacaggctttccttttgaggcagagcaaatgtggtaaaaagaaatgcagccaatggagggggagcgcttgtaactgtggcgtaatataatctaccctgtatcaacgtgtgctttgctcagcattgttaggacagcaaaggggcatattagaatctgaactcgaagtctggaagtagctggagaatggagattgtaaattaagaattagaaggtagtgtgtgtctcgttttcgagttgctgtcagagagtcaggcagccagccctgtggagggcttggctgggtgggctcctctggcaatggtgggaggttgtttgggtttggctcttaatgagatctcagtgttaatatctgcctctggaagttccagcaccagcctcggaattttaagtgggacagtagttttggtgcagttgcc

SEQ ID NO: 7832 - DNA, 1157 bp, artificial
  synthetic oligonucleotide
ttttagaagttttagctaaagacaaagttgacatgtatttatgtaggaccaaataatagaaaaaaattcctttagagaccccttgttttatgcttgaggatgctgcagctgaagaaaaatatcatgcttgcccaggcttccctggcaagctgctaggagctgaggtggtccaggacccaggaggcccagcttgcaacccactgcttgccccacaccgcacttcctaggatcttacagaagaagcctccaggccctcaactccaaatgggacctgcagtcagcagaatatagggctgagtgattctgatttctagctatcagatactagcttatcagaatggaatttttattctccacccctgcccccaacatccaagggttctctgttaacagtaaatatttaattttcttggttttgtaccaatgcctaatttaaaataaaacagattttttgaatattggggggtggtccttaggggcttgttatttggatttattttatttcaaacagatgggctgttttaggtttgacttcatatttgctaattttcattatggaaaaaaaaaaaaaacaatcccaagccaccccacccttatttttgtactgagtaacagtttgtcttgtctaaaagaagcttttattttctcaactgtttgcacccagcgtattcagccttattttgtatttttaatcacataaatgtgttggccacctatagcttatgggatgttcacaaaatgcgccccactcattcccgaacagccaccaactttgggactgtatctctcagctccagcccagctacctcttgtctagttcccagccatccactcctctggcctgaagccagactgtatggaggtgcagagtcagagaggccttggccttggagggaggcaccctggtgcctggcccagctctactgccttgctgtgtgaccttgggcaagtcccttcccctctctgggcctcacggttcccactgttacaaagaggaggctgacctaaaggggctttgtggaattttcctcttattatgttagattgttatatttggaagatgtgacttgaccagtacagtacatgacctttaaatcctttctagaagcaatatttagtgatgtttctgaaagagttaggaggtctatatctctgag

SEQ ID NO: 7833 - DNA, 2267 bp, artificial
  synthetic oligonucleotide
ctaggagtcaagaggctggcttttgagaggctttactgcttcgttgctgtggggccttgagccagctcctgacttcttctgagcttcagtgtcctctctgaatgacaaacaatgtaaggtgggaccaaggtctgcgacctccagggagttcctttcctatcagggcccagaacaaacaagagatcaaggaacacacccagttcctaggcctgggctcactactatcaggttcaaggtcctgctcaatttctgacagcaatatccacataccatttctatgtcaattataggagccagtttctccagcttactttataaaatgttaattacttcccccacctccccacaaatgtgaaacttggatttaaaaagacattttggaaaacaggtacattttgacaggaacaatctgaaattgccacaggcataaacacatacaagtggatactgtttggtttgcttctgagagccccgtttagtggagagccggccgagccagtgactatctgaatgaagtataccagccatgccattatcagaggaaaggatgagtgtggactagtcaagtggctggatgctaattttatcacctttgctttcagaaaccagatcccattctggcagcaatggttcacatccctggctccttactgtctttaggtaatcataatattaatgtcccagtgcacccttaagccctttgcatctctcttcaaagcctttttcagacatgcaatacttatctggggtgaggggttgaacttcccactgagagaccagaactgatcagatgggcgggcctccaatcgcgagcttggctttaggcttgtagtcctcacttttctcaagtccagccacggcagcctgccaggcctgcctgccacaggcagccttattcaattgaatggggtcttaacaaggggaaaagccagagacatgaactggcgcatggagcacaatgatgctgactacccagcaaaggtaagcttgagacactctgaagcaccacactgactgtaaccacattgcataaaacccaacacaatccaagagaaatggaatcctcgtggggatagcattgggccaatagctcaacagccacccaaagtctccatggaacaactcaaggccagagcaaatttagtgacatgccttccctgttggagcacctgtatagcagccccgcagaagaggttgtctagtcccttccaggactcatgggagcccacgactctatagccattcttctccgccagattccacatcttcatagctttaagttttttcctttgccactccctatcttatttcctttctccattgtgtgttagcatacttaacagatggagaacagcatatacaagtggcttacaggactgtcaaggtagcagaggcacatttgaaaacagctcatgcaaccaaatgccaatgattgagcaaaccaccactcaggactgactcccccgcgttggccctgaaaatctagctactcagtgcttccatttgcagacataaacatccacttaggagttctgaaaacaccatctaagccaacatttggactcaagtaacaccaacagggctgcataatcagtaaactcacttttctgctctgtgcctttgcaacactctctgggaaagatgcagtagactcttacagataaaagttgacatggaggcaagttactaatatatagaaatgttggattttaagtaaagtatatttcactctgcagataaagggaacagagattctttttttcttatctcaaaacagactctttttgtagaattgatgaaatggaagtaattgtcaagaactgagagcattaatcaagaaaaagatgaaaaaaaaatggagagcaaattaaattaacttggaccacaaagaatatttaatgtttttgcccctgaaatccatttgatgtttcattttccccagatatagtacaggtggcctcaccatcattttgataagagcggcgccccagtcaccctctcccagtgatgcactgtgaagtgtttaacaaggggctctctaggaggaaaaaaaaaaagctctgattaaagtgatagcactgactgccgtgttgtaaatactcttgttgtggccgatttctagctaccaacatgatgtcacccaccttgcaaaattcctgaaaacataacagttggcttttgggagcccgtttgagataactctagcccaccactgtcccctcctctgcctgtatgtttcctatgctctccactctgggatcatagag

SEQ ID NO: 7834 - DNA, 981 bp, artificial
  synthetic oligonucleotide
aagagggtacccaaggctgttaccagaggttgtccctgggtgggggaagtggggtcccaatttactggcgtgcgttcctgaaattggggcactctgcccttccccgccccggccctgcacccagaaggttttatttgtcccagagttagctgacctggcccatatctgaaaggagcccaggctgggccttcatggggttattgatttcggcacaaggctttccaaatcccagactgcaggaggcttttacctaccctgaccccatatgcctggcttcagctccagcccacaggccacctccacaaggacaggccaggtccgtttctttccttctaaagtggatttttctcctctctccacctctcttcctctgtagggccacaggtggaggctttcccattagaagatctgggagccttgccatgactgctgaagcatctgctggttttctgtaaattgaaatcttctggccactgaagatgtgaggcacgtggcacaaagccttctgtggaaatgcagcaccacactcaataatgtggcccacggtcagcaacaaatgaggaaatgtgtggccctttcaaagtgtcatgcagagcgctggcctgccctgcatgctgcctgcccagagccctgcctccttctgagtggctgtggctgcaaagctcctttggggacaaagggaacagacttggcacactggccactctggcctgcagacagcaatgggaagactcggcagagacccagctgccccagggcctcatgggacttggatgcagtctgtgagtcaagggacagcgcagggcagctgttaagcactggagctctggcaccagagcccccggggttcacattatggagcaaccacttgttagctgtgggaccttgggcaggtcagcaaaccacttagcctctctgtgcctcggtttctccatctgccaaatggaaataaaaatagtattatctcatagggctgtcgtg

SEQ ID NO: 7835 - DNA, 1138 bp, artificial
  synthetic oligonucleotide
tgatccatttttctacagggacttcacctaaaatttcccctgaaagacagatccgctgcttttgcactgcactgcgccctgacttgggccgtaactaagatcctgcctctcctgacacaacaagggactcataacccctaggcaagtcccctctgtttgaacccccaaccagtgcccctctgggacctggggagattcctatgtcactgtgtggttgagaggagatccagtgcctggtgcagccctagcccaggcctggtgctgagaaagtgctctggaaacaggctgtattaggatgacccacaagcattattaataaccagacagagggcaccggtgtgtgtcaaacccagaaggtgagacaaggacaggcaggcaaaggaggagtgaagtcactggctaagaaaggccagtgtgagggagggaggatgggtcagacctgagcgggcccagctacttaaagaagccacaaaggcctgcctctggtcagcccaggctccctgtggctgctggcccgggctttcccctggggggaaacagctcaggctttgtgctacttcgatgctcacacacaggcacacccacttccatgggcccctgcacatgggaacccatgcgtattgatggccttcctcatccacaccccatgtcattctcatccccatgcgtacaccattcagacgttgcgccaaccaaccactcctccactccccttcatttaacaaataccacaaagcagcccttctgggacaatccctggggctacagaagacccaagacaacccctgtcctctcagaactgacagtaaaaacctcaatgaccacacagtggctacacagtgctgtgacagagtgaagcacggaggttgagggagccttgagaaggagctacctgactcagcctggaggcgtgggcagggatggagcctggcgacacacagctccggatgaaacttgggaacctagctttaagccaaacagcatgtggtgtttccttccatgacagtcactgatccaggggtgagcaggtgaactaggcagacccatcaagatctttactgactctctcacccagtgaattccaacaaggagttgtacagccagaatcgctatagacagtcatgttagggacacaagg

SEQ ID NO: 7836 - DNA, 562 bp, artificial
  synthetic oligonucleotide
attaggatatcattggttgagaaaaatgtgctccataatggcttccactgtcaccaaattcccctccaaagaggtaaccacagaaacacatgcctgtacactgtcatctctcttgaacagtgtcaggtatgcagtaggtgctcaatagtttctggatgaaggaataccgtggactccatttaatgatcaaacgggtttgcccttaggccgagagaagctggctgtggggacaaagtcccaggttttcccaactttttacaaaaagagtgcaaggcagttttcagacaaatctgacaagtgtaaaagcagcccaagctcagcttctctggtctgccctctccaccccccaggcagttctagggcacttctggaagcaccattggaccctagagttccatgaagccatgtggaaacccctgttggaggtcaggaatcaaaggcaaatgagatttttgtgtgctgatgatacatcacacacaacagcaaagcattgacaaccatacctaaagttaacccataagattaaacaactttgtattccaccccacaagcatgtactgaa

SEQ ID NO: 7837 - DNA, 1560 bp, artificial
  synthetic oligonucleotide
attttttctgattgtctgaaacctaagatggtcctatacacacagtagacatttagtaaacattatttaacttgaactagacaaaggaggccagcttagaattgttcacacatgatcattgtaaccaattctgttgcatgtctagagatcatgctccctgtctgccagatgaaatggagctcatgcttaacctttcttgccgtggtcaaacagcaaatgagaaagttctttgaatcagtcattgtcttgccacccttttcttctcagcttcttgatttttgaactcttggcatgagcagtttgagtacagattagtttttgctttgcttgctagtatgtttggggtgggaagttgaagggggaataattgaaagtaaaaataaaagttgtttgtaactcattcatctcttatccccttgcctccaaaccctgacagcacacagcaatgccctttctttagcatgtgataattgttatattttgatagcatgtccttgaacttttttgtgagaaggaagcattgtttatttcccagagccttttgcttggaatgtaatggattgctacatcagttatcctttccccttcttgggagatgtagaggcagaggtgggttataaggtagattcttagcatcaggtggtggtgctttaaattcccttatatgacttttaaattgctttatggccctgagacaacttaggtggggatttaggagaataggtactatgctggaatccagcaggcctggaattggcccaagctcttttactgaaataagaaatgtacctgcctgcacagcagtgacccttggccatgacatgaaatatacctgcgtgtcagtactgtttgtggataacagtaagaaggaaagtttgcacttggtttcagtgagaccccaggagggcgctgcggttaacacgggttatgtgactaggaggatatgagaaaccccagccagtattccattttgagtttcctggttctgaggtgttccttgcccatgtcagtggttctggatctgggagagaaagcacaggtccctactgccctaacaaagggaggactgaccgttggtgctggcccccacctctttgaatcccttgcttggagagagaactgattttttcaaagttgaagctgagtctaactctgctggacatgtccttccttcactatatcaactctaataatctccccagagattcccattacgcctatggcatgaaacaggtttttcttattgatggggattgcccttgctccccgggagctggtgaaacaggcagaatttcaagccccatcctcacccactgagacccaccaccgactccttaagctgaatgtgaattttaatgaggcccccaggtgattttgcagtaaattaaagttcggaaatagtctaatagtaccagctcatatcctggcttcccagtcctttaagatagcgctagccaatagagaatgtgtaatttaaaattttctagtagccacattgaacaagtaaagaaacaggtgaaatcaattttaatatatttaacacagcatgtgcgaaatatt

SEQ ID NO: 7838 - DNA, 2191 bp, artificial
  synthetic oligonucleotide
ctttgagccatggcaccaagaggaatgggtgtgtttatgaaatcaaatttagttcataagaatattccatcctttgattgtgctgaacatgggttggataaatcaagggtcaaatcatgtcctgtgcaaccttgtagttgcagtaaaagcttaatgtagcacaagtgtgagtcccttctcctaacagcagcttcataaagggaatctactatactcaccaaagcaaacaaaaaaacctccaagcttttaaaactcttctcttgagtttctatgctaaagctaaatgtgtttcttttacaaaaggaatctcctacggggaaatctgaagcaattgggtcacttctttgttttattccagtagttgttcttttttgccatttaaaaggcatgtcccagatttatcaattagaggtttgccttactatgtctcactgacatataaatgcacagaagtttcaagccaaacttgacatgactatgggaagagaagagaaatgcttgattttcaacttctatcttgagagcattgtgtattcttaaaatggtcctaatcacctctgtctcctatatgcaacattttattagctagtcctggattgaggactttaaaatgtttgatgtggcttgctctaaatagagagagtcatacctttcctaagctcctccagattcagttgattaaagcagcttgctttagtaattatatttcaaaataatctattttcacttatttttaacatataagaaacttaagtctgtataatacatgataatatttagccattaaaataggctttaacaacgtaacatttgaagtaatttaaaactctgatattgattaaaatagctttctcacttcatgagatgctatacagttagtcactagttcaggcgataaagcagaatttcaaattaaggcttctaagattggagatcttttagtgtttctaaaaccagacatttataagtatacctgttagtttatgctttattgcataaaatatatttccaaaacagatgtgagtataaaaatgaatccattaatcgttctccacacctacccttaatgtgtttacttccaaaaaattttggcagaaaatgtctttaaaaaccagtctgggctaaaaatttgaattgaattaactgtttggaggtaacgatgattcctaatctatattattttaaccatgcatctttggataaggaggaggatggaccatgtcattttgtggtctcccagtagaactaacatagccctgaccaacatttaacattgaatttgttatttatagtttggctttcttccctgtataaaatgtgatgaaactactatgtgtagtatttctaaattgacctttaggtcctttaataaaacatagtgaaatattcttgtaactatgaaaataattactattttgaattttcaataatttagaattataaaagacatccatttaaaaatattttgctttacaaaattatgctgaaagcgtagtattattcgacctattttccactgaacactagtggcctccgatgttaacaggtggaaaaagcagtcccgatcaaataggtatgaggaatgcattatactgtggcgccctcttgcggattcggtgtgcattgacacactaaagatgtctcactaaaaaaagcaaatgaggccgggcgcggtggctcacgcctgtaatcccagcactttgggaggctgaggtgggcggatcaccaggtcaagagatggagaccatcctggccaacaatgtgaaacccctgtctctactaaaagtacaaaaattagccgggcgtggtggtgtgcgcctgtagtcccagctactcgggaggctgaggcaggagaattgcttgaacccgggaggcagaggttgcagagagctgagattgtgccactgcactctagcctggcgacagagcgagactccatctcaaaaaaaaaaaaaaaaaaaaaaaaaggagaagaaaaaaagcagctgaacttgttttgcttaacccagcatttcccaaacttttatttatttatttattttttaagacctattcacatctcttgggaaagtaatgctctatgaaatacagctttggaattgctgggggttctgatcaccttattcttattcatgacacattatgtcagagatgccaaggagaaagtgactggtttccttggcagcgtctc

SEQ ID NO: 7839 - DNA, 7631 bp, artificial
  synthetic oligonucleotide
ctttgtgaattatgaaaaccacgtgttatatcctgttgctagtctgagtcatttggaattgtgggtaaattattatgtacgatggaatccacggatgagacctcaggtatctttttgtttttcttttcatgaatgagagagtttgcctttttttccaagtaaagatggtggtatgaaaatgtgttaatggtagatattaacataccatactgaccgtcttctgccctctcctgtcagggttcaatcctttgcattcatgttccaggaggttccacccatacgccaactctgatgatgtttgctgggttacagttaaaaagtcttagcacttctgtctcgtactgatgaggtacataaaatgctatgtgctccagtgcttggcccttcttcttataaactactttacctgcagatatgggggttggggtggcagcccttttccctgtttccacgtagaggtggtagaaaggcgtgtggaagatgcatcagggctacagtgtatagaccctgttagtccagcagtaggagggcaggtgcttgaatcacagaacaggtgcccctttgaagaagggggagagtttgcccctccccaccacactttttcactgtaatattttctgagattgaacaaaattagagaatggtgcactacaggggccagtccgccaagcctgtgtcctctctttgtgttcagtggctgagctctggctgcgggttcctgaagggctccccacatcctccactgtgtcgtggtttggattcagtcctgccccgcacccccagtctccacatgggtggccagggcatggttggttctgggtggtgaagaagacagatagaggcagcctgtacctccatggacagataactgtctgctgagacttttttcttttttatttatttattttttgagacggagtcttgctcgtcacccaggctggagtgcagtggcatgagcttggctcactgcaacccctgcctcccaggctcaagtgattctcctgctctggcctcccaagtagctgggattacaggtgtacagcaccatgcctggctaatttttgtatttttagtagagacgggatttcaccatgttggcctggctggtctcaaactcctgacctcaagtgatccgcccgcctcggcctcccaaagtgctgggattatgggtgtgcaccactgcgccaggcctgagatttttcttttgacttgaatactctcagagtttaactgcagtccatcaggagcgtgtacccagggcattgtttaatagcattgctctgtcagccaatgatacagaaatctgccttcctctccatcctcctgctccctcatccctctcacctagggtcttcatgatctctagatcgtctccacactccactagccatggggcagtctgaactgctcatgttccttttcagctgcctggccctggaacctcaaggatacgtcactatagtaccccggcctgccagctggaaagctccctcactggtggccttagctccatgctccatctgctgggtgcgccccgctgccccaggccgctgcttggccactcctcactggatcctttgccctctaccacagaccaggctagtcatcacttgcctcttctttcctagatggctttctattttgttccacaaagcttccactgcaaatgcttttctcctctggaccctctgagttggccctgccacccttacgacctcaggagtgttttccagaacactgtgatgggtgctcattcagcctagtacttgtacgctgggcctggggagttgggaaggagtcctggctgcaggggtgctcctgcatcctagggtgcccttagccacatctcccctgtacacgccctgcccctgcttgaagcagatcccccgtgtgaatgagccgccctttgtgtcttcacatgtatgaaaacaactagtgtttgatcacctctttcagctcttcccagagtcttccttggataggagagacttgcatctgtgtccctctcccactagccagggagctgctgggacttgtgctgccctggagcctttcccgttgagcgccctcttccctgctcacctagtgctctggcggccctatgttgattgcccaaactagcgtactttgagaaagagagtggaggcgctgctaataatcagtctgtagaattccccaagacactcgatactgcaccggcctgtttgcctgcctgctgcccctacacaccacaggctttgaaaccacagggccctcaggatctagcatggtgtttggcaactaacggagactcgacagatgtgactgaatgaacgcatgagtgaatgaagaggtgcgcccctctgctgcaggccagttccccctgcacatctgctctctccagccccttgaacctgcatttattccttctccctgtggtggctcttgcccctcagcctacagaggactcacacctgcccaccctaaacctgtcctgtccccactggcctctccctcaggtctcccctccacacccagtcctctgggatattgggacagctttctacctactctccccgcctcagtctgccttgtgtccacgctccaccttcctccagagaggccttttgctcctgcctaacagcccagacatcaccttctgtggctgcccgatggctccagctccccacgccctctgccacttggccaccacctgagctcctggcatcaacttagcttccttcttcctctttttaaaaaaatttacatttctggccgggcacagtaacttacgcctgtaatcctagcactttgggaggccgaggtgggcagatcacgaggcagaagtttgagaccagcctgaccaacatggcaaaaccctgtctctactaaaaatacaaaaattagccaggtgtggtggtgcacgcctataatcccagctactcaggaggccgaggcagaagaatcgcttgaacctgggaggcggaggttgtagtgagctgagatgagattgcaccactgcattccagcctgggcgacagagtgagactccgtctcaaaaaaaaaaaaaaaaattacatttatctctccctttagactttgtgctctgcaagacatgtccctgcttgttattaattgatctttaagttattaatctaataactgcttgtcactagattgaatccttccccagatgagaactgagtttgaaggcgagctgtctttgaaatggtccatgtgcccaggaactatgagtgagcgtgagaggttgctggtcccattagcatcttctttcctggctttcagcccaagaagtctatgtgcagggtgacctgctgccctgtcactggagtccaggtccagcactgtcctcctttctgacttcaggtgcattatttgagatgctaaacacaggggcccatcaagcacttctttccagtcagtggtcaacttgggaaccaaagcctacatcccccttccagcaccttcctcttcactgatgtgtatttctacttaggcatcttgctgagttattctgtcctgggtggcttctatttcatctattttggcaacagggaagatgggctacagagtgtcagaagtcactatgttactgaaatcacatagggttaccaggtgatattcttggtgactcaaaggcccgggtggttggtggagtgtcatgaacattagcagaaaatccaacagaaccatgcctgatctggagtgcctttggctaaacagagcctctcgattactgcaggagacccccgtacccctgccacgctcccccttgtgcagcaggttgcagaggtgaagaaatgctgaaccagcagagagggttagagtggtgtcccacaggggtgcacccaggctcagattcttgcccgccgcgtgaggcaggtaacagacctttcctaaaacctacaaactgcgcgacagatctgttcccagatgtggtcaggttctcactcatgtaggcgaagccacctgcaacatcatgatgatgatggaaaccacagcgacagcgcctataacctgcagtcctcttgtgtgccagtgggttctgtacacacatgatcccagttaacgctcccagcaattccacgacgtagagaatgagggaagggtcagagaagcagtgacttggttgaaatcttgctgcccagtgcgtgtagttgtggaaggatgcccccgacagggccagatcccgtctctggcagtgactcaccgcctgatctgcagcagggtcctgagcctcacggggacctcacagggggttgctgagcaggaagtgaatccattccaagtgcactgtgctcggagggtagtaggtgtgtggtcctgctttttgcattctccctccattgtgctacacagaagagagaaccaaaaaagagtacatgggccgcagcttgttatcctgtatgcaacaggcatgtgtcggacacctcctaggtgtgggaatgggggtgggggagtgcattgaagacaggcagagatcagtggctggtgtgggtgtccagtgacagggcctgaggagccaggtgaggcagagagaaggaggaagagaggggaggggagggagtgcaggggggtaaacgacagggcagatgcaagcctgttgggcctcttttctctgagaaggcagtggctcgattggctgccgagaaaggggttctttgggcatccatcagaggatggctgggtgtggaaggcccaggggcgtcctatttcctttgggactgtcttgccttatgtcttgtgatgctagtacccatgcggcaaacatgactggcccttagatgggaattttctctaacacaatcctctgtttaagcctccgagttttctattccttcaggcatgcccttgatttgttgcaaatgaaaatatgtgagtaggccaggcgcggtggctcacgcctgtaatcccagcagtttgggaggccaaggcgggcagatcacttgagatcaggagttcgagactagcctggccaacatagtgaaacctcatctctattaaaaatacaaaaattagccagacacagtggtggcgggcgcctgtaatcccagctgctcaggaggctgaggcaggagaatcgcttgaattcgggaggcggaggttgcagtgagctgagatcgtgccgctgcactccagcctgggggagagagtgagactgcattccgcctcaaaaaaaaaaaaaaaaagaaaaagaaaagaaataggtgagaaaagatgcaaacagctggtgaagagatgatagtggtgcgtttgagcagtgctgggtctgccctgggtgtgtgtcagtggtgtatttccctgcgtgtcttgcttcttgctgaggtcacatgcctgtagatggataatgggaacttgattgcaaggcgtcccttgtctgatcagaattaaatgatcctacagacaggaaaacgcatgccagatgggtcctaagggtaagagaggagctggtgccacctcccagaggcctgtgggatctgcctttgccatcacactccactcctgtcccctctgttcttcctgtggcctgcccaagggggtcatttcttctcagcccactgggtgctggttactgagcaccttgttattagagggacctggctgcccccttgcggtctcgctctcatcctccttccgtctcccccttccctccaggagggctgatcaccattggcacacacggtggaacagctcagtctttgagggagtgggggaaggacctggtgaaagatgagccagagggccaggctggggccagactgcagagggcctcgaggcccctctcagggcagggggaagaagtccctggaaggtgttaagtggccagtcacatggcctggctgaggcttaggagccagccctgtggctgctgtttacacatgggatcagagacaagggaaggctagggagctccccagaccccaccctgtttctccctcagcccagtcggtgacccctcactctggtcagccttgcccccagccaaagagctccaggtgagaaaagctgggtctcggatgtctggcctcctagtagctgctggggacagcttgttaggcgagtgggttgggtgctatgactataaaatagcaggactggatgtcccatatgccccgggaaaacctttcttgtttatattcacccctgccccacagttgatgggtttaaaagagaaaagctaattaaaggtgaggccttgcggtgatgctgagcaaggagggaggggttggtccttggggaggctccccacccccctgccggcactgcccgctcccggggggcttctggcagatcctgctccggttgatgaaaacacagcttcaagttgtaaaaagtgctgatttaacagaaggattttcagtcagcagagctatttataaaaatgcaaaaatacagagataatggagatgctggaaaggggtctgcgtggaaacatttctgacgcacagtctttaggacactgctcgtgccgagtctgcacacggcgccctcggttgatccatggtgcgcagtgtccccgtgcctgcttgtcttctgagaaactgtgggagcctccccatggtgccttttcatcccggctcagcggctcggcccccggagctgcagggcggcctcagtggcagccaaagctcatgggatggggtcccattgtccacctgacgcgagatcggtcaacgcctcaggagactttggccgctccaggagtctggatggtgaaaagctcctgaagccaacagcatctccatgtggaaacgctgtggtaggaggatggcctgataatgcagctttgtctctgctccctccagatgcccattcaccagaatctcaaggagctgctggccgtcagggcggagctgcagaagcgtgtggagggcctacagcgggaggtggccacgcgcgccgtctcatcctcatctgagcggggctcctcgccctcccactccgccacctccgtccacacctcggtctgatgggcgaggtcagcctgctgctccactgtctcccggtggctcaggaaagggacctggcgatcactgttatggctgtagcttgtgatcttgtcttttaggattaggcccagggaccatttgtgtggctaggtgacagctcccactgttggcaaccgttaccctcctgtcagcggtttcacaggggagccgtctgtcacgcccaccctgtgaagcaacttctggcattcaggcagcttgggagaaactaagtgaacggaatgcagtactgaggttcaagaaagctgtacgccatttctttccaacttaaatccttcagtaacaacaaacaccactcacttcaagatgcattgccagccccgtggcttccctcagctcttggccacaacttgaaaactgtcttgaatgaagtacttggggagaagacaggccactgccctctgttccacagttttcttcatgcacggggtcctcctgttaacaattactgttgtgtacatataaggtatttttagagaagagaaacaggcctttattttcctatgtccttttttacgtttagaatagtcacccgaggggggatcagctcaactgtactgtgggagaaattcttttccaacaaacctcatgctcgtttttctgtggtgcaatttcaagggcaac

SEQ ID NO: 7840 - DNA, 1555 bp, artificial
  synthetic oligonucleotide
cctgctgctgcttgcagagagtcaagagtctgtgtctcatccctgcgtagcacagggactggaacccttcagccccgggtctgtgggaaaactggggcatggttccaaccgaccgaccgaccgaccaggcaccagtgcaagtcaagccatcgtcctgggctacaggctccttgcctaaacaagaatgcccaccacctgcctgccccggtggctgctgggcttgaggtgggagccaaatgggcctgtggcaaatgcgggcgttgctctttggcaggtgtggccggccccacgcagagcggggcaggtgatgagtgcagtggaagctgccccaggtgcaccttcccagctgacaggtgggggccaggagacacaccctgagcctcgtgatcactgctagctgccaacccagtgggcgctggatcgtctccttcctgtgggtggccctctatgtgctccccaggcatgaccaccagtgggcacctgagtcctcaccatggcacctcaactctccccccacccctgccacatccagcctggggacagagtgtctggcaggtggcatcctctcacacgcatcagggtaagctaaagatggtcctggttacagccacgtcggtgagtgccagggaagcaggagggagaagagcggcaaggaagcgccagagcagggggcgaatgaggaagcatcaaggctgaagcaaaaggaaagtgaggaaggcaaagcagcgttaccttgacctgctgctgcatctgaaggcaagacacaaagcttagaatccctggagtaagagcgctcctgacagcaaacatgcgggctttccacactgagggcaaaggcaagggaagccaagggtccccagcatgggccttttggcagcagcagaggccgagagcacctgagggccacagtggtgggggcaggccttcctcgcagccacctcctgctgtctccccagagcttggtgttctgcaccccggtcccctctaccgccatctccatgtggcagtggctgagactcaggggaaagagtggggacaggaggcccaacccccagcttctcagtgttttcagccaccccacaaacgtctgcgggactcctcctgattctggcccgggccaggtgccagggacatgatgtacacgcagccccgccacggaatggacggtccagagactcctgatcacggagggggcaaggcgagctgggagtcgcacactcagaaaccaaccggcccaatcccgccccatgagcaccaggtgaggtcagcagggggcgctgtaggaccacaggctgggagaggctgctccaggcctgcagggcgagaggagctaggtcaggacgggggacagcagaggcccgggatggggatggaagagcacctggcgccctcgggaagtgaaaggcctctgggaagcctatggaggggaaaggatgtggttgggaccaaaccatgaagggcttccactgccaaactcaggctcagccaggaccttgagggcagcaggaagcataagggggatccaggcattttaaaacaggtcccgctggaggag

SEQ ID NO: 7841 - DNA, 15075 bp, artificial
  synthetic oligonucleotide
gtcccctccgctatgctggaggtggctgtcgtgatggcatcctctgctaatgtattcatgtcactagacttccatttttctggactctgagtaattcaacctattctttcacctcaaggcagaaggaaactgagtgttctcaggtctcctttcccttaggagtacttggccacaaggattcccagcaacttaaatatcacaagactgcggagcaacaggctgtgagaagaaacataaacaggtcgaaccccttcctaatttccccccagggacaaatggacagaagggctgactctcccagactttcaaaaagactcaaagctcaatagttcacagctccagcaattcctatctgaccatttgtgattgttggaggtcctgtcctaaaaagatgacaaaaatgtgcttctcttcctcctcaaaaaaagtgatcccatcctgtgggcaagtcttctcagatgggcatgtgaactgaaactactgtgaggctaagaaacatctggaagaaaaaacagccagtcatcttagatccttctgtcctttctcactgcatgaacctgaagtcagccacacaggccactggagttaaccaagccgaggtcatcgctttgagccacgctgggctaccgagcttcgcttacttcctctaggcacaggctgaaccccgttactttacaaaatgcacactgtgcaaaagatggtattggtgatgagtcatgggcataaaataaaattacccaacccaataccatccgtgaagatcagttcccagtaaaactaaagtggatgaaggcgtaaaagcactatagaaaaatttaggggtaaggaatttctattagcttggggtaaaaaatgactttctaaatatgatcctaaagccagaaactgaaaatggaaaagatcagatcaaaagtgaaaacttcagtactaaaagtgcaagcaacaaaagaaaaactaaattgggctttgtcaaaattaaaaacttgtgtgcttcaaaggacatcatcaagaaagtagaatgacaacccacagaataggagaacatatttgcaaaatatgtatctgataaggagctagtattgagaatatataaaggaccccttcagctcaataataaaaaggcaaatcattcaatctaaaaatgggcaaaggacatgaatagatgtttctccaaagagacatacaaatggccaataaacacatgaaaagatgctcaacactgttggtcattggggaaatgcaaaccaaaaccataatgagacaccatctcatatccactaggataactataatccaaaaaaagaaaaaggaaagaagacaaggggaagggagagagggagagaaaggaagaagtgttggtaaggatgtgaagaaattggaacccctaaacattgctagcaggcatgtaaaatggtgcagctgctatggaaaacagtttgattgctccttaagaagttaaacatggagttacaacatgactaacaattccatttctagatatatacccgaggtaactgaaaacatatgtccacataaaaatgtgcacacacatgttcatcgcagtattcataaaagctataaacaacccaaaggttcatcaactgatgaatgaatgaataaaatgtttatggaatatataagggcttcctaatctctaatgtaaaaggagtccttaaaatatatgagaaaatatgcagaaatatgcagaaatgagaaaatatgcagaccccagtaaaaaaaaaaagcgggcaaagaacacaaacaggcaattcacaaaatattttaagagtgtctaataagacattgaaaaagtgtttcacttccttttagattcaaagaaatgcatatttaaacaggatagcattttgctctgaacaaatctgcaaagataacaaaactataatgcccagtggaggtgataatttgagaaaacaggcacctgtttacttactagtggtggaaatggaggttggcacaaccttaatggaatatcattcagcagtaccactcaaagtgtcgcatctttaaaagtgtctgctttctgtacccagccatttgacttctgggaagttatctgactagggttgtgcacatttggctaagacaatgttcatcacagcactgtgcagagcagcaaaaagctgaggggaatctctgtacaaaaatagggtcctggtgaaataaattatggtatatcataatataatgtaaccactgacacggtattttagaagaccctttaatgacagagaatgatattcagtgtattattgaatgaaaaaaatggtttcaggatagcatgatcccatttttatttttttaaaaatcacaaatatttacaaatatatacttgtgcatagaaaaagtactccgagcacgcagtcagaaatattactagtgattcttcctggatcatgaaacaacaaacaagtctttttcatgtaatttgtaagaagttttaactctgcaagccccatgcaaatctatccacccctctttcccacagctggagagagagctcaaagaggcaatttcacaggtcactggcggactcttcagtttcagtatgttttgtattcccacctgccttctgagttcacaattatatgccaaagagactacagtagctttctagtagaccagaagtctccctgcacagtgtatcacatgctgcaatttgctttgagtatagatacctatgcatataagtagctgtatggactgccataactctagggactgctgccgttgctatagccacaccatagcaatagggaccgtcactgtagcaatagtgaccactgccatagcaggtctcatagctataggaacctctctagctatagcaaccaccatagctacagaggccctgtagaaaggaggcatgacctcactgagaaagttgtgaataagccctgcgatcaaaggaagcgtcagaccctcagcatctcacagacaaaagacaatgctatacgcatacatggcagccttgattcctacgtagccatacatctgggggaggcggggatgcaccacacggagctgcccttctctgacagcagcacaacctgggctcaccgtgagtgcctgacccacctggttgccaagggcatggagagtaacgtaatggtaggaagattataactgctgggggagatgttcaagtatttaaagacatctataagtgttctagactcttctaatagacatagctagggcttttagatattttagaaatgtattttcattatctaaaaaaatggccaaagtgcaaaataaaaacaacttttaaaaaaatgaataaacaaagagaagaaaatcttgcatcaaataccccatagttaccaagtcaaactgaactgaaaaatctaccaaaacatggctgcctatgctagccactggggagggcactcctcactgttccaggaagtctccaaggcccagattttatccatcccccaccacagggatgggaatgccctccctctaggtaatataatgggtatccccttccaatctgatacagacccttaaaactctccttgtcttatgtcaagctcctgagataccagcaaggtggtcatctaggacaaaagccatgttcacgccgtgttcccaggtacgtgtttggggaaggggagtctaagggagcaagtgggtctcttcacatcacagaacaccagagctggggagctattcctcacatctgaaacatcctatttctttacatgttatgaaagctgaaatgaatgtggaaataggtccaaagaagagaactctcaggtatctcttcttagaactaatcccatcacaaagaccccaccttcaagacctcacgtcacccaaaggccctaccctccaaataacatcctattgggggttagggtttcaacacatgaattttcaggagacacaaacatttagtccataacagaaagggatcatgagagggcccagatacttgaagacaatgactgtaaacacagtgaaaatggaagagaaatgttttcttcaaaaacccaagagggtaaatggatagataaaatgtggtctagccacacaatggaatattcagccataaaaaggaaggaaatgctggtgcgtgctacaacacagatgaactttgacactgtgctgaacgatgagaacacatggacacagggaggggaatatcacacaccggggcctgtcggggggtaggggggtagggggcttggggagggatagcattaggagaaacacctaatgtacgtgacaggttgatgggtgcagcaaaccaccatggcacgtgtataactatgtaacaaacctgcacgttctgcacatgtatcccagaacttaaagtatatctctctctctatatatataaaaccgggatcaacaggctacatttggagggaactaatactcaaagttacagtcaaccaactgatcatagtcagtaccgtcccctttaaccctgtgaactacaagtgagggcgttcacgcttcacacttggggacatctccagatagcctctgtatgcaacccagacacatgggtaagagaatgcctgtatgtctttagaaggagggtttttagtcttggctcagtgtttaagaactgcatgctttggcctttaaaaaaatgccctcttggtgtaaaaatgtgcccaatttgattcgaacattttcaaaataatttttttctgattaagaaaaatgaggcagtgtttcagccctgtgaacccacagtagttatgaacaagcagtgtatagctgagtgagcccagcatatgggctgctaaacgcaggaggtggtgatccaaaaaaaggaatcagtacagtgaaatgctgggtgctgcaaagcaagttccacctttagacccggaaggagaagctcaggtagtgctcctctccttctggtgttctctgcagtgcatggagggttcgcacttggagcagacacaaggctcaccgtgaagacatccatttcgtaccacccaaggctccaagtggcacccttgaaagagctgtcacgaaaactctagctttgagcagactcagaagtttgggaaaggtctgcagataacgaaggagagggtaaaacacctagcccgagcaacggagtagacactgcttaggggatccttaaggagcacagaaggaagactctccttctggggatagggagaaaggaaagcagcaaatggcctctttccccagccagcagtgcccttgcccccatttggttccttgtgttaatttatcaagagtcttctgaccaacaggccagtgagggtgatccgggagtgctaataacacccctccccgcttctcctcccctccgggttctttaccaactgagaacagatgtaaggagccagagaaagatcaaaggtaaggcatctgcttgatgaagaggctaaagtacagcagcaccctcaagagcagggcttctgtgtactagttagaggacatgacctgaggccacacagaagctacgtgttacttctctcccttttcccttctcacaaaaatcatcccagagctcatgtgggggaaagctgggcttatagagcagacacagggttcacctactatgagagtgcacacttccccagctagcgatgtggtgggccctggctctcgcactcctttgaggttccaggagaaagcagcaggtcatgccatgatcccaccagtaatgtggcccagaggatcagcaggctcaccctggcttcgccaatcaaaagtatcactctagccttcacagggaggtgtgacagagaaggcagagagcaaagctgggtgtttgctccacagtcctcatgccagcaaacctgcatggaggtgtcagggatacacaggaagcccagtctagcagaagcaaaaaagataaacaccacccgctgtggttcagaatgacatgtgctatcctgtaccagcggagtgacagaagctctaggagagcccaggggcaggagatggaagctgtgctgcagggcggagagtgggcagggagacaggaccacagatgggggcagcctcctgagaggaggggatctccagcatgggtaacttagcacttgcttgaggatgactgggaatttacatggtggaaggcaagcagtttagaccgaggaatgtcatctgcaggcactggcatatgtacctactggcctttctccatgtttgaagatcacaggaacctggcggtctagggcagaaagaacatgtcagcagactaaggggcttgaacttatctcgtaagcagtggggaaccactaaagaggcttttgttgttgttcctgcttctttaatttttttcaccaacatctaattaagaaaaatttcaaacatacaaaaaagtttaaaacttcttgcagtgaacacccaaattcccagcacgcagacctgtaattaacattttgcatcattcactttatcacgtctgccatccctcttgtcaatcgatcttatttttgtaacacatgtcaaagttacagacatcagtatccttcaacctatggttacctagcattttacatttgcttacgattccttttttaaggtaaaacttacatacagtgaaacacataaatcttccacgtaccagtggataacttttgacagatgcacacaactatgaaaccgagacccctatcaagacacagagcataaccatcatgccagaaagtgacacccagttgatcttattcacacacctaacccccgcagccacagatctcatttctatcattatagcttagttttggctgtagtggaacttcatataattgggctcaaataatacgtactcttttttcattagcctcttttactcagcatattgtttttgacatttatccatgctgtcgtatcagtaactcatcccattgcaataaacatataaatgtatcacagtttgtcgatcaattctcctattgatacctgggtgtttccaagttttgtttgtgttttctgctatcgtagatcaagcaatgagcattcttttataagtcttttgttttgttgttggaagcgggcagaacatagctctcatttctcttgaatagggaatgaaattgctgggtcgctaggtaggtctatgttcagctttagaagaaacttgacatccctaccaatgatgtatgagaactgcagtcactccacatcttcatcaacatttgatactaccttttaaattttagttattctggaggatgtgttgtggtatctcatggtggtttgatttgtatttccccaaagaataatgattttggtttttttttttaaaaaattttaggttcaggggtacatgtgcaggtttgttatacaggtaaattgtgtgtcatggggatttgttgtacagattatttcatcgcctaggtattaagcctagtattcattagttatttttcccgatcctttccctcctcccaccctccaccccttgataggccccagagtgtgttgttcccctctatgcgtctatgtgttctcatcatttagctcccacttataagtgagaacatgtggtatctggttttctgttcctgagttagtttgcttaggataatggcctccagctccatctaagttgttgcaaaggacgtgatctcattttttaaggctgtgtagtatttcctggtatatatgtaccacattttcttcatctagtcctctgttgatgggcacttaggttgattccgtgtctttgctactgtgaatagtgctgcactgaacatacacatgcatgtgtctttatgatagagcaatttgtgtttgggtatatactaaataatggcattgctggctcaaatggtaattctgttttaagttctttgagaaatcaccaaacttttttcaacgctggctgaactaatttacattcccatcagcagtgcataaatgttcccctttctccacaacctcgtcagcatttattttttgactttttgataacagccattctgactggtgtgagaaggtatctcattgtggttttgatttgcatttctctaatgattagtgatgttaagctttttttcatatgcttgttggccgcatgtatgtcttcttttgagaaaagtctgttcatgtcttttgcccgctttttaatgggatggtttgttttttgctagtaaatttgtttaagttccttatagattctggatattagacctttgttggatgcatagtttgcaaatattttctcacattctataggttgtctgtttactctgttgatagtttcttttgctgtgcagaagctctttagtttgatgaggtcccatgtgtggatttttgtttttgttgcaattgtttttggtgtctttgtcatgaagactttgccttctgacaaaggtcctatgtccagaatagtattgcctagcttgtcttcagggttttcatagatttgggttttacatttaagtctttaatccatcttgagttgatttttgcatatggcaaaaaggtaggggtccagcttcaatcttctgcatatggccagccagttatcccagcaccatttattgaataaagagtcctaaccaacccaaatgtccatcaatgatagactggattaagaaaatgtgacacacatacaccatgaaatactatgcagccataaaaaaggatgagttcatgtcctttgcagggacatggataaagttggaaaccatcattctgagcaaactatcacaaaggcagaaaaccaaacaccgcatgttctcactcataggtgggaactgaacaatgagaacacttggacacagggtggggaacatcacacactgggacctgtcgtgggattgggggaggggggagggatagcactaggagatatacctaatgtaaatgacgagttaatgggtacagcaaaccaacatggcacatgtatacatatgaaacaaacccgcacgttgtgtacatgtaccctagaacttaaagtatatatatatatatatatatatatatatatatatataaaaggagtcctttccccactgcttgttttgtcaattttgttgaagatcagatggctgcaggtctgaggcattttttgtatgttctctattctgttccactggtctatgtgtctgttcttgtaccagtaccatgctgttttggttactgtagcaggacacaatacaaaaagaaaacttcaggctgatatcattgatgaacatagatgcaaaaatcctcaacaaaataccagcaaattgaatccagcagcatatcaaaaagctaatccaacacgatcaagtagactttatccctaggatgcaagattggttcaacacacataaattattttgaacatcatgtaacttcttttgtgatgtgtctgttcaaatcctatgctcattttttaattggattgtttgtcttttcattgttacacagtattttttaaacagaggaatgacagggtcacattcatgttcttgatggttctctcttgcggctgcaaggaggacaagctggagcaaagataccagttaagcggttaaggtcaacactcttaaccgcttagctggtcatcccaagggagggtgaagatggcctgggcttgaggggagataaagagaaagaataatctagattcaaaagataccagggaagagacttctggcatgagacagtaaggagatcaacaaatcctctcctcaaaaagcaactataaacctggacaaaaagttagtcatttcaggaaagtcatttgatttcagtaaaaacagcttgagtccacggcatttttaccccaggctgctctcatttttcccttccctaagtctgtcggcagactgttcaaccggagcaaaaaccagcaatagtgtatgactgctaggtcatatggcaagtctatgttgaactttacaataaactgtcaagctctcttccaaggtggccgtaccattttgcattctcacaaacaatgaatgagcgttcttgttgctctgcatcctcatcagcaattgatattatcagctttttggattttagacattctaacaggtgcatagtggtatcttgttttcatttgtatttccctagtgagaaatgacgttgaatatcttattttcctattttatattcttctttggtgaagtctcttcatattttttacccattttaaaattggggttgagttcttattgttgacttttatgaattctttttttcttttttttttttttttgagacagagtcttgctctgtcacccaggctggagtgcagtggtgtgatctcagctcactgcaacttccacctcccaggttcaagcgattctcctgcctcagcctcccgagtagctgggactacaggcacgtgctaccatgcccagctaattttttgtatttttagtagagacagggtttcaccgtgttagccaggatggtctcgatcccctgacctcgtgatccacccgcgtcggcctccagaagtgctgggattacaggcgtgagccaccacgcccggcctatgaattctttatatcatctgaatacaagtcctttatcaggtatatgattttgcaaatattttctccaaatctgtggcttgtctttttcttttcttcatagtgttgttcatagaacaaaagtataaagtattatgtgtatgtctacacagaaacctgtatgtaatgtttaaaaatgtttatagctgggcgcaacggctcccacgtgtatcccagcatattgggaggccaaggcagaagaatcacctgagcccaggagctcgagaccaccctgggcaacatagcaagaccccatccctacaaaaattttaaaagttagtcaagtatggtggtgcgtatctatggtcccagatactcaggaggctgaggtgggaggattgcttgagctcaggaggtcaatgcttcagtgaactgtgtttgcattactgcactccaggctaggcaacagagtgagatcctatctcaaaaaaaagttttatttatagcagttttattcatattcactccagactggaagcaaccaagatgtccttcagcaggtgaatggataaacaaagtggtacatccatacaatgggatattgttcaatgctaaaaagaacaaactaccaagctatgaaaaaacatgaaaaaactttaaatgcatattgctaagtgaaagaagctagtctgaaaagcctatatactgtatggctccaattctatggcatcctggataaggtaaaaccacagagaagtaaacaaatcagtggttgcgctaatagaaactagactagggttgagggaagggggagtggctgactatcaagggcatgtacagaagtccttgcatggtgaagaaactgttctgtatggtacttgggtggtggacatgtgactctatgcatttgccaaaacccacagaactatatgttacaaagagtgaactttaatgcctacaagcagaagaacaaaacatcaaccaggtgggtgggggactcccaggatggaatgcagactatgacaaatgaatctaactccattataaatgggtggcattactgtactgaatggatgaggaaggtaaaggaaccgacctaagtaactttgaaaaacagtattttgactgggaactgtaaggtaaagacaaaagaaactgaacataaacactggactctagttggtaaagttgtttctcctgggggtatgagttagcaattctgatgctctatacgtgtatacctgaattgagtaagacagtaaatgaatgacgggtagtaggagctaggtgtctcactgtcagagaggaaagttataggtaagtgagaaaggaagatcgaaataatccttctggcactggattacagttggagatataagtatgaagtcatgtttaggttatatacctgctgacggttaaaagaaattattttggatatgtgtatatatatggtgttatgtactgaacatttgtatcccgtctctcaaggtcatatgttgaagtcctaacctccaatgtgatgatattaggaggtggggtctttgggagttaattaggtaatgaaggtcgacccctcatgataggattagaacccttataagaagagacaccagagctttctccccactctgtcctctccaccaatcagggacacaacaagaagatagccatctccaaaagaggatgcagatcctcactggatactgtatctatccatgacttggtcttggacttcccagcctctagaactgtgagaaacaaatgtctgttgcttaattatcacccagtctgtggtaatttgttatagcagcctgaagtaagacacatgggttagtatatatacatatatttcctatttcctatctctgtctgcttagacagtctagaagtagcgatataccactaagcaatgaatactcagatcttggtttctaataccattctctttcccagtgaaagagaatgacatacagaattggacaccaaggaaataaatccaagaggcagcagtgttcagaaagaagcagtgaatgagactcatgaatgagaccagtcaatgagtgagaaagggcccaggaggaaagaatgttaaggagaaggtgatcatcaaagtcaaatgctacagaggccacacaggacagagggctgtgaccatcaggaagccattgggaaccacagtgggagtaggggcttgcatactctagggtatacatggcaggggggccatgaggagttgaaacattggcctcaaatttctcaaagtgctatggaaagcagtctgttggcagaaatgggggacaatcagagtcctgcccaggctgggcaggaaggaaataagggcggaggaggagggcttataggccatcaccttcttagagaaaggcaataggacctgttgacaaaagactgtcatcgttacctataggcaaaatgtggggcttctacagggtaagaggtcttcctgagaaaaaaaatccataacaaataatgtattgtttcaaaaatacactccaaaatgtagctgaatctatgtgcctaagacccaagcctgaaaaatgcattaattaggattcttttcatgctgaagatcataatttattgaaatgtgatgttttacctttgctcacagcattagcatatttttgtgtaaaggacagtgtctgagaattccatggtgtgcttatcataaccatgtttcagtttcacacttgtccttttttccacgaccccctttatcttcttttcctgacacctataatggcagagggtataacttaagctaacaattgattattctttacaagagaagttcaaatatgagcctaattaaagaattcctgaacacttcttccttgctaaaacatgcacttttaataaggaaaagcccctgacatgccattcagactttcattcatgtgtgtgcttacacgtgtgcctactgctctcatttcaccatctggaaataccacttatcacccagaagtaattggctaatttgctggatttgccctttaaatgttccatgttatcctgacacctgtaggtttcatttagaggctttttgtgctttttagtagagatgactctgtctggaaaggtgtttcgaaggataaatttaaccatggtatcctttaatcggaagagaacactattcccatacgaaaggcacaccgttcttgcaagaaaagagcaaacactagtaaccacagccaagactgtggggagtgtatcagagttacaaccagatacacccataacttgtcacacttataaccgggtgtaacagcaatttgccattgcaacaggttacaaccagggttaccacaatttaccatcataacatgttgctatcacaacagattataatcacaagttacaatcacgacaggttacaaccacaagttacaatcactagcctgccttgccacatcaacaaatctggctaatattccctccagacttgatgtatactatgataaaaggttgaaatctttggtagtttggggaattaacactatctggccttggggaggacatgactattctggggtaacatgagggaacttctttgtggcgatggaacagttctgcctgctaattatggtaatggttactcaaatctacacacataacattttatagacctacccatactcgctcacacacgcatatctgaatgcatgcaaaatctgatgaaatctgaacaaggtctgtagctgacttaacagtactgtactaatgttgacttcctggttttgacaatgactatggttatataaggagaagctaggtgaagtatacacatgaactctcttgaactatttttacaacttcttgtgagaaccatttcaaaataaaaaggtattttaaaagatatctgacttgctatgggtctcttaaaaaaaatgctcgtcatgatgactttgctcctcccatcccaagagtgagtgagtctcttgaggttgagagggctgctttcagagtccactggcccccagttattatcattggtggtgttgccttggcaaataggcttcagccagcatgaaacgttaacctatcagcactgctgcttaaggaacatcaggggaaatgtggggcttttccaagatggcttataaatcccccccttgaactgcatggctcacatcattccaaatgaaccccaactggcaggctgggatgtctgggaactaccactcatttcccagaggctcaattaatctggttgctgcataatcacctttttcaccagaataagggttgtgttggcacaaatcaatgctcctacctttacccttgtcaggtttgtattctccaccccctactatgtcttcaagatccttgtctgaaaaacctggagaaaataaaacatacatttcaacaacaagaaaaaaaaatcagcaacaagaaacttgtgctaatgttgcccaaaattcagaaaatgattcccagttccacttaagaatgcccttcatgaaattctaagaggtccccccagaccccctcccactggtgtacatgtcccgcataatgtcccaccactctgagtgtgagtggaaccatggataggatggctatatcactcccgtgattaggttagattacatgccaaaggtgaagggat

SEQ ID NO: 7842 - DNA, 653 bp, artificial
  synthetic oligonucleotide
aaacacaaagacaacagaactaaatatagagagaccttgaatttgaataggaaaacttaatactactaaaaaaaaaaaagaaggaaagaaaagaaaaaaaaaaggaaaaaaatgttgattttcctaagactctcacctagtcaatgcaagtgcaatcggaatcccaacggactttttttaaaaacttgactctaaagtatatgtgaataaaatgcatgggaagataaatttcaaaacaagagtaattttttaaaggcctgcccctatcagattctaaaatttctgcaatttattaatcaaagcaacatttaaatacattttttaaattgcagtacacatatgacccagctcatcattaactgtttacattcaatgcttgaccccaatatcaattcaaaggtcattggggtccattatttggatatcactaatgtagacatttcctgctaccaactctaaataagcagttctatgccacattgctaccattgcctgctctctatcaagctaatttaaggactttcttatatacattctcccaaataacaactctacagcaaggagtgaggtcaccccttccttccaattccactcatcagagaggtcactggtatcaatgatttgggacctgctacttcaataatcaacctaaa

SEQ ID NO: 7843 - DNA, 1775 bp, artificial
  synthetic oligonucleotide
gagagctcccttaccccttctgtaatgtgacgacacaggggaaaaacagctatctatctaaaaccgggaattcacaccaattcttgccatttgaatccaacaatcagagttgattcttgcatgccactcttccatatttacacttccctccccacccgtgccaagaaacctgattcttataatcctcaacatattttttttttgctcaatttccccatatggccactaatctccttgtcacaaaggccatctcagctattgccctattgcacctgccagctgtacctgctgaagcaccctgtcctggcactgccaaaggctggctgtgccagttgagtttgcctgaacccgacaccaccctgctccataaccttggcctgctccctctgtctagcccaggcaaagggagtggcaaggagaaatttgtgccttttctgagcaatgagcagagcactgtgtgtgtggccatagtgtcaggaaagggtcgcaagtgacatgagatgaggagagagccctgggctttgtttccacgctaccccccgcccccgggagagtgaggagtttggactgggtcagtgcttctcagactgtggctcacagacacccagaggctgctgctgactacaggggaggcttgggcagatcctggagaagtaaggaatctggatcagtaccgggccctgtggggactggagctatgaagactgtgaactggagtgagcagatcaaattcgcatttgatttagcggctctagtgatcaagtgagtgttcaatggggaggtgggagcagacagaggagggaaaagactggaggcagagactcgttaggaggaggctgttgcgggaggccagggagggggaatgggtgtaggaactatggcaggggcagaagaggaaacaagccacaggatggccaaggtcagggaacacctctccatgctgtggcacttagagaccagctgtctgaagtcaggttggagaggcctcaggcagagactgagagagactgggagagagctgctgggggagggggaaggcagagggagctgaagggaggggttttttgatgtggaggtgacagtgggatctcaaagagaagcctctgcaccgggtagataaaggtccagaattcagaagaggcactgtacgggggaaaactcatcaaggtcagaagcagggagctctccaagtggcagagaatgtggggcccctggaggagacctgggtattagacagttgaggtggtgggagtgtggggcagaaaaaggagggccagggcaggaggcaaagggaagagggggaaggaaggaggggagacaagcaagagcatgtcctgaacagcggctcaccctggcagagtaggatccacggctggtcctggccagtgacctgctgggattgctggattgactgttggctgtaagctccagcaaatgctggaatcacctgggagatcatccagcatctccaacctcccctacctgaaggaagcctgagctggtcacctgctcatccatatgggccctattcaaccctatggatgtctctaacagtctttaaacaccctctcctccaggcaggcagccatgatttgcaggaagctctgaggattcagatgttcctgaagggtcgcatgtaattcccatctcaaactttcctttctaccgttgacaatttcaacaggattacccactttcgtatcactggaccccagtggtgcgtgtcccaattttcctaaagggagcaccctacagtggcccagaatcagttactg

SEQ ID NO: 7844 - DNA, 1710 bp, artificial
  synthetic oligonucleotide
gttggtacttcattcttcttcttctctttttttgagacagggcctccctctgttgcctaagctggagtgcagtggcatgatcatagctcattgcagcctcaaactcttgggctacagtgatcctcccacctcagcctccggagtagctgggactacaggcacataccacgatgcccagctaattttatttatttattatttttaaaaatgtttttgtaaggccaggctcagtgactcacacctataatcctagcactttggcaggtcaaggcgggtggatcacctgaggtcaggagttcgagtccagcctggctaacatggtgaaacgccatctctactaaaaatacaaagaaaattagccgggcgtggtggcacgtgcctgtaatcccagctactcaagaggctgaggcaggagaagtgcttgaacctgggaggcagaggttgcggtgagccgagatcgtgccactgtactccagcctgggcaacaacagcaaaactccatctcaaaaaaataaaaatgtttttgtagagatggggtcttactaggttgctcagggtgatctcaagctcctggactcgagtgatcctcctgtcttggcctcccaaagctctgggtttcaagcagccactgcacctgggcttcattcctcttatggctgaataatgttccactgtatggctagactaccttttgcttattcattcacctgttgatagacatttccattgtttccaccttttggttattgtgaataatgctgaatgaaatttgtgtgcagttcctgttttgatatacaactcctgagtccctgttttcagttcttttgggtatatactctggaatggaattgctgggtcatatggtaattctatgttcaaccttttgaggaatcgaactgttttccatagcagctgcgccattttacattcccaccggcagtgtctgagggttcctatgttcccgtatcctccccatcatttggtatttggatgtcaactcgtgaaggataggttaaggaggatgagtctgaatgagaccaggagaagcagcagccagggagagagaaggaaaatctggaagccaaggagacagcaagtggtgagcagtatgagctgctagcaggatgactggtcagagggctaggtctagggcagggggcaggggcagggcctggccaggcacttgaggcttgggggaagatgagggcatggcaaggtgtggacatgtagccagctgggagtgggtagagttggtgtgtagcagtagctggggtggtgaggtggggagggcacatgtgtgggaacctggggttcaagatggggcttttggcagggctggaggacttgctggcaggagaagggcaataccctcctctctggctggggctggagcatatgccaaaggccagaggtccagctgagctgacagctttttgaaagagagactgcccccaggaaacctggtaaaagcagcactgggagaggcagacccagggcttggggaaactcaggaatgctggagaggtgccagcaccctcctcactgtggaaatgaggggttggttcatagcagcgccctgtgcgcagggcctctgaaaaccccagggctcagctcagtgcctggctaattgtgaggactcaataaatgcatttggatgaaggaatgaaagcctgtgaggaacatgtgaggtcatacatgagatcctgtgag

SEQ ID NO: 7845 - DNA, 6195 bp, artificial
  synthetic oligonucleotide
tcacaggaggctaagcggtgtgcggcaggggccctgagaaggcctggaagccagtcaagactccctatccctgaagatctgcacttataaggactccatatttacaaaggttcctaggtgccatattgaaagatcttgtttcattgtagggtcttcacagcaagttcccttaatacttatatataagattttattttatttttttggctttgttgttgctgttgttgttttgttttgcttgtttgtttttggatacagggtctcactccaggttggagtgcagtggcacgatctcggctcactgcaacctctgcctcccgggttcaagcaattctcgtgcttcagcctccccacctcggcctcccaaagtgctgagattacaggcatgagccacctcgtccagcctatttctttgttttgagacaaggtctcgctatattgaccaggctggtctggaactccttgcctcaagtgatcctcccgcttcagcctcccaaactgctgggattacagatgtaagccactgcatctggttcatatatatatatatatttgagatgagatctcaccttgttgcccaggctggtctcgagctcctgggctcaaccagtcttcccacttcagcctctcagcctctcaagtagctgggactacaagtgggtgccactacacctggcttcccttaatatattttgttcaacaatcccattccacccctaccccccaaatccactctgtctacacttccattgatttttttagatgggggtctcactatgttgcccaggctggtctcaaactcctagcctcaggtgatcctcctgccttggcctcccaaagtgctgggtttacaggcgtgattcctttttttttttttttttttttcccctgagacagagtctcactctgtcacccaagctggagttcagtggtacgatcttggctcactgcaacctgtgcatcctgggttcaagcaattctctgcctcagcctcctgagtagccgggattacaggtgcccatcaccacgcccagctaatttttgtatttttagtagagatggggtttcgccatgttggccaggctggtctcgaactcctgacctcaggtgatccacccaccttggcctccccaagtgctgagattacaggcgtgagccaccacatttggcctacaggcatgattctttttttttttctttttcttttttttgagacggagtctcacactgtcacccaggctggagtgcagtggcgccatctctgctcactgcaacctcagcctctcaggttcaagcgattctcccccctgagcctcctgagtagctgggattacaggcaggtgccaccacaccaggctaatttttgtatttttagtagagatgggatttcaccttgttggccaggctggtcttgaactcctgacctcaggtgatctgcccaccatggcctcccaaagtgctgggattacaggcgtgagccaccgcacccggccaggcatgattcttaaaaggaggctgggttggcccaaggtactcaaatgaagactttgggaactgtgggagggtgggtggagtgtgtaggcagtgggccaggggaccagggtttcatttttgttgaacgatgaggattccccttagtcttttaggggccttgaactgacaggaactgaaaacctctttaaatagcatttgccacacttcatcccatttcttatttaatgttttcgtaacttctctaggcagccaagcagcttaagggattctggtttgaggttctcctgtgtggatgggctttgcctgtttccaggtagggcccgggcagaggcctagagtatccttcattccctcaagcccttgcacgctgacctgggtgctgctgctggaggtatcctcaagctaacgggcattgagctttgctgcagagaaggcagcctgccttgggctccctgagtctagggtgtgcccaggcatccctggctttctgtcaccttttctttctttttttcaccttccaaactagtctttaggcctctcctggttggcctttgactggtgacaagcagaccgtcttcactcagtctccctcaccaccaagactggcagtggtctgggtggatgaggcgggtggaatcacctttgatagaggacactgaggctcggagccctcaggtgacatgtgaaaaggcataccaggaaatcagtgacagagcccaaagcctctatcttgtcccttccttccagccttactccccactccatctcatctcccttctgttactgattagtagacatgcaatacatatacatgaaagtttctgctaaggcaggagcccactgggccacaggccttgctcaggcatgtcgccgcacacgggcaggtgttaaggagaaaatctggctgtgaggagcctccattggtaggtgggtggctggggggatggggaggagcagggagccatctttggatctctgtcactcagtgatgtcatagtcatgttctgtgagttcatgttctgacgatgaccagtttgtagttcagcttcaggccaagtgcttcagctccatataagaggtagctttcttgagagcagagatcgaaatatttcctatgcaaaggatggaaatacttcctgcgcgtaagcgcaatcctttcatcattcgaagtatgtggggagaaatagatggtcaatgggcagggttggggcagtggggcagggaagcatggatcttgagggtggcaactgggggccagtttgggttgggagatgctcttatttctctggtttgcccttgaagctgctgcctctgggaatgccctgggtgtgcccatacgtgagtacgtgtatacatgtgctgcttgtgagttggcatgggcttgtgtgacccttgtcatccatccaagggcccaccaccctggttcccccaccaaggtgcctgccaactgtgccgtgtcacttgccactgtgggcagttgctgggcagtagctggaccccaacttgaatctctggtctagaaaggcctggcaaccttgagaggctagggtgctctggcagaggcgaggtattggtcagatcacttgtggaaaccctgctcccctctaggccttgtggagacaggggaagagggagtggcttgggcaggtcaggccctgggaaactgcttgtagaaggagcagggaggggctgtctgtctggagaaaaggcctggcctgccatgaactatctgaagggtgagggattaccctgtgtggagatgttgaccttaaggctcagaggtggctggagatggaaggaactgccatgaaggaagatggtaagctccctatgagtggaggtatgcaagcagaaggcaggcaaccactaagctggttctaacaggacagagggatggatgaggtggccttaagatctctgaactcctgagtctgtagtggggacctgggttagtgacacaatacctgcctgctcttgtcaaaagcagcactatctctgccttttttttttttttttcggagtcttgctctgttgcccaggctggagtgcagtagcatgatcttggctcactgcaacctccacctcccaggttaaagcgattctcctgcctcagcctcctacaggcatgcatcaccacacctggctaatttttttgtatttttagtagagacggggcttcatcagattggccaggctggtcttgaactcctgatctcgtgatccgcctgcctcagcctcccaaagtactggaattacaggcatgagccaccgcgcttggcctctatctttgccttttgatctggattggaaccttgatgatgggagccaacagcaccagcttcaggggctcaggcttggctgggaggctcagaggagttggtaagagggggcgtaggggtgaagaagcaggtgccctgtgaagccagatcctttgcacacctcaaactcagccacggtttctggaagcagcatttggaaaattcatgttctggtggggcttatttctgaatataggactcataaatagctggatctcttggcctttcaaagaaaagaaaaaccaaactcatgacatctcttcctttgcattattttctccaactgtcaatctttaaactgctctttttctcaccctttcattctttccaggcaagggccctcagatactttctttccaaatagggctgatacttgcatttgaagtggagtatttcttccttgcgtgggactgtcctatgcaatgtaggatatttagtatccccggccgttccttcctcttattgaattccagcaacacctgccagtcatccaggcaccggccccacgaatttcagaacatcccttacagaagtgacactgcggctcctatactttgaaaaacattgcctgaatccccaaagaagtgactagctcaaggccataccaccagccaatggcaaagtggagatcaagtcaaatcccattcattcattcattcactcattcattcccgaagctttaattctttgctctagggtgtgtcaggagagcagagggaatgagggccttgaaccgagacagtgaagagggtaagaagaaaagtgttattctttgcccacaaaactacaatttctcacaaattctctgctcttgccaaattttgttttcctcttttagcccgtcggttccgcaatttcgggcgcaaataaagaccttctggcatttagtggaaagagcctagttgagcacgatccgcagaagcggaatcaggtggctttcggataggcagcgagatccgaggactaaatcccgaggtcttggcgagcaagcagctgccctccgccaggcatcgaggagcgagctgccgccgcgtttctgtcgcggcgccgcggccgaaccgggtagaggtggtctaccatcggcccttcgtggtgggcccaggggtgtttccccgggcaggggagctgactgcaggccaggggcgccaaggccgcggtgcggtgggagcagagggcagcgcagcggggctggacttcatcttcccacgccagaggccgaggcctccgggaatcgcagggccacctcttcaaagcccttggcgatcccagttctgttccccgagggggctggcgaggtgggcggggcgggcaggcgagactaggtctttccctgtttggcctccgtagccggcgccggcgggtcgttctgtttgaatgaatgatcccagcagccgcgcccaatgggcgtccacgcctgcttaatatgcatgaggcccgcagccaatggccaggcgaggaggctgttttaaacggcagagcccgctggccaatcaggcggctctcgtggaggcagctagcgcgaggctggggagcgctgagccgcgcgtcgtgccctgcgctgcccagactagcgaacaatacaggtacgtctcgcaccgcccgctcccgccgccgccgccgccgccgccgccgccgccgccgccgccgccgccgccgccgcagcgcccgcacaactttccggcccgcgccgccgtgagcgcgccctgccgccgcctccccctgcctctactccccattcccttcccgccccctccgccttccctcctgctaggcggccgggaaggaagaagcaattcaggtgtttcaacttttccaacgcgttccccgagctccccgctttcgggggtcggccccctcggcggacgcccgcccgtggcggccccaggggccgcagccgggaacccagggcccccgaggccagatgtttgggcagctgcggctgcggcggctgggcgagcagaggggcggctgcgggctgtgggcgctgggcggcggcagcgggaagggggccgggagttccccggcccgcgacggactccgctggggaacgggcggccggtgcccgccgggggctgcgcggctggtgcccgccgggggccgccgcacgggcaaacttcgctcccgggcttggcccggcgccgcgcgggcccgcaggctacgccgctggctctgcgttaacatggccgtcgcggagcgcccggtggcccgggggggcgcgggccggccgcccccctctcgcctcccgcccgcccggcgccgccgccgccgctaacatggctggcgcggcgctggcctccggcgagggcaggggaggcgggcggagcggtcggcggggcgcccggcgggctccggcctcggccccggcgcccgcggcccggggcgg

SEQ ID NO: 7846 - DNA, 353 bp, artificial
  synthetic oligonucleotide
caaggtccattccatttttcagagtcccagctcttcctattggtgcccttatcttaacctaagagactcaagggctgaacatttaattggtgctgcaattctgcaaccattgcaatgagacgttgagcttggcctacagtcacatctgcccttgcttgaggaggtaggaaatgctctaagatgccgtggaagccttctgctgctctacatgtgttcttttttcccccacataccatcattcccaatctagttgtgttctcaactgcatgttcatagttttaaagtcttttttcccctatgatttctagagccttaatatggatctaagtgctactgcaatctttacaatcact

SEQ ID NO: 7847 - DNA, 826 bp, artificial
  synthetic oligonucleotide
tgtgacagatctctcttcacttccctcttattcaccacactctagccataccagcttccttggtttccttctaacacgctggacacactgttgcctcatgtgatctcatttgctgatcgctctggctcgaacactctttgtctaatcatatgccagtctttgctcaaatgtcaccttcttagaaagtccttctttgacccactcgatttaaaactgtgctcctgctccctttccagtttctccgtagcacttatcatctggcatactctatcttttacttacttaccgtttgtcttctccaaccagagcaccagctctgtaagaagagaggcttttgcttgttctgttctgtgatgtatccttagttctagaatagcttggcacagagtaggcactcaataaatatttgttggataaacacatgaataaaaaaaaaagtgtcatttcaaacacaatcaactgggtaccacatcctgtctcaaaccaaaactcttttttcatagtgcacttctatgccgacttttttgaaatctgatgcctcactccacactccctcatcccagcatggttaaggtctccatgtccaagcccatatcttccctgtgcttttctctgtataagcttcatcaatatgtatgtatatgagtcattttttcccaatcaaaactgccaacaatcttgtctgcacttgctgtctcctttttcttacttcccacacattcctcacctcactctgatctgacttccttttctatcatgtcactaaaacagtttctgttaaggttccaaggctctctgtgtcaccaaatcccttggtcacttttga

SEQ ID NO: 7848 - DNA, 951 bp, artificial
  synthetic oligonucleotide
tcagggggtctgctgctgctgaacagatcgtggccatggattaaaaacctctgcttttctcggacacgtttttaatcctgagaaaatgtgaacatagaaaccatgttaggaataattggcacacagaatgactgcatttggaggagcaacaacatttctactggagaacagggcgggactacaatgggtggggggtgggaggatagaggatttcaaatgcttcaaaggaagtcttttcccagtggtccgttccatcttttgcggagagtgccagaggcacacatctcagagagtcgtgactgtgtcattatgttctcgtcagcacagatgattcagtcaatgtataagcaagcacagttgcattttatacgactttcaaatcagttcatttccaagtcagaaaaatcttccagcaagtctgatcaccacacacacagggcagcaaccagttctaggggcttcacctgttaagatgatttggcttgtttgcaagtcattttcagagaacaagagagacaatcttcccactactctataattagagtgctgggggcaggctggggggaagacagcatgaacatggagctctcattcttattcaggagcgtctctaattcacacggccctggggactgcttcagatgtaatattctctccacaaaggatggaaatcttttctcttaaaacgtctcatcgctgcaactttgctgtaaggcttcatcggataagtgtataaaaaatccaaaactcacctgttttcttatttcatccaactcttttgtgtttatataattaagcacaccctgcttgattggtgtgtgtgtgggatgtgtgtgtttgtgtgtgtaaatcttaaaggactcagaagttggagtgttcgtgcgcttatcacagctccacggactctatgtaatcatttagcttcttgaggcttttgctgccctgtgattt

SEQ ID NO: 7849 - DNA, 8566 bp, artificial
  synthetic oligonucleotide
ctagttacaagcaaggcattattatagtgctggagggttaaacagagagcttagaacgtttgataaaaggtaaccttccatcattgccgatgtaaatcagggaactgaagatgcaggcagtaccctcatgtgctcagaaggattacccattcctgagcagaaactgctcacttgccctctcattcctctgggaatattccaggtttcctctatttggattggatatcttaatagctttaaaatctcaaataaagggtttatgtccactccagttatttagggcttcctaacaagccttttagaaagagacttaattaaaaatccagtggaatcttaaaccatgcacattacactctatccaataaaggactcccccttaactcttccaaagcaattgaacttactgcacgagacttgttttgcctttgcaaacagggaccgattttctccctcatatgtatccttataactgattcaatatctgattttcttttttctttttttttttgagacggggtcttgctttgtcgcccaggctggagtgcagtggcgggatctcggctcactataagctccacctcccgggttcacgccattctcctgcttcagcctccctagtagctgggactacaggcgcccgccaccacgcccggctaatttttttgtcaatatctgattttcttagtactggggccatgttcagaatctttattaagacgagttcataaaaataagaaaattattttaaccggatacataattctgtccccctagatcattaaaatattcaccttttccacttgtctagtattgaaaaaccaagtcccaccaggtcacagtcaagtagtgtccaagcaggggtaggggccagggagtcagctcacccttgctctcctgcctgctcctcaatcccagggatgttcaggccacatccgcggggaattcccgggggctctagccacctcatctcagaagtgcagtacactggagtgtagcaatgcctgcaaggtttgcaagctctccttacaggtttgtttggggcagggggagtctagtgtcttaagtcactagaaggtgtgtttcgttttttccttcaaatgtattttgtttacttatttgaattcaaaatcgccccttcccacaagtgaagggatccaaactctcggggaaccagcaagaacagcctgatgtgcatcctacaaaatactccactgcgcggacgggcttttgactgacagcctctttacagggcgcacagctgtgtggggaggacagcggagccccttcactgtctgcacttacggaaaaaaatgcgagcgcgcgcggccgggagttccagccagcgaggggcagtgagataatgaatgtgaaaagcctccaggcgggagattgtaattcgcgccggattcagttcacagacgcgaaagccgcaggattggggtgggggcttcattttcaaacaaggagacacatttccagtttaggctttatagctagagacagtgtgtgcaatcttggttttcaacagtgtctgtttttttcgttaaaggtatctgaatgttgaagttcgtcgcgtaacaggcccctactacctaccccgccttgtccgtccccccacccaccccggggcaagagggctgctgtgtccagacgatggcgctcccggccagtgcaacccctctcccctactgtggcaagaagactagtctggaacaagtttcaaggtgtttactgagattttgaaaggcttctcgacaggagccgtaacttttagtagccggcagaaatccattcccgtgaccaaggttattgagggaacgagtgtccgaatcacgcccctttagttttgcccgaatattcgaattttccgtggtccccgcggagcgagatcctgggcgcaccgcaggggaactgtgacgcacggggacagagatccgcggtgtggagggcgaggggggaggcctgagagggatggggtcgaaacgagaaccccagaagggcatgggaaaggagaaagaccgagaggaatcctgactgaggcagggatcgccggtcagccagaggcttcttggtttagccgcgtgacacctccgcacctttcccgcggctgcggcgcagctccttcagccttcctgactgccccgtgccgctcagtagagaatgccgagcatcccgagagggagaggcgtcagagcctctcgtcctgagtttccttgagaagcggggacccaagagaagagctttattgcctgttttactttttcccaaagcgtcccttggcttccgccgcctggctgccggcagctggaaaggagacgagctcccgctcccgttcgcccccaaactgaggaccgagtggccaccaatgccttccctaggtcccagggtgcagacccgctccccacttccagagtcgggcgcagggtacatctctttatggagagtgcaagacctggaccggactgagcggctactcgcagctgccgctaagggagccaagaggctcctggcgagaaagggagcggggttaagttccctagggattagggacccagattgggggtgggagctcccagcagtagtcccctgttccccgcgggacacagaaggctctagacaggcaagggcatggggcgtgggatggacctcacaaggatacttgcagaggcaagcatctagcgttcaaggggccaccggctatcccctataccctgctgggggctgtggactggcttggtctagcactggatcctatgaaagactctgtgctccggctctgcaatctacatctctttgccaggtgtttgcactggaggagagagggagaagaacttgctagaaacgaatgcacaggggctggtggagggggtgtggggtggactccgagctagtcatgatgcttgcaaggtacctgggagattgagaggcagggcaggctggctagagaggaagtacatacaaggcagtcggaagcaagatgacacctcaatgtggatttgtccaataagagggggtagccaaggggggggtattcagggaggtctgattggtcggggggagggatttggggtggggctagccgcctcttgaggctttaaaagctcatcggagaggggcgggatgctgtcatttgctctctgactctcagagagggaggcacgctttcctggagctcctggtgacagaacaggtgtttgctgtctggacctggctgctgatcctgagcctgctgggagatcttaacgatccccaggagcaacatggggcccaccctagcggttcccaccccctatggctgtattggctgtaagctaccccagccagaatacccaccggctctaatcatctttatgttctgcgcgatggttatcaccatcgttgtagacctaatcggcaactccatggtcattttggctgtgacgaagaacaagaagctccggaattctggtaagccaccccttcttctccctacccagtgtgcagagacttgcaacccctagggcgttagtttttgagctccccgaatagagaatctatggacagtgccctcatattgaacatccctgctcccaaattccccgcaagcctgggggtggtagtattctgtcccggccctctaaacgtggaggttctcaaggccgagagagcacagagaattagctttgggcatccaagtacaaagcgttcccgtggtgcgcggcagcccgaggatccctgtcccgtcggggcctgatgcggagggagccggcacccgagcgggagagtcaggcgattcgcccggggacagcaagccgagccggacgccgcaagggcggccgcgctgaggcagcgcggaccgaactgacgcggagggagcagcggggctgcgacctgctctgtgaaagttaagttcgcggcggccgcggcggcccttaccagagcgcaacgcagtggcctctccctagccgggccaagagcccgctcgccgcggccctggggctccaggacggctcccgggcagatcccgggcggcggagcacagacccccgcgcccgagaatcgagcagggaggtctgagcccgccggagccgagctccgtccgcccgtcccagggcgaacggcagagagaggcaagcggcgggtcgggcacagcaggcggtggcagcgacggcggcggcagcggagatcccaaggtccgtaagcggggaactggggggtcgcagggcgggccggccaagaggcttgggagctgggcgttgctgggggtggagggatagaaggcagcaaaaccgagtagggattggcgggagggcgacgggagagctcagaggcggcgatgggggactcagagaggctgcaaagggctggggtctgggagccgcaggcgggacttcccccgctgctagccactgccgagcgggaggaggccgggggccgggggccggcggcgagcagggcaggagggaagcgtgggaggatgccgggcgctgcgacctgtgctgggggtgggggcggcagacactgcagagcagctagtccggcttacaggttgggcgggagagggctctggaagggaggggaaggggcaaaggcgcccaaactccgagttcaggccgggggagggaggggcggcgcctggaatttccaccgccagattctcgatcggctggggctaggagtggggaccgaagggggtctgagagggtggggagaccagctggattctcccgggcagggcgtgggggagaggtggcggccggggtctgggggattactttgcttgggcaaggagtcacgaacactgaacaagtttaaaaacgcactgactggcacacagtcattaaaagttttcttacaaagtctggtgggtgtctccgatttctccttcgtctcctggaatcgtggggccatacactaggtcttcaccttcacccccgcggtgcggtcccgaggtgcaaacccacggaatcctgggggcgacctgcgaagcccattttattccctttagatttcttttctttctttttctccttctccttccttccttctataattcaaataaaggcttttatggttgttgtggttttgtttttaaggctttgccccttctcttttcggctgtatttccctgaattcattactctgccggaaaaccatagaaagaacctcttcggtagaaagtgctgaggccgagtgctgacagcgctggaggaaggaggaagaaggagccatacctttgcccttttcaaaagcgctcattttctcctagtccaagatgaagtgcaatattttgccaaaccaatgctaattagcaacgaggtgtctccaaagaaagagggctctgcgcctgcacctggcctcttccttctcttttttgtgaaaggttttacaaaaaagttcccacctcagccctacaagaccggagtgggggtgacccttcttctctatcctgtttaacctgaaggctccagtaaagttcagtgcccggcgctgggagctctgtgcagggcgctgaatgtgccagtgcgcggctctgcgcgtggacgtggacgcggcatgtaactgaaacaggcacttctgctaatccttgcaggattttttctcctcccccccacccccgcccacctcgcgccacccttcccgcccgccctctcactacttctttggtctcagactaaattttacagggcttccctgcttcccctcagttttcactcttaggttacctcggaacggtaagtatttgacttggcaaggttttaggttactgcttgatcccatcggaaaagactgtttaagaagatggcctctaatgccttttctcagaatcttctctctagtaatgtgtttattataaatgcaatgctaggctataggagggagatggctaatttatctttttctaattatttaattatttttaatttttttagtttgaggcttcctgacatccctccagtgtctctccttgccccccactctccagcctccttcctaaaaacaagtccctctagctcacctctactcccctcctccttctccctccccctcacctccagtgaaggaaacgtttgcattttgtttttctctaagatggtggcagcatgaccctgtctcattgtgaaggctcctggcagggattttgtgctcactgctgtctgtcttatgttcgcttctttctcagagcatttctttaaaagaattctggaattataaaaggtcataatccagctggccttcccctgcaccttaaatgtgtagatttctgtacttaaaccacttattcttctctgtctttcccctttctccctccctcgatatgtttttcaggcaacatcttcgtggtcagtctctctgtggccgatatgctggtggccatctacccataccctttgatgctgcatgccatgtccattgggggctgggatctgagccagttacagtgccagatggtcgggttcatcacagggctgagtgtggtcggctccatcttcaacatcgtggcaatcgctatcaaccgttactgctacatctgccacagcctccagtacgaacggatcttcagtgtgcgcaatacctgcatctacctggtcatcacctggatcatgaccgtcctggctgtcctgcccaacatgtacattggcaccatcgagtacgatcctcgcacctacacctgcatcttcaactatctgaacaaccctgtcttcactgttaccatcgtctgcatccacttcgtcctccctctcctcatcgtgggtttctgctacgtgaggatctggaccaaagtgctggcggcccgtgaccctgcagggcagaatcctgacaaccaacttgctgaggttcgcaattttctaaccatgtttgtgatcttcctcctctttgcagtgtgctggtgccctatcaacgtgctcactgtcttggtggctgtcagtccgaaggagatggcaggcaagatccccaactggctttatcttgcagcctacttcatagcctacttcaacagctgcctcaacgctgtgatctacgggctcctcaatgagaatttccgaagagaatactggaccatcttccatgctatgcggcaccctatcatattcttctctggcctcatcagtgatattcgtgagatgcaggaggcccgtaccctggcccgcgcccgtgcccatgctcgcgaccaagctcgtgaacaagaccgtgcccatgcctgtcctgctgtggaggaaaccccgatgaatgtccggaatgttccattacctggtgatgctgcagctggccaccccgaccgtgcctctggccaccctaagccccattccagatcctcctctgcctatcgcaaatctgcctctacccaccacaagtctgtctttagccactccaaggctgcctctggtcacctcaagcctgtctctggccactccaagcctgcctctggtcaccccaagtctgccactgtctaccctaagcctgcctctgtccatttcaaggctgactctgtccatttcaagggtgactctgtccatttcaagcctgactctgttcatttcaagcctgcttccagcaaccccaagcccatcactggccaccatgtctctgctggcagccactccaagtctgccttcagtgctgccaccagccaccctaaacccaccactggccacatcaagccagctaccagccatgctgagcccaccactgctgactatcccaagcctgccactaccagccaccctaagcccactgctgctgacaaccctgagctctctgcctcccattgccccgagatccctgccattgcccaccctgtgtctgacgacagtgacctccctgagtcggcctctagccctgccgctgggcccaccaagcctgctgccagccagctggagtctgacaccatcgctgaccttcctgaccctactgtagtcactaccagtaccaatgattaccatgatgtcgtggttattgatgttgaagatgatcctgatgaaatggctgtgtgaaaaatgctctcgtaggtggccaggcagtggtcccctttctagtttgttttgcatatgtaatccaaagtgagatgccttactgcatctagacacagacactgacacatagagatggtgtaagctacatccacctttcaggcgtactcatcctttacttaatgtactgtattaaagtgtgtgcgtgggtgtgtgtgtgcttgctattttagagaccttaatttccctcaagtttgacatctgttgttccaaacctccctttccaactatggtcgaccttcagtcctcagtgatccttgaaattttagactttgatttttttcccactcctctgtccctcctcccctttcctcatttcctctgccttgttcctgctttcttctcccattccccgagggggttgggagaggggtatgtgcgcaatgctaaaggtgtgttgtggtgaacgcttccgttaatgtgactgcacagctttatgttcttcaatgtgtaactctatattgtacttttaatagcagtcagaaaagcagttgtgatcaagtacaagtactggaaagtttctttcctaaatttcagcaacaacatatgaccca

SEQ ID NO: 7850 - DNA, 1338 bp, artificial
  synthetic oligonucleotide
tacaaaacccaatttaggcttctttaatctaaaatccttgaaagccccactggtgccttcttgaacatgtcatttggtgaatgttggacgtgagcaagtgtgtcagtctgtgtcaagagattacctccctccttttcctaatacagtaaaactcaatgattgttgtggttaattcttgctcatgcaggaagagtcactactcctttccacaagtcactcctcctttcccttagggactgggggagtgcatccaaactgagtataccttgttgctccttgcacagggctccttgcagagctgatattcagaaactgagtgagcatagatctttgcctttaagtcctaccaggaagttcactgaatcaaaccaaacccaaccaaagcaaagcaccaaaccaaacaagaataacaaacaacaaacataactctgtgtagttcaaagtagtggggttgatattgctggatcactgggccattctgaggtccactgagatgtgcctaggatgaggatttcctttttcttgtcttctctccctccctctactaccttgtgctatcagacattcaaaggcctaggggggcaggtcacctgaggttgggagttcgagaccagcctgaccaacatggagaaaccctgtttctactaaaaaaatacaaaatttaaggctgggcgtggtggctcaagcctgtaatcccagcactttgggaggccaaggcgagtgaatcacgaggtcaggaggtcaagaccatcctggctaacacggtgaaaccccgtctctactaaaaatacaaaaaaattagtcaagcgtggtggcgggcgcctgtagtcccagatactcgggaggctgaggcaggagaatggcgtgaatctgggagacggagcttgcagtgagctgagattgcgccactgcactccagcctggggaacagagactccatctccaaaaaaaaaaaaaaaaaaaaaaaattagccaggtgtggtggcgcatgcctgtaatcccagctactcaggaggccgaggcaggagaattgcttgaacctgggaggcggaggttgcggtgagccgagatggtgccattgcactccagcctgggcaacaagagtgaaactccatctcaagtaaataaataaataaaaataaaaaataaaactgtacggtatcactgtcaaaaatagatgtagattaatggaacaaaataaaaaatctagaaacaggccccagtatataaaaatttatcatgcatgaaaggtgttgtttctgacctggaaaaataattatttatcccataaaaggtactgagataattggatagctatttggtgtaaaaagttattaa

SEQ ID NO: 7851 - DNA, 1497 bp, artificial
  synthetic oligonucleotide
ggactaactgaagcttcaggccccagagaatagggccagccccagaaacagttaggaaggtggaacgcggtaccaggaaaacagcaagccatcagtactggggagtcagacctcaagtggtagccatactgccaagtagccatggcccagccacaagaaattgaggaaccagcaagcctcaggacacattgatcagattttctttaatagtcatgtttgcagctaagatctgtaaaaagagttggtggggagaggaaaaaaatagattaggatttgatattattatctgaaacatctgccttgagttttagaggatgtcaaaaccaaaactaattgccaggtagatctagagggctgtttaatattttagttggtagatttaattaaagaggttaggaaaatcaaagtataattcattttggactagtcaaatggaatgcatctgattaatttctcagcaggtagacgggcctcagccatcatgttagctttgaaggaaggactcaggccatgggggaaggcctgacaagagcagggcatggcttctgtcttaggaaccgggctgcatttcaagacaagcccatggccctggacacgagattcagttgtaatgactgggacatgaagggagtcttgctctccactggtagcggacctgagtcttgggtataaggtaggaggaagcaaggaggacttggtgtcacagtcttgttgccgctggctcctgcctcaggacacaggggttctgttgcctggtgtgtgcccaggtgggcccagctcttgctgaggctgccagttaggcacctacccctgttgttagtttcctagggctgctgtaacaaaatatcagaaactttgtggcttaaaacaacagaactttactccttcaccattctagaagtttgaaatctgaaatcaagatgttggcagggccacattccctctgaaggctctaggggataatccttcctcgcctcttccagcttctggtgactccaagcattcttttcttgtggccacgtcactccaatctctgcctccatctttacatggccttttctccactgtctgtgtcttctcctcttccgtctcttatgaggacactctaaatccaggatgatctccacatttcaagatcctttgtttaattatatctgcaaagaccgcttttccgaataagattgcaatcacaggttccaggtgaacatatcttttggagggacactacttgagccacttcaccctgaattttgagtttcctattcgttccacatcgctctgtgtggagactacttgtattggcactgttggtgtggctgcccagctcctttcagagtgttcagaagcctgatggatatccagtgctactgctcagtgggccaaaatgtggacaggtcaaggcccagacattgaaggcatagttctgacactctcatcatgctacagctggggtgtttgccataattgctactaatcatagtgaaagcttttaaaaat

SEQ ID NO: 7852 - DNA, 3186 bp, artificial
  synthetic oligonucleotide
cccaagttcttacattaggtggttcttactcacctaaaggtctagatgaggcccagatagagattactattatttttattaaatattttacagtttgttttttagagacggagtcttgctatgctgcccaagctgctctggaactactggcctcacgcaatcctcctgcctcagcttcccaaagtgttgagattacaggcgtgagccagcacagtcagccctagagggggattattcagtttgaactaaaacctggacttcctgctgcccagtccattgccctttccaccactctaagctgctggtttagtcatgatttcagatgtggtctttgtatccatgtggtgcagaaaatagctgtgtggtcagcggccctttccaggcgctgaccatgttaagggctgtcctcttattagcagccagtggcaacttaattttgtcaagcctgactccagacttacccaccctttcgtttttacctctctcgggttgcgcaggcccgggaggcccatctgttcttactatttgagtccctgttgtctcattggcggctttctgagcagctgcaaaatatgtttttaacttttaagtggaagttgggggtcactggcatcgagtctggaacagtcattctcagcaagagctctttgaactctgacattctctagttttacggactcgggtgagtgttttaactcctcccagctgccaagggcttgacttcctaccactgcgggcagtaattaatgaggcatttatttgctcaagtagtggcgaaataatgcgcactgcttttttgtgttgtcgtcggcggaatacgctcagttgcctagcaccacagccctctggctggtagtccctcttcgcggctcatatgctcgggtctccttgcggcccccagctcagcgaccgagacgcagacgaggaccagtgttcacgcgagttcagggggcggcgtagccgccgcccgcccaggaggaccatgttgcgcggcaagtcccggctcaacgtggagtggctgggctactcgccaggcctgctcctcgagcacaggcccctcctggcagggcgcacgccgcggagccaccgccggtaagtcatgtgagcgcccgcccccgcgccggcaacagccctgcgtcgctgcggcgcgccgcgccgcgccgcgcctgcgtactgtggcccgccgcccggcgcgaacgggcacttccggcgcgaacgggcacttccggcgcgaaccgctacttccggtgcgaaccgcctcggccgttccctcgcggagcttactgagcgcggccgccgagcccagctccgccgccgagcgcctgtgccggcacggctacaccatggagcgcccggataaggcggcgctgaacgcactgcagcctcctgagttcaggtagccctgagcggggcctggaccgcgaggcggactggccccagcctggagcagggcttgagggaaggccctagctgaatgggtgggcgtgaggtctggaccccggggacctggcctcagggaagggggcggggaaagcaggttggagcctgagacgtctaaactcccggccccgaactttcgctcgggaacaagggatccggggtcatggggaataggtcagtgggccttcagctcatgctcctatcctagcactttctctcgctgtgtctatattgcagtctctttcattaccgcagggtcagccttctgaggacaggaatgcagtctccttcatctccgtgttccctagggggcctgcatagtcggggcttaataaatgtttgctgtatgaatgaaggagtagaagggaatagtcccctggtgtgagattgcttcacttggggaatcagtaagatagaggctggtgactgagttgaaggaatgtatgagagagcaggtggttctggcccaccccagtaggcaagggagtggtgagggagttagctatcattcgttaagacctactgtatgccaggctcagtgcacgtgctttacatacattgtcagaattcttaatttctctaactgcttgatttcccaattttgaagaggatgcagttgagggtaagtgacttgaaactgagggtgagtgattacagaattaggcgacaaagttagtatgtaattgaagctaacgtttgaccaagctcactgactccaaagcccacgatctttggagctctgtgatgccttctctttccgacagggtcattgtgagttttttttttttttttttaacttttattttaggttcatgagtacatgcgcaggtttgttatataggtaaactgcatgtcacgggggcttggcgtacaggtaattttgtcacccaggtaataagcatagtacccgataggcgttttttctgattctctccctcctcccagcctccaccctcaagtagaccgcactgtctgttgttcctctcctagtgtccatctgttcttgttgtttagttcccacttatgagaacgtgcagtatttggttttcttttcctgtcttaatttgcttagaataatggcttccagctccagtcatgttgctgcaaaggacatgatctcattcttttttatggctgcatagtgttccatggtgtatatgtaccgcattttctttatccagcctcaatgtgggtttttttttaattattcatttatgagaataccaacatatttttattagatacacttacagcatagtccttctagactgattctggtttcctaatggaatttgcagtgaaatcttgactgtgggagaaagaattcctgttgtcttacttgctacaaaagggaatgtggtaggctctgtctgctcaatgttggctgcagaagtttgtatgaagtgggaaaactaggtggtgttataaatggaggcagattaaggttcatcctgaactttttcctttgtgtgaggacaactttaattccagcctttctcattcctcacttctaacaaatctctgctcagtaacacccaaagatacataggataaatcaattgaatagcatcagttgctttgtcttggataagccactgattttacccaaggtggcttgcatcagcaaaaccaacagctcttgtggctggaatccagggagaaaatgtcctataaacagtagaggaagtttgctagttttcaaaagtttgtatgtacactttgacttaatgcttagtcccatattag

SEQ ID NO: 7853 - DNA, 555 bp, artificial
  synthetic oligonucleotide
agcaggtaatttaaatgtgatttatacagaaaggaaaagaaagagaacaaaaaaagaaaaaagaaaacaaatgaagaaaattaccccttgctcacgtctttaacaagttattctgggtgtggagttagatgggagaaagctgccatatttctttcggtgcccaaacattcttgtttacagcagcattgaaaactggcatctttgtgccccgagttgtataaatggtgcagggaaggcggattttggctcaatctgaagaaacactgattctctgagatgcccggtggtggtaccagctggcttgggtggcattgagctccctaatgcatgggtgtgattctctgacagagaaggttgcttggtggtgttgggatggggaggataccctaaaggactctttatttatttagcaatgcatgggtcctggcatattgaaggaataggaaggagcccagccagcctgaatggtgggagactaggggagggtaaagttgggtagtaaggtgtggcaggatggtggagtttcctgagtagaaacaatatcctgaattaagt

SEQ ID NO: 7854 - DNA, 607 bp, artificial
  synthetic oligonucleotide
atggtccactcagatatgacagcaacaaacacccaaaggggctttaggagagctctaggtgggagagagatgtagcaggggcctagaactcaaatactggagggggaagtgatgaggcaaggatggaatgcacttcaagattcttacctcctccgaagcctaaaatgctgctgcacttcagctttgatactgtctagaggtttgaagtgcactggactgtcactccttgctatagaccaggaattctcaaatattcaaatcccgtgtcttagcaatcactgtcaagggactgagctcttaacatgatggaaaccaaactctctctcctatttttttttcaacgaacaacactgatgtgtttacagacactttgtcagcatagttatgattttttgtgagtttcaagagcaagatcaattgctgaaaagttattggacataaatgtaattgctacagaacatcaaagtaatttgttgataggcaagggaaccagaattgggagaaatgtgggatgttcgtgcttagtcctagtgagctgaaggtcacagatggaaattgggggtgggtgtaagcagggtggttgggaaacaacacgtgacacttgcag

SEQ ID NO: 7855 - DNA, 2779 bp, artificial
  synthetic oligonucleotide
cagttatcatgtccagatccacatcactgcaacagctttcttctcttacagtttttatcctgaggcgtatcaagggccccccgtgaaccagctgccattgatagatacctcaaactctgaggcaatttcttcttccagcattcctcagtttcccataacttcagactcaaccataagcaccctggagaccccacaggattacatccggctttggcaagagttgtctgattcactcggtcctgttgtccaagtgaacacttggtcttgcgatgagcagggcaccctgcacggccaacccacctaccatcaggtatgggacagccccctccttttccttccagcgcaggtcaagagggattctgggccccttccacataaggcacacaccccaagtgcatgctgtgtgtgagagccagacttcaaagctcagtacatttgacggcagttagtcacatgatggtagcactcattgctgagtaaaaatattctctacagggttcctcaaaaaagtgagctggcctagtgaaccttagacgcaatctgactgaaacttctctcaaaactatgttacatgggcaaagtgagccatgccatgtttttaatctgagctcatcgtctggtcccaagcctcctttcagacttatggatctttagttctgctacaaaatctaagacctagtgtaggtatgtttccttgtactaaaaataaacttagggcccctctgttgaatgtgcttggtatccatctatggggtaccccgtatttggaagggcaggcctaccttgtggattatctgcagtggccatgtttccaggatggaagctggtccagatggcagttacgtagcaggttttgctccccgcaggccccccacacacaatttcactaatgaatggaacttacaaaaggtgttttcactctagctttaaaaatcttattatagcctaaccttttttttttcaaacaacaaaaccaaaccaaaataaccagaacaaacagtaagctaaggcagaaaggagtttaaatacttgaggcaagcaaatgtatgattattttcacatataccccttgactaactgtgccaccagtactgctagaaacttggtcacttagagggactgctcacacggagagatcagagtgggcaataggtcctatggttcctatggttccattaccaagccagactttgttgagaacatctttcacgcctatttttgaggcactttccctcctagagggggtcctgagagaccaagccagcacaaggctgagcacgttgcccagggaagtgggaaaggtcagattctgaaaggttgctcagctgggagaaagcagggcaggaccaagtcggagctttcctgtccacaaaacctcaggggctccctgctatcctcaggatgaaacccgagctcctcttcttagcttcccagccctcactgcctgccctggcttatccctactgccttctggcacctttctgcctgcaggtccccagacacctccagctgtctgtccagagcccagccctgctccttttgctccctgtgtcttctccgcccccttgggttccagtccttgaaaccttgcatcactttgcaacataacccaaggaatccctcctccttaaccagaaaacaccccctcagcccatactttgtaacaccatctttgtatctattccttctccctcctccacaccccagtgtgggttggtacgtctcctgtcactttgttaaagtgggccaagtagctgcaaatcagtcagcatggaaatgactgagcccaagacccaaggctagtggccttggccggccatggctggcagagaagctggacaagagagggccagacacagacccaggagccttaagacaactttgagaaagcccaggtctgcttctgctgctctttaagctaagatgctgctgggagagagaagaggagaggaaccttatcttctgtagctcctccgtctcccatcaccttgcaggctcatgttccaaagaagtatttctcagcagcttgtgtatttgaactaaaggattcctcctaccaccaaaaaatgggcccacagactctagcaaacattccaccttgtttcactttttcctggcaggtgcaagtttctgaggtaggagtcgagggacctcctgatccacaggctttccaaggccctgctgcataccagccagaccagatgagatctgcggagcagaccagattgatgcctgcagagcaacgtgactcaaataagccgtgctaacagtactttcatgaccagtgatgaggggaaatggggggagggggcaggccaatgaggtctgcatggccaggggaccttcaaggtgcgtaaagtcccttggggtagggtttagtgggtagagacttatttgtttcctgataggttatgtttgtaattgtttgttaagcacagcctgtttcttggaagttatgctgtagaggcagcctgtgatccgtagtatgctagggtgtgacagcagccagccacagctggatctgatgtcttgtctgccccgcccagctttgcatatccatgttctaccacaggaaggtggcctgccaagagtctgctcaaagttttcaacataaagaataaagaaaaaaaaatgccaaagtgcttttcaatctagtaaatctagagggttgttttgtcttagccacaagaattccgaggtcttgaccctgatgatcaacctgcctcccctccatagtcttgttggagaagcccagagagaatgggactccaactaaggg

SEQ ID NO: 7856 - DNA, 1729 bp, artificial
  synthetic oligonucleotide
atggatatatgtaatctattatgtaaatttttctccatttttttaaaaaaccactgcagtttcctttgataagcatatttttctctcttcccttattaagactatatgcattcttctcaaacccagatacaacagctccatttttcttcaagcaaaaaatccttgccatgaggcatactatatccacaccctcaccacataaagctcaggtatccataatgcaagcagaattttgagatcatattccatcttggttctgacaaacattgagggccaactgtctcacaaggcaggccatctgttgacaaattcacatgttgatagttttgagggagattgttgcagggttcaaaagagaaagccccttgatgtggcgtttccacaaatagatgtcagatctgctgttttacctttaattttcttttctttcttttctctctttctctctttctttctctctttctttctttcttccttccttcctccctccccttcccttctccttctttccttcctccttcccttcccttctccttccttccttccttcctccctccctcccttccttcctccctccctccctctctccctccctctctccctctctccctctctttctctctttctctctttctttctttctggctttgtaacccaggctggagtgcagtggcgcaatctcagctcacttcaatctccgcctctctggttcaagcgattcccctgtctcagcctccagagtagctgggactacaggcatgcaccgcagcatgcctaactaatttttgtatttgtagtagagatggggtttcaccattttttggtcaagccagtcccaaactcctgacctgaggtgatccgcccgcctcagcctcccaaagtgttgggattataggcatgagccaccgcgaccagcctaaattattgatttatatcctacctgtttgccaaaaggattaggtggcatattataaatgcacaataggacactggaaacataaatagaaagctgtataccacatcgcaggacagaagcatatgtgcttaacagctgggcttccagggtgcctgtgcttgactggcaatagtgacgctgaacttcctggcagcctaggcaaaaaggagggctcaatggattccacagttcacgtgtcttgcatccagttagtcatcaaaccagagcttctgcttggggaggggagcagtggggtgattgctcccagatgtggacagctcagcaagggctctagaatgtgtgtatgagtgggcgtgtgtattgtggggagggacagagggagcagtgtgctgtgaccatggtttaagtactggctggatagctccttagcaggagaaaggctttctgacaatagctcacattaggggcaactcttgtagttagcgtctcagtgtcgggcatctaaattcatgtcttggcactctactgccatgggctttaatgcaaagagagaagagaggcctggttccagaagattccaggtatcttgcctctttgtctggtgaagatgaacacagcgggtcacctgggtttgggccttctgattatgcctgggaatatgaagaatgcagcattgttgtgcatggaggatgagaccctgtagaagatgtgtccactgaaggttgctataggctagtcccagcagggcagtgacttttgagatggttgatgctgtgttaagctttgttttcagggaacatgcttgtcattgga

SEQ ID NO: 7857 - DNA, 823 bp, artificial
  synthetic oligonucleotide
aagccccaatataagaaagtggtaagagctgagctgctctggatgaagaacagtagagtctgccttgaagcccaggcagcccccacacacctccctgaaacttccacgtgaacatgggaaactgaggctccaagcaggtgaagcaacctgcctaagatgtcccagtggcagggttctgagtcactcacagatgtgctgattttgggctaggttcctgccatctcctgctgcagcttgcaagggaggtgggagctgggggcagacagagctgcgaccctgagccgctgggaaatggagcagagtgctcagctgactgaacagctggaagaagctagtggttggaaggcactgttggaggcagatgatcaggctggctgggggcaggcagagaagacagacagacacaagggcagatggacaggtaggcaggcagcagcctgagttggacacctgctccgtgggtggctggatgccctctaggtttcagcaaaagcttggatgcaattaactttatttgtttggtccccagtggaggctctgtgctcacgatcccccttagggaaaaagatgatacatttcctttggagatacttagcttgaaaggagggagagtttttgtcttattcttttctgttaataaaatagctcttattttaataaagatccaaaccctccagcagacagttcatgggaaagaaatacagaagatcaataaacatatgaaaaattgctcaggattattcataattaaagtaatataaattaaagcaacaatgagatggatatcatttttcacccattaagccttttaaatagttgcata

SEQ ID NO: 7858 - DNA, 1109 bp, artificial
  synthetic oligonucleotide
aaaagctgaaactcaatattccagttcttttgtcacaggctggcttcctggcagctggtggaaggtgggaagaggaaggtgggcatgtgaggaggggtacatgagggtgcatggaggggactctggtgtacccaggagcagcctgaaatcctggcttcttggaaaggagcccaaagctcactgccccaagggtcttgccttgtttcccttccctaaccccaacccttcttggaggccaagtccaggggacctggcagagaaggtatggattttcccctcaggccagccctaccccaggtacctcttctctcagatttctccctggcttgacctcagatcaggtggactggttgagattgtgccaaggtctggaggcaagtacaccagggctgtgagctggtggggttgaatccccagacacatagctctgagcatgctccgtgcaaggcagggctcctcagggagcttgggaggggctggcttctggatctgggcaggcaagcagcttctacagccaggcagcccagcacccagccctcgcctgccaacagcctggggtgtacagtgcccacagacaggccagcttctccattgggcaggtgacaccctggggcagcgtcttgagtttgccttagccatgagcatgagctcttcttggcctctgccagcttctcctgttggcctcaggcagggtggggcagctctctgaccccgaggctgcagctaagttgtcaggggctcaagggccccgctggcctgaggggcaggaatggcaggagatctctgttagctccagatgccgatgagcccccagtggtttgtctctgactggaggttgtgcagaaggaccaacggatgctgactggccaggagagcccctgcctctgaagccatctgattggtgaggaaagcggctgaccttgggctgatacctttctgtgaccacaggccagttacctccatgggggtacagaactggagtccgtgaaaagtgcgtgggccctagaacctggcttgacatgggtcttcatatgtgtcatctgccgagggagctgaggaaagtggctgtgttgggaaactttgtcccctgttaaagcagccaaagaaat

SEQ ID NO: 7859 - DNA, 1030 bp, artificial
  synthetic oligonucleotide
ttcaaatgctcaggttgcgttttctcatgctaggacaagccccagggagtcccagtggttctcctttcctgttctacattttctgaagacttggagcactttttgtgggctccaagaaaagcttacactaagttctccacaccaggtgttcaaataacagtcattacttaaagttagataactggggaaaaggtcagagctacaggtttggaggaaaactgttgggccttctgggaggggttagaatcactgtaagctccagagtttagggcttgaaagatggacctgaggccagagtgaaaagaaacagtgtgtgtgtgtgtgtgtgtgtgtgtgtgtgtgtgtgttgagagagagagacagagggataaacgaagtgagatagagagacacagaaactaagagacacagagagcaagccagagagagagaaagacaaccatggtaattagaaaagacagaggcacagagacatggagatctagggagacacaggcagagaccctgaaagcctaggagccagagagagatgctgcccatgagaaaggctgagaggcacagtcagaagcatggatgtgtggagctggtgggctggcttgctcagcttctgataaatgacttcttccttccagtgaaaaaggatatacgagctctggatttggaagttacgtggggtgggggggaggggagccaaaataccaagggaagacaagtgaaaaataagcttgtcagctggttaagaaatttactggtaaagtttttatatccacacattttcttctttttgagcccagtctgtgcaagcaagaaagtaggtgcagaggcttctcaccctcagaaaggaggtcaacataactaatggctttttcagcaccctgttgagagtttttcctcaacctgcccatggtctagccccagtcaaggcagctgggggttccacgtagatcccatcaccagcccttaactccattcattgtgtatttcaccccagcctgtgtcctcagggccacagatgtggtaaccatgggtg

SEQ ID NO: 7860 - DNA, 690 bp, artificial
  synthetic oligonucleotide
agaataaacctacctaagctccccaaattccaattggaaatatatgttaagtgcagattgatttggagaaaattgacatttatttggtaatcaggtttcccatatgggaataaactctcttcatttgtttaaatcttcctaaatgacacacgataaaattttctagtttttgtcattttgtgaaaattgaagtggctaataaggcagggatgtagcaacgcaaggtgggtccactagtccaaagtcgctcactgggcagggagctagccagggaataacaaaccacaaggatctctcttcctctcctcatgtggcaacagcccctctcttctggtctggcccctttggctagtgagtgttcactagccatttgtacatgctttatctttatttcagaaactccctttggggaaaggcttaatgttctatatctgcactgtccaatatggtagtcactattagacaatgatgatctgggatgttgatttctaggtaagcctgggatttgggaggtggtattataattctaattattcacgtgaatactttggccaccaaagtcacagcatcaggaggttgttagctgtccttagctccaatatccaaacacactaatgccatttatggaaaggccctttttgatcttttttgctggtaataacctctggctatctgagtgctcctggggca

SEQ ID NO: 7861 - DNA, 1556 bp, artificial
  synthetic oligonucleotide
actgttcctcaggctccttaacatatctaccaccaaacccatcacccttttccccttgttctttcctgcttctctctctctctctctctctctctttctctctcataatggcaccactatactcttggtatcccattctaaaatcctcttgagtatctctgactagctcactctcatctttcccattaagtctgttttgttgattcagcctccctgcagcactcacattcaggtttgcctcggcttttctctccctactctccaactttggtccatcagtacctctggcttcttcaatgatctgattgccccaaggctctatgatctctccgatctaacttccaagttcatctcttgagcccagctgtcatcataacacaaatctgctcaaaaaccatccatgtctcctcctcttacccacacaacaaaatcccaatggacgttcaaaaccttgctcaagggctaactcttatttccaccaactccctcaaacatatcctctgctttagaaaattaggactctactattcttcaaatataccttgtgttttctacccacggatcatacttgaagcattctccttttatctacatttgtcaaacaaaatcctactcctccttcaagacctcagaccagggttgactgtttcataagttttcactgaacagagctcatcactagttgatctttgcactgtctcccagcaacccaatgcctcccatattttatagcaattgtttggtcctgtgtctctttccacctttggattttgagctccagaaaggcaagatcatgtcttagttctctctgtattcccaggccctgatgcatagtaaatgctcaggaaaattcactgaatggatgcctgcatgcagcctttctgtcagaattatgtatttcctcttttggattcttgtatctaatataagcatttgtgaaaacgcttatctccccaagttgaccacaagccaggtgagggtgtggtcaatgtcatctgtctcttgctacctctgcacatattgaactctcaagcagtgtgtattgaataaaaggagtgtggttcaagttggctaattgtatgaaagttcatcattttttttgaacactgaaggtacttttggagaaaatctataaaatcagctaaagccctacgtcaccatggggctatgggtgttatagagtgagggaaggagggagggagggagggagagattctgtcagtgtgtgaaccagtgagtgagcatataagaaggatgagaacaaataaatgaaggagtgaatgaatgtgtgacagagtaagttaactaatttaatgaccaagcaaatgtgtgattgtgtgaataagcaaatgaataaatgaacagattatttctccttggtatttgggggccttacttaggtttttgcattgcttgatcccttggtaggggtctcatgcatcatttggaagggtctctgcctcctcagattttaaattgcagattttaaattacatatatattttgaaaaattgccacaaaagcagcgctacttgaaaactcgattaattactaat

SEQ ID NO: 7862 - DNA, 749 bp, artificial
  synthetic oligonucleotide
gtgcagtgttggctgcatgtcattcattaattttattttttagatattatgcacttaattatgattttaattttttcctttcaaaataactatttatgtgagcttctaaaaatttaccgatgtagggattttatgtatttgtagatttattacagtgtgattacaaaatctggtttgcactatttctgtgtttcaaaatccgtttaaatatgactgcttacaaatttgcatgtctacattgcccaagagccacactgccttttttcctccctatatctttagtgaggaactactttcctagttctaaaattgttccttatattttctgtgagtttcttgcatgcaaagtgtttgagcatcattctaaaggctttatggcaaaaatggctgttcaaatatagcctttttgtctcctctttggttctcattattgtttctgagttcctttagagttagaagtgtcacaggatgccagggccacacttcccagcatacctttagactctcttattttgaaaggtgaataatccaaggtgtccaggcttgctccaagcctggccagggtattagcatttctaaggtccagtcccactccactattaagtccttgtgtgacaggagacaagtatctcctgttttctgtgcctcagaatcctcatctttccatggtagaggaggggaatgttttgagtctggtggtccctaggaaccgtctcgttctgataaggggggctagagtgataggcaag

SEQ ID NO: 7863 - DNA, 4083 bp, artificial
  synthetic oligonucleotide
ttctaattccataaaaagtgtttttaaaaatcaaaatgccccacttgctaatatctggatcttattttatttaaaagcaaactcttgaaaaacaaacagaaatcatttatgacacaataggagagatttgaacactgagtggacagttgagacatgaataaattattctttaatttttggtgtaattatggtattttcttatgtttgtgaaatattaatgactagaaatacatactaaaacaattacatataaaatgatatgatgtctgagatatgcttcaagacaatctaagttggaattggagggtgggtggtgtaaaagaaaataagagtggccatgagttcacaaacaatgggggtgcactgttccccctacctttatatgtctttaaaaaattataattaaaagtctttttaaaagccatcgtcccatattaatctgtgatactggaaggcaggagagtggtttcctttggggaggaaagtgtacggggacaggcattttggagatgcatgcgtgtgtgtgtgtgtgtgtgtgtgtgtgtgtgtgtctgtgtgtgtgtgtgtgtgtgtgtgtgtgtgtgtgtgtgtgtgtgtggtgagggggttgcaatgctgtatttcctgatctaggtgttggttacacgggcctgtttacttgtgaaaagccactgagctgttcactcatgatgtctatgcttttctactggcacgtcacacttccaaaaggatttttttaagccataaggcaatttgtttcctaaaataaggggtaaacagggcaagagacgttggcatgacccctgtattgcggaccaagggactgccaacttaagaagcaaaatgcattttttctgcagtatttcaagctgttagaattgcttaagtggcatacagatgtgccaaatccacaccatttctcatgtctgaagtggctacttcccattgtgggcgagggaagaactgggcttggaaaatacagtttctactttcaaatgccatatctagaagatgtcctctttccctgaggccaaactcccagccatctcaaaagataagggccagtgactatgggaagagaggaggaaaaatggagccctgagaccctgtaaaatgagtgatgtggctggaaacgtggcacaatcagaactggcagtcagtggtagactgagcactgccagacaggaccacctaaacgcctgaagcagcccctcccagatgtctgaaatccatggacgagatcctccccgctgccccaagtttaaaagtgcagaggcaaacaaataaacctgaaagcactgagaccaccaaagccctcctgcccctagactaggtctgcaataaaaatgatatcagagggtcataaggtggctttaatcctaaaattggcttttgccagttaaaaaaaaaaaacacaacaataaacaaacaaaacaaaacctcatcttgaggtccttggggttaaagagctgctgacaatgcatacctttccccagccagccattaagctcactttcggggctagacagaataaaaacttgaaaaacactcacacattggaatagtggcattttccagggcagtttttcagacattcacatgtctctagacataatggtccagcatgaagttgaatctctgcactaccccctcccaaacagtcgactgttggtggtgtgagaagtgggggggggaggggcgcataagaaaagatgttggatttttttctaaatcagatcttttttttcattctacagatggacaaactgaggcccagatagaggaaggactgtgccccaagtcacacaactaatttgaggctaagcctggaccagggagaggtcttctggttcagtgtggcccagtacaccccattgtcacctcctcagctctttcctgacaccacaggttgctatgcttgaagggcagtttccatttccccagtcccttttccctgctgttttcctctctgaccaccccttcttatttcccccaccccagagccatcttttgccctagccagtcaccacgtcagctttctcaactagtccacatcccattttgagggatgtggatgactggaaattgctagcacgcatagaaagacatttatcaagctcctgctgaggctagccccactccagggcaccagtgagccagcaagcagctacacatccccttctctgatgagctaacgcaatctggggtagggagagaagccaccctccctccccagaacagacaaacaagacacaagcccagtgccatggaatcttcgagaaagctccacagatcaggaagcttgcaaatttgtgacacttcacacacagcaggaaccatctcaaaacaacaacaacaaaacgaagcagtcatcttccaccccaaaaagccacaaatccagggcacgaccctcctagccaagtctcagggcgaggagaaggtgtgagggaagatggttgttcaagggaaacctgaaaggggagaaggggattgaaatctacggcccaaaccacagacttcagaggagaataatattcctggcctctggctccagtctgcccaaggcccagcagggtgtctagggatgagttaaggaagtgggaggctgtcagcggtggagagggggcatagctggtgcgggaacccttagactaaaccaaagctcgtgcctgagactggcaccaacaggagcagcggcatgggaagcaagtaatgtcagagttgcctggcgcagtgcctggaactcagtaggcactcttaaaaaaaatgtgagcagcagagaacacacgaggcaacactcacacatttttggcgcagctaagctccctcagcccgcgcacccccttctcaaaatgcacctccggcccccccagtagctgaagcctgccctggccggtcaccccggggccgctcccctgttcctgcgcaagactccgaggagtgcttgtcaccaggccaccgcagtgcttctgagagcgggaatccgcgaactggagtcccgtcttccttctggcgtcctgtcttccttttggagctccccctcaaggaccccgggagcccatcctacagtgaggcgggccgaggccggcgcgcatcgaggggacgcgggactcggccagcccgcggtagggccggggcaaagcgggcgcggggctcgaggaacgcggggccgctggggtcccgggagccgtcccggctcccggggagagggagctgggcgcgaagggctcccgggtcccgggatggagactcacctcgactggaggatcaataagatgcctaggaggactggaagaactttggacaacatttccgcggagaccggcgcgaccacctgcgcggaggtcgcggctcacgctctggccgcactgagcgcggggcggaggcttttgctgggctccaactttcactcctcccactcgccccgccccgtcccgcgctccccgccccaggcccgccccgatggaaatctccgacgacgtgacggctgctgcggtggggagccggggaggctcgcgcgggcgcgggaaggaggcgggagcccggttgctgaggccccccgtccccacgccgccactgcggcgctgccagacagccaggggcgggggaggcggagggaggaggcggcgagcccgcggcgcggggcctgggcgggggaaactcgcgccccaggctgtggccggcagggagctgcttcagggacaagatgtggggctggatgtgctcacgccccagaggcgaccccctcctgcccgctggcacgccgcggggtcaaactgtgctctccagccgtggcttcctccccgccacctgttgcaccccattgcttccccaagtgtcctggcttcaacctccctctctggttttcccagctctcagcccacaatcttcagtccttcggaatacaagtcttgtcgtatgaaggaagccgggtaactcagcaccttccttggcaccgagaagaagagagacaggggtctccccagcaagctctgatgtgaggtattccacagggcaaattcccaggtatttgggggcagggaggacccgccaacagaggaccaggcggagacattcactgga

SEQ ID NO: 7864 - DNA, 1516 bp, artificial
  synthetic oligonucleotide
aagtccagaagggcccttaaaggtcacatagctcaagatcctcattacacaggtgactatttgagacctagagatgtggagggcctatttcaattcaggaaccgtgttgggattagatgtatctcctacatacgtaatatggtttggttgtgtctccaccccaatctcatcttgaattgtagctcccataattcccatgtgttgtgggagggacccagtgggagataattgaatcatactgttctcatggtagtgaatgcttctcatgagatctgatggttttataaggggtttcgcctttcgcttggctctcattcttccttgcctgccatgtaagatgtgccttttgccttccaccatgactgtgaggcctccccagccatatggaactgtgagtccattaagccttcttttctttatgaattatccagactcaggtatgtctttatcagcagtgtgaaaacagactaatacaatataagtggcaattaaagattgtaaccatctttcatgtgcaatagctcatttaatctttgtagtcatccctgggaaagttttattattatgctgtgttacatagaggttaaatgacttgcccaagttcacacagctgggacagtggtatatcccagattagaactcagtattcctgcctccctgtgcctgtatctttttaccattcacactagttccaaccaccacaagctttttcccatgatcatgttggtatcttatttttctcatggattttgacagagaccattcctgatccaagcctcttacatggccacatattagtacttacaagaggaaagggccacctgcccaagatccaggctctgctgcatctatcatcatggcttcttgaaagggattgcagtgtgaccatgccctaaaaccaaagtgcctagaactgatttaccagctgaggtaaccatagaccagaagaccaaccttgggcaacatatcccatttaccttgacatggaggaggtctgctggtgccattgaagcctggaaaatttggctcatcatagcacaccagctcagcatggatattgtttgaagaaagcagacagcttcagggtcagtagcagcttcttctgactacagcatggagggaatgtggtgacttaagaagaccttggatttcactagtactagttctactgggagttcactggctctccactttgccagtaagaattcattaaactttcctagatttcttcctatcaagaggcagggagatgatcagtatgattctaggctagatctgtatttcagaaaggaggcccagctcgaagtgtatgaataccctagagctgttacccaacatgacatatgcaggtataaaatttcatttgctggaatgcagagtcaagcctccagccttgtgcagcttttagtgctattctgttattctgaggctacaataaaacctagcagcctgcaaaagacctagcagtgttgttattatccttcatgcacctttgtgcattttatttgacccttca

SEQ ID NO: 7865 - DNA, 1391 bp, artificial
  synthetic oligonucleotide
gtttctatttgcaacttttcgatataaataaaaaatgcttgatcattttttcctgaaaagtttacaggtggtaatgagtccaaattaagtagtgctcagttggctacaagggtgccaaaggcagtgggggaagaagattttctggaggagagatgtaccaaggaggggactattttcccgaggggctggacatggcagggcaccagccatcttggtgccaggctggcagagctagttctatttattttggccatacatggtagacggtggttagtaccaattgtccccactaatttccaaaccaataaatgggttgggggtgtagaactggctcccacctttgctatcagtacttatgcctagtaggccttgctgaaggcaggggaggtggcacgcaggatcacatggcctagcctaacctggctgcctagtaagttagagtcatctgatctagatgggagtcaacaattctccttgttctgggcctctcaaacagccaaggcttccactatggagagtagaatctcttgttctttttgcagcgggcagagtgcaataaaatacatgcagtgccctcagctaggggagattggcagactaagatgagcaactggacaaatggcagtgtttggctttgatggggttatactgggcaatattggagggacaagtaatttttctgtagttattttttgcgtagagattcataaatatgaattgagggtcacagcttggtagaggggtaaaaaggagaatcctgaaatacgcgaaggggagccccggggtttgggtgcctggatgcttcacggggtatacagtgctctggttgctgcactgccaccactatctactgtttgcggatcatgcccttgatagctgactcccggttgacatatgtggcccaatagaccagattgaatatggcaaagagcacaggaaagatgatgcgggaaattttgtcaaccttgctgacactgttgtaggtcttggtctcagtcgggctgtcctgcacgtaggtggccttgggtgaagcaatgattgttggggttgaggaggcactgggagcagcgcccttggagatggtggaaaattcagtgtccttggccaggttgatgggataggtggtccccacgatgttgaaggtagtgctggttttctttgctggggctgctggtgttttcttctagaggccaggaaaaagagggggggaaagggagaaaaaagcaaagctaattaattcattacacagagaaccttcagaggctgcagggaggaggagccatgagggaagttaaggcacaggggccatgtagccaatagcactagtaaccaggtttgtgtcaaggaataactgaagatgagtatgaaaagagaaaacgtgcatcatcctg

SEQ ID NO: 7866 - DNA, 954 bp, artificial
  synthetic oligonucleotide
ttttaaaagttagtcaaatattttattaaaatctatgacattttctggtccactagtccaataaactgttgacaaatgctcatgaggttagataatttctcattagtgaactcaagctgtatatcactgattgctgctaactgctcctaaaatatctatctgtttaataatgtattttagggaacttccagtttaatatgtcagagtaaggatacctttgttcacttttcctctctgcaaccaaccaaaaacagtaagatgagaaataaaaaccagaactctatctttggtgaaacttaacagcttttataaccttaatcccaagaagtaagggctcggaagtgaagtgaaagtgaagcgcagtgaaaatcagatcagggtgaagatgacactgaggatacctgctgctctagatttcaggtcaaggatagtgtcccaaaagtgtgtggcatgacctgacaaaggaaagaaacaatccctgttttgaaataaaatcagttttcaaactggtaatgagaacatcctggaactctgactaccacatagtggcagaggagacagagactgcaaaattaaagaatataatactatacacgcatacacatgcacaagcacatacacaaacacacacagagacatgcacacagacacctgtatcaacatagagggatttcctgtgaacaagggaaagttcttactagtcagaagtagaatcacaactacaaggaagactactcataagagattatatagacaacaagtgatgctcaaactactctactactcattctcagctactcattactatcctgctaactctctcagttactcccccaatgatatttccatacataacaagagtagtaaaaatttctctaatgcaacttcaagtaagaattgaagacaaactatcatgcgattaacacaaactttgttacaaaaggaagaaaatga

SEQ ID NO: 7867 - DNA, 675 bp, artificial
  synthetic oligonucleotide
tattgtacaacatggtgagtatagttaataacagtgttttatatatttaaaaatcgctgagagcagaatttacgtgttctcagcacaaaaattgagatgtgaggtaatgcatatgaaaattagcttgatttagctattccccaatgcataaatatatcaagacattctgttgtacaccataaatacatattatttttatttatttattataaacagagcatggattccaaagccagactgccagatttaaaacccaggtccaccatgaacccagcttgtagtagtagctatgtgtaagttacttcagttctctgtgtcttgttagctaacaccttgcagatgctaattgaagccctaagactagatgatactacaaaaggagtgatgtatctagggaagacaagaagtctaacgactgagattcagcatactgggttcatgtctttccactgactctccacacatctcaggcagaaggtatatgtatcagaatcttgaaggagggaggggaaatgaagcaagcagtaaaccataaactgcatatggtcatttgaaacatttggtccagcaattatgctatgccatctcattgggttcaaaatccctgctattgactaaaagtcacagggtaaataatttctttctatacctttggaatagagacaaattagtgac

SEQ ID NO: 7868 - DNA, 631 bp, artificial
  synthetic oligonucleotide
tgttgacagaaaagtaacgatcacctcagaattctatagccaaacttagattaccatttaagagtgaagtcaaaataaagataattttagataagtaaaataaggcagagaatttaccatgaacagatcttcactgttgctccaggttttctcatggctgaatcactcacagccttcaggttttaatcaaaagttactgtatccgaagcattgcttgaacatcctatcattaatagtaatctcccttcctcttaccatgagttatttttcttccttatagcactgaaaaaaaaatatttttttatttgtttacactgcactagccagcttccactagcctggaagctccatgacagcagggactttgttttgtttactgctatatctacaccacataaaactctgcatagcgtatagcagatgctctataagaattttaaatcagtagatgattgaatgaattatcatgaaaagaactactaaaagaagatcttcatgtgtttaaaaatatagccagcagaaagatgcaaaaaggaatggtgagcataagtattgacacagttatcctaaacaaatatgaatatctacaaatgacaataagagctgtaaaaacaaagtggaacaaataact

SEQ ID NO: 7869 - DNA, 636 bp, artificial
  synthetic oligonucleotide
tatatgcccaatgcatagaagaatatctgacaaataatgagtacttaataaatactgaataaatgaatggtattgtaactaagtcacattcctaaatgaggaaaattggttaagaaggataaggtgtaggatgggctttggaacctgccagactgaaaggttactgggcactaccaaatactagttgtgttaggctttaatgacctacttcttcaataaaaaatggggataacatccatcttgtaaaggctgtcaatattatataagataacaaacgtaaaatgcctagttaaacacctgctactgggataagtcttctgataagtcttgtccaaagacaaattcattttatcacatttgagcacctgctatgtacaaggtaccaatacgaccaattattctattggaattcctaaaacttctttatttcagtacctagaaaccaccagatactgacattatgcttacaaatgtccctgtttggatgacatgaggactgtctgccagaactttacctgaacaaagtcattccacatgttgttacccagatactacaaagtcaactctgccatttgtcacaacttgtcaccagagtttcatttaaggtcatctaattccacctagcctcaaagcact

SEQ ID NO: 7870 - DNA, 1465 bp, artificial
  synthetic oligonucleotide
tcagtctttgcagagctccagacaaccagaacttgctgactctcaataagccaaactactcacgttagtaatcctacctcatcaccctgctttccataaatccaacagccacccttcccccagtcctcttgcccatgccacccgcagccacagccacagccacagtcagaggagcaacaaactgggaggccagttgcagacaaaccatcaggtgtttcctcccttccaaggacacagctggacttaacatgatgcctatgagtgagatggggtggggtatctcaatctctgatctaggatgtcagctcaattatctggaattgagggtgggcaggcaatggagcttctcgccgggaaacaaggcaaacctcccaagtttgtggaggaagtcaggcccaaccccacagtgagcccctcaaaggaaggggggagggctcaatctgctttaaaggaagcagttatttacaactttctactcacttgcatgtgggggaggtaatggggagatggggaaagaggctgcaaggtaccctccttctttcttatttccagcagtgagaagcagctgcggagaaagagttaaagaagggagaaagctccagccattactacatccctggtgcctagagctgtctggggggtcatgacagtgctgtctgctttggctaggggccactccgtggctttctgcagcagctgctggggccccccaagcaatttgcaaggtcagtgctgacctgcttccaaagaggaacaaaacaattcactgacaatgaagcaaatcacgcatataccacatcgcaaccccccttcctcaaatcgggttttaccccagtgtctccctgctcagatgccgcctctgggcttccaccagccccactggggaacccaggatagcatcacagctgcagagcatgcctcgcctcccggccaacccaaggagactctcagtacgggggagagatgctatcgctaaaggagacctgagcttgggggagggggaagaaggaacatcaatgtttcttaccgagctctacagtctgagcggaaaggagagaaggatgaatgaactgaaacaagttggaggttgagccctgacagagctcggcttctggcttcttcttctctctctgggtctctctcctggtccctctctcggtctgtctctctggtttgctcgctagcttgcgcgcgctcacgctctctcgctctctctctctctctctctctctctctctctctctctcaatctgcctccctccctctctgtcagtttctccctcccctcctcccctccccttctcccctccccctttgctggctttaggttcaccactggtgcttagcacgcggctgtgctggggctctgaatacagtactgcaaggctttagatgtggttgttttacgaaatactaaagtagtattttattccttaaggcatccaacagagaaatagagggaagc

SEQ ID NO: 7871 - DNA, 1807 bp, artificial
  synthetic oligonucleotide
gatgtagaggtagaggtagcatatatatatatatctttatcaggtcaagtttgttaatcactttttttttcaagtcttccatgtacttaactgatttttgttctgcttgttctatcaattactcagagaaatgtgttaaaatacccaactgtgattgcttatttctccctatagttatgtcaatttttgctcttgtatttttacaccatgttattaggtgaccaagttttaagactgtcaggagaaatacacacattactaatcacagctagtgattttaacccaccactttcagaaactgagagttcaaacaacagaaataagcagcgatatcaaagacatagtaataaatctgagtgattagacaatataaaactctatacccaacaaaaaatatatacattacttagaggcacactgctgatttacagaagtagaatatgaatttaggaaaagagaaaaaagcctcaataaactccaaacgatcaatatcatacaaaataggctctctgatcataatgctaatgcagaagttaataacataaagacagcatttaaaaaccaaaatgtacatttcattatcctcagtaaactaacgcaggaacagaaaaccaaacactgcatgctctcacttataagtgggagctgaataatgagaacacatagacacatgagagggaacaacacacactggggactgtcgagagggcggggaaagggagagcatcagtaagaacagcgaatgggtgctgggcctaatacctgggtgatgggttaatctgtgcagcaaaccaccatggcatacatttgcctatgtaaaaaacctgcgcatgtaccccagaaatcaaaataaaagctgataaaaaataaataaataaaaaccaagaagtctggaaatgaaatagcatattactaacttttggatggaaggaattcatacgtatttagatattaatagaaacactctgttagtacccaaaaaagtttaaaatatgtttaccctaagacccagcaatactacagctaggcacttagactcgagaatcccatgcacacatgccttgggagacacagcccagaaggctcagagctgcattgcttgtaattgtcccaaactggacacaatccaaattccaaagctagttgaatgggtatacaacatgtggcatatccatcaatgggataccacacaggaaagtacatgaacaaagttggctacaagaaacaaattggatgaatcttgcaaacataacactgagtcgaagaatccagacacaagaatatatactacatgaggcgtgcatataaaaaaaaaaccatacacattaactgggggggctggtgttgggaaagaccatgaaggacttgtgggagactggtcatgcttttttttttttttgatgtggatagtggttacacgaatgcccacctcataattattctttatgccatatagttacattctatgcatttttctgtaggcgtgttttctttcacaaagaaagtcttgaatatcgtacagtactgtgataattcccacagttgaacacctttttagcactgagtttgagggctaacatgttctccacgcattagagcaggctctgggtgtgtatgtgtgttttgatggctatgggagtatttaaatttgtctgaaaaaaagatggtctaagaggatttctctggtttgtgattgaccctatcttttaaataactacagctacagtataggcaggtccaccttcatttgtgacagaaggcccattccagaactttttcattggacaaattagttatggtcaatatc

SEQ ID NO: 7872 - DNA, 2105 bp, artificial
  synthetic oligonucleotide
accctggtctccagtgcctaactcccttgaacaccccaaacactgaccttggcctttttttccccttctatggtgtcagccatgaaccttcattctgcatcccctggctgatgagacacaaccacatctcagagagaccccagttggtgagcccttccagttccttgagtctttttcctgagtacccaaagttggggtgaagagcactctaggaaatttaagtcttaagcaactcttgggctcctgtagcccaatgtccatcctgagggaggagcagtcctgctgtggccagagccctgtaacaaaacccattaggatcctccttgaccttatccagagacaaggcacgcggggttactggaggctcaagggtacggagtcaccagccgttgggtacctcctgacgcccaaaattgtccaagtctttcagaatgcagattcagccatggcggtcaaattaccacactcccttcaccatcaaatacaactctcgggcacaggccctttcttccaagaaaaacacacatttcgcattttgcagagaagagacaggacccagtgccccttgaggcggattcctggcccagcccccaaggagccagccctcctccccctcccccagcccggccccgccctgcctgtgtctggagatggccgggggatgactgcagaagcctgaaggggcgggggccgggcggcgcgcaggctacgggcggaggcaggagcgcgcgcctttttgtgcggctcctggcagctgtccgattggctgggcctgcgatgccgtcggagtgggcggagccagcagcgagctgggatctgtgcccagtcgcagccaggagcggccgcagacggagcgcacctcgcagctgccgggcgggccctggggggagctgcgtccagcagagctgctgggtggttgctcctcccgggctctcatctccggtatccgggccgacccccgcaccccctacttcccttgccctcgctgctctctccttagaggcgactctttggggaagggccagcaatcccgccttccccggccccagtagtcacccactctcccaccccacctctgttccttttcgcggccccgtctcccgcgccctcaggcgcccagaacgccccggccatgggcatccgaggcatgctgcgagccgcagtgatcctgctgctcatcaggacctggctcgcggagggcaactaccccagtcccatcccgaaattccacttcgagttctcctctgctgtgcccgaagtcgtcctgaacctcttcaactggtaagcgggcaccgccaggctaggcacggcggggacgggaatggagacgggcagacgacctctggcctcttggacggagcgggctgggggcgactcgggctggggggtactcggacccgggctcgctgagccctggcgcccgggccctgcctgttggcccctagaaggggtaaggtgggagtggggtgttgaaatggagccctgtgcttccgcccacctgttactgcggagcttgactgagccctgcgtgtgcctaaaccgcagcccgaggggtgggggcgggggtcgccctcgtcccaggatctgtccatccatccccaaggatttaaggttcccggcagctttccccagctttggcacctgtgggattggggaggagggtacaggatgacgggcaattcacaaaacatagacaggagagacacctgtttgagtctacattttagtccatttcctgaggcgcgcgcgcgtgcatgcatgtgttgaggggatgagggactctttccaatgcggcagatagaaatgattaactcaaacccatcggagcccagacagtgcgatcgtgtctgaataaacacgaaccgtgtggtctgggatgggtgtgcttttgtacttagtcgtgtgaaaatatttgaagactccggtttttttctctttttgattttaagtttgtttgggtgtgcgagtatctgaagcctttacatgtaaatcacacagaaatgtgtatttggggtggccacagatcctgagcgttggcacatgggtaatgtgtgcttggaaacaggtgggaatgcattgctttaatttgggaataattcatgtgc

SEQ ID NO: 7873 - DNA, 3454 bp, artificial
  synthetic oligonucleotide
ctaggccccacaagttttatagccagtcctagctaaaacctttattttataagagagaaagctgacccgtagggagcagatgtacttagtctaagttcacgtgactgaaagtgcacctcaggggctaatgcatttgcacttagctgctttcaggcaccagcaactagactgaaacaggccttcagtgtgggaaggcattcctggggttcccgtggcagaaaggtaggggtagctggaatcacagctccctcacttgttctaaggatccaactcagaactggagaaatccaggctttagggagctctcaggctcgtagggaagcagacagcattaagaaaatacaattggaataggagctgaggaggtgacagcaggacaacacctgttaggggctatctggtgtcccccaaaattcatatattgaattcctaagccctagtacctcagaatgtgactgtttagacatggggcctttaaataggtaattaagatagaatgaggccgttagggtggtccctgatccaatatgactggtgtccatgttaaaaaaggagattcagacacagacttgtgcagagggagaaccatgtgcggacgcagggagaagtgggccatctacaagccaaggacagaggcctcagaatgaaccaaccctgcccacaccttggtctccaacttccagcctccagatctgggagacgatgcatttttatggtttaagcctcccagtctgtgatgctttgtcatggtagctggagcagactagtataacatccttcattcctcccactcctgtgaaataaagcctatgactctttcacagagaaagggcccaagactttaaggggttaactatcttgctcagggtcaaaccagtaggcagccatgccaggacttgaacgcagcttgatctgtccctaagcctgtgttttccactccaccagcctagggggaattgcaccccaattcgcccaattcagaaggtctgaatccctttcctaggcatgcccatccctctgctgccctgtgggctcagggacttcctggcacagatctcccaaccccagactcaaagcttccctgtggtttgcattcctgccctagactaagaggactgccgtggctggatcctttgacagaaggactctggagccatatcaacatttaccctaaccctaaggaccaaacaaaagagtgaatatgacaagcctttataagtgtcacacaccagagttccaggtgcatggggttcatgaacaccagcactaagggaacattcttcctttactattaaagtagctacatcaggaaatcacagattctgttgcctttatgtggaggagcaattcagctctctctgtgactccctcatttcaacccagaggcagccaggtatcttcctaaacaaagagctatctacccagggacaaccatgttactcgcctgaaaagcaaaagcaactgcagatagttaaggagatttttcttctttcttcttttgttaaaacaattttaggttaatggtgctttattggggtataacatacatacaataaattacccagatattgtgtccaacttagtgaaaaatttaacaaatgtacactcccatggaaccatcattcttgttgatatggcagttgtatttttaaatagaaatcccaccttctttagccaggcgtggtgacatgtgacagtagtttgagctactcaggaggctgaggtgggaggattgcttgagcccaggagtttgaggctgcagtgagctaaggtcacgccactgcactccaggctgggtgacagagcaagactcccatctttatttacaaaaagagaaagaaaatcccatctctctgctgcgaggcttccgtgccatgatgaagagaacaagggctggggaagcacagagaagagtacaaatccagcatggaggaatcctgaaagcatcccctcgagcgtgtgacagacaggtaagctagatcttgtaaagagtctgctgagaggagacagggaataaagggacattgtagacataaggataagcaaaggcttaggggtttccaacagcttaggagaaagagttcagagtaaatacagcagaagatggctcatggggtgccatctggggtcaggaacagatatgattatataaaaatgaaaccaagcttgctgtctgatttagaagctatttctgctaccagaacagtcagtgcctgtctaacgttcatgtcaggttttattgcttgtggtcaaaggctgtcgcacagtacacggagcaaagagcagaaactgcatgatttttcagaacaacgtccagaataaatatgaatctctgccttaaatgggacattgcagagcaagttacataaagaattatcagtctaatagatcacagcactagttgatcaaaatacttaacatcagcttagcacggacgtttaaagcagtcagcatcaaagagatacttaaagttgtaaaacctaaatgcatgtttcccctcattgtccccacgtcattttctccctctttaaacgcttgtcttactctattgcatagaattcatctttttaagctgttttaaatcctttctggaaaaatgaaagtatacaatatacacagattaccacatacataggtgcatgcctgtctgtctcagaaacggcctatcatttcacatcaatttttaataccacccctaccataaaccagattgccatatgcacataagcctgtttcaagactatttcttctgttccaatagtccatttattcgttcctggtagtataccacactcttacttactgtattttctttcatctaaacaatcaaacattctcaagtctttcccattaaaaaaagaaaattctcccactgccacccccacatggccactagctaccatgctaactctctttccacccttttacggtcacatttctcaaaacgtctgcatgtggccctctgtttcctcagccacttttcaatcctaagccacggcaatcttatttctactcccaccacaccacacaaactgctcttgctaaggtcaatgagcttatgttgctaaatccagagggcaaactccagccttcactagcttcacccaggtgaccacttcctctccctttgcttctgtgcccttccatcctcttgggtttcctgcagttgctttccttattttccatcccccttcttggcctctcctcctcttcccacttcttaaacacggaagctcctaggatttcggggctgggttacattctcttaacaggctcaccacagtttacctaggagcactccccctcatctatggcttccaacattacctgcaacatggaccatgctgcatgttcaccaaacacggtttccttttcctgctttacatgcagttagaccacatttcctggaatcccttttgattatgtgccactagcttctgaccaatgggatgtg

SEQ ID NO: 7874 - DNA, 1064 bp, artificial
  synthetic oligonucleotide
ctctaacttgattacctccacaaataccctacccccaaataagttcaccttctgacgtcctagcagttaagacaccaacatatgaattttagaggtcacaattcaactcataacaagggataatggtcaggaagaaaaagagccacagaatgctagacatttttaatgagttaataaatccttgctataggatcaacaaacttagtaagttaataaacctgatgatggatggatggagcattgtaccaggcacaaagcccggctatgatgacatcaaaggcaccctgctctcttctgttgagaagtgttcaaagtagttagggagtctcaatgagcccatgtagcaggtaagcaatcttgatcgctcacactcaaaaatgcaaatgtatcattttgttcacttatagctagacttaatagggtatccattcaaatgacctgtcattccatcagtgcccacacctggtgactttttccaaggggtccacagccccaccaggattctccccactgtggcattatctccatcacaccccaaggctagatgagaccacagccctccaaggctaaatgagaccacagccctcttggggcactaggaagatccagcttaaaccactgctgaattcaaggtaatttagtggcactgcctcagaacctctctgtcctggcaccccacctagtggcaagggacatatctgcaagactgctgtcttccagaattccagctgggacgcagtcctctatttgaaaacaagttttctggaaggagggagctctgaggaggagtttcacaaggagaagaacacagatttgggataagatggggggacaatatttcagtagggacaatgacagagacatgagtacatatatatatagcaactaactttatatgaagggaaacacacatagacatgtattaaggacacggtgtccaagtcagagggaaaaagaaaaacaggctaattaatgagcagccatcatctgtggcaaagaggcatcaggctctacgctagcctttgtttgctgtctttgacctctctgcacctttgttttctaga

SEQ ID NO: 7875 - DNA, 1175 bp, artificial
  synthetic oligonucleotide
aatgccattgacctgtcaaagcaggaatgattattttgtctttctttgcttttccaggatctgtacccagctctgaaaggtgtaaacacagttttccactgtgcgtcacccccaccatccagtaacaacaaggagctcttttatagagtgaattacattggcaccaagaatgtcattgaaacttgcaaagaggctggggttcaggtaaggggaaggctggagtgagtgctgtcaggagcacgtgatggccctttctaagggtgcaaggccgtagttcttgcagtctccctgggcctaggcggggttgcttcttaaagtgttgggaagatcttagaaatgaagcccttggagtcactggagatggtgaaggtctgcttgccaaggctgatttgagatgtaatattctaactgcacacaaatagaacatctgaggacctcaagcctattggccttcagttaaagagctgcagaacttagacattgcttatatttttattgtgataaaatatatatcacatacaatttaccatcctaaccatttttaagtgcggagttcagtggcattaagtacactcacaatgttgtatagccattaccaccatccatctctaaacctttttcttcttccctaataaaaactctatacccattaaacagcaactcctcaatcgcccttccctacccagcccctggcaactacccttctactttctgtctctatgggtttgacaactatagggacctcacagaagtggactcatgtagtatttctccttttgtgtctggcttttcaccgagcatgatgtcctcaggggtcatccatgttgtagcatgtgtcggaatgtccttcctttttcaggcagaacaatatttcattgtatggatgggccacattttgtttattcattcagccatggatggacatctgtgttgtcttcaccttttggcaattgtaaacaatagtgttatgaacacaagtgtacaaatatctgttcaagtccctgttttcaattctttcaggcatctacccagaagtagggttgctagatcatatactagttctacgtttaaccttttgaggagccaccacattgttttccagaccttgcttatattttaaaagaaaagcaaactgtgtttacccttagccaatagaaacgtgttataactcaggc

SEQ ID NO: 7876 - DNA, 940 bp, artificial
  synthetic oligonucleotide
atgtaacttgctttgatgcaaactgctatttctctctttcattcaacaatatattattggcatttttcatgcccctaactagagatctaaaatcaacacctcgattggccacatagtatcctgttataactttggaatggatcttctgatagaaacttatcttgtaacgagttttttaaaatatcatgaataatgttgcaatgagcatacaggtacttagttatctccccctgatgcagttactacctgaggataaatgcctagatgcgagggtactggcaatacaaccccaaaccacactgagctgacactttctatccactgcattgagaaaatagaacacatctgacaacaccaagtgttggcaaggatatgtagcactgggaattgtttaggcaggaaagtcagtgttctgctgtcagattgaacatgcacataccctgtgacccagcaattctgccccaggatatattatatagatggttcatgacttaacaatggcccgacttacgatttttccactctaccatgatgtgaaagcgatacacattcagtggaaaccaaacttgaagtcccatacaactattctgtttttcactttcagtgcagtattcaataagttacatgagatattgaacactttattataacgtaggtttcatgttaaatgattttgcccaactataggctagtgtaagcattctgagcacatttaaggtaggccgggcaaagctatgatgtttggtaggttaagtgtattaaatgcattttctacttagggtattctgaacttatgatgcagttacatcccgataaactcactccacatctgggaatgttaaatgctgctgacatgtccagtaaaatgcaaactgaaaactgatcattggatttagcaacatagagggggttgatgaccttgacaagagccatttctgtg

SEQ ID NO: 7877 - DNA, 1169 bp, artificial
  synthetic oligonucleotide
acgctggcgggagaatgtgcggaatgtgccaggcgcctctacctaccccaggaggggcagaggaaggggccggccgaggggaggggcgaggggcgaggctccgggcggccggagaaaacctgtttgttctcctgcgggcggagcccagtccgcgcctcctcgcctccctgcgcgctccccgctgtgcaccgcgccccgcgccccgcgcctgcctccccggcccggcccggcccggccgggcgccgtccacccgagggagcccgcgccctgcgactgcccgaccctccacccgccccacgagccgggcaccggtgccaggtagggctgtcgagtcgccattggatgcggccctgcttggaggcagtggggggcacccagtccgtgcccagctggggacaagtcagggcctcagtttccccatccataacccttaccagctccaagcatctctcttcgggttccccccgggagtcagtggatttctggttttcgctgtgagtgaaaagactgacaggcagaggaggccagcgtcccctacagaggcaagtgtcccccttgccagcctgatccctctgtcttgccctttaggaaagacacggtttaattgttagtaaacggcgaggggccaggatgctctgagagttgactgcaggcctttaagaatcagggaatctcatatccctccgtccccctgtgcccattttatagatgaggaaactgagacccagaggctggctcacccagaggatcccctcaatcgccctggggcctgtgaggtgcatgtgctgggtacagggcaatcttggggagggccatgaggatggtggctgctcacactcagacagaaggcgccgaatcaggtgtcactgggtgttatcgacaggatcggcactgcaccagctctgtggctggattgttttgatgggggcagagggagccaagagtctgtcctctttggaaaggcagagggataccttgccttacaaaaaggccgaaagctcaggtgctcctgcctgatctgccacttctgagctggggacacctgggtactctgtcggtttaagggggtgacacgtcaagctgcctcccacccagggctgctggggactcagataaagtaggtggtgggtgtgtcccggctttgggacatctgaggcatggtaggagtt

SEQ ID NO: 7878 - DNA, 15497 bp, artificial
  synthetic oligonucleotide
agactgtctgctccctggaattggggctgtgcctggctcctttctgccccgctttcagggatatgagtccctccaagtccacaggaggtgacagccagcttgcgtcctggggctgaggcagggttagtttcagagcacttttttcataagggtgcttattcttcttcagggccttggctgattatgaggggaaggatgtggccaccagggtcggagaggcctggcaggagaggcctggagctccaagaggtggccaaggagacccagctgtacccgctcagcaacctgcagatcccagcaccccagagcggcagagcagccccagcggatctgagcaacttgtcagacgagagagttgtggcagcaggtaagggctgagctgcagtgggctctgcctctggagcccatgtttttgttgaggtctgcgacccacatgggaaccacttccccacaccctgtgccaatacccgacacattgcacacccaggctcctgttctgtgagtgggtcatggtgattccctggtcctagagcagtgtcatcaggcttcttgtggctcaaggagctgggaggggactgtgataggaggatgtgtctgtccccaggtgtgagaagccctggctaattcccaatgcatggggcaggaaggaaggctgtctctcagagtacaggtgctctacaggtgggggtcctgggcagagtgagggctatttgtgtgggtaaaatgccattgtcagagaaggacagagtgtgaaagagcaaaaaaacaggagggtaaaagtgcaaaagtgacagagtgaagcagagagagagaggccagagggagagaaagggagcatgtgtgagcaggcatgagagagtgacacaggatgtgactggccatgtgttggtgtgtgccactgtgcatgagcaagaggacaaacgtgcctgttactggagctgaccatgtggcattggtgtgagagtttcaagtcaggctctcttgaaggcatcttgcctgccagcgcaaacactgcatgtccttgcagctctggacacgtcaacaggccagtgattccaggggtgcaaagcgaacagtttcttacacaagacagaaatgtagaaggagagagctaagactcatattgccccgagagaggagctagtggaatccagcagggcatctgctgtggggagcaggtggagcctggggttccttttgcagggatgaaagaaacacagtcatctgccttctttgttctggggcttcttgtaccacagaggttccataattattaatagttaggttatttttagggcctagctcaactgttagataacaagttttaccttctaagaatatctagcccatctttgattccttggctccaggccctggagggtcccagtccaaaaacagagtgaacaactttggacttgctgtcacattgtgtggcttctagaactagtcagtgttccatgcagaaggggtataaaaagtgaggcttgtggatgaaggaggaggcgagtggttctgggttttgttttcgttttgcgggggagtgtcaggaaaggctttctttacagggagagtgatgttggagctgggtttggaaggctgagggagattttgccagatgtgccagacgtgcttgggaaggcattccgagtggaggctcacaaagtgtatagggaacatccagtcaggtagccatcacaaaggagggttaatccagcctggcttggcaggaagcaccaagtaggggctgggcaggcacctgctcctaggctgaggagtgtgacccacatcctgagggccttgggagccaccgatggttttcctgcaggagagtgccacagccagactcgagtccaaagaagatccctccattgccctgtggaggaccaggccaggggagtatacgacgagacaaggcaggaggccatattggagactgtttgcttacaccaggggcaaggtgatgaggctgcaagtatttttgaattattaaaggtaaaagcgggcttggcgtggtggctcacacctgtcatcccagcactttgggaggccgaggtggcagtatcgcttgagcccaggagtttgagactagcctggggaacacagcaagaccccatttctacaaaaaatttaaaaacattagccaggtgtggtggcacatgcctgtagtaccagctacttgggaggctgaggtgggaggattgtttgagccttgcacgtcgaggatacagggagccatgttcctgccactgtactccagcctgggtaacaaaacaagatcctgtctccaaaataaaaataaaaaaaataaagataacggtgagggaaaagtggtagccaaggttgctccccagatttcagggctaggcaattggatgggtggtgacaggaactagctgagggtaaggagtttgggggcaggcccgctgagagatgcacagagatgagaaggtcactgggccatgccgaatgagaagtgcctgtaggggctccagccagtgatgtccagtaggctactgagtaaacaaatgtggagttgagcaaagatctgacctggggctagagagctgggagttgtcagctcataggaagtcactaaagagaatgcatgaggttgcctggagaatgcctttggaaggcagtgtgtacaaagcatgtattctcggcttttctctgcagacttccagggacagttgtccagccaggcccttggctgggtgggtgagtccacgtggttcagggatgctgagggaagctgcttcatcagctgacatttctctccattttctgctcttcttttgtctcaaaaagaaaaaaagaggggatattaattattgatcccctaaaaccctagctgaatatataaaatgaaaagaagtaaaaatatgagagaagcaaaggcagatggaccataattttggaaaataattccaaaaggtcttaaggaggaagaggagctacagagaggtattgagaaggaaaattttggataaatggaagaatcaggaaagactaccgtcatggaaaccaagccacgctgagctaactttccagtgctctgtagatgctgaaataggcccatcagatttggctatgtagaactcatgactgccttgaggggagtaggttggggcagtgggaaaggctgtagttggattataatggattgaggagggagcggaggataagcaggtgcagttgatggggtacacactctgaaactggctgtgacgtgatggatgtgggaggggtgagcagataattacagctacaagataatggggaaggtttcctataggtgaaagcaacgtgtgcatgttaggtaaaggctgggcagagggtgcctacgtgaccagtccccgataaaatccttggactctgagtctctcatgaattgccctggtcgacagcatttcacacttgttgtcacaactcactgctgaggggaactgagtgaatcctgtgtgacccactgggagaggactctggaagcttgtgcccgggttccctcagaaatttgccttgtgtgcttttccctttgctgattttgcttcgtatcttttcactataataaaccatagccttgagtgtgatgatgtgatgtgtcctgtgagttcttcttgtgaatcaccaagcctagggatggtcttggggacccctgacacagatgggcaggatcagaactttatgccataacaaggactttagattttctttcgagggcaaagaggagccaggaaggtttgaagcaggggagtgatatggcgagagtattgctttgcaatgggatctccagtggcagtgagaagagtgactgaagtgggcagagtggagcagggagaagaggaagtgcttacagcatcctccatgtaagaaatgatggggcctggactaggggactagctgtggagatggagacagaactgtaaaataagtagaagagatcccaaattggatgacaggtaagacttgggagagcagtgacggagagggaagtgacaatttagaaagccacatttctggtcgagtgagtggagtatgtgacccctcctggcttaggtggtggccaaagtatctctaacctgcctctatactgcctgcaactgactgagcaaatgcctggtccgtggagatcccaagctgacaagggcacctgaggcaagcctctggctttcaggtggaggccctacctaggctggcctggctggattgccctggcacactgctgttttgctgaggcagacagcagcactctgcaagtgctcttctcctgttcctcttagtggtctaaatcctgtagcatgctggggtgcgactgtagacaaatcccctttccgggccccctggggttctctatttgcagtctttgggtctggtcactggcatggcatctcagtaggctaggttcatcaggaagggtcaactatgtcatggcacctgatgggcagcatttagagtctgtgggccaggggcttaagggctgcttactgctaatagttctaagtagcaagcattccctcagccctagtctgggcacacgccaggaagaaagccactagatgtgctctcctagtggataactagcctggagttccaagaagggcagagacaggcagagtgagagccttcagagatgtaggcaacgatagtagcagaacttcgagggagagtagatggaaaaattaaaaaaaatccttgtcattatttttaaatgtctgaattgaccagattagaatctttgagagtctagacactagggagatctcatgggtgggccagttattatatcatatggagggagagtacgtatgacccagcacgagaggaccagaggacagtcagtgctaagggtaaaaccttaggccatgggagattgagtttttcatcagttggcaagttttcactttaatactccactgtttccatcatttcagacgactggggatgataaggacaatgtaatttgggggataaaggaagaactcattatatttcttggatgactttactggggaaatggattccttagtcatttgaaagaagcggtagaattccacatgtggggaatacttgttctaacaaaagcttaataacattagtggcaatgatccttttatataagggaaagcttcaagccagtgagaaaaacataaataaactagtaagaacatatttataaccatgagatttgggtgcagaataaaatcaaattggcagttcaggaaaggtcctaaacatctgtatattaacaatattccatcagtgagcaatgtgaatttcccataattgaaatgatgattgataaccttgtattgttcttatctaatataaggcaaagcagcactggggctttgataaagagcaatatctcatgtacactgaggacactgaaaccccgctaggaattctatggaatttctaaaatatttatattaaggacattttacccattatagactaatttagggaaggttctgcattttttttttgatttgacaatgtttccaatgcaatttatacaatattaaataagactaattagtttttgcacctttcttgttacaaggtgaaagaactaatcctttgagattttccagaaggtccctggcaaatcccaaagccagttttaggtataaaatatatttaagttttgattgtgggaaggcaaatgttaagagttgtcaggagttctcgaacatttgattgaatagcattatgggttagcgagaaatactacttggttagctagtgaatcagagttgtaaaaattttcaagtaaacatatgaggtaacatggttgtaaagaatcttcagttcctttaaaattgaaaagactttaaaaaaataactaaggacataataaactgaacatacagatagggcattacagtattttgataagacataaaatctttgcctcttaggcagatgactcagaagaaaaacagaccatttataactttttattagggacagaccaatgatcaagaattttttttttttttttttgagatggagtcttgctctgttgcccaggctggagtgcagtcgcgcgatcaccatgttggccaggctggtctcgaactcctgacctcaggtgaactgcccacctcagcctcccaaagtgctgggattacaggcgtgagccactgcacctagcctaagaaaattttgttattttaacagagaaaccaacattttaattttatacaagtataatatttgatattagttcttttttgaaaatcttataaatacactgaataaaagttttaaccatgacaaataaaattccttttctgtgaacattttctaattttaaagatatttgtttacattttgtctcacacatttttaaattatttgtcattttaatttgggacaaagctattctctttttccttaggaaaagcatatttgcatacaaagttgtttccctttgccatttttgccattattacttttagcagtttatatatatatatacacacacacttatttacttattataattttaaccattaataacttctctttcacagagaaaacaggaggtaggtaattttgaaatatcatataccagcattttgtagcagactagtaaagcttatgaatatacatctcataactttttatagttgttatatactttttatagtaccattttgcaatgtggacaaatgaacacatttaacagatccatatgtagtcacactgtaccataaaaaaagcaaaaagtatataaacttaaatttaggtctagtgactaagtattttatcttctttataaatgatatttaatgaatttagttaacttaattcagcataagtctaaggttttaagttaccaaaaagattttagaaactgcctttaagcttacatattataaaacataattactgttgaaataaagtttgccagaataatgactcagtttggttaaaagcaaatttaaatttttataatcttaaacatgtagtagatataatactagcttattcaacatgtaaacctgtttaagtttaggaggaacatacccaagtagagtaaaaatatatgcttgtattctgttgtattatatgtaatgctgataactcaaagacacataggtgtctattaaactaacaatattaaactagttttgtttgccaaaagtttacataaattctgtgaacttgagttttaaaagcatttgggttagtttttataagaatacttttttgttgtttacactgaaagtattagaagttgtttccttaatttatgagagctttataataatttatataagtacttatttatctctaagtcaattagaatagaggataagggattttgtaaattaatttggtaatgccatctggaggtactgaactattacacatatacaacatacatgtatactaaacatacagacagacacaaatagagatctaatggcgagccctcaatgggtgcagggggcctgaagctctactggctataggcagttgagagggctgagtgggaaggggaaagcctggtgaagagtagataggggtatgtaggaggtagaggcattgaaggggacagatgaaaagattcagggagctgaagggaaggtccaaggtggtgaaaagaagggaagagggatgcggtaggaagatgagaagggggaatcttagatgagcaggtttggggagaccccaggttccctaataaggtcactgaagttccaaattacccttcgtgattactttttttttttttttttgccagttttggaaatactggacagaatgagtgccataggggcagggcatgtagtcagcaagggaggaggaggaggatgaggaggaggaagggcacccagtagattgagagttacctgtgggaagaggcagatcaaatagagaaaggagccaggctggacagtctcattaggaagttctgcacacagtcgtcatctgggagccaaagtttctcttcagtcctcattgaggagctgaagggctttccttgtgcaatctctagacaaggtgtcaagggaaacaatgaggcctcacaaaagagccaggaatttggagtaaatctccactcaaaaggaaccaagaaaacttctatccaggacgattctggctaaaattgaaaaggaccaggaagagtcctgctcaacagagtcaggggttaaatccccactcaaaaagagctaggaagagttctgtctgcgaagattcttgctcaaacagaaaagaactgggaagagctcatttaacagaatcaaagtaactgaatcacagaaccataaaaagtgtccaataaaagcaaataccgtctctgggcagggtgcaatggctcacacctgtaatcccagcacttgagaagctgagggaggaagatcacttgagcccaagggttcgagaccagcctgggtaacatagcgagactcctatatctataaaaattttaaaaattagccaggcatggtggtgtgtgcctatagtcccagctacctgggaggctgaagtagtggaggattgcttgagcccaggagttgaggctgcagtgaactattattgcaccactgcactccagcttgggtgacagagcgagaccctgtctcaaaaacaaaaaacaaatatggatttagatagagacttttattttattttattttattatttttgagacagagcctttctctgtcacccaggctggagtgtaggtgccatctcagctcactgcaaccaccacctcccgggtttaagcaattctcccgcctcagccttctgagtagctggaattacaggcgtgcgccaccatgcccagctaatttttcaatttttaatagagatggggtttcgccatgctggccaggctggtcttgaactcctgaccccaagtgattcacccgccttggcctctcaaagtgctgggattacaggtgtgagccaccgtgcccgaccaatactttatttaaaaagactattgcaatagggacaatgctgcaacctcaggacttgcaaacatcacaaaataatacaaaaaacatcacaaaataataaaaaaaaaaaagcctttttttttcagtagggagtagtaagcacagctagcagctcagctactttcaagggccagtgggcaagcaaaggggaacctgtttggcatgatttgaccagaaatgtgtttccctgtggtcagccggttctcaggagaagctgctaagtggggcatgttctgcattgcagcacttacttaaccaggagcaagcaaaattcaggccctgtggggaggacagaagcctgcctaacattctgtcaaggcaaaggagagggtaaaaagcagacagctgtgaacacttgatcatccttcaggcaataatccattctgggtttctggcttaagactcttgagaaacaaggggaaacaactggtaggagcagcaggctcacctatatgtagttccgtgaggtagccttatggacttctgccaccttccaaaactcagcatgtcccaaaccatctttatcaacacagcttctcaccaaaaacaaccaaataaaacaaattaactaatgtactaattctgtatctccccctgtgttgttcatctcaaaaaactgttatcacctcattgactcagactctcaaccagcgaggtagaagaaatgtttgggggcatgttaaatgtaacacctatgagacatgtaagaggtgaggtgcaggacgcaggtacatggtgataaaagaaaaacctcagccggattaaatttaaaggagtttcattgagcaatgaactatttgtgaatcgggcagcccccagaatcacagcagattcacagagactccagtgcagctacatggtggaagatttatagattaaaaaaaaggtggagggggggaaatgacgtacagaaattggaagtgaggtacagaacggctggattggttacaggttgggggtatgccttatttgaacacagtttgaacactcaccagtgtatgaatggttgaagtatggccgctgggattggccaagagttagctattgttacaggtacacactcctaagttaggttttcaattttgtctgcctctaggttacagtttattgacaaagactcaaatatagaactatggagtccttctcaggccgtatttaatttgctttaacaattccccctttttggtcattttctcaactttgagagattgacaaaaaccttagttattgatatcactattacccttgtaaatgtacttatatggtcttgaaacccactgggaaacaggaggacagtgggttttgtaaggagagaataaggactgagtagaaggtacctctttatgctagaatgttctgtttacaggacaaaaacaaaacctggtctgttttaataactatttgtttccttaaagtcttagtttgattatgttacatttagcatgagcaactccattttgtttggtttggtctgttgggtcctagtgcatgagctcagtacacaacaatggcttgccagaattttgtttaaaaaattccccttggctgggcgtggtggctcatgcctgtaatcccagcacttagggaggctgaggcgggcagatcacgagctcaggagatcgagaccatcatggccaacatggtgaaaccctgtctctactaaaaatacaaaaattagccgggcgcggtggcatgcgcctgtaatcccagctactcgggaggctgaggcaagagaatcacttgaacctggcagtcagaggttgcagtgagccaagatcacgccactgcactccagcctggtgacagagcgagactccacctaaaaaaaaaaaaaaaaaatatttccccttattggccaggttctcacttaggtgagagtgtgaccaaaacttagggccttagcaccacttttagttacctagttaccatcattttaggtttccagtctcagcatgtcattcataggttatgatgtcctcataatcatacatttcaatcagttttgttattccagttgaagagagaccatttgacatttcagagatggctgcatgcaaacatttgaaacctttgagagaatacagtgcactggggagactactatgactaccagtaggataatacccagagtttgaagtatgctgtttacctgaggtccccataaaacaaactgcctaaattaaataaaataaagaatgagctagacgaagagtctactcacttcactaagtgatcttttcattaatcctgtatgactgaatttttataatctgcacttgatatacatattagaattttagaaaccccatataattttggaatatatattaatataattcactaaaaatataccctgaagattaaacattatttttattggccaagcgcggtggcttacacctgtaatcccagcactctcggaggccgaggcaggcggataacctgaggtcaggagttcaagagcagcctggccaacatggtgaaaccctgtctccactaaaaatagaaaaattagccaggcatggtggcatgcacctgtaatcccagctactcgggaggctaagactggagaatcgcctgaacccaggaggtggaggttgcagtgagcagagatcatgccattgcactccagcctgggcaacgagggcaaaactcagtctcaaaacaaaacaaaacagtatttttattttgacaatgcctcccatgatttttataccaaataagccaaatgtcactgttgcattagtgcattatcgatgtcaaacccaattcttaaataaaaccttatagacaaatgtattcaatcttaatcagtttgaacataaggtaagaattttataaaccttttataaccctttacaatttttgttgaagagcagattagtgctctaagaaaacctgttgtgcttttatgtccatgttcaatttatggaaaaacctaataatacccttttaaatttagtattatcatacataaaattttttacaaggttaattttttttttttttttgagacggagtcttgttctgtcgcctaggctgacagtggcatgatctcggctcactgcaacctctgtctccccagttcaagcagttctcctgcctcagcctctggagcagctgggactacaggcgtgtgccaccatgtctggctatttttttttttttgtatgttagtagagagggggtttcatcatgttggccaggctggtctcgaactcccaggtgctcaaaggaaaatttaagacagtccatggaggagaaaggtatagacaaggtcatgcagatattaaaccagaaaggacttatttcctaagccaggaatcgaacccagactgccactgtgaaagggcaaaaccttaactactgagcccagaaggagtctagagtagttaattttgagcttgcaaaggcttttaactagtcaagataatttttagaactaactatgatatgaaccctaaaattcctgttccctggaaggtagagacaaggagaaagtactgccacatggttacaaggtcaagctcccaaggacataaaacaggatggcgaccttgtccagttttttgttggtttcagggacctgcagcaaagtttgtcactgaccagcttgctgggccatcttgagcagcaagcttatgggggcccaagcccatgttttatcctaaggtacccctcgacacagaaaaacgactttatagcacaaaatataccagattgactacagcttaagactagacagcctcagaattcctttttgcattaattaaaattttacagaggagataaacagtgattttacaatcagtttgcacagagagagagaagcctgaaatctgactgggaagagatatttacccttttgctggcatgccaggcttctgggctccctttccctgagtggccctggtgatctggctctctgcaccattgccccgggagccaagccacaacacaaaagaatttttttttaaaatgcacttcagtgtgttgttgttcatttggaatgttccactgtaagttatctttcgtaagatgtcaccatttctgtaagaatttgctgcctcccgggcgtaatgtgtaacccagaaggaactcagttttccagaagcaattaataggttccatggaatgttgatggtaagaaaggaaggaaaaggtgacaagagtgagcgtagacagctctttctaaggagtttggctgctggaaggggaagagaagcagctggggttaggtgggaggaactaagtttagagacgctaaaagtgtatgtagcaggagtcacctgatcaggttgaactgcagcaggaacaaggaagttccattttgactactattagttgcaaattggacccttatgtcaactttttcatctgtaaaaaaaaagggatggccaggcacggtggctcacgcctgtaatcccagcagtttgagaggccgaggcgggcggattgcctgagttcaggagttcacaaccagcctggccaacaaggtgaagccccgtctctactaaaatacaaagaattagccacgcgtggcagcgggcgcctgtagtcccagaatctctggaacccgggaggcggaggttgcagtgagtcgagatcacaccactgcactccagcctgggcgacagaccgaaactccgtctcaaaaaaaaaaaaaggggggcaggggatgaaaatgctattgctttccaggaatagctatgactacttccaataaagaagacaagaaggttccacatgtgaaaactacgcggtcacaacgataagtgggcgggtgcacgcacgcgcgctgagatcgtgcgtgcacaggccggggtgcggccggcgtgagtacgcctgcgcgtgccgccatttcctgcagccgcagactctgcctgcggtgctcgccgggaaatgagacgatcaacaaagaaaatggttgttttgggcgagatcgaccgtggagaggctttttctgcagcagtcccggttcctgccgccagatggcgctcgaggatcacaaatgggtctagggttctcataatggccccgcctaagaaattttggattctcctggcccttcccccctttgtggggtcaacagcggatttgggaatctggtgaccaacacgtgcgcactcccctacccttgcccctaccgagccctccagggtagcttgggggagaagctcctccctagactgccgggtatttgatgagcctggccagcgcacaggtcttgagcaccatggtcagggaagaaggctgaatggcttaggtcttcctagagaggccggaggcgggaaagaactggagaaaggagagatggcagtgggaggatggggacaagaataccagtgtgtttccagccagaagacgatgtcttttaacacctcattgaagtcgtcaggtgactttgcccttgtcagaaaggagcagcactgcgggggtcctactgaggaggagactgactgctccttggggtggggattgtgcctccttcctgtctgccccactcttggggagatgagtccctccaagtccacgagacatgacagccagcctacctgccatgggagaacaaagtctagtctcagggcactcacttcataagggtcttattcttcctcagcgtgttgactgattttgaggggaaggatgtggccaccaaggtcggagaggcctggcaggacaggcctggagccccaagaggtggccaaggagacccagctgtacccactcagcaacctgcagatcccagtaccccagaacagcagaacagccccagcggatctgagcaattcgtcagacgagagagctgcaccagcaggtacgagccaaactgcactgggaccttacctgctagagccagtgtttttgtccagggcagcaacccaggacaaacccccacacactaggcatgcctgtttatcctctgcaggtgagtgtggttaggagccagagggaaggagagaaaccagcatctcaggggtagatattcatgggtttcagcttggagccatagcatcaaatctgttagactaagtctggcacagaaaggatgcacagagaaccaggttgtctggcagccagttcgaacctggaaacctgggtcaggggagggatataggttgctttttctgttaatggagatggaaactctctgagcaaggtgtgccatggtgtggatgtgattcactgccagaaataacaactgtaccagttggatgagctcttccactgccatcagcactgggatggccatggatttggacagtaatgtagctccacagtgctgactcagggttgctcattgattgcaagaagttggcagcagtagcctgaggaaacaggggctctgaattttctgagagagaccaagaaccaaggaacagccaggtactagggaacagacaacaccagatgcttgtgcttttctgtgagcagctcaggtctcccaaagtggtagtttcctggcttctggcctttgtagatcagtgtggatccacacccaattgtgatgtttgt

SEQ ID NO: 7879 - DNA, 710 bp, artificial
  synthetic oligonucleotide
gagggcctctgctcttgatttaattataaaatgtctacgtctttctccagtttctgagccctatgcacattggcttgtgggcttgttcttcctgccaaatgatcagagaggaacattccatttatttgtagtggatttcctctggagggcatgtacccacactaaataccaactgctcttcctcagctgtagtccccaacatcagacttggcacgtggtggacactaacacacaggcactcaatgaatgagtgaaggaaataaaagtcaccccgttggtgagaggtgctatccctgagtctcagtgcaggaccagtggatgaaaggcaaggtaaagaggcccaagataggctggcttcccccgttcaaggtatagtctgcctttaagggagttttagaaccaacatgcaagacattgaaagaaatcttgcaagagccattattgacttagatccaaaacagcctctctcatgtctaaaaaggcacagaattttgcagatctgaggaagagggatgcattacctttttgcttcttttcaattgcttagtgtttctaatcatacttaatccacactaatgtgcgcaattataataaatggtaagatatcacatgtgtcagtgttaaagttttcttttgaagtgtaataacttggtgtattcagctgtgtgatttctttattcctattgcctgaagccattctctgtacaaaa

SEQ ID NO: 7880 - DNA, 3096 bp, artificial
  synthetic oligonucleotide
gaattctgtctgaccaggaaaaagcccttggggccatttcttcttggtccctgacaagtgccaggctgacgagcagaactcagggtggggcaggaagtcagtggacagttttgtgccccactcactgcaaggtggcctcccagacttggctggatgggtgaacctggcctgaaaatcaaccacaagccccttttcgttgtgtttggagaggagctgaagctgtgtgaataggagttgagcatgcggctggcagagcaggcaggacccacagaacacctgggcccactgcctgagggacagtcactcccttcttcatttggctgctgccctgggatcaaacggatacaatagaacccacggcgcacggctgccaaggaagggcaggcccaagggattgggctccaagtcctggaagtggtttcccaagtcactagatttgcagcgcacaaaaccggaaaggtcccggtaaacctgtccactggcacctgggcagcgaagcgctttggccggagggcctcaggtcccagcagcgggatggacagcggggagatggctgaccctccttggggtggtgtgcgtgacctgcatgagtgcctggggcatctcctgcacggaatggcacccgcaccaggtgcccctggcctcgccagccagaggaccagtcctggacggggagggggaggacaagagcaggtgaacaggccccagaacccggctccctgaccctggccataatgcagagctgcctggcgcacctcagaccactccctggccctctggtgggcacgccggggtgcagacccctcgccccgctggcacctccgtggcacgtgcgggaggggcaggagccgggaccaggaaccgctgtggtgagagccaaaggcacggggactggccgccacagacctttggccaccgcagtggggatgggggtgggcgggcgcttgtgtgcccgggggcccgggggcccccgtggcgggggggctaggggagaggagcaggtgacgtcacccggggacctggggcccccaggggcggcggcgagagcccgacctcgtgacccgtccgcgccaatggccctgcggtctcccggacgacgcggaggggtccgcgctgcaccgccgccgcgcccccgccccgtgtccgcactgcagagagccgcggcgagcaggcgccggcgcactggcccacgtgctgcgcgagcgagggagagccacagtctgagcgaacgtccgcgctgggagccaggggtgcccgacccccgtccgccgccgccgccgccgccgcgcatagcccccggagagccctctggggaccccgaccagaagggaccttgccctgggagaaggtaacagacccacctggggagggagacgctgggccccgggagactccgccgcccctcgcctgtccgccctatcagaactgaagcagcctgcagggcaggggtccagggtcctggggcagcgcggggagggggctgaggcccgcagagaccccacggggggtgggggtggggggctgggcatgggccgggcctggctgcagaggcgccgcacggggaggagggcggctgggggtgggggtgggggtgggcgtggatgtgggcgtgcggagaggtgggcattaacctcgctctcgccctgctcgcattcacaggctgtggagacctgggccttctgcgatcaccctaggagttgatccagatatgtgcctcacgccctgatcactccccccaaattagtatccgcagagattcgaggacatgccgttgaccttgttacaggactggtgtcggggggaacacctgaacacccggaggtgcatgctcatcctggggatccccgaggactgtggcgaggatgagtttgaggagacactccaggaggcttgcaggcacctgggcagatacagggtgattggcaggatgtttaggagggaggagaacgcccaggcgattctactggagctggcacaagatatcgactatgctttgctcccaagggaaataccaggaaagggggggccctgggaagtgattgtaaaaccccgtaactcagatggggaatttctcaacagactgaaccgcttcttagaggaggagaggcggaccgtgtcagatatgaaccgagtcctcgggtcggacaccaattgttcggctccaagagtgactatatcaccagagttctggacctgggcccagactctgggggcagcagtgcagcctctgctagaacaaatgttgtaccgagaactaagagtgttttctgggaacaccatatccatcccaggtgcactggcctttgatgcctggcttgagcacaccactgagatgctacagatgtggcaggtgcccgagggggaaaagaggcggaggctgatggaatgcttacggggccctgctctccaggtggtcagtgggctccgggccagcaatgcttccataactgtggaggagtgcctggctgccttgcagcaggtgttcggacctgtggagagccataaaattgcccaggtgaagttgtgtaaagcctatcaggaggcaggagagaaagtatctagctttgtgttacgtttggaacccctgctccaaagagctgtagaaaacaatgtggtatcacgtagaaacgtgaatcagactcgcctgaaacgagtcttaagtggggccacccttcctgacaaactccgagataagcttaagctgatgaaacagcgaaggaagcctcctggtttcctggccctggtgaagctcctgcgtgaggaggaggaatgggaggccactttaggtccagatagggagagtctggaggggctggaagtagccccaaggccacctgccaggatcactggggttggggcagtacctctccctgcctctggcaacagttttgatgtgaggccttcccagggctaccggcgccggaggggcagaggccaacaccgaaggggtggtgtggcaagggctggctctcgaggctcaagaaaacggaaacgccacacattctgctatagctgtggggaagacggccacatcagggtacagtgcatcaacccctccaacctgctcttggtaaagcagaagaaacaggctgcagt

SEQ ID NO: 7881 - DNA, 1224 bp, artificial
  synthetic oligonucleotide
cctcgatttgcatacgccgctcacagcccggccaggccccgcctccgatcccgctctttgcacctcaccagggcaaggggcaggctcgggctggggagccggcgcgggcacggcggcagcccgccgagggggacgcagggcacgtcgccccgccccggcccgcccgccagctgcggcggcgcgtcgggaagtgcttggggcggcgagcatggcggcagcggctgcaggcctgggcggcggcggcgccggcccgggacccgaggccggggacttcctggcccgctaccggctggtatcgaacaagctgaagaagcggttcctgcggaagccgaacgtggcggaggccggcgagcagttcggacagctgggccgggagctgcgcgcccaggagtgtctgccctacgcggcctggtgccagctggcggtggcgcgctgccagcaggcgctcttccacgggcccggggaggcgctggccctcaccgaggccgcccgcctcttcctgcggcaggagcgcgacgcgcgccagcgcctggtctgccccgccgcctacggggagccgctgcaggccgccgccagcgccctgggcgccgcggtgcgtctgcacctcgagctgggccagccggccgccgccgccgccctctgcctcgagctggccgccgccctgcgcgacctgggccagccggccgccgccgccggtcacttccagcgcgccgcccagctccagctgccccagctgcccctggccgcgctgcaggcgcttggcgaggccgcctcctgccagctgctggcgcgcgactacaccggcgccctggcggtcttcacgcgcatgcagcgcctggcgcgggagcacggcagccacccggtgcagtcactgccgccgcccccgccgccggcaccccagcccgggcccggggcgacgcccgccctaccggccgcgctgcttcctccgaactccggctcggcggcgccctctcccgccgccctgggcgccttctcggacgtgctggtccgctgcgaggtgtcccgcgtgctgctgctgctcctcctgcaaccaccgcccgccaagctgctgccggagcacgcccagaccctggagaagtactcctgggaggcttttgacagccacgggcaggagagcagcggccagcttcccgaggagctctttctgctgctccagtctttggtcatggctacccacgaaaaggacacggaagccatcaagtc

SEQ ID NO: 7882 - DNA, 281 bp, artificial
  synthetic oligonucleotide
ccatggctggccgtcctgggaggctagagacgactcctgaaccttgtgagtgcaaagacacactaaggaacccaggtgtgttaaatgagagccaacggggaggtccccaggttgaagaagagtggggctggcatgctccgtgtctactgctgaaggagcaaaggacaagggagaagaggccagcgtccccacctgtcccgttatgtcccatccagcccttccctggggctgcctgcagagctcacacctgctccgcacacctgaactccaggtcctctgct

SEQ ID NO: 7883 - DNA, 549 bp, artificial
  synthetic oligonucleotide
aacttaattactcctgtaaagagcctatctcaccttctgaggtgctgggagattagggcttcaacatacctttttttgcgggggagcaggaggggaaacaattcaacccataagagtggccaatgccacaaatttgagaaattataaaggaaaatggtatgggataaaattatggggctgaaatcaaggaagcaaatagcatattttggtccatggtaataaggaactagagaaggtttccagggcaaaaccttacaagaccttgttgtgttgtgttttgtcaccatacacatgagaatgttactcagggaactgggttttatgctgtgaaggtccttgctgggcctcacggaagctgggaacattgtgttgggctaagggggtgggggttattttctttaagacagccgtgctcagacagtgcaggtggggagaatgatctggacctacaagttttagaatcaattccaagactcttgcaccgaaagtccagaggaggatggaatgtacagggaaggagaaaaaagaagaaaagtggagttctccaga

SEQ ID NO: 7884 - DNA, 2036 bp, artificial
  synthetic oligonucleotide
cacctgcacctcctgcctcacctgctgctcctgcctcacctgctgctcctgcctcacctgctgctcctgcctcacctacacctcctgcctcacctatacctcctgcctcatcttcacctgcagatctttcctcattcacacctcctgcctcacctacagatcctgcctcacctgcagctcctgcttcacctgcacctctggccactgcttgcccctggggctgtgcagggaaactgggtatatcctgaaactcagcatcaagggcctggggcagggagatcactttccagggtccccctttgcctgctatttggcggggaatcaagctttggtttaaaccctcagcgaattccaccaaggctgccctggccccgagctcctttctgaagaccttgatgagcactcggtacctgcccaggggcgacagggcagcccgcacggcctcctggaactcatgttcctcgcagtcgtcagggatatccaggatgagcagagagcgctctgcgttcacacccatcctcctgcaccagtcctgaagcatcgccagagctatcgcagaggacttgagggagggagcctgatcagacaggaatgtgtgctgactgttgcagtctctgacgcagcctgtgagtgcaaaggggagagagggacgacgttgctgccaatcaacccacccccactacaggcctttgccctcccctcccaagcactgcagcagccagggatccattccctcccactgctgcagcccatgcacccccaaagccctcccccagttggtgacacttaatcccttggcacacacccaccacctctattgggagatccccttttgcctgagctgatgtccccttatcacaccacaacaagtgcacctccccctcccaccatcatctgtaacattgcagccaggagtcctcccctatccaagcccctgcaacaggtagctcttcccccacccagaatccctgcggccagtagtcttcccctacacagatctttgcagcctggagttcttccttacccaaactgcagaagggaagcagagagacctcccccgtctcttttccagcgccaaaccaggagccccctccctcttttgatcttcctcttttgatcttccgtgtaacctggcaacccccctccgcgccccccacacctgcagccagaagtccccttcctcccccgaaagccagagcccccctctctcccaccgtcccctgcacctctgcaacggcagcccaccctaccccccacccccgccccaccagactcctgcagccaggagccccctcctcctctctctgcgggccctgggccggaccgggaccccctctcgcgcccactgcggaggcagcgatctggcacctgcccagggcgcccgcggtcactctggggtcccgccggagcctgctcactttctccgactctgcggacgctgcgaccacccgcggaaaaacgccgccttcaagctgtggagcccactctggaggccacctagaggccctggagcaggagggtggaagatctcgcctcagtcacgcggccgcgctgcgcagcgcaggggtctccaaagcccgctgtgctaagactacagggcttcccgcttctcccagaagccccaggtagatgaggaagaaaaatttcgtagtctctgtggaagacaagtggctagacaggaggagacatctgtgttgccctggcaacgggacctgcatggtaagggcttaatgttccaaggcttggagcctctgggagcaacaggcccaccgattggccctccaccatcaaaatgacctccatcagtaattgtggcaaattgctgggatgggatggactagaagtcacgaggaggagatcctaagaccaggtccccagggtattcacagcctgccctgctcaggcctggaatccctacaacatagattgattgctggctgtgttcctcataccagctctttaccggctggaggccggccttcaaccacctgggcagccattgcctaggaaagcgtgtgggctttcaatcagacaga

SEQ ID NO: 7885 - DNA, 1764 bp, artificial
  synthetic oligonucleotide
gaaagagattggttcataggcttctgctgtgggcagctaggggaaaattcacccatgtgttctggcatcacttcctatagccacacctaagtgagggcaacagagcagaggctcggagaggaaccctgcccctccgatggcttgtgcgttatgctgatagaagctggcagcactgccctgggctatgatttgcaacagccatgcccaggaggagcactaaagcaaaggtttggagggcagtggaacccttctgaaagcctgtgtggcatagaagtagaagctggtcctcctgggtctgagctaccatttccagtgggctcccccaagaggaacagcagcaagggctagcgaggaacctgcccctccagtggcccacagaagccacagatagaagccagccccaccagggctgtgctgtgacttcccagcagctgtggctggggacagggacactaggagggcctggcaaggaagtgtgcccttctcgtgggcccaccaaggctgaggcagagcttcctagcagacacaacttggaagggcttctcaggcacccatcctgacccccaggctggagaggagccaaaagcacttgttacatagtgattccttttgccctgtgggcctcagttcttgcagtagttgtgaatctgtgtctgaaatcactactttcttctcggatcctttttctcttttcgagttgttaggatgtgttttgtacagctgtcatttgataaagaaggttgacctctaccaggggcaagtctggcacctttacctagaagtactctgccatgtcttgcccgttcatttatcgtttgttgggtttcatgagggatcccattgaagtagatcccttttatgaagggatcccattgaatgcagcattaactcagaacgtagcataaagtcgtcactgctcccagctgggacgtggtgtcttggcatcccttcctgccgtccttgactctttcccatcttcagttctataattttctcccaaacaaatgctcttttagagttaacactaaagatctggtctttgccgtcaaggttgacagaacagctgttcatggtgtttgcggtgaaacccgtgttctctttcaatgcagtctgtggctttaacgtgtgtcctgtaatttcgccaagatcatttcttgcctctggtaacttgggggtggatttccttgggctctctaggtgtactgctatgtcagatgcaaaatgtcacccagcttcctgtcacatatccttgtctgtgcattcatgcatctacctcattccggttttctttctaatctcatgtattcctgttgtgaggaaatgtgttcttttcccgatccttttgtagttcatacacatgacaattgggtttccacgcacgtgcatgagatgttcctccttcaaaccttgttactatgtcagcacattaactgcctggcatggaaaaagaaaaaaaaaaaagaaatatgttcttttcctaccatttgaaaaaaatcctccattgcttttattagagttttgaatacttgtgaaaattttcaaaagaaagtaattgattaccatttttgctgcttattacgatgagctgtgtccattagctgtgtcaccccactcttgcatttccagaatagtccctacccaattgcagcgggcatgtttttgagtggtgttgcattccatgtgcttgattttgtcctagaactggcacagcgcctgccctacctgcagccctgggttgtggccctgttgcgtaccatgtgattt

SEQ ID NO: 7886 - DNA, 1579 bp, artificial
  synthetic oligonucleotide
cccctcccctagtttcccacagcagaggcgagaccggctggaacacggaatgaaatttattgaagagaaacatatactgaaactattgaagagaaggaaaccacaatacagagagaaactgtaaacagccaccacaggacacaggtcccaggccccctcctcctggggttcctggcaaggcacgtcatctgctccccctcccgctgctgcccccgctgccacctccctccttcccgagggccccagggtctgccttttgccaggacagtggactctggcagtgtccactggcttcagggagccccctcctgagcccatccctatggccttcacaggacagtcacagaacactgggaaacaccagggaacaccccaccaggctgaagaaactgagtcacaagtaacaacaggggtgaaacgccaaagcatagttcttgtggatcctcacgcagccccgctgtgccccgggtccggttcttcttcccgcagtcagggtcaccatcgtggtcacggggtgagcgtccgccgtgccctggtgcctccttcccgccatctcctgggactgcgctgggggtctccggggagaggctgctcagagaagaacacacgcagctccacgagaacaagcagcccctggcctagatctacgccaggaaagcagaggtggtgctcacgatgcaggacagcagcaagcagagcctgggctcgcaggaagctcacagcacgtgccccgggcccagaggtggccgcctgcatgggcgcacagtacatgacttttcgcagaaatgatggctagcagtgggtgggcgtctgctgggcgcgtgggtcacacaggtgagggtgagcttcccggaacagagggcagcctgccccggagatggcaagtgggctgacccctcttgagagacccaggcagctggcaaccttgagagggcctctttccccctgtctctcccaactcacggcctgggttgggggcagacatcttcaggtgcccccacccaggccacagctgcccactcagggctccctccaggccagccccccgtggcggcagggtttggggctggggctgggtgtgctgggtgcaagggagcgggggggcgcctctccccaccccattttgtatcaaacgtggtcatccgggtcacagggaaggaatgggggtggtggccagagccccttgggggaggtggggggcccttactcctgaatgtggggtgagggactggccctggcctggcctctgtctgcctccaaggcgctgctgcctgagaggagaggaggccccggggccctaggagcctatttgccctgggaggacttgggctggccctcgtccccggccccatcctcatcctcgttttccggctcctccaagatggtctggagcccctccagtgggggtttcctggcttcctggcctctcacctggatgaggccctctggaccccagctaagacctcttgggaacacccagacagcactgctcatccgggctggggaggagccccaggggacctctatgggccttgcctgacctaggccttcggggcctgcaggggcactttcaccttcc

SEQ ID NO: 7887 - DNA, 4428 bp, artificial
  synthetic oligonucleotide
cctcgcccttcccctatgccccagatggacggcttttgttctgggagcgcaggcttgccgagggctccttgctgcgggctaagtgctcctggccagggcccagggtctctgaagaaaagaaacccctgaactctggttcaaaggccaaggaggctcccgcctcgtgctcagttcccagtggccggggctgggatatgtgatgtggctgatttttccctgttgcttttcttttacggtctttttcatacgcttcactatttgtcaaaggtctcacaattgtcatcagagcaatatcccaaccaaccttggatttcactccctgctctaccacgtggagcatgaccctttggaaaatgacaaactccaggtgcgatcccctccggtaacctgagggaaagccagatgcacccagagggtcttggcttcttgcacttccctgacctcctttttcccctcctcgtgtctccacaccatgctccctgagtcacctttcacctcttccccgctctctgatccttgccatcctgggtcactcctttactgagtgaccatggccggggtacttggtgctagctgccctgcagaggtcccggggaccccagcgagatgaataactgaatgaatggacgtaataacgcccaggggtctagcccatgggaggtgttctgccaacgcgggtccctcccgtccccttcaggagccgcggtgcgctgaccacttcgaccccagccttcagagcagcccagacagaaagcggaagtgcctcggggcgcgtggggagccaggccagacgcccctgtggggcgggcgcggggcgggccgccatccctctgcgccgcgcatgctccatgccccccccacaacgcgccccgttcccacgctgccgccgccccggccccgcccgctcccggcccgctcgtcggcgcaccagactgagactccccttcaggacgctcttcgcgagcggtacccagaggcgaagtcgagacaagcccaggagcccccaccccccgcccgcgtttcctggggacgcggcctcggagggcttctaggaggaggcggcggccttggcctcgggcctgccgggagcaggaagggaggccgactccctcggctgcccgccgagcccaggtaagagggccgagctgggccgcaggggtgcgggtaagcgggtaaggggcccgtctcggcagggtgcaggtgtcgagggggacgagggagctgcggcggcggcgacaagcagggactccctgggaggcgggctagcactgagtggccggaccagccctcggggccgccccgtaccaggggcgccaggggaagagccatccagggctgggcgctgggagctgcggcccgtgtctgtcaatttctctcctgattggtttccagccaccggtcccgaggctggctaaagagcatcctgtcgctgatctgcctggtgagtttggattttgcacctctgggtgtgagagtgctgggcagactggcattgtgaggttgtggcaccgctgcccaggcaccggccctgagggtctccagatcggggcaggatgcccaaaattgtgctccagagggtatcaggtgggggctggtgcctcgcggtggtgcgggatgttgaccaggtgactggcatgccacggaaaagcatcagcttagccaagccaaggaggaagcgaagggccgatggaagtggtgggcaagggtgagagaaggagccagctgagctgggcagaaagcggcacccagcgcttccctacagggctagttgtgactgattcactcccacagatacctcctgagcaagcatttgagatctgccagggacacggcggtagtaagccctgccctgttgttctcgttctagtggctgagcgcagacaataagcagaaaatgttttccattagtaattacagagtctgttaaaaggcagtaagagccggggaagggaggtctggttgccagtttaggtggttagaataacttattctagaataagtctcatttctaccaaaacttgaaggtggtaaaagagcgaggcatgtggttatggttttggaagagcattctaggcacaaggaatcccctgtacaaaggccctgaggcaggggtggcctggctcaagggagcaagagtgtggcaggagcagagggaggtgcagaggtgggaggagggttgggcaaggtcaggaagggttgtgtgagtttactctgagtgacacgggcatcccagggataactgtgagcagagaaggacaggacccgacccgcctgttagaaggatccctcagcgagcagcctgggtggcccccttttggctaggttaccctctgcccccagagggcaaggcctgcccagctgcaaggaagctcctcagaggactttttcaggctaggctgcatggagggccccggtcgacccatgcagcacccaggccgggccttggctctgggtttctccagtttccttctccagccgttctgccaggtgggcagcaggtgactagggcctcgggccaaggaaagctgatggggctgagagaagcaagatcccccaggacggaagaaacccaaccaaagtggtgatgcctgtcccttgctgtggatgaaaaagcccaaattcctgctcccaccgagtgggactgctggatgcttttctgattgttgtttgtttgtgtgggttcttttttctttttctgggaatatctccccatctagtggtcgtcttaaggcatcctgctagagccagctctccccttggttggccaggcttccttgctggcagtggccctgctctcatccccttcccagccctccccgcgtggagcaccctgcatactcagttccacccataggctaaggtccgcaagcaggggtcccgggtccgaggcccctcacagaggtggagcagccctggaggggccggcagtggcaccggtcacccaggttgatgggcctttctggctcctcacctgaggcgccaaggtctggtggattctcacctgtgtgcccgatgctgtgcctcggggaagcctggcttcagagcccaggattatccttctgcttggcctctgctctgctggtccccaaaggtcacagggtcttgctggtccagctggaagaagctgctctctagttccgccaggtgccttccaggtgcttctgtcctcagatgcacggagtagtgcccacctgggtgttatttgagttctatgggcacagggtttgtcgtgtctttctttccaggagttgaaattgtagatgattttcgggaactagctctcaaggacaggcactgctctgggtgacggcttggtgtggccagcacctccgctgggtcttccgatgctgcacttgagtgcgggtctccgtctctgggcggcctcccgccgatggggtgttcactcagggggtcaccactcaacagtgctctgctcccttggggctcagacctgcctcagtaatcttggggtggagggactagagataactcctccccctttcaacttgtccaaaatgggtagtgaactttcagtactgttatggtaaggaaaaaaatgagcttatgctgcttttcaaaacaataattttatactagtctgaaagcactggcaaattatcagtaatacctccccacgcacctttagttttgcaggggtcccagtgactgacagtgtgttataatgaaatgaggtgtggcctgcggacattagaatgattttacctacaggaacatttcttttccctcctttttgattgaggtgagattcacacaacataaaaattaattttttgagacagagtctagctttgtcgcccaggctggagtgcagtggtgcaatcacggctcgctgcaacctcaaccttcccagttcaagccatcaccccacctcagcctcccaagtatctgggactacagacacgcgccaccacacccagctaattttatgtattttttgtagagatgggatctcactatgttggccaggctggtctccaactcctgagctcaagtgatccacccacctcggcctcccaaagtgctgggattataggtgtgagccaccacgcccggccaaattaaccattttaaagagaacaattcagaggccatttagtacattcaccatgttgtgcagtcaccacctctacctggctccagaacattctcatcgccccataaggaaacctctagacccattagcactcactccccatccccccacccccgggcacccaccaatctgccttctgacatgatggatttacctgttctggacagacatgttttatgagagttaaaggttctttggatgacaggaccctgggatagatgaaaggcacagctttttgttctgtatagctctgaacgagagaaggctgccaggcagggccacacagaggttagacccggggaccgggaaacagc

SEQ ID NO: 7888 - DNA, 6132 bp, artificial
  synthetic oligonucleotide
ccatttggtgtcactgggtaagtgatccctccacgacatacacacacccagtcccacctactctgtctctgggctcagtttatttccgagattcctgtttgtcggttgctatgagcccaagaataaatgcatttctccatcagaccagtaatgccagtaatccattgcaggccagccgccatctcagtaggatggtttttagctaagtggtctggacctgtaaatgttttaggtaaatgcgttggcctgtaagtttcagtaccagtcttatcttgtgtataaaatcgtggatcgactaaaggtctttctactcaaaagagagatgcaaattctactggaatatttatgtgcactcttttagacttaattcgtttctatgacggctgcattttgcatccgttccactttgtaaaatttagcaacatcttttccttccattgaccagggaggtcccacataaggacaaagtgtagacttggatttcaagccttgagaagtcccgggaggagctggggcagcttggagcacactgctctcccccttccatgccagtgcacacccactgccggaaggggcagcaattttgccaattaaagggcaaaagcaggagtcacaggctagacggatgggggccggagcactcaggaaggttttcaggtggggtaaagaacgtctgagggtgccagtgacttgcccccacctcacgcagctgatgagagatgcatgcgtgaaacagagtgggactgggcctctggcttttcccccagtgtgcccagcaaggctggctgctgcagctaagctcagacactccacttcccagtggaaatggaaacactccacttccccttgccgctggaggggaaatccagagggtcttcaacattgcactctactgcctttggggttgtgggagtctgactccacagattttgcctctgtaatctagccccatagagggaaagcagcttcatcccctggattccttctgacactcaccaggcagacctggggttccagggaggggtctgggatcctcagtggagttggatgatgaaacagggcaattcagctttcggggcctatggctgtcggcctcccaatagtccctggggcttgcaagcccttcttctgtccctcagggtgcccacacacatccccgatttctcatgagcttctcagcctccctgcaggccaggtgacaaacacagttgtcctcatggcccaaatcgccagctactgaagatctccgtgcccacctggccctggacgcgcaggagcccttgccctcgtagagggacttggccctttctctgagccttcccagtagtgctttttagagagttctttattctctgttacctgaagatattgagaattgcctgagttcaggagcgaccctgccctcagccatagtggtcttgacctgcttcatattccacgcccaggattttccttctccaagcctcacctgatctcccaattggaacgaggggaaggaccctgggtagcagacatccccagaacctgggccaccgcaggattgcacataggtgagtgagaggtgctcaaccagctccccatcggggtaaaaagaaatagcagtggcaaagggggcgggggagggtaccctgccgctttgggtgggaaatcctctttggaggcagatgtcaatctccaggtgtcacagcagccccgctatctccagcccatcctcccgccccttcatctctcctgtctgcctgtgtgatggctttctgttctgtggtcaccttgccccatccccctatgttctcacctcctgctcgttcatctctctgacttggcatgagggtgacactgcctggtgctctgtctttccaggtgacagaacacagagcaagacgtcgacttcaacgcagaagcattctggacgacaactccccggggccgatccacaaggtggcaaggaggggcaggcggcgaggtcgtctgtgctccagagaggtgcccagggcttggggcagagttcggctgcggggccgcagggccccaaaggcgcggagaagcggtacctgtgccagcagtgtgggaaggccttcagccgcagctccaacctcatcaagcaccgcatcatccacagtggcgagaagccttacgcgtgccccgagtgcggcaagctgtttcgccgcagcttcgcgctcctggagcaccagcgcatccacagcggcgagaagccctacgcctgccccgagtgcagcaagaccttcacgcgcagctccaacctcatcaagcaccaggtcatccacagcggcgagcggcccttcgcctgcggcgactgcggcaaactgttccgccgcagcttcgcgctcctggagcacgcgcgcgtgcacagcggcgagcggccctacgcgtgcccagagtgcggcaaggccttcagccgcagctccaacctcatcgagcaccagcgcacgcaccgcggcgagaagccctacgcctgcggccagtgcgccaaggccttcaagggcgtctcgcagctcatccaccaccagcgcagccacagcggcgagcggcccttcgcgtgccgcgagtgcggcaaggccttccgtggccgttcgggcctcagccagcaccggcgcgtgcacagcggtgagaagccctacgagtgcagcgactgcggcaaggccttcggccggcgcgccaacctattcaagcaccaggcagtgcacggcgccaggcgccctgcgaaggcggagacggcgcggaggctagcgggccctgggagcaccggccctgggagcgcggtggcggccaccagccccccgcggccgagcacagccgccaggccttccaggcccagccgccgctgactccccgccagcgcacccagggcgcggccggtctgcgtggggggccttcctggggacgtcgaggctcagcccccttcaggtgggaagaccgccctcccagggcctcgattgcggccacagccctgacctctttggccatcagaagaccccaggcagagcctcaccctgaggctgagaaacgcaggaaggactcagaaccgaggactgccgcctgccctggctcctccatcaacggcagtgcgggctgggaatggaggccctctactccctcctgagtcctgggccttgcaactgaggcacatagatggcacctgggccactcgtccctgagccacaggtactatcgagtgtgcacaggcgtgcgtggaggggatgcgtgaaccatccctcggatttgcatcagaatcgcctgctgcgggtagggaggaggccacgtgaggccagtgaggccagccagcgcggggcacgctggctttgagttacagaagagtggtgcatttcctccctgggggtcgttcccctcgccctaagagttgttagtgttcccaagtagaagatactgaaagcactttaatcctttaagcgcttatattgcaggtgggggaggcgctaaagttagcacagaggcaagaggctccctgaatgttggcataggatggggggctgtgccagaaaactcccgccttgtctgggtggccccagctgcttctgggaggaggagcagcgcccaggccccatcatccctgagcaccagtggttctgggaatggctagcccaggccctgcagagaggataagacccttcaagtcactcacaattggacatttgtagctagccaccctccaggctttgctttcccccctgcccgcccactgccttctgctccccagaccccaccagcaaaggccaccctggcctctctgtcccctgtccccctgccccgccccaccaccagtgcctaaagcttcgcacttacctgctcctccccatcaggcagcctctcttgcggctggtgacgattaggaggaaagccagacgggttaggaatttgcacttaggcaacagagcaagcccaggaacgaatctttcatcgaatgtcttttgcgtgacattttgtagaatactggacgttccgttgctttgattgtttttgtattcaggggtaatgtatattgaaaatagagattttgccatatcagagtatcagggattcactccctaaataagagtccccccagccctctgagaagacctcaggcaggagaaagggggccaccccaggcctgcccccagatgagtgtggtggcaagcctggcccctcttctccctacaacgatgcagtccacccctcttccccttagccctgcagaaacagggcagactcttcaaatggcactttactgaaagccaaggggaattctcaaggaaaagtctcagggctggcagaggcagctgctggcaggccttatcctagttccccagcgctgtccccagagctgggctcaggagctctgccccttggtgctctcagcccagcgtcctggtcagcggccacctccttccagccctgtcccctcccaggggagagggggtttttcatccacaaggcctgagggcaggtgggtggtaggcgtggtggaggggggaggttcaaagacagctggctcctatcaggagagtgtgggaagacccaaacatacaggattccctcggagaatgctgcttggagtgccagtcactaggacaactccagaaataatgttatacacacacacacacacacacacacacacacacacacacacgatatatatagttttatgaaaacttctagagttcttgtaagttgcacttataccgtagcctccttcagtgtgtccctattccccatcctgtgattgcgttcttgtctgcaagctggtctcataagcccacaagtgtgtgtcatgcctgtccccatgtccttgatgccaagcccggtgctggtaatcagtaagcatgagtgaaataggtcttgcagtcctagcacctcagactcaggcttgggaccattgtcggctccagccttgccttgaggcaatccgaagcatctacgactttgggttttccagaaaaagaagtattaggaatggtgtatttgaagtccctgatgaggccattgggaagtctgggtttttctgctgtgcagacagtctttgcaagggctggcatgggcccagaaatgcaatcctcgtgcagagtaggtgcctgtggcaggaggccatgcaattgggctctagtcttgcttcattcaactgaaccaggaaagaaacagatccacgcactctgatacccatttccgttgttctaggaggtaaatgatttcgttcctacaagccagacagtagccagctttcactaaagaagaatcgactccttagtatcttgtcatgccattggttctgatgcataagtgaaccctgtttttaacggaagctccttttttttcacctcaggacctacccaagactgtctagatactggcaggacaaggtacaggagttttcagcagaaagtggagttgccaggagagatgctgggcacttgcactgtgactttggagtgccgggaaaagttccagggtccccagtgcttacttagataaatggcatttaaaatagtgcagccttttatcattgcttagtctaatttagctccccataatgacattctcactgcaaggtggtcattgctatcattttcttttgggtgtggcagttaggtatgccacgtgagctgaacgggtttcacatggaatcaaagtcagaatgttcgaaaaggacatttgtgtttttccttcaatggtgccttgaaattgggctccctccctcttgctgtgtggggaactgggagggtatagcccaagcttgctttgtgatggacagctagaatgtaaaagcttaaactatggggaaagtcttgcctgttttccaaggcttcctccaccctgccaccgaagaacttacctggatgccaacctgggacccctttgtctttgggcttttgccctttgaaactgtgaatgcttcaagagccacataaatgctctggcagtgtctccatgtaactagtaaattgtcctggctggattcgttgtgaaatggaactgtcccatttactttggttgcaaataaggaagatgtatgagtattggcctggaaatgagccctctagtgtagagaggttattctgagggtttaaactacatggataggccttgggttcaaggttacaggaaaggctgtaa

SEQ ID NO: 7889 - DNA, 1912 bp, artificial
  synthetic oligonucleotide
tgctgggcacccaggccagccgggagagcacggccctggaagcggggcctggagaggaatccagggccgtatggctggtcaggcagccagggaaggcctggcaggtgcacggacctgaggctgcccagataggaggagccgggggtggtagaggccagctgaacggtggaggctggcactgtccatggcacaggaggtggccctggtgctcaggcctccaggctggggtcatcaggcggcaagtacatgggctcgatgtgggcccacccacgggcctgctcatcggcccaggcgagcagctctgcggcgcggtgcaggaagatcaggagcagggtgtgcacgtcgccctcggctgagtgggctgcgcttggctctgcccggaagtagcggtggaagaggctgccgaggctgtaaccctggcggccccgggcccgggtgccgtggctgtgggcgcggtccaggccccgcagggccggcagcgtgtccaggcagacagtgtcccggggcaggcgggcacccaggcgccgcagctcggcacacagcagggggaaatcataatcaaagccattgtgggccacaaggcagatgggccctgcctggcggctcaggaaggcctgcagcgtccgcaccacggcgccatcaaagccagccttccggcatcgcgccaggccctcactgctcaggccggtgatctcgctggccttggcagtgaaggggcgctccgggcacatgcacagcgtgagcttgtccaggacccggggcaatactagggcaccagactcgtcgtgctccgggttctccagggaggagcggtggacagcaaagagggacagctcggcaatctcgggctccacactggggagcccagtggcttccaggtccaggaagacaaaggtctcggcccggggtgcctcggacatggtgatgttcccacggggatagcaagtcctcaaactgtccgagcgagaggcacaaaccctgaggactggagagaggggttcgcccgggccctgctgtgtaccatcctccccctagccaaagctctgacccttctggggctcacttcctgccacccccgaccacagcacctgtgacctttggctctgggagcgtcagccccactcctgtcacctactgaacagaaaaggcaggcctcagagcgctctactgcctgcctccagccacagtccccagcagggattgggagaggcagaggcagctcagggaccgcaccttggcggggtccagccccttcaccggaatgccttggctgggaacctggggcatagcacactgggtctccagccctggaaccagctgccgggaagcaggcaagcagccacccgaaagagcccatgcagtgcacccagctcccgctgggctcgacctccccacccttgtccctggcacacaggtgctggtcccgagctggcctctgcctgcttgcccccaggctcccggggagactgtccttgccaaccccaccacaccagcttacctggggcgggcactgaccggcttcctgggcttctgggcacctgtcgccacacaggctgctctaggcggcctttaatcagcggccgcagcccgcccccagctgcctgttggccaacaatgaggcctggggcctcaggacctgcgcagccggctcgctcgccaccccctcgctagctcacagccactgagacacacgccccgtgtttacaaattaggaagcaggccccgagctcttcacaggcacggggaggaagccagagtggtgcggaaggcagtaacctccacctagccaggctgtggctgccaggcctggcaggcctggggtcaatgcctcccccatgctggggccaatgcctcccccatgctggggccagttacacaaaggcaacaggtcctctttgccaggcctcagtct

SEQ ID NO: 7890 - DNA, 5052 bp, artificial
  synthetic oligonucleotide
gggcttggctgcctccacagcaccacccacctctgtgacttattaagacaaccgtgggttctgcgcaagcggggttggggaaggaagggggaggccagcaggctgggctctgccagcggggttgccgagaacatctctgagcacaaggctcggaggagcagagggcactcacccagcactgtgcaagggcgggcacagtaaaccctgaacacactcaaaacccacgctgcagaagccccagtagccagactcagtaagggctgtcactcaagtcaccgcaccgtcacagcagagggcagagcaggaacagaaaatgctggaggccttggaggccccaaggaaagccacagggccttgacctccacaatccagggggctccatgagctctgccccaacccacaccaaggaccaacactaggtgcagcttccaggttctactgggaggagatgaaaaggcggccctaaatggggctgacagggtgcggtcacgtacaaagaaaggcaatgggaaattcacaggaaaactcccatccatctgattctcctgtaggaccctcaaaaggcctaaggaattctcgccaacctgaaatcagacaacgtcatcgtatgctccctggcagctttttcaaaggattcggtttctggtatttacagaagtactacaggttgaatatccctaatctgaaaacctgaaatgctccaaaatcctaaactttctgatcgccgatatgacgctcaaaggagatgctcactggagcatttgagatttcggattttcagattagggacactcgaccagtataatgcatatattccaaaatccgaagaaatcgaaatctgaaacacttctggcccccagacattttggatatgggacactcaacctgtagaagcatctgaggggcgtggctttggcctcctacccgtccctctctggccagatgaccccagttccccaagtgcccccagcttccacctgagtcaggcaaatctgcgccccctcccacaagagcctcctcctgggagctcgctcaagaccctcacactccacccagccatctccagtcctgcctcacctcccagcctcccaggttcccaggccaggggctggtccctccagggccagtagtggctgccagacaagccatctgccactcagcgcagggctccttctgtctttccctggggtattggtctccctgcctgcagccattgccctccaaatccatctgccacagagcaccctgagtcaccttaccaaaatgccaatctcagcacgtcgctccccaggttccacgcctgccctgcccagaacataaagctcaaaggccttggcacagcatgcaaggccctgagggagctgccctgagctgccattccagctgctgctgcccagctctctctcccacacctcaactccctgctcctgtccaaacgagcaccccgctgttaccgtccccatcccagatcaaatgccacctcctccctgccaacatccacagcacccaactcagactgcagtgctgtgcatcatttctgctgaaccccaggacttgtacccactaaatacccagctcctgaggacacccagtcacgtctgcagcgcgtggaatggcacacaggtgcagcctggagaaccccccgactgcacggccacaccatgctgcggctcccatactaaagagccggaaatgacagcaggccaagagtgcacccacaggttgagggctccagcaggggcagggtgtgctcaaaggctgtgggcatccagagggaagcggaatacattctgccctgggaacaggaaacattttaaaaggagacaggacgtgtgagttgggtctttgcgggctgtacaggaggacgtacgacatgcagagactagaaggccatttccaggagggggaacaatgtgagcaagagcaaaaggttatgaagcgaggagctgctgtgctgagccctggggagaggcctgaggaagggcctagaaggcagaggcaggagacgcctctggaacagcaagggctcaaacacaaaaacgcctcctccttcctctgggggcctgtatccagctgggcgtcctgctgatgtctctggtcctggcgggccagaccggctggatgcaggttggctccccactgctctactgccaggctcccgcccaggccccttcctcaagcagcaagggtaggcaggccgcaggctgaggagggggaggcccgggcctggactcacgagaggctcctgtaccaacagactacagctgttcctgagcatggcctgggcacacacccaatcccacaggagcctgtgctctgtgggaggcggggaaagccttctccactcacagctgtgaggcagtgagacagaccctcagctcagggactacgtcaccaggggaaggatgtctgccctgggaatgggacactctggatcatttcctccaccatcactcaggaagtcaccctgtcaccatgggcttcatagggtgccaggcacacaccatgctacaccctggcccaaaggcaccagaggactgggaaacgggtcacggcacagaagctgacaagaggtgacactgcatgaggaccacttggccagctgagacccagccaggagcccacgccctggccctgcctgtcactcctccactgggagaccagagactgttcatgcctccagcctgacccttggcttccgggtctgagaaggaaaggactggaatggagcatttctcaggtgcctgccagtcctgaacctccaaactcataaggcaaggcaaacgctgagggcaagttcagcactgcagcaaaggggtggctggactagcccagcaccgccaggggccactttgccccaagtttgatcatgcctgtcaccagtactccttacctacacagctgttctcacgagggtccaggctagggggtggagccctctgggaagacagctactcacagtaaccacaaaccccatcttccccaggtggggctggctggcgcccatgcacaccccaggtgggaagaggaagaaactgatgcattaccgggtacacatccactctaggatctccaagcggtactctgaggggctgcacagcagttcctgaattgtctttggctctgtgatatacagaccctcgaggaaggggcagtttaggtcctaagcaaggaaaaggaaagcaacattcactgaaagtcccagtgtacatcatttcattttatttatttatttatttttgagacggagtctcactctgtcgcccagcctggatggagtgcagtggcatgatctcggctcactgcagcctccacctcctgggttccagcaattctcctgcctcagctcccagggtagctgggggattacaggcatgcgccaccacgcccggacaatttttgtatttttaatagagacggagtttcaccatgttggccaggctggtgtcaaactcctgacctcaggtatctgcccacctcagcctcccaaagtggtgggattacaggcgtgggccgccgcgcccagtcctcagtgtacatctgcaagctcccaggaccctttcctttacccgcgtcctgccatcttgccaagagttcaagtccccccattcttaaccccacatctcccgcggcatgcagaccccacctctttcaagtactcccactctgggctcttgtggcagcaggacctaggagcaacgcctgagactaagacttaagagagagtcctaggtttcgggactgagggaaaggggagagggaaagggagagggaccactgagccagtcgcggacaggatgggggagtgtctggggggaggagcgagcgggccgaggggacctgggacagctccctaacctcgtgggccagctttcctcactgctgcagtgagggctctgtcctgtggggctgtagagggcttctggaggctatcacccctggcatctgacaccaactgacaccaagccctagtctcgctgacttgacagagtggcacgaggctctgcccatctgtccccccagaccccgcaagatccctaaggccaggcctgggtcctctgtgtctgcacttgctccgagcgcccagcgcgggtactgcagttccacaggcggtgctggccccaactaccaggcacgggccgtggagacagcaagaacgaaggcctggggcacaccaaagggcaaagatgaatgatccacaagcaccccctgctgcaagggaacagggcgcagccggaaccggcgacggtggccgcgtggcgccgcggacttccgcagcaagccctcccgggcctcgggcggggccctccccggtcccccgccctggagtggctttctgggccaacagcaccttcagcttcccgaacacctccacagccgccctggacacgctgctgtcgccctcgtcctctgagtagtcgtcgccgccacggccgcagccagcgtcctgccccgccatgtttcgcgctccgagccgcgccccgcccatgccctggcttcactggccggcaagaccgccaatcaacctccagcgttcttcccgcccacccgcctgcgcccacccccttcccgaccgacccttcccattgggcgacatctccgcctgcgcgggccccgggctcccaccccccgccccggcaccacccagaggcaggaccacagtgaagcgggcagggcggacacagggaagggggcggggcggacacagggaagggggcggggcggacaccgggaaggaggcggggcggacaccgggaaaggggcggggcggacaccgggaaggggcggggcgaacgggccaagctggctctgagtcgcaggccttgctggcgtcgcccctgctgccggccgggaatgatgatgcgttgaagcgaggctcttccaggagggggcgctcctgccttggtcgggttctcctgggccaccaccactaaggggcaccctggttcccaggaggaccaaggggagccttgggtgcagaatggaactcggactgaagcgttcctctcccagcgcggggctccgtcttctcttcaccatgctcacgctgta

SEQ ID NO: 7891 - DNA, 1037 bp, artificial
  synthetic oligonucleotide
cgcaggccaggcctccccggagcccccacgcaggccctgaaattacagccctggtggcccggaggggagagatgctgtgtgattatgtcctcagaggaaggtcaaaaaaagctcctggcatggagagtgccagctttcaccagccacacctcggccatccagcactgggaagcttccagagagtggaggctccgctcactcagcaccagctcagctgccccagggcatgttggcacaagcctcctccataaccgccccaccccctgaacccagaggtccccgctgagcatgagcttcatgccgcttcgaggccgcaggtcatccagagacccttgagtggtgatggggttgcccactggtgtctgcccccgagggtgccgacactgggaatggacgaagcccacaggctcggagtgaggcccactcaaggccataaacttggggccgctcttgctcaagaggtaacctcgatgtgtgagtgacaggtccctggatgggaatttgccctggaagctgaggctctgcaagagctactccccaatgacaggcggcctcagggcactgcctcctcctctagaagctctccctgccccccagtcttgtacgggcacatagcacttgtcacctccttgcttcttgagggtcttgctgatggtccagggggtgggagtgctgcctgtctgcctcgcccactgcagctctctgtcccagctctgtcggctctccctctgtctctccgtcccatccccaagacaggcatgggcccttctgttcacaccatcagaatggaagggtggggaggttcgtgtccaggcagaagggttcgagaagcagccacccacagagaagagggcccactggacacacttggggagcagggcagagggagcccggggcccagttcttgtttccagaccctggagaatcatggaacaagcagcccacctctgtaggggacccctgcataagaggccacctcccaggctcctaggctctgccctctaggactcacaccacccgccagtatttcatgccca

SEQ ID NO: 7892 - DNA, 576 bp, artificial
  synthetic oligonucleotide
aaacacacaaacctgccgaaagacaagccatctcctttgtctggaaagggcatatgtggtctccaatctcctcattccaaccatgaaatcaagagagaaccagggttaccagcctggcccctggtttcccacgtctctcttctccctggcccagtctagaagcttcttgcaggcaggtaccacagtttggtcaaggtgccatgcgtcccaggtcctagccaggccctgggctgccgctggtgaacaggaagggggtctgtgccctgccatgcccccaggtagagctcccctgggagcatcctccctggcctgggacctcccagaccccaccccccggttgagtgatggcactgccaggggttgaagaccctcagccctcgacgttgtcctctctccattggatgccgcctctctctagccacccctctctccctctctgccccttcgagctttttctctcaatatgcaattttctcttttggtcttccgcactcttggcccccagttctattgcagatctgtttctcactccatctaaactcttacccctgtgtctcaggagctgctcttgctgag

SEQ ID NO: 7893 - DNA, 3253 bp, artificial
  synthetic oligonucleotide
cgaaagtaggactgtgctcagggccccagctgtggcataggaaggcctagggtggacaacggctgggctgcaagttccagccgatctttgcttgagtagggtcccctgaacttggtgacagattgggtgtagtgtgagaacggggttggttgtgatgctccgtggcctggagaggggaaggggaccctgaggaccaccacctgacggccaggagcattccggagctgctggaaggcagcaggcgtgggcttacacacgtacacacacacatgcacgaacacacgtgcacacgcacacaaatgcgtacacaaacacacacgcacacatgcacacttgaacacacaaacacaagcacacagaaacaaacatatgccgcacaaacacatgtgcacacaaacacacacagcaatgcaggtcacaaagccgcttcctcggggagtggctgtggagggcacagggccgccgtggggccgtttctcagcatttgctgcaggtcaggtgccttctgggcacagcagggcccagcgggagcctaagccgaatccactgctacggtttagacgagtccgggcttgtcaaaggggcagcgagccagaccttggcaggctgggcccacgatgcgggcaggacccctgagggacacgacccctccttggagggctgcaggggcaggtggcaggcctgggagccaagtcagaggggctgccctgaggacttggcagtggcctggtctccaggctctgctcccacaggctccagctctagtctcaggaggcagggaccacaggaagaggccaagaccctgcctgccactctgaacaggcagggcagggcaccatcgccagcagagagaccttgtctccctcagcttctgggagggcacagcctctctggcgccctggagaaccctgggcagcctgggtgctgaaaggccctgatgcctgctgcacaggggcagccagggcccaggcaggagtgcccaggggactgtgctggagctgcactggcaggagtcatgcccaaagagccatctctgtctctctctctcacacacacacacagacatactctcacactcacatactcacacacaaacacacactcgcactcacactcacacacactcccactcacacatgctcacactcacacacactcaaactcatactctcactcacacacactcacacactcacacaatcacactcacactcactcacacactcacactcacatattcacactcacacactctcacactcacttgctctcatgcacactcacaccccacacacacccactctctcacacacactcactcccactcacacacactctcacacacccacacacgtgctcacatacactcatgcccacatccactcactcacacccactcacacactcacactcacacccccacacactcacacacacacactctgcatcgccagccagctttccagaaccaccaggcgtggatgtactcaagccaagcagcccaagaagcctcagttgtgctgtggacagggctctgccgagctggagctcctcggtggcccagctggggcttggatgagtggcccgaggccactgtcatggataaccacaaaccgggtggctcaccacagaggacatggaccctctcccagtcctggaggccagaagtccaaatccaggtgtctcagggccacactccccccagaagctctagggaaggcttcttcctgcctctcccagccccggaaggctccaggcgtcctggacttgtggccacctcactccactttgcctctgcaatcacatggcttcttgtgggggggggggtacatgtgtgtgtatatgtgcaatgtgtgtgtatgtgtgtgtttctgtgagtgtatgtgtgggtatgcgtgtgcatatgtgtgtgggtgtgtatgagcatgttcgtgtgtatgtatgtgtgggtgactgtgtatgtgtggggtgtctgcatgtgtatgtgtgcaatgtgtgtgtatatgtttctgtgtgtgtatgagtgtgtcttgtgtgtgcatgtgtatgactgtgtgcatatgtgaatgtgtgtctgtgacgatgtgtgtgtatgtgggggtgtgcgtatgtgtgcatgtgtgtgtttctgtgtgtgtctctgtgcatggatgtgagtgtgggcatgtgtgtgtgtttctgtgtgtgtgtctgtgcatggatgtgagtgtgagcgtgtgtgtgtttctgtgtgtgtgtgtctccgtgcatggatgtgagtgtgagcatgtgtgtgtgtgcatggatgtgtgagcgtgtgtgtgtttctgtgtgtgtgtgtctctgtgcatggatgtgagtgtgagcatgtgtgtgtctctgtgcatggatgtgagtgtgagcgtgtgtgtgtgtttctgtgtgtgtgtgtctgtgcatggatgagagtgtgagcgtgtgtgtgtgtttctgtgtgtgtgtgtctccgtgcatggatgtgagtgtgagcatgtgtgtgtgtggcggggggggataacccaggataacccacatctcaagattcttcacttgatggcatctgcaaagaccctatttccaaataaggctgcattccggttccgggggttgggacatggacacatcggtggggacatttttagcctgcccctgggctgcaagtggacacgggctttgcccctgaggccttggggaaggggctgggacctcagccagggagacagtgggcatgagaagacgggatgggggccccaggcccagccaaaggggtcctcacttcagagctggccaaggagctgctgtcccaacagtggcaggagggaacctgggcaaggagggggcatggcccagaggcctgggagaggacggacctggtgactgggtaggggccaaggagccaggagagaaagcagttgtgggaggggagcgggactgaaggggctggaggcaggtggagagagagaggggtgagagtggggatgaggcggccaggtggggcggtgggcagccgctgagagcagggtgctctctgtggcttttgtttcccaggcagtcgtcggcaatgtgggagagtggggtggggacggaggcctggcgtgccctaaggaggcaggtccagggcatggtgggacaggctggcttgggacctgggagggagctgggaagcagagtggtctgggcctccctgggtttggctccctaagtactcccagtgcagaggacaggacttggtgtatgggagaactttctagcaaag

SEQ ID NO: 7894 - DNA, 3076 bp, artificial
  synthetic oligonucleotide
tcctcctcacccagctccctcccctcccccctccctccctccgcgctcagagctgcggttggagccgagcgcgccgcgtcgcccgccgccggtgcagagcgtggggagcactcggccgcagccctcgcccgccgcagagggtcgcgtcccgcgccgccggccaggccgccccgtgcccaggcctttccatccttggagcggatcgttgcccgcctgacgcccgcccgcagcgacagcgcccgccggagccgaggccgcggcggcggccgtgcccatgcccgggtaagtggtgctctgggcgcgcgggcgccgccggggtgggcgcgggcgcggcgcgggcacaaggcgcgggtggggatgggaggatgacccggcaggtggtgcggcggcaggtagggggacacgggtccccgcccgaggcacctgagccccgcgccgggcctgcgtgtccttgcggcactgcggccgcgcgtcaccccggggccccaggccggcgggcagcgccccgcaccctgcaccctgcgccccgcatcgcgcgcgcacgcgcatccgtgtctgaggaacaaggcccttgggggctgcgggccggggctcagggtgggcgcagccgggggcgcgggatctgggccgggagcccgccagtgcgcacgcaccttcccggagcctcgggcaccccctcccccccgcgccctcacactgtatcatccttcccctctcgccttcccgcaccgttccccgcacgcccacgcggctgcccagcagaccccaccgcggtcatgggcagtgcccacgagaagccgcccggggccgcacttaggtaacttctccatccctccaggaacggctgtctccccctcctcgcctgtgtgaccttggccagccagcttttcctgtggccgcctgcgttttctcacgggtgaaagctctggctttaagattctggaatttggaatggcaggtgcggcatctcccagagcctgagacgatgggcttctctctctgtgacctggtgtccttccttctgctggcccttctgggggttggtggctcagccagccggctgaggaggggtgggaggcagggcaggggcatggcgccggggcaggtcaggactggagggagtcttggagagcccgcggtgagggctccatgagggtttaggagagactgtggaaatgctccttcgctcactcaaggggcagggaagggaccagaattcctcaacgagatgcttgccatttcctggcgaggtcatataactttcaaagatgaagcccagggcctccgacctcaaaggagtccctgcctgctaaaggatcaagtccagcctgtccccaactggcccccatcctgaattccactggcaccctaaacgtcagccgacttcccctggctgacttgggcaccagtctggcaggcaccccctgcacctcctcccctcctttgcccactaggatctgtgccctcaccccctgccattgcccctcactagtcagtgaccatcttaaggcaaggactggctcttcatttgcacaggcctggcacagagtgggcacctggtttctgcatggcatattcatgaccttgacctcactgaatctgcagactcactgaacaggagaggcaaggcctggatttttgtccccatttttcagatgggatcattgaggcccccaagaggagaagggattcagccctgaattgaggccccttccttcatgagcagatggctagggacattcctatgaacctggtggggcagggaggcggggagaggttatcgtaataatcaaagaccagccccacttcctgagctccatctgagtctcacctcaaccacacgagtgaatggctgttttcatccccaacccccaccccccgccgccacttttcacagatgaggaaaccgaagccatgtggctcattaaaggggcactgggatgccgaggagagggctggggatgcctgggcccctgtgggacacagctgagacccagcagagggtcccagggtgaggtcagcccctcaagtctgcgccatcggaacgggctgggaacttgtggtccccggccattgattgtcactgctgcaggccccgaggcgggggacagccaaggacacagccagtctccatcagctccacctgggccgtgccctgcacggccaggtggtttgagtgcaggagtaggcatgctctcacacagcagggggtaacgggcagatggaagtggggcgggcgtgggagggggccttgcacagggccagaaggagagccggtccctgaggaaggaagcccctaaggcaaagagcatgccaggggacagccacaatgccaggtgatggagatgccccaatcggcccccgaggggcaaggaaggggccagaggaggctcgtgagggtgcctggggcttcagtgacagcagccccttacctgatggtctttgtgaccttggccaagtcccttctccattccagatccagggagggtgggggtgggcctgggggagctggagcttcagaggttgaatcattcactagcaggagaagccaagcctgtgagtcagtgagtgctctccatcccagaacgtctgctcccagcccagggatgcagccacggagtgccggggtcagccgtggaggaccctctgagaatgtcttgtggaaaggggcgccttgcctgcccggtagacaggatgagggcgccccagagccccaggggcttctgagagctgagtaccctctgggcctcttgcagccagcagagccaggcagagcttcttctggccttttcacctcctcccccacctcacagagcaagtcatcagcacatatgaactcccctctgattttaaactgatggcttgtgtatttcaccaatggccactgtctccatcagtggtcagtagcacatcaagtaatgtcaacaatgataatagttataatggcagtcactttatgtcagacactgagtgctgcacagacatttccttgcccacttaattgaaacaacaacaaatgattgcaagtgctgttatccccattttgcattgcggctgaggcccagagaggctaggt

SEQ ID NO: 7895 - DNA, 1912 bp, artificial
  synthetic oligonucleotide
agtggggagagcaggcatctgtccatgagcacagagggggcgggaggaatggtgctgatgacagatgatgataagagggtcaggaactggaggagcagctggtggtgggagggtagggggagctgatgggctgtggggcgcactgagggagagactcggagccctgtgttggtgttgggtcccggcctgagagggggcctctgcctctgcactcccttcaggcactcctggagcacggcaggaacttggtggtgcttcctctgggctttgctggaaaagctttgggctcgtatgccgggttcctcgctcagaaatagtgtcttaggcaaaattcaaaaatgaaccagcaatgctcagttcacgcgattcagacagcagccaagcccttgatgaccttcgcgtcctgcagcctcggctgcagcttctgaggtaccctctctctgggcatcctcgccactggctcttcctccatcaccacatttggcagcaggcatcctgccccctcagctggggagagtggcacggatacttcggtgtgctcgttccttgggtctagatcacagaagggcaggcttgactcccatcttcagttggagcccccatttggaggtctgcctcccagatccttttattggcctctgaccttgacaccaatgcatccccccagcctgtactcccaaggactttggcctgcttccagaaaccaggatgccctctctactgcccctgccaggattcctaatggggccccatgggactcgttccctaggaggacacgtgtatgtgtcctggtagctccttatttagtcactgcctgtccaagctggaaggacttagcccagggcccacagccccatggcctccagctgcctgtaatttccttaattacctatttaggccccgacggcttccggtcctcagagctggctctgagattggaagcgggctgggacgggcaccgaggtaccacagcagagccgggccgacttggggcacctctcctcccatccacgtgctctctggctatgaagggctgggaggacagggacccggcttcccattggaccccaaacacgaggtctccgtccctttgtaggctagagtctttcacgctggccacagccacagcgtttctaggtccccatgccgtccctgccttcggggctgctgggcaggcccgggctggcaggaggggcgtggggagcacgtaggggcagggtagtggctggccaggctcacgctgctatgcagctcgcacacccgctgtaattggataattagtgtcattatgcttcctgctccctcgctctctccttctgcagctcttgccttctctggcaggaaacaaatgactgtcccccaaccctcagtgtagacttctggccccaatcacaaaggggcttccaacctccccgtgggatccagggacacccagcattgtgagggccgcctgtgtgggagacaggagcactgcgggagtccgggcaagcttggggaagcatccagagaggcacatgggttcagcccccggccgaacggaatgttctgacttcaccggtcgagcttggtcctgacctgtgaactctggggtccagctggagtccagctgaagacttcaggacaagcctcgggaggggagcgtgtggcgggaggggctgactcagcgaagagcattgccctgctcggcttcctggagatctcctgggcttgaaggaacctccgggaaaatgggcccagtcccctggggaccagcctcagggtgtgtgggcaggtggagccctgccttctcaccaacccagcaaaaaggaacgaggaccatttcgcagattaaaaagtgaaggcccagagagcttgagtgaccaaagccagcacctgcactctggaaccctgaggttgatggggacagatttcc

SEQ ID NO: 7896 - DNA, 1296 bp, artificial
  synthetic oligonucleotide
gcgcgggcaagaccagccactgatcagtcccagcacgctgccctcacttcagcgtgggttcccgaatggatctggggggcagtgacagcctctgcctccagctagctagtgttaaccactgcagggtcctggcaggaggcatcgacacttcccctcccccacctgggcaagccctccaggttctgggcacccatggtgggcaggacccgggagtggcctggctggtggggcctggcagagcatgagggccactggcccagcctgggaggtgatttctgcacttcgagggtcatggcacagactgagtgaagatttgccgagaatattctggaagatgggacctcagttttgtctcaaccactcccctggcttcttctcgcctccatctccccaggtgtccacgcttagcagctttctcaccgccgccaaaccttgcctgggcactgggaccgtgggtggccgcctgtccctagctgtggctgagccaagattgcacttgtgagaaggcctgacaggcagcatgggcgacatggccaatagttccatcgagttccaccccaagccccagcagcagcgggatgtcccccaggctggaggctttgggtgcacgctggcggagctgcgcaccctcatggagctgcgaggggccgaggcgctgcagaagatcgaggaggcctacggggatgtcagcgggctctgccggaggctgaagacctcacccacagagggtaagtccctctcaggctgcatgccacccagccctgctcccagccttcagaggagcgacctgaaggcatccttagccccaaggctggccagggtcaagggccacctgtgcccctcctctcagccatttcccttgagggggagatgccctgggtaacctgacctgaccccctcatctccacacctccacaatcaggagttctccgctctatagagcgagactggggagggggagatgggaacttcatgggacacacacacaggcggaatgggccccaaacagaaacccttccgaggaacagggcagggcagggcagggaggaggaagacagccccatctgtatatttggggatttccggtgtgctcaaccctgtgttcacttaagggggatcagaacaggaggaagggatgcagggtgcaagccttcggagtttcgggtgaccggggcctctcctgggaagagagaggatggcctggggatggcacaagccatttgggtctggcaggaaggggtgaccgaagctgggtcacgggaggcccagagtgctgatcagaggtggcactgactg

SEQ ID NO: 7897 - DNA, 1408 bp, artificial
  synthetic oligonucleotide
tgggcgccttggtggcagtataaactggggacgtttgggatagctcaagggaggagaggaggtgccgagcagggacccagggggcagctttgctgatctgtcagctcaggtccctcggcatgagatgggccagaaagcaggcaggcggtgagatacccaggggttcagcatctgcacaatgtgggcagtaggacggaggggctgggaggcagcggggaagcggagaatcagcagagggcccgggacactgggaggcagtgggaggaggtggggggagccaggtgtggggtggtggggtggtggggtggtggggtgggagagctgcagggctggtgggtaactgagagggggctcgggcaggggaggtcccgggtgcgcatcccgcccccaccattggatgaggttgctgatgccttacagcctcgctattggctcagggctgaccaggtgcccagtgggcttagtgccacacgtggagctagctgagcagaacagagtcacgcgatgtttgtgttgacatctctcactcctccaccccaacaagcacctgggccaaatgcccacaccctcgccctttgcagaaaatgatgaaagacaacaacctggtgcgccacctggatgcctgcgagaccatgggcaacgccacagccatctgctccgacaagacgggcacgctcaccaccaaccgtatgaccgtggtccagtcctacctaggagacacccactacaaagagattccggcccccagcgccctgacccctaagatcctcgacctcctggtccatgccatctccatcaacagtgcctataccaccaaaatactagtgagctggggcaggagcgggcgggcagggccgggggcaggagcaggggagggtcctggccagggtgccaggtgagctgttgcaaggtgctcattaggcccccccttgagaacttttgcccatccctggcctcacaggtggctctggctgggaaactgcctgtagctaaggccgaccttcctctgctccctgccgcccacaccctaacaatgtggtgaccacgagggggcagagctggggctccaggggcagcatggagggtggtctcaggcccccagtgcctgctagccctcgtcatcttgcagcctcctgagaaggaaggcgccctcccacgccaggtgggcaataagacggagtgcgccctgctgggcttcgtcttggacctgaagcgggacttccagcccgtgcgcgagcagatcccggaagacaagctttacaaagtgtacaccttcaactcggtccgcaagtccatgagcacagtcatccgcatgcccgacggtggcttccgcctcttcagcaagggggcctcagagatcctcttgaaaaagtgagtgagcagcagggaggtgccggggtacgcacgg

SEQ ID NO: 7898 - DNA, 830 bp, artificial
  synthetic oligonucleotide
cataacaaacttcaacagaaccattttaaccttttgaaagtacataactccgaggtttatatccctccactgtctattcccagaacattctcatcaccccaaaaggacacccagaccccgtgagcagtcactctctactccccaaaccccagcccctggcacccactcatctgctttctctctctatggatttgtcagttctggaagtttcctatgaatggaatcagacagtacgtggccttgtgtgtctggcttctgtgaggctgatttttaacgaacaactcagaggagctgagaaggaaggtccagttcagagtttctgcctcctcctgcccctgaggtgcaggagacaaggagagcagccctcactctgttgccccaaatggcagaccccatcgtcgggctgttttgtggtctggggtttttcacctcctgcgagggatttggagcacacctgctgccaggtgagagaagggaggcgggcacgtgacagcccaaagaaaacgccccactagcgtaaaggcgatgtagggatggagatgtctgttttcatgggcatgaaatcctggtgatgtggaccccatgaggagcccccaggagctactgggtttccacccccaaccttcccgggcaggcggcccatggaaaggtgactgcctcctctccataggactctcctctcaaagccgtgcagatgttgtgggtgaacttgatcatggacacatttgcctctctggccctggcgacggagccacccacagagtcgctgctgctgcggaagccgtacggccgcgacaagcccctcatctcccgcaccatgatgaagaaca

SEQ ID NO: 7899 - DNA, 1883 bp, artificial
  synthetic oligonucleotide
cagcggttcactcagtcacttgtgcattccccaagtgtctgctgagcagctgctctgggccaggctctgttgttaagccacaaacaaggcagatgccatccgggaggggcacgctggagtagccggtgagaccggaggagcagtagcagcagaagcccagcctggaaggaagggctggctccgtggcctggctgtcctttatggaggtctttggagttgagccaggtgcagtgagacctgtgcataggtttgagcaggggcctggcctgatcacatgcccccaggtctgaatgaggccaccagctcagcgagatctcaccccacacagccctggggtcaaggcctgcagcactttgtcctttttgtgacttgatgggcaacagctttagcaggcgatgtcccaggcggcttccacaccacaatcctgtaccagaaaaggcctaaataatgaggcaacatctgcattggctacgaaaactgaattctgtttcttttcattaaaaacgtcaaattattctcaatttctgtgttacccctaattcagaaaccagtctggggataaaggcctgagtgagaatagctgaccatctgccgtctggcagatgtggctttcccgaatgcagagaaaatccgaaccagatttcagatggggtgctagaaaattccaatgtggagctttttggcttacttttttttattattattttaaataggaacggggagtatcactctgttgcccaggttggtctcgaacacctgagctcaagcgatcagcccgcctcggcctcccaaagtgctggaattacagccgtggaccaccaaacctggccctggctcactttttgcactggagaggtgatgaggttggcatcatttcagctgattccgaagcactgtgctttgcctagctgagcccctggagggctgaaagaaagtcaccgaaaaaaggtgattaattgtctaaacgacagagccagagaggaaatatttttagctttccaggcctggtctctgctgccgtgacacaactgtgcccttacagcatgaaacttaaaccagtaaaattttattaaccaaaactagcagagagctggggttagcccctcagcaagccctgacaccttgtctaaacccagaaaaccaaatcctaggtcgaaccttggccccagaaatgcttcagaactcctaatgtgtccacctgctcacataggcaggggtggacaggtgttggatgaaccccagggtctgcctggcagctcagcgctccgtctgctgccccctatagggatggcagtacaaggtgggccagctaccattggcggctgtgctgacactggcctgtgcgaggccaggcagaggcctccccatcaactcctggcttctagaagcaggagggggcccaggctgaggggccagggagcaaagagaggcagcaaggacttgagtgcgtgaggcaaggtggagaagccagaggagggaagggctcgctcctggagcagtgccctgccggagggtcagggggcttaagggctgccgtgcgctcagctgggggcagagggccactgtgccgggggagtctggggcacagcgggagctctttcatgcgggaagttccgctgatctgaggtctgcaaactcctgtggggagggatggccagggaacaacacagagcggagcccgggaggcagcagagacgcaagttttggaatgtctgactggaagatggaggaggagacgggagagaggacaggcggagtgaggtcagaagagcaggggcaccagattgaaccagacccagtcagacacgggggctgtgaggaggccacaggggcatctgagcagagacaggctttagtgggtgcaaatcaaaagtgtggccatt

SEQ ID NO: 7900 - DNA, 1521 bp, artificial
  synthetic oligonucleotide
ggaaagagggtatctgcagatgtgatgacagtaagcctacatgacggggggcagggggtgccaaatctaatgacaggcatccttctgagacacaggagagacagagaggagaaggccgtgtggagatggaggcagaaattgaggaagcctggagcccccaggagctggaagaagcaggaaggatcccccctagagactcggccctgcgcacacctggatctcagacttctggcttccagagctgtgagggaagagattgctgctgtttgaagcctcagggtccatagtcatttcttatggcaaccatgggacactcatttggtgagaaaaagccccttgaaacacacaagtggtgggtgccgtggatcaagggccgccaaccacagtcaagccccagggccgctggctgggcagactggaccccacagaaccaagccacatggaacaccccctgacctggaggacaggtccctgtcagaactggctcaggaggaactcactgactgcgagggccgggctgggctgggccaccgggaggaaggctggggacacagccaaggtgggggagggacaggcagactggagccccctccagctacaccctcttgctcacaggaccgtgcctcctagccagacttctggaaagtcttcttgacagtcacctgccccaaccaggtgtcccccccttctccttcaccccctttggacagttcccttctctctcccatgaccctcctccatggcctggtgcttcagctccatgacctctggcttcaagtaagggggaggggcaggagggactgggacggcccagcagcctgttctcagaggctggcaccgtgagcaggagaaatgaagggcaaagccaggagacaccaaatgtaggttaactgcaaggaaggagggaagggaaggccatggcagaggctccattgtgcagacccaccccactgaaggctacaggctggccagagccccagcgcctcacaggcctaggagcccgggcttaccatgaagcccagtagccacagtttctggaccccagggaggtctcacggctgtacaggcactgccacccagggtcctccaggtgccagaggacaagaggttggcgagtcaggaacctgccacagccatgctcgtgctaaggggctcagaggatgcctgggcccaggtgcaccctggcttggaataacctgaccttcattcaggtaaccttccgactccccagctaggatatcaaagtcatggcgacagacacttggtcgagtccactcttctatcaccagcacaggtgcttcaatatgtgttgaatgaatgaatgaatgaatgaagaggttcagtatttcctgcagggagcagagggtggtctgggcagcctctgaaatggacgactgttgttgaggcatggctggcgtaccctccccctctttgaagggtagacggggtacccgggggaaagagccttccactcactgccctggagccaaatctcttcctcttggtcagtcttctcgcgcc

SEQ ID NO: 7901 - DNA, 1940 bp, artificial
  synthetic oligonucleotide
ctgtcgttgcaggcagggcagtaagaagccctggaaggggctcagtgacctgccacagcctcccaccgggaaaggccaggctgcatgcctgaccccacacaaggagccttggctgtccccttcccatccatggcatctctcaggcagaggcccactggccctctccgcgtggatgcggttgatccctgggacgtggctgccacctttctcaccttccccctcctctccaccttctctctgcccaggagccggccccgaggtgtgggcaggtcacgtggcaccgcatctgcactgctctcctctctggggccctcgggacccaaatcagccaccgatgtgggaagcaggtactgaggggtaatagccgctctctaaatttagacgggagaactccccagagagctggcagaaatatcccgagccttcctgtggcgaggctctcaggcaggagaatgaagagggggcagcgagaacccggggatggggggcagcagggctaagagaaggtgacagaggagaaggcccacacctgggctggggtgcacatgctctggaccacagccttgaactccaccctggtgggggcggcccacattcaaggacaggccagctcttctctgcaattccggtcgcacccatggctctccagcacccttctgcaaccaggagggagctgcctccttccttgctctggccgggtgggtggcttgccaggtgactgaggcctgagccagcagctcccctcctgcctgtcccccagcctataagaaagagccactcaagggcagaggcagttccctgcggaggggcgccctggccatggggccctggctgctagtctgtggaactgagcacatagcccggtcaccgcccccacattccatacttcagcatcctcatccagaagcaaacaagaagtgcagcaaacagcatggcttgtcctcacggtcacggcaccagtggtgggagggaggagaccctcatctgtccctggagctgctgtcaccattacccaaggggcctgcacacaaggtggaagcttcaggacagctgtgcttccaagggtggcccacgcggcgcccctgtcctggaggccacaagtctccatcagctgggactccttgcctggaaggtgactcgtggcacccacagctgtgattctgtctccagctgtgcccctgatcgctgcagggccttgggcaagtggcagcggtgggcaggagaggtgctgggtgctcccagatgccagagcagcaaggggctcagcagcctgagggtggggatgggtctgggtgcaggaagccaatggggcccaccaggctgggcctttcggtgctgggaggagatggggagtggtggagggaggcagccagacaagccaacaggtgctgtgaccgagcgcgcaggggcagaggcccccgaggagtgagatgagaaaaacccacagcctccaggagccgctctccacccccacagacatctgagccagggcaagcgctcgccacaagcccctgcctgggcctggccatggctgcctgtctcgtgtcttatcttgttacctgtggtgagacaccctgactggagaagcatgttcctggaagggggacggggtgggggatgctgaaatgcggccagaaaggcaggtgggcctttcctcctgggccaggcggggcaaaggttggggggatctgcagcaggggagccaggtggactgggaacatccttggcacccccaatctccccagacccatcgtttcacccttggtggctcccctctctcctggttcccttagccctggacgtccctgggccacgcgggaaagtcacctgctgccctctctcctcctcttcccctgcatggggtctggacagaggctccttgtctcccctcacttcccttcccctgtctagcccagggctgtgggtggctggctgtcccg

SEQ ID NO: 7902 - DNA, 7349 bp, artificial
  synthetic oligonucleotide
acagccgctccctactcgcttccagcccctcccccacccaaacgtcctggctccaccccttccaggcactgaggctcaaatgctattactattagccagaatctgacacatgagaatgagaggagacactgcagggggacctggggtgggggatggaattggcagcgctgtcagccagactttataccctcttcactgtgggagcaggaggtggctctggggcaccaagttgcgcccagtcctcaatgggccccttcgctggggtgccagtgcagattctgcgcgtaaccgtccacctagcccaggcccagcctagttcagggcccccaaccccactcccgcgccccaagcgccggagcccccactcattggcgccactggggaccggggagcgcagggcgcgtcgggcaggactggcctagagaacagaggcttgcaggtgggaggaaggcggcggggggtggggggggcgtgggaggtggagggagacgccgggcaggccgcggcccctccccgctccctccccgcgagccgccagctacagtgcccctcctgggcagggggcggagaagacggcgactggaggggaggaggcggcggcagaggcggaggaggcagcggcggcggaggcgggatttggagtttccctccgcagcggcggcggcggctgcccctcggctccaggagaggccgccacccggggttccggtggcgttaggctgcagcagtggcgcttcccgccgcccgagcttcggaaacttcccggccgcgacgcagggaaccggcgcggagaaccgagcagagcggaggtgagtggagcaagcggcgccccggggacccccaccccccacccggcctggctgcccccgccccgacgtgcgctcctccaccctgcacccccaaagtcctgacaacgcacaccccacgaagccggcgcacgcgcccctacgacacccattcggtgctgctccgcacacccccgcacgccgcccgtgcacctcccgtgtctcctgccacttgcaccggctgcacactcgcgcgcatacaaaccacgcaccacagacccgggtgcctgtagtgcacacactagctgcccctgccccaccactcaccactgtccccaactcatgccaacccaccgagaccctgccacgccccagtacacacccaggcgcacacgcacgcttccaacacgtctctgccatacctgcaccaacatagctccccctaccatgcccccaccacctcgaactccccatctgcccattacagacaccccacccacgttgccagcccagagacactgcagtccacccatcctggagcgaggtcccgtcagaaacccacatcccagtggctgacgctccccacgtcccaggcacacacctccagcatctccaacgcgcactctcatccaccccagcacgcgcgcacacctgctggattcacgctctccagcatcctgccccgcccccatcacaaatagccttcgacaccccccagcacatctctgagtccctccctccctcacccccaacacctggcacgcgggctctagaggctgcagcatttggtggcatccctgccaggcacctctggctccccttcggcagaggctcagcagccttgggccccccaggtgcctccctaaacagaccttgagactccccagcgactagcttggcctcttccctaagaaataaagaaggcactttggggtccaaggtagggtacttagatgtggaagcaaggggccccggggaggggcggggaggcggcggagagagcccggcgctgaaatggaggcggcccaggtgggaccaaaggggcgccagctgcccggcaagcacgtagtaggtgggttccatgggggctggcgtccgcgcgcgctgtctgggtgcctgcctgcgtgtgtgttacggggagggctgtgtgtgcacgtgtgcttgtgcgtgtcggggtgggggaggagtgtgtgatcggcagaaggaaaagcaggagcagctccctcaggcaacaattggtttcattcattcatgccttctttgttaacgagcatttcttccgcgagcgccgggcgcgtgccaggccctgcactgggggctggggccagcctggggccgggcacacacccgttcctgccttggaggaactcccagtcccgcgaggagaccgaccaggaaaagcagaaagccatccccagcagaaagtggatttggtggaaaagacactggatttggcaggcacgctgtcgccgggacttgtgctcttggccatgtgacccggccgcgacagccgaaatcctgtcactcggcccggcgggaacggtgcatctcgtgggggaaggcggcgcggcgccgctctcgggaggctcccgggaccagagggcgcacgcggcgcgcgcgaggcctgcaggcggcggcgtccccgcggcctccagggggcgctggcccggcccggcggaggcccggggcgcccggcgggggcgggtgcgggggcgggggcgggggcggcaggcgcagcgcccaccctgcggcgggcagcgagcgcgcggcctggctcagcccgccggagggggccagacgaggcccgggcgcgcggcgcggcctcccccagcacagcgcacccgggagcggctgccggcggggcggcgcccagagccggcgctacagggggcctgagtgggggcggcccggcgagggtcgcgggtgagagggggattagggggttggctgcgctcagccctgcagtgcggaggtggcaacaggttcccatttgtcctgttgctggcgctgcgggcgctgtgggccccgagcactgagctctgactttggaaattgagcccctcatggcctcctcccaaatgctttctcccggtgcgaggacttggcagcagggctccgcagttaggtgcaggggagcccctcgccaagcgtcgggagacgtggacccttggatcctaggcttcccctcccttccccattgcggaggttgcctctccccgtcctcattccagcccagctcctctcacctccagggaaccctctccagagagcgccactgagcagctcaggagctccctctctagccgaactgagcccccacggcagggcgggccggggaagtggctgtccagctccctgctggtcacagccctgcgccacccccactctccacaacaagactggcacatggcagaacctccgtggtgccttcaacccctgcccactctgagctcccacccacagctgcagtgggcctggaggcagcccccaggctgggtgccggtgtccacctccaccactgtggagctaggctgtggacagaaaacagaagacaaagtccctgccccaggaacacactgagaaagggggaaagtgaccacactagggagcacagaggagggagactactggctccgagttgggaaggctgcctggaggagggggcctgaagaatgagcagaatctcagaatctgggcagggggcataggagggaggcctgggctggggcccttgcccactgggtgagagaaggaagggcacagtccagctgcccaaagcccttggatgcaggaattaggactcttgttagacgcagggacatggggggtgtggccggaaagcagcccagtgccagggtcctgggagtccccggctagcagcccactgcccgaaagggagggagagaggcaaactggaagccccttagaggtgacccacctagctttccgtcacctgccctcttacctaaccatgacctgagacattttctcctctaactccatggctcctgagaggagtctttagactcgtagtttgctttgcattttccacttgttagaaaaatgctttgtggtgcccatcctcgtgtgcataactttgctttcttttactttagttccttagattcccaaaagtggtcaaagggttgggattttttcctagctcttgatattgccagattaatttccaaaggggccgtaccaatatataaccctgcaacagttgaacagcacgctgatttcacagcaatcttgccagcactgcgtgttctcaaaaatgagaacatttctaatgcagtaggtgggaagtgttacctcgttggtcattgttacttgtttattggagtggctttccttccacgcctgaagttgaaccttcccccaaatatttgttaggccaccgcattccctccttcctgcagtatgcagtgttttcaggttctttgcccatttatctacaggggtcttaaccttttagttgggtatgagctttatcttatctggcgtacattttccttcaacactgttatttgcttttgttgagctttaagcagagaagggacttttagccagatcagcattgtggacacctccccctgaccctggtctcctgcctcagtgctcaccacacctgagaccttgtccagtgctcttgctgcctgtggatctgtcccgcctgttgtgcccatggaggaaaggatggaggccaccagccttggttgagtggatggcattctgacgttgggcagggctgggcagggcagggtggagggcaggtcgttgcaggcccggaggcagggagactgttgtgcaagacgtgacagtgacctggcctaaagctgatgaatttgagccctcggctagggcaagggacaggggagagaggcgtggatgtgagagatatttaggtagaaactagttctttccactttgattagccgaaggggggttaagggaaggaggcagaggggggagccacgggtgactcttaggatcagtaatgtgataagagcagagtgccccagtttagggctgggagctcagggttcctgggtgcttttggccagtcctgtgcgagtgaagcgggctggtattggtaggtatccaggagctacccctgcctgcctagccctgcagcagacctctgggccaaagctgcactaagtttctggtcctgcctcctcctcccctccgtgatttcggtggcatcccaagtttgcccaagctgctagctctgagcccattacagagatggggccactgagatccaggcaggggagaagatgctccagtatcaccctgtgagttgggctggaggcagcttctgcggcagaggggctgggctctggtcctcacccctccccctgcctcccgaggccaggctggcgccggccaggggagccgcagctggtcccctgctgggcccctgacctgcccttggcctctgccccgaccccgtcccgcctcggtggaagccccagctcagccgactcgcaggtcccacccgactgcttcggctagcacccgttggctcaccggcccgccgggcccgcccccggagccccgccccggcccgcccctcggagttgtaactccacgtccgaaggcagtttccaaggtggaagctgggtccggctgccaggaagcggccggtgcgcgggctgcgcgggctgcgcggggctcggcttccacgtgcgagcctgcaccgccgccccgccctctcctggcggccaggcctggggactctctgccgcgggacggcgcctcgcgttccgccgtggcagtggccgtggccagaacgtccacgcgcggtcgtccaccgccggatctcgctccaggtctctttccttttgttctctcctaggggtagggggagatgggggaccgggggccagaccacctctgagaggactcgctgaggcccagcacctcggcgcctcctctgttcccctggcccacctggccctgggggagatctaggcctcgaacggcactcctcgcacgcacacccccagccagagtcggaagctcgaacttggggagcgttcgcgagaagaccgagacaggagcagaaagggggtatggagggaggcggctgcgacctcagggtaccccaagatgagcctcgaaggggcggttagccgctcagccctcttctcgaggacccttccccgggccgagctgctgcctggggggtttcttggggcgccttgttgggagtcctcatggtgggggaccctgggctcccgccttcaggacgcggggccggcttcaagtctgagccccctcggccctccggtagctcacaccgcgccttctctctcttcgcagcgcccgtggtccagcgtgtagggagccgatcgcccatggagggtctgggccgctcgtgcctgtggctgcgtcgggagctgtcgcccccgcggccgcggctcctgctcctggactgccgcagccgcgagctgtacgagtcggcgcgcatcggtggggcgctgagcgtggccctgccggcgctcctgctgcgccgcctgcggaggggcagcctgtcggtgcgcgcgctcctgcctgggccgccgctgcagccgcccccgcctgcccccgtgctcctgtacgaccagggcgggggccggcgccggcgcggggaggccgaggccgaggccgaggagtgggaggccgagtcggtgctgggcaccctgctgcagaagctgcgagaggaaggctacctggcctactacctccagggtaggtgccgcggggccctccttccagggggttcgggattcatttgaccttaggccagccccacttctttttttctaaagcgagttgaggcccccctcccctgatgacctgccaggctgctttgagaggagggaagcctgagtgtgaccgtggggaagttcttcaccctcggcagcccagtctctgagcctggaaaatggggagaattagcctgacctgagctagttctcaggatgctcaagaacgaattacaaagtgcgggctccccagggtctcggcaagggtatccccacctccccaacctgctcaggaatgagcaagggaggcaggggtcagacagcactggtgcaatcacggctcactgaagcctcctgggctcaagcgatcctcctgccttagcctcccgaacagcatataaagtgttcaggtgtccagcccggggaaatagtatctgtaaatagagatgctggcttcttgagccatattctcccccaagttcccccacatcttggggtcccacttcatccctgagagtcaggagatgcccaggcagagagctgacatctgagttcctccttttctttagctgatggccgcagtcctccctaaggctggcagtgcatctcggctctgttgagccctcacacctgcctcagcttgaccctaggggtgtaagatcctttccggtggctcagcgtgagcccagcttcttgcagcccgagctgactgagggtggctagggccccacgtgggtaccaggacacaccaagctgctgggttttgtgttccctttgggaacatttgcaaaccctccaagttgtccag

SEQ ID NO: 7903 - DNA, 1569 bp, artificial
  synthetic oligonucleotide
ccgcgcagtggccgcagcgccaagccccccgcccgcgccccgccggccccgccccctccgcgcacgcccccgccagccgcccaagcacgcagtggcccagcgcggccgcggcgccgcagggcaccttgtaaggcaatcgccgggatccggctcgggtgccggccgccaccgcccagcccactgctcgctcgcgccgcctcccggagctgcggcccggctgggccggccccagggcctttgcaccaccggtggctgtctcccggagagctcttcggccacaggtcggcaaggctctctgccttccagtctctgccttcaccgcctctccgaggacaggctgacccggccacttgcccgaaagcagcctccatgcctagctccaggaccctgcaaccctgcaccacagctctgccaccctgggctcccggcactcactgggctccctctggctccaccattaatccctcaccctcgctttcttctctacccagcagccagagcattccttttattgagatcatgtcaccctcctgcagctctctatgtcaatccaagtcaaagcatgagtccttagggggcggcctaacgactgccctggcccctcctcctccacctcttccccggccacactggcctcctgacggccctagcctttgctcccctgcctggaatgttcttcgatcagatatctgcctggcttggctcctcgttccatcagatctcggctcaaatgtcccctcctcaaaccggcctcccccgccctgcccctgccaattctctccgcataaccctgccctgtctttagaacgtccaaccgcaaaaatcaccttcttcgcctggtcttcctcaccaaagcgtccgctcccagagagtgtatctccgcgaacccaaccaagacgagcccaggaaataagtgcgggtgaccgaattcaatcctgcatccaacagttactggacccccctcgctgctcgccatccagtcccatgaggttgtggccagcatcacaagggttccgtcaagtgaccgtgggccctggcatgacacgacgtcttcaagagagtccacggggcaggaagagtttttaaaaaatcatttttccagacctcaactcccatatatactctgtgtaaaaactgggaaatctgagaaggcccctagcagctcttgccccctggcctttcccagtcacccctcccaggacactgcagaaggctccagggaccccagcactcagaaactccagtcccacctgctcctctatgtgaaaatggtttcctgggaccgacatctaaaacagaaaaaaataggaatggaactgatggtgagccccttctcatgacagcaggaagtgcaatttgtttacagatacctacagatagttccccagaatgtctaatacgccaatggtgctttgcccaagcagagttctacaacatggtcctgggttataaaaagaaatagaaatacacatatttctgtgccccagaaaagtaataaaaaactgcccgcgtggaaagagatggcacaaagagacctatctgaggggcagcagatggaaactggaggcc

SEQ ID NO: 7904 - DNA, 2617 bp, artificial
  synthetic oligonucleotide
cgccggtgccccccgcctgaccgccgccccccgtgaggcgccgcgaccccggcccggccgtgcggcccgccgaggccatggcgaagaagagcgccgagaacggcatctatagcgtgtccggcgacgagaagaagggccccctcatcgcgcccgggcccgacggggccccggccaagggcgacggccccgtgggcctggggacacccggcggccgcctggccgtgccgccgcgcgagacctggacgcgccagatggacttcatcatgtcgtgcgtgggcttcgccgtgggcttgggcaacgtgtggcgcttcccctacctgtgctacaagaacggcggaggtgagttcccccgcccgccgcggcctcctcccccagcaggccgccggcccccgcccgacccccggagccgccgcggaggggtgaagtccgggcaacgggtggcccccgggcacgcgggggtcggggccgcccctcgtccgccgctgccgctcggtggccgggccgggcgcctccacccccctcgcagtcatgtgcctggcatggtggggggagggggccggcgatgcccgcgaggctgccccccagactcccgggctgggaggagcgattggccgccgaggtgggaaagcaggcctgcgccttggggtctccgcgaggtaaggagccctggctgcccccacgggtcgggcacacaagcggcacattgtgtgggccccccacgtgtgcacacacacgaacacacacacacacaatgggccactctgtccctccccctgccctcccctcccctcgcggccctcccgcccctcccctctggcccgggcctggaacactgggtgcccgagccaggcttgggaagcctgcggcctggcccgcctggcgccgccactggacacactgcatgcacgtcccatgcccgcccgcccgcccgcccgcccgggcccagcttagcaacagcgatgggcacgcgtgtgtcctgtgactacaaaacagcactggggttgctggaagccgaagtgacccggtgatgggtgggaaacagaggtccagagcaaaggcctttgcccaaggtcaggagaaggatgctgggacctggagtcaggcaagttgcagccaagctcagcctctgagtagtggagcgagcccagccagggcaagggtaggaggcccagagaggagaagggggtagtggcacccagctctccctgcccttctgccacccccaccccagcctgctggcctcaggagataggcctgtgtcacgccctgcctatctcctgcagagcctgactccctggccttgctaaggccggcctggcccctcttccgcacctgtatccctctgtccttgcacatcgccatcccaccagcaggggactgtgacccacccaccctctgccttagacctcacacttgcaggcaagcgtccaagggcaggacagtcgcgctccctgcctttggatgagccccccaggcctgatcacccagccttggcacacatgcacacatgcacgtgccctcactgtgctgcctgaaacagggaattgcagcactagggacagcccgcgtgtctgagcgtgtgtgtcctccatggccatcgccccaagtgaccgtgggggtggaagccctgggggcctagggcccctctgccacccagggaatagggctccaatggctcaggggctactgtagcccctcttcaacacactcaacccaccccctcaagactccacctggggcctgagtcagtggccacccctacactgactcacccagtcggaagttgtgatggggcctttggagtctgggctggcccgctgggcctgggcagcctggctgggggccaccctgagtccacgctgtgcctccacccccaggtgtgttccttattccctacgtcctgatcgccctggttggaggaatccccattttcttcttagagatctcgctgggccagttcatgaaggccggcagcatcaatgtctggaacatctgtcccctgttcaaaggtgagcagcccttggccagcctcagggactgcccccttctcccagctggctcccacttgagaaatcttttcctgtcgtgagcaccaggcctggggccacgtgatggcgtcccagtctcgaggggggagcctggaggagatgttcaggccgcacagcgaacttggggaagcggggactagagggggcataggcagctccacaaggcaaggacaggccaggcatagccgggctggggacgggacctgcccagcagcacccttggctctctaggtaggtcctactgttactatccccaaggacgctggggcacagacaggtggagcgacgtactgaggttgcccactgcaggggcgactgtctccaacactacctcaggcgactagaaaccccccccccccaccaccaccatcaacaccagctgctgaggactggaggctactgggtggccaggcagaggcttggacctcctggaaccgccatggtggcagtgggacccacagaaggggccaggtgtatgaggctggagactccacagcacttggtcagatggggacaggaggagaggggctcgctctgccttgggtctagggggcggctggaggagagga

SEQ ID NO: 7905 - DNA, 1691 bp, artificial
  synthetic oligonucleotide
ggttcctcctgagccccattcaaaccacttagcctcactggcctgccggctaagcatggctgcattggggttggaggcgcagggtgctattggtctgttttcagccagccctcgagcgtgcgtgcaaggcttgttactaatactttggcacaaaatgggcagcagcgggcagaggaggctcctctggacttccctgcggggaaggacacgaggtcgagcctcactttgcttagtgctggccagctcgtcctttagcttctgcaggtcagccttcaggctcctgttctcttcctccaacttcacctcagcattcccgacatccaacttgcctccgtcaacagcagctccctgggaaaagtgccaaaggccagggttactcaggagggagggagggagaggttccagccccatcctccccaccgagctgcggttcctcaagctgccctggccacacgccccttcggaaatgtcaacgcggaaccgagccaccacttgctcccagctcctaggcaaaggccagggcgtggctgcccgccgagggaaagagaagcgccagcggggccacctgctgcagctcgccgggcacgccttgcctgccctggcccctggcccctggcccctggccctgcctccttcccaagcagcagggctcagcagctccatggtgctcaccaacccctccacagatggcggtgcctcgtgctccctacatggtgccgctcactgcagttaggagcccccagtcggcctggccagctctatcccacctctgcatccacatccctccgagcttgccttgcagctcacctcctgacgggacgtctaagactggccaactaccctgcccccacctcctctccagcactgagggatgccacagaccccgagttccagagggggtgcggcaatcttgcagggaacaagggcctagctgagggccttcggatcacagcagagggcctggctcactgaggggccatttttctcagggaagggtctaactggaagcagtggatggaaacgagagcagcaacaccctcctcctcacccggaccctcacacacagacgcctccagcaggcatactctccccactgaggacttcccctctgcgcctccacccaactctggcttttcaggcacatttcccagcgtgacaggctagcagtggccactgaggccctgaagaatgtggctcccacagtgtaacaccaggacgccccatggtgggtcgggaagctgggctcaccttcttgagctggtcattctcctccatgtacttcttggccgcctcactagcactctccgcctgctttttaaaggcttcattggaggccagcagcgtggcctgctgcgaaatgagagtcaccaggcgtctaagcaggctgcaattatttacaaaaagaagggagaagtgagaaaaagagcatgaagggctggcaggagcacctcctggttgctcccactccacacctagctccagcctggacctgccctcttgccaaggcagccgagtgagaagccgccaacctggtgctggcagcgtgagggaaaaggtggggcccaggagccgtcctctgccgctgtgcccaacggccaccctcagctctcagaggggctggaagcaggagcctggggggctgggaagagcctcgctacagcatgaggtcccagaacgcggcactttccggg

SEQ ID NO: 7906 - DNA, 615 bp, artificial
  synthetic oligonucleotide
agccccctaaggcttctatgtgtatgtgtggatagagccaatccacatggcagccactcatgtgggttaggaccacacctaactacactgttctgccagcaccttccccacacttcggcatctggtcgttaagaacagactcagactggcaagcatcatgctaaaaatccatctacactccatctatagaaggctgacagaacttctccaggaattcacagcagtcaccaatgatcccgctcttcttttccaaaagcatacaagctattctttctagagcatggctggagatcaaagtcaaccctccccaggtcaattcctcatctaccttctcctccctttggaaattgggatgtttgccaggctgcagtctgccagtatctctcccactctgcaaatcctcaagcatcggtggcaatgccttctgcagatgatctcaacagcttctggacataatctcatcaagtacatcctttagggatgccactcttgcccacctgtaatttccattttctcatcctagtgtttcctttgcccttgaccacctaccctccatctccttccttacacagacatataaaagggactgccttctcctcacttctccatgtcttt

SEQ ID NO: 7907 - DNA, 1573 bp, artificial
  synthetic oligonucleotide
aaagtcacctcatgatccaggagggctgctgcagccctcacatcatgtcccaggctgtaggatggaggaagtagaagggaaggggcaaaaggtatgtgccttcttttaaggaaggttccagaagccgccatattgaatacttacagttatatctcattggccacaacttagtctcatgctcacacctcatcacaaggccacctgggaagcgtaatctctactctgggtggccatatgccctgttgccacttctagccctgggccgctggggaaggcagcatgggcgagaagacaggaagggccgcttctgccgcagcgccccgacctaatggagcagccggctcacctgctcgttcaagcagcccactcgagccttgccaaagtgctgacacggggcagtgacaggaggcccaacccctgtgggtgacaagcccccggtctggggagagcactcaggccgctctggagctctgtgccaaggaactgtatgggtgccctggggctgccataaaccgcagggatggattgtctcctagatccagcagtccgagatccaggtgccagcagggtgggctccttccgggtgccatgacagaaggatgtgttccaggcctctgtcctcggctcgcagatggtccacttctccctgtatatcttcacctcatgttcccctgtgcatgtcttctgcccacacaccccctttttatgaggacacagtcatattgaattagggtccactctgatgacctcatcttagtgtgatcacctctgcgaaggccctgtctccaaataaggtcacactgaagtgttggggcttggactccaccgtatctcttctgggggaaggcacgattccagtccccactcctccatgattaatgcctgtcagacagacaaggacgcagaggcacaggggccctgtcgtcacagctagctcattcccgcagctcccccagctccccggctggcccccgggtctgggtgctggtggaactgagccaagaccattgcccccgcctaggttgggaggctatgtgtgactggaaggacgtcctgtcgggtggcgagaagcagagaatcggcatggcccgcatgttctaccacaggtgagcactccgggccggcaggctccctggggtcccctggaaggggaagtagcagctgtggggaggcctgggctcagtggagcctgagccgggctggggtgttgggccctggagggtgcacagactctcctctcggcccggacccccaggcccaagtacgccctcctggatgaatgcaccagcgccgtgagcatcgacgtggaaggcaagatcttccaggcggccaaggacgcgggcattgccctgctctccatcacccaccggccctccctgtggtaggtgccctgtctccctgcctggggtcggtgggagtggctgcctgaggggaggaggtggcctggcgggcccggcagcagcaggcggctgtcatcagcagcccccgtgccgtgcccctgaccctgtccctctcctggccaggaaataccacacacacttgctacagttcgatggggagggcggctggaagt

SEQ ID NO: 7908 - DNA, 1621 bp, artificial
  synthetic oligonucleotide
ctccacctgtggtcggccctgaatgccccacagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggaggtgagggccaccttcaaccctgccccgccacggtgctcaggccgcctctgtgggggccagcagcttaggctcccatgtgtgtcccagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgagtccgtgccctgggtgggcaggtggaccgggtgccgccagcatgcactcaggaaccctgcccgccccccaggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggtgagacccgcccacccccagcacacttccctcctcgccattggcaagggcgccctggcaggcggctggcctggccccggccctggctgatgctggccccggccctggctgatgaagctggccccgggctgcaggcacaagagcaagcaggccctgcgggactaccagaaggtgctagtgcagctggagagcctggagaccggcgtgggagaccagtgccgcaaggagttcacaggtgggtgcggaggcggggggacagggtacccacgaggcctgaactcacacctcggcgcctcctggccccgcagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacggtgagggccgtgtggcgggagtgcccagtgggcaaggaggtggggctggggaactactggcctgagacaaaggtgggggaggagtggggcttcccaggatgagcctccgacccctgctcagctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggttggccttgacctggacccggtggcgggggtgagggcttgcc

SEQ ID NO: 7909 - DNA, 2225 bp, artificial
  synthetic oligonucleotide
gccgcctagcgggggaggggggcacgcccccgaggtgggggcagcggctcgcccctcaggttaactcttcgctggccgaggccaggcgcgggcatgctccctcgcacccggccaggagaaaaagggcagcgggggatgggcgggcgcgccgggcgttgccaggctacggccccccagggagcgcgggggcgcgccgggccgccaggggccgtcaggggccgtgggccgcgcgcctccccgcccgcggggcccgccgctgccgctgccgcctccggctcctgcccatggccgccagccccgggagcccggccctcgcgctcggcgccgcggcccggcccgcgacaggggggcagcggcgcggcggcggcccccgcccgcggccaggccagcgcccgcgctcccgcctcgcccggccgcgctctcggagctcccggcgcccgctcttcgtccagcagccgctggccgtctccagctcccgcccgggacgacgggcacgcgagcgcgcccacggcggcgggggaggggcgcgggcacggggcgcacgcgcgccgggaggggcggggaggggagcggggccggctgcgggagggagcggcgggggcgctggagccggcgcgggaagccgggggcgggcgctcgacggaagcgggcgggggtcctaggcaccccacgacacccggcgtccggtcctgaggggcgggcaccaggcgcgttgtctgcgcgatgccgctctgggagagaggggtcctgccaggaggagcagtctcctgggtcccccagagagagtccgcgatttcagcccctctccccggtcttggacgcagcagccctcacgcctctgctccttcctcgggcttcgccttaaatgactgcatccctccttcaactcagccattccctgctgtctttgaaacggacacctttgtttaaaacaagaaagaaagagagaaagggaggaaagaaaagaaagagagaaagaaaaaaggatgagcgaagcgtggggagggggtgggtcgtggggagagtggcctcggaggccttgggacccgggcctgcacacagcactggccagcctgggcccgccgcctacctgttcctcagccccagccctcacccggtccccgctttcacagcccttccatctcttcctcttctctcccaccacctccccgtcttcttggacaagcctggagggagaaggcctttgcctggaaagcagcagcgggtggaagtctgcgttcccagaggctgccccggctgcaggagatcacttggagaaattgctacatgcttcatttccaggtttgggcaagtgagggaacccccagccacacggggctgttgaatcggagcccttcctttcctccctggctcctcgttagaagagaaatcaagaatggcgggcctgcccagaatgtggagaagagaggcgagtttcttatccagggcttctcccagaaagcagaacttgagacaagggctggtgtgcaggttgcaacctgccacccaatggctggctagtcttgaggaatggcgtcatattgagggctcagcatcggtctctgcagctggtggatggaagaacattcactagcggcagtgtctagatgagccgtggtaagaggaagcccttgccgttgggcttatacagagcctccagccctcccaccatggccactggcatcgtgggtccatcgcatcctggggagaagctggctgacctccaccagatggtcccctctgttcgctagcttctggcgcgccccctccacactgcatgctccccagcggcatgggcgcgaagacgagcacggggccccacactctccctgagcactcccgtaggtacctcttcgccaaacctgtctcttcttccaatcttcctccacccgggtccctgaccagtcagcccagccattttccactgcccgggggtcatggacaccttcatctcaggccatttctccctctacaaagtagacaacctagtgtcttgctcccctagaggatgtcccctcactgctgtctctcagggccaccctgcaaagggcctcagtgtgacagcaggtgtttttcctagtggtgacatgagatgaccagtcgaggacctgggtctgagtcagtcatggggacaccccatcaccacctcccatgaggccataggtgtgagctgaaggggcataccagtgtgaaagagccgggtgaccgggggtctggactgcctg

SEQ ID NO: 7910 - DNA, 3682 bp, artificial
  synthetic oligonucleotide
gtctctgctctcgacgcctgggaaggggtctgggcagggtagaggtgggagccaagctgttcttgaggaagcctggagttgtcagatggacctatggtgggaagggccatgcctgagggtgaaaggagtcagggagagagtgcagagcctctgagactcactggccttgacccggaggtcaatgggttccttctgaatgatggtcctggtgcctgggaagtgggcgtggcagatgtagtctgagtggttgtcggaggtgagcacattggcaaagtagaggttgccgttctggcccatcgtcacccgctcgtcctgcttgatgtgcaagatctctgcagggggcaaggaggccgaagtcatgaccccgtccaggaagacacccccgctaacaccccgaccccacgaggcagccgctcgccggcacccactgctgttcatccagtagatccggagaggctctgcacttgggggagggttgcaaggcagaaccactgactccccttcctccacctccacgggcttcactgtctcctttggccacttgggggcacctagaagggacagacgggctgacactctcctcctggtccagatggtgctaggcaggagaagggaggtgggggcaggggggtggcgggctacaccagggatggacgagggggcgagagggtcaggccagtagaaacttcacagaaaaggaggcagacactctggataccttctggactcatagcagagactagcacttagggaggccagggtgagcaggagaccaggaggccaggaagggttaaccttccacggttctcagctctccctgcccaccctaggaaaggacgggtggggggaggctgaggctgaggtgcagtgatgggggaggggagctgtggagggatgcaggagtcacagacccttccatcatcctgacacagaaaccatggcaacggttcccaaggtaactggaggggtggggaggggagaggagagcgctcaggaagcagaaagctcagggaggatggaatgcaaagggaaaaccccagggaaaaggcgacacagatcaagacagagccgtggagcaagagagaccaagtcggaggtggaggggaggagatggagagccaagtggaaaagccagagaagaggggccctgctaaggagtgcaggtgtagacagagatgactgcagtgactcaggcaggtctgcccagaatcagtcactccccccaccagcccgcccccccctccccccgccaccttcctgctcagccatgaggcaggcaccaggaaagcctgagggagtgaaagggcatgagatgaccggaagtgcaatggagacagagacagggcaaaggaggagactgcacaagaaacaagatgggccaggggagaagctggggtggggtggagggctggcaggacacccaggcccctcgccacgagacaactggctgacagcagcttccagcccacaatcccacacgaactccgggacctgccctccctggtccctgcagcgcctcgcaccctcggccatgagccggatctcatgggacatggcggtgcccagcttattgctggcaaagcagcggtagatgccctggaacctctgagcaaagttgctgttgttgcccgtgatggtgaaggagccagagtggggcgactggtacacggtcacacccagctcttccttgggtttgaagtggacaccatccctcgtccagcggaacctgtgggcggaaaaaggcccagaggcctgaggccctggaacccaacgggggctggaacaggctggagggacaggtgcaagcagccagggcccccaggggatggactgggagatggcgaggacttggggtgattagcaaggtttggggcttctgggcttagaagttaggcagtccagggaggcacaaggccggggtcagtggcaggcaacaggggctgagacggcagagatcactcactgcacttcgggcttgccactggcctcacacttgaggctgatgtcatctgtggggaagacaaccaggcgccgtggagactgttccgtgatgacaggtggctccatcactgaagacagggtggagagagcggtggtgagggtgctgcctggctggtgtcatagcctcagcacctgtcccatcgtgagggaagcagggtccagagcccctggaggccccatggccacagggggacgaacggaggggaagaacaaaagaggcttgtgggacatgaaaagagggagagaggggacagccacgtaagttacaaagagatgcctgagaaagacaaaaagggtatgacagaaagaagcgggggcaacaaaagccaagacacagaaaccaagaaggacaaaccccagacaggggagaagggaccagagagaatggcagagaggaacagtgagggtgacagagtacccaggctggggcagagacagaacaaagccagccccacacaggtgagagaagcacatggtgctcagggagagccgagcagggccccggcactcaggagggcgggggtgcaggctcagctgagggcctccttacccttctccttggccttctgggaaacactctcacccctccccaacttaccatggtgtccttcatctgagaaatccaggcaggcagcaagggagggaatggagagaaatactgacaggcagccccagagtggggcagatggcaggggacatagtaagctcctgcagcccccccgtggagagggaatggcaggagaggaggccctggcagtggcaacaagggggcacacgctgggctggagcagtggcaggtcaagcccagggagatgggacagagagatgcccagggagaggagctccactggatagacacacagggcatgtagcccagaggcagccaggccatgcctccagctctagcagacagggagagagaaattcttgcctttaacaaggagtgtccttgcagccccctggcagggcctggcagggcctgcagaactgaccccacccattcaggatgccttggaaggcaccgtcccctgctccagcctgcttccctcctaatccaattagcacagctgagtgttttcaattaccagggcccagccttcagagccctgctgccccctccccctgaaaactatcccaaaggccctgctgcctctgagtttccatagcctgcggggttggcgccagccctcctcttctccctccttcctcccagacagccaccaagctctctggggcagaggccagagctgctgtcccagccccaggactctgcagagcactggccagggcggcctcgaggaagggagaagagggagggagggagcagcaggctgcctctgaaagctttgtctctgcagaagacctcagtgtgaaggtccagggagggaggagggggctccctggggacactgcagagggccctgagctggggagggagatggtgacagggatgacaggatgcagaaagccaactaggtggaggaagcaggaaaagagacaaagggggctggagtggctggggagggagagatggaagacaggttccaacagggagggccggctgcctgccactgcccactgtgtcgtatcagggtcaagaacaagtgctggtcagtgaccagggcagccttggagctgccatggccttttggcctagttctctctccccactcccatcttt

SEQ ID NO: 7911 - DNA, 1240 bp, artificial
  synthetic oligonucleotide
aggggtggggttttagagggcgtggtggctccctaagctgcctctcagaggctctggcatcccaacatgtgtgcctgctgggcttcccagggaaccaggggcctgggcgaggatggcctccaagccatcctgccccgtggggagggcttacttgccaggcagatggcaggcaaatgtcgggggcagggagtgacatcttgggatggaggccatgcggaagtaggatgtgatcaacatcacgtctcagcacagagctgaagcccgacaccaaacaaacccccaagtcccccatccaggtactcagtccaagagaaggccaactcctttcccttttgggcttggggacaggctggtttcttggtcccctcttctgctctctggaatctggacttgttctgatacctttcttgcaaccagaggctccagaacccctcccaaagaggcccctctccaatcagcatttagggacagcagtggccccattcttgtgtcgaaggagatactgatgcccagcaggcggcaaggcttcagcctccgagacccctagaaggcgagagaaatgaggtggcagcaaaactagggctcctctcaggccccaggcctcctcagggagctaggatgaccctagcactagagggggcttcagcggccaggccagaaggaacagactgcatccagttcctggggctgtggcctgaaaaggagagcagggaaggagcccagcctggggcagggagaggccctggcccacagcagtcctgggatacctagcctgtgttggtttgcggggggcggggtgggggtgcctggaaacagctcagacactgccaggccccacgggccccctccaggggccccactcccgaggggttaaagggcagagggggacacaggaagcccgggggcggacaatggggcctctgtgatccccagggcttgggcattcctaagtcatgaacacagacgcagatggctgggagacagggccacagggaacccccctccactgaagcacagcctgggttggccagaggctctgtccccatccagccactgcagcagccaccctcagccccaccccttcccagcacaggccctgttggggcatctgaggagacccacgtggcctcatgacaatatgtgtgtgcatgctggttcacgaacacacacacacatgcaaccaaatatatgaccccacccagacaaacaggaatactggaggttacacacacacaaatac

SEQ ID NO: 7912 - DNA, 2541 bp, artificial
  synthetic oligonucleotide
ggatcctgagcgcctgggtagggaagctcttcactggctgcagggcaggggaccccgccaccttgaagcgctgattgtcctcctgatgctcagcagggagctggcagctgggaacttggggaggagccttttaggagcgcggtgtagcaaaccagggaggctggggcgtgctgaacgtgtttccctcttggtgatcagatcactagcgattcttaatttcttttgttcttttctgtatatttcaagtgtcctacaataagatgtattactttcgggatcatacacacacaaacatcaataaatatggagagagactcagatgcagcagagagaaatgaccaggagccaaggaggtgggaaggtcccaggcccaaccctgccccaaacttcccatgtggccaagacagccgagtcctcaaaggctctggagccctcaggtgtgcacatgtgggcactgcatgggagctgtgccaggggagaggccaggctgggccaagtcccaccacctgcagcaaggagctgacgggaggggagaggccctggggaggcccccgccccagaaagatgatgctgggcagcagcccccaggggaagaagggcggactgcactgatttacgtcagggccacatgagtcagcagagatggcactgggctgccccgatgcccctgccctcagggtggggttaacaggggcagggtatctacctggggggtgccaggcccccactccttctggagaagggggcagatggctctaggcctgccttcctgagagggacagtgataggtggggggtccagataccctgtcgggggcaatggattgtagtgcgtgttctttgcaatccctgccaaccaagaggccccaaaagtctgacctggaatggagggaataggaatcgctgacccctcccataaccgcacagagataggaagatgtggcagtgggcaaaagacctgcagtgcgcagggaccgcctgagccagtgaggcccaccttccctcacccctacctgatggaccctacctgatggacacccatgcacgggaggcacagcagtgggtgcccgaaccgacctcacccactccagccctgactggccacagagcctgtggaaacgggctccagaggcgccctacgcctccggggaggagcccctggctctgcggcaggttttcgggtgagcccggaggagcccaggctgggatttggaaagaagaaggaggagaacaaagcccccccaaccttggggcggaggggcaggcagcgcccagtcccgttcactcccctccccccattgcaggggcggcttatcccgatctacccctcaccacgctgtcagccgggattttcaaccaaactgagctctcggctggggatgaggggcagccacgcccagggccacaccccacggcggcctgtgggggagcgctcgacccgatctggcttcctttctcagacacgcacacacgcacggggacccgccaacttcagcccccgcctgcccacacagaccctgcctgacgccccccgccctgttctcccgcccaggccagcatctggggccccgcaggttacccctcacctgtcgggctcgggcacccggcatccctcccccgccccgcttacagcccgcggtgcccggagcccgacgcccggcatgggtggggctccggcagcaacgccggttaccgcgggccggaccgggccgggactccctggtccgtgcaccccgggcagagcggtgtggtgtcgccgggggatcgcggccgcggcccgggtcgcacggggaggccagcccgccttacctgcgctgcggccaccgctcgggctgcccgcccagcctccgcgcacgccggcctcggacccgccgcccgagcgcgtctgcgatgccgatgctgcggcagcagcggctgtggcggggcggggcgggcgtgcgcgcaggggcgggggaggggagcgccggggaggagagggagggaggagtgagatcacctccccggccgcccgccccgccccgccccgccccgccgcaccctagcccctggtgccagccgagcgcggcttgggctgggggcccccgggcagcccactccgggagctcagcgggaccccagccgacgggtcccgccagacccccttccccgcagaccgggagtctccggccggagagtgtcctcagccccagcgcaagggagcccgctgtgaaagctcggagcgggaatcgcggggcgagagtgctcccagaggcctggggccgggcggtggagagaggagtccggcaaggaaggggatgctcccttagcctcggcctggccctcgacggcgccggccagcgatgggcacctgcacgcaacgcccccccaacacacacacacagggcaggactcccgggacctctcccgaatgccccccgatcctgagggcccagtcagggtcctgttgggaggggtgcgggggcttcgtcctcagcgtgttggggaggcgccgcggagcaccggctcctgcgcaccccagagcccaggtgggcggcagggtagg

SEQ ID NO: 7913 - DNA, 1760 bp, artificial
  synthetic oligonucleotide
actgcccaccattacagtgaaggccagagaatgccaagcccagcagggggtgaccctcacctcatccccatcatgggggtggtagtcaaagcgcagcgggggacagaagacggtagcatgcacctcgagaaccttggctttgtcccctggaggatccagggcctccacagcttcttccaggctgcccaggccctgcacttgggaggcttgggtgcggctctcagcggccgtgtagctccggagcacctgccccagggccaggtggaaccctgtgtcacagcactgaggaggaaacaaggagatgcttgggtaggtcctggagccacagcttcccagccccgaggcaccaggcaccttttcccacctgcccaccaaggactcacgtccatgaggtccaagacgtcatgcaggtagtagttactgacagcagcgttgacactagccaggctaagcaggtactcgttgcgcgcctttgtgcacttgagtttgtgctccatgaacttggcctgccgctactcaagacaatgcaagcgtgccagggtcacgcacgtggccagcccctatctctagcctttcatgtaatgcccatcgcctcccctcccactgtggacaactacacctgaactggtcaagcccagaagtcctgctgccttccccacgccacagtccacagtgtgctcagcccagtgccaggaggtgacttgattccccggctgttcacccgccacttgccttggttcgagccacaacattccccacagaagtgggggatgacacagaactattcacagatacctgatgagtggaaggtgcgcacatggcaccccaccatggagggtgcacgagaaacccagcttggagccagcacacaggtgcacagctggaagcggccacaggcctctgcgggggccagagctgagggggaacgagtaccccaaagggtagggatagatcatcaagagccatgaaacagaacctgctggcacctgggttctaaaactggcactctattttttttttattttttttttttgagacagagtctcgctctgtcgcccaggctggagtacagtggtgcaatcttagatcactgcaacctccgcctgctgtgttcaagtgattctcccgcctcagcctcccaagtagctgggatgacaggcacccgccatcatgcccggctaatttttgtatttttagtagagatggggtttcaccatgttggccacactgatcttgaactcctgacttcgtgatccacccacctcagcctcccaaaatgctaggattacaggcgtgagtcaccgcacctggctaaagctggcacgctaaccacagcagccagggagaccttcccccaacacagccaaactctgtcatttcccctaagaacacctgagatgctcgactccctcctctgctcccagagtcccagagaccatgactgtcagccacgcacagcctggcggctccatccaggcatttcccagcctccccactctctgtactgggctcacctcgaaggccctttctccgtgcgtgtcaccccatcacccaccctaagtgtcttcttgcccccctctgaaaccttacggaatggctggcagaacagcagagctgcaggggccccgctgggagcatggagaggctgcatggggctgtccagggccaggcaactgttttccccactctctcaggccctgggagccttccgtatggaatccctggaacctgatggcactgtcctgccactcctgccctcc

SEQ ID NO: 7914 - DNA, 1946 bp, artificial
  synthetic oligonucleotide
cgacagagcagggcagagcccacgatgccaagtgagacagatggagagtgtcttcatcctatccgaggctggcctcctgtggttaactcgtcagctccaaggccaggtggggtgggcgctaatgccatttgaaatcaggagagtcctcactgaatcagtttaacgttttgttttgattttttgttttgagacggaggatgttgcccaggctggagtacagtggtgcgatctcggctcactgcaacctccgcctcccgggttcaagcgattctcccgcctcagcctcccgagtagctgggactacaggggcgcaccaccacacccagctaatttttgtatttttagtagagacagggtttcatcatgttggccagactgggtcttgaactcctgacctcaggtgatccgcccgcctcggcctcccaaagtgctgggattacagacgtgagccaccacgcctggcccagtttaacattttttgataaaagtaaatttcatttcattccaagaaaggtgttagacaactgctcgcctcactggccctctggagcctgccctgccctgcttcccccagaggaatacaatccctggggacttatgacaactgaacagtgcagaaggaaccagcagagggaaccgctgcctttcttcatcactgccggcagcaaaagctgactggaagccatgtcctagtccagatccgggcatgcacaccggctggtgttgagcaggcaacttgtgaattgcaagtcgattgcattggtggctttcctggcagagctttcggatctcagttcagacaaactcgtcagcacaccctgtcctgacctccccctaaactagggctggccctcttccgaccccttcttggcaccgtgcactttccttccctttgtagtgcttattatcataatgcaaagtctatgtctcccccactagacccgtgagccatgtgagggcggggtggccactgacgccatttgaaatcaggggagtcctcattgaatcattgcttttactctgggtaaaaagccagggctggaggggctggagtcggggttctctctggtacagcagtatactcccagggcctgggacagcacagatgtataggaaacatctggcaaaaggagagctggaatccatgtctgcctgaattacagagctgggccccgggccccaccagcacttcctgtgagcaaggcatttggtctcacttctgctgacaagcaaaacagaagaaaagatggtctccaaaaccaccgctatgctgacctttgagaatttagggtgtcaagacagtgaccccactttgtagaatggtaggaagcttttccagggtgtgggatgcagacccagagcaagtgaggaacccttagacagtcgtgctcgaaaccccaacttttcagtgtgaaatcactgacccatatttgctgactgaagttttccaagtctttcagcttcatggcattttggggaagcaggatggagatcattacctccatctgagcaagatgatggcgaggcttggaaagctggctcaccctgtgtagtcacctcaagctggctctggacacaggctgccttttccaaaggaggactggagcatactttggtataaattgcttgcactgaataatgatgttagaacctacatctctgggttcaaaggcacttcaagggtcattgcattctacgtcctagaagttgcagtgctgtatgaccacgggcaagtcactgcacctctctgagcttgtttccgtaattggtaaaatggagtgattgagagtgatatggacgagctgctggcactgagctgctgcctctttcctttgcaagagttaccatgccctgaataagatgggcacaagctattggctaagaatttgcaaagctgatttgcatgtgatttgcacatgggtgtttatcagaacccagaggttcaa

SEQ ID NO: 7915 - DNA, 305 bp, artificial
  synthetic oligonucleotide
gggacggacggcagagggcgggccgggtcccatgggcctggccggggcggaaggagggcgccgcgggcgccgtgggagcctgggacacctcccttccaccggtgccggggcgcggccgacgcagtgcgcaagcccgcccttcccccgcaccctgcgcgcgagcccagtgccgccggaccaatcagagcctgggaacgaacctcgccgcgggcttgcgaaccggaagacactgccgccaggcgcggggcgggacaggactccgcctccggcccatacaaagggaagcccacgtcttaagccaatca

SEQ ID NO: 7916 - DNA, 799 bp, artificial
  synthetic oligonucleotide
cagctgctgaaggtcatgagactagggagtcccacctccaaagctctttccttgtactcgggcctggcaggatgctctgggtcaaaaggccaaggctcacatccccaccagaggacctggagaaacacaccctctaaatgtgcgcgcgctcacacacaaagttccccagtgccacggagcgaatttattgtgaaagctcgtggggtgaggaggggatggggcaggctctaggaggctgagtcggaggcctctgagctgtccttgacatctgtgctctctgtggtctcgctgacctcgctgaggtccttgctgtccccaccactatcctcggcagccaggcccttctcctcgcgacaggcctctcctgagctcggaggtgaattgcctttgctctccaccttgttctcgatggcacccagcaccacgtgcctgcccttctctttcagctccaggtgccgcctcagctgccaccaggaacccagggagaagcgggggcaaagagacagggcctaagtttccagacaaagggagcctggccctgtcgctggctgaggagaggggcatagtgaggcagcagggctaggcaggacacgcgggactgagtggggacacctggctggagccccagtccaccgctacctgggcttaccgactaccatggaggcccccacgacagagcgctgccccttgaccagccctgccacccgatgagccttgggcagaaccctgactcagaactacctttgagcaggcaggccacccactggtccctagacctccccacttcccttctaaaagc

SEQ ID NO: 7917 - DNA, 2555 bp, artificial
  synthetic oligonucleotide
gcgtggaacacagtgaaactatcctgcgataatatgaaggtggacacatgtcatttggtcaaaaccatggggcttacaacacaaagagaagtgcagtaatgtaaactatgggtttagttaataataatatatcggccaggcgcagtggctcacgcctgtaatcctagcactttgggagacagaggtgggtggaaacacctgaggtcaggaattcgagaccagcctggccaacgtagtgaaaccccattgctactgaaatatacaaaaattagccaggtgtggtggcatgtgcctgtaatcccagctactaaggaggctgaggcaggagaatcgcttgaacccagggggtggaggttgcagtgagccaagatcacgcgactgcactccagcctgggcgacagggcaagactccgtctcaaataataatagtaataataataatagtaacatatcacattcatttatcacttgtcacaagtggaccacacaaatccaacatgctactaacagaggaagctggcagggaggggatgctgaggggtgctataagaactccatgtcctttctgttcaatttttctataaactttcaactgtactgaaaagaagaagcctattcattttttttaaagcccacagaggcatccaccagacacgtgtagcttctgtcttcctccttggtgactcacattttggccaggacataccccacaatcttcccattctcgtcctcagcaatgtaagagagctggtgacaggaaaacagagtgagaaaacttcttgtcggagctagaagagccctttagagggacacaaactggacgagtggcgagttgtgtgatggctcatgacctccgggctgagtggcttggtctccccctcgccacactgtgccctgcccatacccagaaagaagacgcaaagtggggatcctgcccctattctctgctcccttcgggcgccttcttttcctttgcccctgtctgccagctgaaaacacccaggacgccaccgaccatacagccccctgggctctgacagacttgtccactccctccaagatggccagatgggattttcctcggcctgctttcccccatgcccaaattcagaagctgcccacctggggccaggaaaggccatggtagaagtagtatttcatctggtagttctcgggcaggcagaggaggttgcagtgctgcatgttcattaggtcctctggctgcagggaaggagggcagtggaacgcgctcagtctaaggcggcggtgaccacgggtgagaagcctgctccccgtcggtctgctcggccccgctccctcggggctgggcaggcactgtgacgatctgactttgcacaacgcccggagcacaggaacaggagtgggcgccccggaggtccccggagcccacccaacggaggcccgacatcacgcaaacaggagggaatcgcagccccggccccgcgccccggcctcttcggcgggctgggccagccccataggtccagcggccgcaggcacactcagggccaccgggccgggctcggccggggccctcgggagcatgcgcggcagccacccggcccggcgcccacgcggcgcggacagcctcccgccccgggcgctcaccctcgcattgcggatgttcataacggcggcggggctcgcgggtcccagcggatcgtgaaggcgcagtcagctgccgccgcgctccgaagcgacgccgggacggccggggctgggaccggagctgggctcgctgggcgacggcggaaggggcggtgcgcgccgggccggccaccggccggaagtgcacggccgccgggcccgtcctcccggccgcttggccaatgcgcgggacaggccagcgcacggggcgggccaatgcgcggagccggtcagcgcggggcgggcctgggggcggggcgggcgctgccccggagctggagccggcccctccctcggcgcgacagcccccctcccgcgagcccacagacgcgcgcacagccgcaggtggagcggactcagcctttattccgcgcctcggcaggcgggggtgggggcgggggagggggcgggggcggggcggctcagcagggcgcccagcatctcctcgcacatggctaggcaccgcggcacgtggaagcagcctgcgggtagaggcgggcaggtagtgagggccgggggcagccgagaggcgcaacccctgcggccccgccctctcccccactcacctttgaaaggacctcccttgatggagagggccaccttgccctctcggctcaggtagccaaaccattccccgtactcgggatcgcgaaactggaataacagagacagtgacagctagcgcctgcaggacccgcccagatgccactgcatcgctaccaggggtcagagcctgggttgaccccaggtgacgtggctccagaaccagcgatcttaaccgcgacactgcgtcctccacaaagatgaaagcaggggtgggcgcagcaggcaggctacaactatataaccgactgggcaaggggatgagacactgctagatggaatga

SEQ ID NO: 7918 - DNA, 1423 bp, artificial
  synthetic oligonucleotide
atgttggaagtgacagtggtggccgtgtgagtggtgcccgtctcgtgggtctcacagggggggttggagcacaccctctgtgttgggaaaggagccagcagcgcggtgccagcctggggggtgacgctgggtgccgccgccacctctaggccagactccacggtcctgtgggaagaagtggcgtcgggaagcagggcacccacgctgaccgacatggtggtgccagtggaagtggtctggtgtgtctcacaggggcgaccagcagggggctgctgcccaccctcgggctggcccgtgcccccgtttgaagtagcggtggtggccgtgtgggtggtgcccgtctcgtgggtctcgcatggcgggttggagcacaccctctgggcgctgcctgcattcgaggtagtggcggtgttggtggtgcctgtctcgtgggtctcacatggtgggttggagcagacttgggtcacggtggccgaggggcacagcagtgcctccagggctgtcacagtcactgtggtgctgggcgagccaccctggaggctctcgcacacaggtgccatgcggggctccccagcacccacgctggaacgggtcatggcagcggtgctgaccgcatggctgtggcgccccgcaggaaggtccttaatgcttgggctgctcagcctgactttgctgctcagaggggccaactgcacaaaagcagggctgcggcccccgggctcccgtgccatgctcggcccaaggagtgggccggccgagcacggggccccggtggccatcacagtcatggtggtgctggtcgcgctggtctggcgggtttggcactgggacttagagccctgggctgcctccagcgccccagtggccacactgatccggatcacggcaggggtgccagctgcacaggcccgacgggcatctcgctggtggttggcgccgacgctcgacatggctgtagtggcagtgttggtggtgcccgtctcgtgggtctcgcagggtgggtttgagcagccatgctgcccggccatgttggaggtggcggtggtggcggtgttggtggtgcccgtctcgtgggtctcgcagggcgggttcgaacagactcggaccacgctaccattctgctggcccacagtcgaggtcacaagagaagcagctgcctcctgtctgtcacagacgaactgcacttgggtgggctgggggtgtcccccaaggttagccacaacagtagtggtggccgtgttggtggtgccagtctcgtgggtctcacagggtgggttggagcacaccaaggtgacagtgccaggctgcacatcaccctggcctgagtcggcgatggtaactgtggcggtgggctgttctgtagtcggggaggccagaatggacacagggaggtcatgcacaggctgggcctccaccccactag

SEQ ID NO: 7919 - DNA, 1974 bp, artificial
  synthetic oligonucleotide
gttttgcagggaggcagaagagcgggtggggtaaccccctggatccgcagaagcggggagacacacgactacgcaggccgctgaggggtaactggaattcagcttgtaaaccagaaggcaccagattaggagaaggggcgacttggaaagaaatgctgcagaagtaaacgtggaaagggagaggcggccctgccgccggcccgtcctaggggtccccaaggctccggcattacccgggtcggcggatgttaaactctgcgtcctaagagcgcttcccttccctccctttttcgagagacagagaacgaatctgtaatctagaaatggtcatttctccagaatgggcactcgagatgagggagagctgagcaggcgcaggagaagggagggagggagggaggggagctctgcctgcgccaaggggacacatccgcccgccccagccccagccccagcccgctgggtaacggtgtgggtctgaagtcaccaccgctggcgacagcccctctccctcaccagtcggactaggggctttcttttaactaacgaaaaccaatcctcaaacacgggagagacaagggaacggggagaagatcagagaaaagcactgaagcccggcacagcaaaggggaggggcaagccgatcagtggggagggagggggaggaggggagaagggggagggggacggggagaggggagaaggacgggtaagggaggaggggagagagagagggaagggtagagggtgagggaggagatggagggagggaggagagggagggagcagatggagggagggaggaaagaggagggagagggaggagatggagggagggaaagagccgaagacccagcgggctttgcactcacccgtgttgtacacgtgcagttcgtccactattccctcgttgccgccgccaaacaccacgatgagctccttgatggccacggcgcggtggccgtggcggggccgtggcaccggacccgaccagcccaccactcgcttccagcggggctgcagaagcaccgctggcaagttggcgggcgacacggccgaagccatagttccgggaaagggtgcggtggggagaagtcaacaagcgggaagggagcccctcaattcctttcacacaccccctttcgtctaaggcagctctcacggagaagcggtttctcacacagcggtagacgactccatggaggccgccatcttaactgccctccttccctttggctcttccctttcttctcgctcaccccgtctccgcaagagccgcccgaaactgtcgagcgcctaggctcaagaagctggaggccgctgagtcccgtcgccccgactacttgtccgggcgctcccgcttacaagctcgggcgggaggccctgggagccgccatcttgagccgcctctctctcctcccttcctcagtcgtagccctcccccgccggaaatggcggagccccggcccggttcccacacccccaagtccccagcactggccggcttccggggcgggtggaaaggagccacaagcgccgcggtcgtcgcagccccgccggcgctcagaccacaattgtgggagccgccatcttgagaccgtcccgcttccccgcccagcgccttagtgcagccgccgctcccgaaacagcctcgacacacctaacgaatggaggcgggccggaggccggtggaaccagctcgagctctcgagggccgtttgggggctcgcgccgtacggcttgtgaagtctcgcgcctctccccttagtccgcctctgctgctcaggctgcgcctgccgccgtgggagccgccatcttgagactagctccccgttcccccctattctcttcctcctaggtcagttcttccactgcacaccaaactcaaggcggtgtccgatcctcacttcccgccttatgactccttcccacaggagccgcttcaaagagctagagttaggccccgaagcggca

SEQ ID NO: 7920 - DNA, 1021 bp, artificial
  synthetic oligonucleotide
caacaagcactcatcacgattttactttttcttcctaccaatacctgtgtaataaacagccctgcgagcctcctgggtcaggcggggtcccacgggaaacaggtggtgtgcctagattggggtgattcagggcggttttgtgggacacctggaagagtggaccccacccaaaggagaggcttatgtggaggggacacctccagaggggcagggactgcaggaagcctggctccgctccctccctctcctgccagagttgccagattatacgccaggcgatgaacaatggttttgcacaagcgtgtctcaaatgttgcatgagacatttctcctactaaaaaagtattgtttacctgaaattcagatttcactgggtgttctgattgttatttgctaaatccaacaaccacgtcctgagccaacacaagcagagccagaagccccggaacctgcgcaaggcagagcaggtggcaaagaaggctccaggcaggccccggcctggaacctgcactccccaggccctttttgaaattagtgtttctccaagtatggccagttgccattagtcacacagcttcctgcatcccttcctgcccaggcgaaccccccttctggggccgggacctcagagtgcctcagccctggcccggggtttgcggattccaccaacccctgagccactggaggaaggaggctggcggctgtgcctccctccagctctgcagtccacggaggagctcggcctcgcccagggggattggctgtcagggccgccgttgccgttactggtcttggtctcagtctcgctgctccactgcgtccccagcacagctggggagccaatggttgccagatggggcctctccccgacctttgacctaacggtttagaggttccaggcctgggagggatcttagaaaccatctgtgccagccccggcatttcacagataaagaaactgaaactctagcagtttgacttggctgaaagttacagtgaggaggagcagaaacccaggcat

SEQ ID NO: 7921 - DNA, 1981 bp, artificial
  synthetic oligonucleotide
tttgccgctttccaaacatgaacccagcaaatgacctcagcattctgtgcttcagtttccttatcttgacaacaggtaaccccatctaggcatccttactgtgagcatcacaggagaaaaggcacaatggcactatataaatatcagctaactcaggccacaggaaactaccgcctagggtcctgggggtgataagacaagtggtcccaggtggcgtgagcctctaacacatgttccctgatgaggaatggcctcggccacagcagatgcggagggaagagcaaggaaaaaggtgtggtccaggcagagccatacatccccttcctgccggtggagaagagcaccctacctattctagtgtgggaggcttccccgttcttttctggtgaccgaagcagctccttctctacacatcactttggcccggtggggtctcgtcagaaatggccaccgtgaggccccacaccccagcatcactatctggccatgatgctctagtactctgtcgagtatgccaccgtgaaacctcctaggactccagagcctctgcaacaacaggggcagcttggaaagaagcagcagccacctgcgagtcccttcgttagcagttcattctggaaaagagcatgactactcccaccctccgtgttctcagccccacaactcccctgtcccatgtggttcacatcagtgctagtcaccgccttgcggctggtctaccccaagagacttcccctcttgtctacactgcacagactgtgcaatgagggcaccatggcactcactggcaagcatccttaggaaaccagaactcaaatgatgtagggaagttaccaaaggctgcttagtgctgggactcagaagctgcaaggacgtatctctccagaaccatcaggtcaggtgtagggaggcaagagatgttccaatctagtgacaaggtcttagagtgagggaatgtcttgtccccaccatgactcacccctgagttcctccctatcctgtatcttcctccagaagtttagggcccagagtgtggctgccagagtcacctagagccactgcatacacaaaggcatcctacaacccacagagcagtctttcttgctgtaaagaggggtccctaatctgtcccagcacagagctcgccttgttttgttttttgttttttttttgagatggagtctcgctctgttgccgatggcataatatcggctcatcgcaacctccgcctgccgggttcaagttattctcctgcctcagcctccggagtagctgggatcacaggcgtgtgctaccacgccaggctaatttttgtatgtttagtggagacggggtttcaccatgttgggcaggctggtctcgaactcctgacctcaggtgatcgacccgcctcagcctcccaaagtgctgggattacaggcgtgagccaccgtgcccagccagagcttccttttcatgtctctgagtcttacagctctcaatgggaaatgacgaagaaccctggaaagctaggtgtggcctgttgcccaccagagatcagcctttgagaatggacccctaggcagctccccagctccccataaaggagggagggaaggggagccaccagcagagtgggccaagaaagcagacagatgggaatcgctacttctacacaatccatcatggcactgcctaacgccagggctgctccctagaacccggacggtcctaatgtcagagaaaaacagtgaactaatgggaaagatctggcttcttcgaaactctcatttgcatttcccaaataccttaatcaccatgaggtcaaactataaacctaaacgtgacgtaaggaatgccttctagaaatctatgctaaagagacacctccagaaatctcaaagaacatatgcatgatgttatttgctacaacattatttttaccagccaaaggcttccaatacccccgatccctatcaccagggcacttgctgaataaact

SEQ ID NO: 7922 - DNA, 7908 bp, artificial
  synthetic oligonucleotide
actaaaatgcacacacgccccacaagcctttttctttttttttccccccaagaagcaaaacaagttttatttccatagtagttccttttagtgctctctgtcgccacctaatggatggcctggtggaagaggctcaagaggtagcagcctagcctattccacggcagaggaatcaaactcacccaggcagggagaacgggactgcacctgggtgggggaggaccaaaagaagcccagctgcttctggaagatcattgggagtctcttctggaagaccaggggctcttggagctaaaatagacgttcgttcattaataatacctacttcaacaacttaagatcatgttcagcggatgcacatcaaccttgacttgtctgtgctccccaaatcaatatgcctcaatattgaggcatattgagggaacaatctgtagatattcatgaaattgtctggtgggacaaaaattgtggggcacttgagcctagctgaactcagttttaagttctagcatttaacacaccacctctaagtttacgtgtactttatgagtgcaggaatgcaacaaaaaaatctagtgtaaagtcctggccctcagggcaaagcaagggaactacaactcttgctgcgaactgccttcctcccacagatgtggcacattcacaaatcacattcattgaacaagaaatggaacaagtgccacaccagaggtgacaagaagaggggaccatacaataataggtaacttccctgtcacacgagactgcttggagacaaggatacagagcccagcataggagatgggacaaaatgatgagggtcaaggaccacacctggtttaactcccagtgaagagttttagccagtaaagagctgcaagaaggaaatcacacaccacgaagaggccactaagataaacgcttgaatctgattaagttttcacctgaaaagtgtgggtaaggacaagcctgccttgttgggtagtacagattcagtgaatgagccctcagatcctgctggatcccgtgatcagataaacagcagcttctcaggaaccactgcatgtgaggttagggtgaggggagggacccgatggagatctaatcccaggggtttggtcacaggggctggcgaatgagaggtggagaccgggaacatacgccactttttttttttttttttttttttttgagacggggtctcactgtgtcacccaggctggagtgcagtggcaccatcttggctcactgcaacctccgccccccaggttcaagcgattctcctgcctcagccacccaagtagctgggattacaggcgcctgccactgcgcctggctagtttttctatttttagtagagacggggtttcaccatctcggccaggctggttttgaactcctgacctcgtgatccacccacctcggcctcccacagtgcggggattacaggcgtgagccactgcgcccggccagccactctttttttttgagatggagtttcgctcttgttggccgggctggaatgcaatggcacgatctcggctcactgcaccctccatctcccaggttcaagtgattctcctggctcagcctcccaagtagctgggattacaggcatgcgccaccacgcccagctaattttgtatttttagtagggacgggatttctccatgttggtcaggctggtcttgaactcctgacctcaggtgatccacctgccttggcctcccaaagtgctgggattacaggcatgagccaccaggcccagcctaagccactcttttggaaagctcagcagagaagatgcatgaggtaatacgacgcgttaggtggcctttaaagggatgtttatagcttttcataacatgggtgtattagtctgctcaagctataacaaaatagtacagactggggggcctattcaactgaaatttctcacagttctggaggctagaagtccaagatcaaggtgtcagcacattcagcccctggtgagggctctctttctgacttggagatggctgccttctcattgcatactcacatggtggagaaagcaagctctctgctgtctcttgttataaggacactaatctcatcatgcgaaacccaccctccctcctgatttcatctaaacctaaccacctctcaaataccccatctccaaataacatcacattggaggtttgagcttcaacactggaattttgggggacacaaacattcagtccataacagtgctgatgtttatgttttaatgttaaatgataacagcacagcacagcagcacacacactgtgtgatgccaatctgtttgtttgtttgtttgtttgtttttttagataggttctcactctgttgcctgggctatagcagtagtgtgatcacacctcactgcaacctcgacctccaggttcaagcaatcctcccacctcagcctctcaaagtgctgggattccaggcatgagccaccatgcctggcctccaatttgtatttaatgccactgaactgtacatttaaaaatggtaaattttaggtgatgtgtattttactacaatttttttaaaagtctaagagaaggcaagaaaggagaaggaaaatttaaaagaacagaaaatatggaaaaatagaatgcacaaatatgctataaatgaatctaaatacatcagaaatcaaatagatgttaaaggacgaaacagacaatggattttttaaaaaatctcgaggccgggtgcggtggctcacgcctgtaatcccagcactttgggaggctgaggcgggcggatcacgaggtcaggagatcgagaccatcctggctgacacggtgaaaccccgtctctactaaaaatacaaaaaaaaaaaaaaaaaaaaaatcagccacgcgtggtggcgggcacctgtagtcccagctactctggaggctgaagcaggagaatggcatgaacccggggggcggagcttgcagtgagccgagatcgcgccaccgcactccagcctgggcgacagagcaagactccgtctcaaaaaaaaaaaaaaaaaaaaaatctagctatcagctgggcatggtggctcacgtctgtaattccaacactttgggaggctgaggcgggtgatcagctgaggtgaggagtttgagaccagcctggccaacatggtgaaaccacatctctactaaaaatacaaaattagccgggtgtggtggcacgtgcctgtagtcccagctactcaggaggctgcggcaggagaattgttttgaacctgggaggtggaggttgcagtgagccgagatcacgccattgcactccagcctgggcaacaagagcaaaactccgtctcaaaaaaaaaaaatctagctatctgacattttcaaaagctccacctcactgatgcataaagacacagaaaggaggaaaataaaaaactgggatggccgggcgtggtggctcacacctgtaatcccaacacttttagaggccaaggctggtgaactgcttgagcccaggagtttgagaccagtctgggcaacatggcaaaaccctgtctctactaaaaatacaaaaacttagccaggcgcgctggtgcaagcctgtaatcccagctactcaggaggctgaggtgggaggaccacttgagcccaggaggcggaggttgcagtgagctgagattgcaccactgcactccagactgggtgacagagggagaccctgtctcaaaaaaaaaaaaaagaaagaaaaataaataaaataaataataatttaaaaaaaaataacatattagtatggtcgcttcataataccaaagggttcaatacaccaggaatgtgaaactgtatctaaaactgaaaatgtggcctcaaaataaataataaaatgaaaatgaccaaactctgtggagaaactgatgtgtccatcaccacagtaggttttaacacgtattccatcagttgataaatcaagtaaacaaaatgacagtaagaagagaaaatactttcacaacaaacggataagacagaggtaatgaatatatgtagaatcctgcacccatgcttggtggtgacatattctgtccactggttgtggataatgtgtcatggagcacttctcaaccaactgcaagaactggtgtcacacagaccaagttctttgatcacagtgccatttagttagaagttgattttttctttttttcttttttttttttgagacggagtattgctcttgttgcccaggctggagtacactggcacaatcttggctcactgtgaccactgcctcccggttcaagtgattctcctgcctcagcctcccgagtagctggaactacaggtgtgtgccaccatgcccggctaattttgtatttttagtagagacgaggttttggcatgttggccaggctggtctcgaactcctgacctcaggtgatctgcccgcctcggcctcccaaagtgctgggattacaggcatgagccacctcatgcagtcaatttttttttctagagcaactaggaaaaaaaaaaaacaaacccaaagccatgtgcttggaaattgaaaaacacattttaaaataatatgtgagtcaaaggaagaaacaaagaaaatttaaaatatctttgggctaacttaaagtgacaatactatcagaacttgctagatacagttgaagtagttccagagggttagccttaaatgtttacatttgaaaaaagggtagaaaaatcaatgaaccaaatttataacttaagaagttagggccaggcgtggtggctcatgcctgtaatcccagcactttgggaggccaaggcgggtggagcacctggcgtcagcagttcgagacccgcctggtcaacatgccaaaaccccatctctactaaaaatacaaaaaatttgccgggtgtggggcaaatgcctgtaaatctcagctactcgggaggttgaggcacgagaatcacttgaacccaggaggtggaggttgcagtgagctgagattgcactactgcactccagcctgggcgacagagcaagactctctctctcaaaacaaaaaacaaacaacaacaacaacaacaacaaaacacagagaatgtactctaagaccatagaaaaaataataaagataaaagcaaaagcagaatttaatgaactagaaaagagacacagagtaatacagggcaataatgcctacatgtctgcttcttgtaagaccaatgaacctaatgagcttttaccaagacaaggaaaaacgggagaaggtacaagtaaacaacaaacactaggaatgaaaaagcagacataattacagatgttgcaaatgtataaactataacatgaacaactttatgctagtcagacaaaatggacaaattcctagaaaaaaaaatttaacagcttacagtagcccaagcaggtgcagggaaaataaaaataggtttagatgtgtctgcgtgtacatagaacacctcaaaagacacagacaagaccctggatgcagccgttccctgaagagaggcctaggcagctgggagaccagggcagcagggacactcagaccttgcatcactctggagtttgcacttcctgaattgtgaagcatgcacatgtctcacttatgcaacagtgaatccaaacgtgcctgtatacaaggaaaggcctcacctggctgcgccgtggaggctggcctggcgtgtggagcaggcagaacattagcaagctaccgagcaggtgcaggtatgaacatcagctgacgctggctctttgctttctttttaatcttgacaaatttggtaggtgaaaaggcatcatttttgttctcgtttgcatctctttgattaccagcaggcagaactcttttcctatcttcattggccatctgtatctcttcttttatgaatttcctgttcatagtctttgttcattagtggtgactagtggtaagttagcaataagaactgtttgcattcaagtctagactgagaaggaaattaaaaaatctgcccatgtattctcacaataaatgactactgactagcctgagataattgtacccactgcccagtcacaggcattaagcctaggatgattcatttcagacttgtccctgaccttcctcataccctttccagaagggccccttgagctgctatgatactcctaaatcactatcccattacccaaatgatggagagccaatcaaaagcttagaccaggacgctttcccaaattatgtcccaataccttcacaatgatcactttatatacaatctcactgaatgctcagcaacacacgagagcaatgtttaactgagggcaacactgaggctcaaggagggcaagtgacttgattgctgaggtcacctgctaggtgcaagagctgagaattaatcccaaggctacctggctcaaaaagcctaagctcatctactatacttgaggcgaaatcatgaaagtgtgtttttaccttgcccagaccctgcacactgcatcaaggtcctgagtttcaagcaacagaaatcaactctggttaaattcaatcacaaaggagttcttgggcagcagatctggaaatggagagagaactagagaactaggctcagaaaagcagcaggaatagaggctgcaccactgcaaacacagccaaggttatactgcagggacctgctggttgggacacccaccctgggcactgttgcatgtcatcactggacattagccaccactgctggttttgtgactcaactgccaccaccatgactaatccctcactgtccctcaagagtcaaagtccctgaaggcagaatgggtttggccaaacctaggcttcatcgccatcccctagtttccagagagcaaggggagggaatatatccattcccctgtggcaggcactgccagttgtcccccaacatccatgttctccatctgccttactaatgagaccctgcgctcagctaaggagagttattccccgcttcccagcagaccatgggactacgttatggctaaggagacagtggccgagtgcactcctgttcatcgttctctttcaagcttgctcttgttctactgactatgggcggagcacacctcccacccactgactctgggcttgctcacgtgttgatgggatgggggaagaagaggctttaagaggcttctgtgactctgctcactcctcttggactcctgacctccgcctacgaagagacttcccctggcagctgcttctccctcctgggtcctggaacgacaggcttgagaacagatctgaatcccatcttgcagctgacccagacccatgtgtgagaaataataattgctgttatagctactgagctgctggtgctgtttgttccctaggacaagatgatgggtgtgaagatggaaatggaaatattgaatgggcctagaagttaagatgtcaagtgccattttgcctttcccctatgacctctttcttcctacctggaggagtggatgcaatgactagagcagcaaccgtcatctcacaaccaagaggcaatcttgagaaatggaagacacccactgaggggccctgggtcctggatccttacaaagccactgcagtggtcatggacagcatgagaaggaagtacaccacaggcccccaaccccatcttcaggttttcttaggtagaaactagggtccacctgcctcttactaagatatacacaatggggagacttttaacacaaaaaaaggtatgaagatggtcagaagccaaaaaagcaacaaaatgttcatgatatgccgtatgtggggtttactcactacactgcttttccaccgagttagcataatcactataactcaacccattgaaaaaatgacaaaacagattctgagattctcttcctatttctgttagctaaaaaagcagcctttgaattgtttat

SEQ ID NO: 7923 - DNA, 960 bp, artificial
  synthetic oligonucleotide
cccaccagagtgaagagaatgtggtgaggatgagaggttatcatcaaaggacaacaactttatagaaagcatatgggaattgattgatgaataaaataggcagtaaaaatccaggtgagaatatttgacaagggagccacagaagaagtgggagtgagtttgctagatataacaccagacaatcagaatcagtaggcatgtggtagaaaacgatagaattaaataggactgaacacatggggattaattgaaggcaccagtacagaatgactgtaccagttggaacctcctctccccaccagacagctgagctgggagctggcacagacctacagggaaaacacctgacagttctgtaaagaaattgattgaaatgtcggtggagagctaaggcttccagcatggatgctgacaacccctgaacaattgtttcctcattccggcatctaggggatactctgttcgtcacctccctgtcctacacagagaagagtcacagcaggaaaacagacctatttgcccaacagcagattaaatccacaatacttatccagtccttccttattaaatataaaccagtcagtaaatattatcagaaatttgatgaaagccttcaacaggaaaaagagtcaagataaacctgtagaaaaaatataaacttggaattcaagaaaattcagggaatgtatcaaaaaatttaatttaattaacatatctacagaactaaaagaaaatgctgtattcataaaacaagaacagaatattatgtaaaaagagcaatcagagaacaagaaggaattattgaaattcaaatttcaatagaaatattggaaaataaaactgaagaagtctcccagaaaatagaacaaaacaatagagacaaagatatgagagaaaatatgaggactttgaggagtgatctaggaagtctggcaagcaactaacaagaattatggaaaa

SEQ ID NO: 7924 - DNA, 326 bp, artificial
  synthetic oligonucleotide
cctttgctttggctcaaagccctcatctgtctgctctccccatagggatcacaggtctctggtctctggccatcatttcctgggagaggtggctggtggtgtgcaagccctttggcaatgtgagatttgatgccaagctggccatcgtgggcattgccttctcctggatctggtctgctgtgtggacagccccgcccatctttggttggagcaggtaagggtgcgaggacgcaagatggagtgggcagggtcagactctgtgaccttaaggcaaatcacttcctttctctgggcccctctgagcgtgcaatgtctatcaatgtatg

SEQ ID NO: 7925 - DNA, 2120 bp, artificial
  synthetic oligonucleotide
tggggccgaccaaggagtggacccgagagtgccatttgcccccctgacccactctccacctccatgtctggccctctgccctgggaagctgatcctgtccacagccgtcaccccccacccctagactaggctaccactgggagcccttcaggaagtcagagcaagggaggagagccaggctggttcttttctgttagcagtgggagccctttcagggtgctggctttcctatatgaagctgcctgtgcccacaattggatgggcatgcctgccaagctctctctagaggagtctgtgagcctgtgaaaggccccctcaccccgtcaccttggggtgaaggctcccacaggtacccaaccatggcttcggctgtattagtctgggatggtagagccccagctccacaatgtggccccagctctgctgtctcagccatccctgcattccagccctcacactccctctctcatccccactcatctgcctgccgccagtccctcatccctggcaggtggtggctggcctctggcctcccccacagtgcctctgcctggaggccattcgtctccttcctcccagcaggcatgaaggagccaccccaccaaagctgccctcagctgcctcaccgtgagtccagggcaggatttagtccacagagtggccaacctggcctaggaagcctgagggaagtgtatgcattgctctgacactcccatcgcgcaccccgccagccactgcttttgcctcccccgccatctccaccttgttaactccttcattctccacgcccagtcatcaatcaaatcaggcctccatgctcaggcctgagcgcaggacaggacagtctgttaagggatcaggtgaagcaaaggagcttgttagatccagctctggggtcatcttaggccacacctagctgcatgccacctccaattctagaactcccccagggccagcctgaggcagccatgtctgcctggggccggctgtgctccactcagggctggaagatggctgctgggctcctctcctcctccccacaactccctatgcctgggtcacctgcctcttgctgccctccaacccccgactcactatccctgtctcccttaggtggcaaagcagcagaaagagtctgaatccacccagaaggcagagaaggaagtgacgcgcatggtggtggtgatgatctttgcgtactgcgtctgctggggaccctacaccttcttcgcatgctttgctgctgccaaccctggttacgccttccaccctttgatggctgccctgccggcctactttgccaaaagtgccactatctacaaccccgttatctatgtctttatgaaccggcaggtaagcaacaccatcagcagatcccactcaaaataccgtgtgccctagaagggtgcagtgatggccccacctggaatcatgtctctgataagaagcccgcggagcatctgggggaccctccagggaaatgaccgggaaaggctcagcgtgtgacccagccccagccagagctccagctggcccttagcagaaggcttaggtgtgccctctggaatcctttatagtctcggcctgagggtggcatttcccaaagcgtctgtgtgccgtgcgctcttcccttccggtggccctagaactatggctgccgagcttcaggggctctcctggcgttcagacgctctaggagttggtgagccctaggtacatccaccctaggtgtgcccctcttctgttcagactcgacccttctcaaccttcatctctccattttcaaaccgtaacctctggaatttgtcttcctataagaacaaaagccggccctccttggctacactgaccaagagttcaagagctttcacgagtttgtgggttagttcaggggggacgtgctgtggtcctgcccagaggcagcctccttagctggcatattgggcctcagcagcaagctgctcacacacctaaatccccccacctcctgcaggttacaggcttcattaaagcgcagctgtgatgtgacttgatggtggccagaaaggtgtgcagaggcctcccatttcaccaggcccagtccatcccttccactgggctcttccttgcttctccatctt

SEQ ID NO: 7926 - DNA, 580 bp, artificial
  synthetic oligonucleotide
ttctcttttgtatctctttctttctacccttaggttgttgtgtcagagagactattagagatctgagaagtcagtagctttacatcacaataatgcaaacatctatgagaactgctctgtgatctgctgagaattctaagctggtcagtctgtgcttgcagagttcagccgatcaggcccgagaggagaacagcggttctcattttaccctcctctgtttttcgcgtgatgacccgaggcctgggagatactgagccagacttgcctccgactccttccttccacatgcatcacactccacacaccacacaccacacaccacggggaatctccaaagggcaggagtgggagggagtgcagcaaagccgagaaagggctcaggctctggagcccaacttcatgagtcacatttccctcctgtttttgtctgaaaatgggggtaacactggcaccgacatcctagggctgctgtgaggagggggtggatgctcccagccattgctgacaatgatgtgattggggatctttgaggattccaccccggaaccctgacaggtccagccttactctttgacctgcc

SEQ ID NO: 7927 - DNA, 2889 bp, artificial
  synthetic oligonucleotide
caggggaagtgggggagttgggcaaacgccctttgggtgagggattgtgacccccgccaccacccccacttcctctaccacctcgaagactcaagcttggagttgggaggccacaggcctagccaggggaggggcccagagcccaaaggaaccagcagttgggccacatggccctgactcactggggcccatcgggagatgccggggtggcagcaggagacactgggaacccccttgccacccactgcctgacccacttgccacctaacgggcctctgggcctcggcaggctcgccacaggggaagtggttagggcgggtccctgacaccccccatcaccatggcaaccctgctgggctctgggccccacccaaggctacttctgggtctcaggctcaaggcaggatggctcatctttagaagccctgtcagcctcccccataatcagacaaaatacttctctggtgagtcaactagggggcgggcctatgaggaggggctgggctgtccatggcagctgcttcccagcccagcaggcagcacctggagggccaggtgagccgctcagagtggcctccccagttcccaggttggtcctggccccacgaggctgcctttcactctccccaaatggcagcagggagggggactcggagaggaccaagggtgcagggccagggaacaaggccagccagggcttcccatcaggcccccaccccagtccagcctcagacccctcaacgacccccacacggggagcaaccaggcccaccaggtccatgttaggccagcctactccgtccccatccccctcccaaaagagagagggaaggaccagggcccagggctgggagactgtctggctggatggccccgccccatcccacccccctttccccagcccctgggccagccaacccctccctcccctaatcactgctgctttccaacatttttttgccttatatggcaaagctctgggaactaggcctgctccagccagctcacaaggaggaggggagctgggaggagggaggagaccccccctaaagagctggggtgtggcccgcctccccacatccggtcgccccccctaccatccaggactgagatgactcagcttggctagactgaggctgggacttgtgggggtgggcctgcccctcgcctcaactggcattccaaagaaagaactttggttcttgggatctgccctctgagtggctgggggaacccaagtcttggtccctcactttcttgggttcagcaagggccattccagggctgcagggtaactggaaggcctctcaattctgaagaagagaagactcatcatccctctcctctccctgttccacatcacccccgagtcacccattctggggcctgccctctcatgcagcccctatcttgagaacgaattgggctgctgcagcaggcctggtcaatgccagcctctccagtccagtgacacagacactgggctggcacaatgcacgctggagcatctaccaaccaactcctgcgtgctacacgcagaaaagcaaggcctacatggaagcaagagtttggcccaagatgaagagaaaagttggcgtccaagtagtctacaagccaggtctctcagtcaaccacgcccaactcaccccgggtgcagttttgctaactatgcttctttctggcccccaggttgcctgtgtgtgtgtgggggggtagatctaaactggtggttggagccatctccgatgggcgacccatcctccagggacacaaagagcccagagccccagacaatgggacgcacgagctccaacccacacttcagaaccaacgggcctctgaaggccagagggccctctctaaacagctgtggggggagagcccgggcctcctcctcctcggggacggggcgcagggccaggagcctgcccagtgcccgaccccccaggcccactcccaccgcgagcacagccgcggaggcgcggcctgcggaggatgtgagttcagcctgggcgccggccagccggggcgcagcgggcgggggcgcgtagcggttcgcacgcccggccggccagccagccagcccgcgcgcctttgttctgcaggcccgcgtggagcagagcagccggaggcctcgggagttgcgctgcggcccggaagggggtggtttggaggggtccgcccggggagatggaaggacgcacggagtccccgcccccgcccgcccggcgcttcggggcgtccctcaccgatggacaccagtttgatgctctcgcggtccaggaactcgagcgccaccgacacgttctcaagctgcatttggcggaaagtgggccgctggttgtgcttgcggtgcatcttcttctggctgagcacctccaacagcgcgataagccgcagcccgtcgctcaggtccgtctgcaggttggcgatgcgcttgctcacgcacttcaggtgctcgttgcaccagcgcgtgaaagtgttctgctggatcttcttccacggcgcgtcctccgccaggtccttctcggtggccggcatctcggcgtcccgcgtgtcgacgccgccgcccggagccgcgcctgctgcgctctggcccgcccgagagtgggagctactcattttgaggcgcgagaagccgggggggcggtgctgcagcctcggcgaggggacggccctttaattaaagtcgcaggcacctaggcgcgcgggaggcgaggcagggagcagaggttgcgctgcggagagagcgagccctttaaatgcgggaggagggcggggccagagggcgggcctcctgcggggaggggccgtggggtggggcttcgagggcgcgcctgccccaccccgccccgcccgttggaatgcccccactaggcccccgggttc

SEQ ID NO: 7928 - DNA, 2104 bp, artificial
  synthetic oligonucleotide
tgcgcgggcgagagccccgcagactgggaaggcgggcccatggcagggggtctgcggggatcgcgtaggcgcgggccttgccctgcagccgcttcccgggcgatgcgcacacaaagcgccctcggcagcgcctggcccggggcccgcgctctcttagggtccgggcccttcccgccgctgctggggcggccgaccgggatgcggccggggaaccctaggctctggggccctgggaagggggacgacggcggggagtagggatgtgcagggatcgggcgaagcccaagcgacttagggaccagagccaccccaagcgccgacttcgcccgctcgcacgtcccgggtccctcgcgcgcaggccccgcccctctcaccccgccgcacgccacagggtgacgtctgggctcccagccgcatcgccctgactcccgcgcgggccccgccccctgccgctagccaatctgtgcgtttgtgacttttgggcccgcagccccgcctgctcccacagcgataccggtttgcattgccctgactcccgcgcgggccccgccccctacgccgctagccaatccatgcattagtggcgtccgggctcgcagtaccgctcgctcccaccgcgagaccttctgctccgcgcccgcgcgggcccctccccctccatcgctagccaatccccgttttgtgacgtatgggctcgcggccccgctcgctcccaccgcgagaccttttgctccgcgcccgcgcgggccccgccccctccatcactagccaatccccgtgcttgtgacatatgggcttgcggccccgcccgctcccatcgcgagaccggttcccaccgccctgactcccgggcgggccccgccctctccgccgctagccaatcctcgcgttgatgacgtttgggctcgcggccccagcctcccagctctcagggcacggccggtctgtgccggctgctcccgcggttaggtcccgccccgcgcagcgcgcgcagcctgcggagccagcggccgtgacgcgacaacgattcggctgtgacgcgacaacgattcggctgtgacgcgagcgcggccgctcccgatgcgctcgtgccgcccccgccgtgctcctcggcagccgttgctcggccggttttggtaggcccgggccgccgccaggcctccgcctgagcccgcacccgccatggacaactacgcagatctttcggataccgagctgaccaccttgctgcgccggtacaacatcccgcacgggcctgtagtaggtacgcggcggcgggcgggaccccttccgggccccctcctcgtgctccgcctcgcgacctccccgctgccctccccgcgcgccttccccggcccgcggccctgaccgccccgtgtccggccaggatcaactcgtaggctttacgagaagaagatcttcgagtacgagacccagaggcggcggctctcgccccccagctcgtccgccgcctcctcttatagcttctctggtgagagcctcgcctgtggggacagcctgggacgcggggaggatggggtcgcgagggtgtggcaggggggccggtcgagagcggcactggagaaaggggagggaagtctgggggggcaaacagttctgtctcctcctttcaatccagacttgaattcgactagaggggatgcagatatgtatgatcttcccaagaaagaggacgctttactctaccagagcaagggtaaggcaggggttgggtgggcacgctggcaccttcacccgacttcgtcagggaccccgctcacagggaggacctgagacctcagtcccaaccactccagcagccttaggagggagaaactgttacaggtcccgaaatgggattcagattagggccatcaggccaggcggggcacaccgatgccccctctgctaccgctgccccccttcccaaggctacaatgacgactactatgaagagagctacttcaccaccaggacttatggggagcccgagtctgccggcccgtccagggctgtccgccagtcagtgacttcattcccagatgctgacgctttccatcaccaggtgagctggctggcaggcgtcctgtacttgggtacaacc

SEQ ID NO: 7929 - DNA, 3922 bp, artificial
  synthetic oligonucleotide
ctggaggccccctctctcagtttatctttgtctcacactcacctgaccttgcagggctcggctccttgctccacgccctgtccatgtggcttttgcatcctgaggcatgagttcctctgctctgtctgcctgcttttctctatcaacctgtcaccttcccttcgggctcacttcctacctctctgaggctctgtccgtctctgtctcactttccctctcgtctctggtttcccttctctgtctctctgttgcggtgtctctctcctggctgggtttgatgtctgtttctccctgaccacctgctctgtcactcatgctagtttgggttccctaccctggtgcctattctgggatatacatgggtatgtgggcagccctgggctggcacatgcagccttggaggctctggcgtcagggacccccatgagggctaccagtaagaaccagagagagtgacggttcctggcttcagccccaaaccctggctgtcaatatcagccttggtgggagccctaggcttccctctccctctcaaaccctccccaggcagaaggcaacttcctcccttcttccgtctccccagggggctcccatacctgctcagaccagcttgtcaccaagtctgcctcatccttaagtggatcgcgataccccagaagagcagctcctgcctgaatagggctaggaggggaaaaaaaagaggaagaggctgtgttcctgagccacccggccaggaagggcctggctgggccggacgccccacccttgccaacaggcaggcccgccccgtctccgcctcgccgccaacaaggaggaccagcaccaggcctgggaactgctgacctgcccgcccaccttcccacccagaccccgccttcccgggccagcgggacatgacagacctgtgagtcactcaagcctggggcaaggaggggctggtgcctgagtgagaccccgagcttcgctcgccaggcccgtcgctcagctcccggtctgggtccccagtcagcagttgctggggaaggcgcaggagctggaagtcatgcctgatgccacgagaccgggcaccccaagggcgtgagtcttctgtccctgttgttgggttctgagtcccagtgtggctgcacacttctgagttaggggtgtttgatgcaagcgctctggagacccaaagagagggacagtccacacatgatctggccacagtcgtgaagtcaagggaggactgaggatctgccccagagaggaggagacccagggagctggcagtccaacgtcctgggggtcctgcagtaatgctgttgggacaaatgaggtgctcggacagggtctgtgagcaggaggtggggctgaatccactcagcttctcatgggatggctgtagctaatggattcgacgtggtaatagaaggctggacaaattttaaaaaatcaataaattatgggctgggcgtggtggctcatgcctgtaatcccagcactttgggaggctgaggcgggtggatacgaggtcaggcgttcaagaccagcctggccaacataatgaaacccgtttctactaaaaatacaaaaaattagcccggcgtggtggtgggcgcctgtaatcccagctactcaggaggctgaggcaggagaattgcttgagcctggaaggcggagcttgcagtgagccgagatcacaccactgcactcgcactccagcccgggcgacagtgcgagactccatctcaaaaaaaaaaatcaataaattatggtttaaaaataaaaaacaggccaggtaggatgactcacactttgggaggagaggcaggcagatcacctgaggccgggagttcgagaccagcttgaccaacatgaagaaacccagcctctactaaaaatacaaaaattagccaggtgtggtggcttgcgcctgtaatcccagctactcaggaggctgagacagaagaatcgcttgaacctgggaggcagaggttgcaatgagctgagatctcgtcactgcactccagcctgggcaacagagcaagactctgtctcaaaaataaaaataaataaaaataaaaataaaaaactgccgggtgcggcggcccatgcctgtaatcctagcactttgggaggctgaggtgggtggactgcctgagctcaggagttcgagaccaacctgggcaacatggtgaaaccccatctctactaaaatacaaaaaaaaaaaaaaattagccgggcgtggcgacctgcgcctgtagtcccagctactcaggaggctgaggcaggagaatagcttgaacccgggaggcggaggttgcagtgagccgagattgtgccactgcactccagtctggcgacagagcgagactcctaaaaaaataataataaataaataaatataaaataaaaataaaaaactggctgcttaatgcatagggggctttctttccgggtcatgaatatgtttcagaactagaggtagtagctgacattgtgactgtatcagatggtataaaatactgtttcttgtattacatatgatacacaatatgtttgtatatattgctgtatatattgtatattttgccatacagtagattatacattgctacatacacatagtatcatgtagtactgtaactatgtcaaattgtatatgtggctgggcggggtggctcacggctgtcatcccaacactttgggaggccgaggcgggtggatcagagtgtgatggcgggcgcctgtggtcccagctactcgggaggctgaggcaggagaatcgcttgagtctgggagatcgaggctgcagtgagccatgatcccatcactgcactccagcctgggtctggctggaccctgtgtcaaacaaaaaacagaaacactagagagacaaaaggcgagcgcaggaggctgccaggaagcgggagccccacggggtgacggccacttcccgccgccccggggctggcctcgctgccgtcaagcggcccgtgcgcgctttgcgacagtcggtcgggctgggcaccggcgcaggttcgctttccggcggttgcaccgggccggggtgccagcgcccgccttcccgtttcctcccgttccgcagcgcgcccacggcctgtgaccccggcgaccgctccccagtgacgagagagcggggccgggcgctgctccggcctgacctgcgaagggacctcggtccagtcccctgttgcgccgcgccccctgtccgtccgtgcgcgggccagtcaggggccagtgtctcgagcggtcgaggtcgcagacctagaggcgccccacaggccggcccggggcgctgggagcgccggccgcgggccgggtggggatgcctctgcacgtgaagtggccgttccccgcggtgccgccgctcacctggaccctggccagcagcgtcgtcatgggcttggtgggcacctacagctgcttctggaccagtgagtgggcccaggccgaggcaggcccgcccgggtacccatgcccggccggaggtgggacttagggtgggggacgccgcggccccgacctagcgggcgagcccggagcgcctgacctctccttccccgccagagtacatgaaccacctgaccgtgcacaacagggaggtgctgtacgagctcatcgagaagcgaggcccggccacgcccctcatcaccgtgtccaatcaccagtcctgcatggacgaccctcatctctggggtacccgggccagtgtgctgggcagggggaggaaaggcgaggattcgggacgggcccagcctcgtcagaacaaaccccttctcgctgccttttcatggagccctggcactccggtttccgggcgttctgccccagggctgagacttggatttgtggctcctgcagcatccctgagggagcatgatttggagagggccttgggcatggagcaggaccaaggaa

SEQ ID NO: 7930 - DNA, 2579 bp, artificial
  synthetic oligonucleotide
ctgtaaaatgaagacaccacctatatcagagggctgtgagtgggaaatcttttttttttttttttttgagacggagtctcgctctgttgcccaggctggaatgcagtggtgcaatgtcagctcagctcactgcaccctccgcctcccgggttcaagcagttctctgcctcagcctcccgagtagctaggattacagggcgcccgccactacacccagctaatttttgtatttttttgtatttttagtagagatggggtttcaccatgttggccaggctggtcttgaactcctgacctcgtgatccacccacctcagcctcccaaactgctgggattacaggcgtgagccaccgcgcccggcctgtgagggggaattcttataatccacataaaacatctagccaggatcccccagtcttagggcattcacccattcattcatttgcccaatatggaaagcctactatgtgccaggtattgtgaagtgttggggatatggcagtgagcagaagaacccaagcccccaccctcaggaagctgacattcttgtgagggtggccagtaaatactaagtcggtataggatatgatgtcagtgttacggcctttagggaaggaagcaggctaaggggacagagtgactgggatgctattttagataagggtggtcaggccaggcctcattgaggaggtgatatatgagcagcgatcttaatggagggagggagccgtttggggaaggacattcctggaacagcaaattcgagggtcctgggcgaggtgtgctcttggccagctcaaggaagagctggtgtggctggagcacagtgagtgagagaaaggggtaggagatgtaggagatggtttgcaggtggctaggcgatgaagtaggaccttgtaggccatgagggggaaggtcagttgcagttcgaaatgtgtgagaaagccttgggtaacgtggagcagggagtggtgtgatttctcaattaaagaaagcccacaggacccaccagcagttcctgggctttccgactgagaaccccggtggccaaacagcagcaaggtcctgcccacaagggaggggaggctgggcgagtgtgtataccaaacaggttagggaagctgattaaaatctcctcagggcctaactgggaagggccagaggaagctggggatgggagtggagggtaggagcaaaaggacaaaggacatctgtaggttgtggagaaaaagggatggggtcggggccactgtggtcctaagagctcaaaagacttcaatgctcgatgcttcctccagcatgttctgagatcctcacctctccccttccgccaaaagcaggtggggggagggtcccgtccagactggacatagccgactctccttttctctggctgggaggcctgccacaaatgctcttggctgccccaccccctccccgcagcttccctgttccctccccagttcctcttgtctgtagggtgggcaaggcggctgactcctactcctgagttaccacaagtcagctgcctgcagatctccccaccccatgactgccttccatgtcttctcaccctgccctgagagtgctggagggaagaggtgagtctcccaccccacccccaccaacacacagttgcgctccaccatactgaacctgactctcagtgagactttgctggccctgagaatgcacggggaaggtggctgtcccctgccttggcccccatcacttgccaaacctcctcagatgtctcccctatttccctaatagctgagcattgaggatttcacagcatatggcggtgtgtttggaaacaagcaggacagcgccttttctaacctagaggtgagagtcctctcccagccaggggccatgggggacattctgtgctccttctcccagcataagaactgtactctgacctcatatcagggttacttgggtctgagtctcttctgggtcaaccatcccccccaaaaacaacaacaacaacaaaagccacctcatactcttagggagcagagacgctggctttggggtagaaaggcctggggcctgaatgtcaggggctggggtgtgggccattttcttggtgagcctttatgggtatggcttgccagaggagagctgccagagaggtgtggggggctgggccaggcccactggcccctggctaactcaccttttgcctctcccctgtccccagaatgccctggacctggccccctcctcactggtgcttcctgccgtcgactggtatgcagtcagcactctgaccacttacctgcaggagaagctcggggccagccccttgcatgtggacctggccaccctgcgggagctgaagctcaatgccagcctccctgctctgctgctcattcgcctgccctacacagccaggtactgcccgcatggcccagccaccagcctcggggcccagagagcagcaaggccctgggctatggcatgtggtggcaccgtttggctaaagatgccagtactccccaccccctcacagcccttccagaaggtgccctgtgtggccagaagaggaggggagggcctcttctgtgact

SEQ ID NO: 7931 - DNA, 1907 bp, artificial
  synthetic oligonucleotide
cctgcagcgcactggactgaagagcttccctcttcctactgcagcatgaactgcaagctcccctcagcccatcttgctccctcttcagcccgctgaggagctttcttgggctgcccccatctctcccaacaaggtgtacatattctgcgtagatgctagaccaaccagcttcccagggttcgtcgctgtgaggcgtaagggacatgaattctagggtctcctttctccttatttattcttgtggctacatcatccctggctgtggatagtgcttttgtgtagcaaatgctccctccttaaggttatagggctccctgagtttgggagtgtggaagtactacttaactgtctgtcctgcttggctgtcgttatcgttttctggtgatgttgtgctaacaataagaagtacacgggtttatttctgtggcctgagaaggaagggacctccacgacaggtgggctgggtgcgatcgccggctgtttggcatgttcccaccgggagtgccgggcaggagcatggggtgcttggttgtttccttcctaataaaataaacgcgggtcgccatgcgttgggcctcttgtcgctcatttctgcgctgggctttaggcgcgtgctcgccggagggatgcgggaggatggagcctggcgagggggaggcgaagaggcatccgcggagaccgggaggggctttagcaagctgggccctaaccgctcagggtagggaggggcggtcgggccgagtcccggtgcgcttcggcgtctcaggaggccgtcgtgacaatggcagccttcgcgtcgtgagggggccgccccaggctgccgcagcggcgcgcgcccggccgcggggccgcgccgagactcccgggggggtgggcgggggtggggaggtgggcgggcgcgcgcggggcggggcggggcggggcgcggcgggtggggcggggcgcgcgcggctcccgcgcacggattcttcctgggccgcagcaccggccgccggcccgccccgcccgccccgccccgcgcctctctagactctcggcgagcagcgtcgcccgcggagccgcgctggtgctgtggcccgggccctggcagccctcccgggaggcgagccggggaggcggtggcccctgccggttgcggcggggcgcgggaagaggcgggactctttgacgcggcggaggggtcgggcgacggccgacgcgccgccatctttggtccagtgcggtggcggcggcggcggtggcggcggcgactgctgcggtgaaggaggaggaggagccgagcgggcgctggcaccgaggcctgaccatggacgaggaatacgatgtgatcgtgctggggaccggtctcaccgtaagtgcggccccggcgcccctggccctgcgtcgtgccctcgccatcccccgcgatgatgcggccgccggcccatcctctggtcactgccatcttctgcgctccgctccccgaaaagccggcgccgtgcccaccccgctgctcccccagcgacgtcgcctctgctcgttgccatgaccccatctccccgaagaggcccccttcctggccgcctcctgggctacccgggtccgacccccggcgccctcccatcttccctacccctgcccgctggaccggaaaacgcacccccactcggcccgatgcccacgaccccgcccacccatcgcccccacccatcacggcatccacccgtcgcccgcacccattgcccgcctagcgttgcctctcagcgtcccttcccatcttgcgctaatcccggtggggatgaagtagaaggacctggggtcagggggcctcgccagagtgggccctcagcccgcctcctcatcgtcttctggggccaggggatccagggaatgttccagaaggaacagcagtgggggcagtaagcaca

SEQ ID NO: 7932 - DNA, 416 bp, artificial
  synthetic oligonucleotide
cttgaccgtgggcacctgtccttgggcggtggtggctctggtgggtgggaagggggttcctccccaggcctctctcccaggcccttgggctcctgttgagtttcccgtaggggacgtggccgtcctgtggccacgaaaacccatcctgccttccttgctgtgggccgtcccagcacagtcgttctgctgtggtgccctgtgctcgacacttgcctgccctgccctagctagccctgctcagacagcccttggggcaggatccagatcgggggtaggtccaggacccctactctgccacctcagcagctgattccccaagttccacttggctaagctgaggcaggcaggcctggctccaggaggctgaggaaggccagctgacagctccctgtttcctcccctggcctgaagccaag

SEQ ID NO: 7933 - DNA, 576 bp, artificial
  synthetic oligonucleotide
gccctccgggttagagaccgtcgggggcgtgtcttgagctggggacgcgactcctcggcgggggtgcacctgagaggccgggaccagcgaggccgcgccccggtggcaggtgaccccgggcgcgtctccgagcgccagggtggggcgaggcggacgcgcgccccaggcccgagggggtgtggcgcgggcgcgcgcgggttccggggtcgcccgaggcggcgggcggggagccggggcgcgggggaggcgcgcgccgcggacgcggccatcgagcgaagggggtcggctggccgggcgggtcccccttcaggtcgcgggggtcagggctgcgcgcgaggtccctggccccggggagcagcggccccgcctgcgtcccctgccgccgcgtccccctcggccgggcgtccccggacgcccccgccccgcgcggtggtacggtccgggtttaaaaggctccggcggcccccgggccagcccagtgtgtgggcggcggcggcggcggctgcgcgcttggggcccggggcgcggggcgaggccgtggggacgtgcgagcggggccgcggtggggctcggggg

SEQ ID NO: 7934 - DNA, 1349 bp, artificial
  synthetic oligonucleotide
atctgaattctagaacccccccccagcaacccaagcacaacaagaatattgggaggtgccccagctgcaaataaactcagacttggaatagtagcgcagttttattttctgtagtaacaaacatttaagaaccagataaaacatgaggccctcccaggaaagtagcaactgtgggaattcctgccctagggaaggatggacgcactgcctacaaggagacgcaaagtgggacctcgctccatttgcccaggccaggcttagcgggaaacggggggcccaaagcgctgcatggtccgcaccaccagggaaagctggtcaagaaagttgatgacggaaattcggagcaggcgacagtcttcagctttccagcggctaaaagtgaggggaaaagaaaatcaaattggaggtggcaactcctggtccctcgctctgcccctcaggcacccaatatagcaaacccttgggagccctgccattacacagcccctcaggcagagaccggcccagcgcacctggcgctccttagggctcatccttggatgtcccccatgtctccatgggccgcctcccccaaccccgtccctttcagaacttacacgaccaggatcctgccactcactgtgagatccttcccaaccaccctttggtggggctcggcatctggtgccagggacccatgggcgatttccgcctccaagggggtcgggaaaggcacgctgagggtgctgggggtcattcggttaaggtgccatctgatacgatcttgcctatgtctcaggccttcttgctcctctgaagccccctctcaggtcaccctgcctagtgtcacccccttcactccttacctcgcccaggccaccgttagcagagcttctccctccatttcaatgtcttcccctcctccgaccacctctgaccgtatacgccagccccggtccccccctgctaccctttccgtcggccccccgcccgccctcctttccttctccccgagtccagccctcgctccgccgcaagcagcccccagctcggaaaggatacaatatgtgcggccgcattcgtgaccccctggccgcagacgcggcgtctctgcccggacctggcgcgtgcgctgggggagctccaccggccggagctgcggctgtgtccacgcccccgcggcagctgtggccaccccggccatccccgccgtcagcgcctccgcctgcgtctgcatccgcgtcccgcatgaccgccgccgcgccgctccgactccacccccgaagcgcaggtcctacgccccgccctctctgtggctccttcccgaagccccgccccctgcgcacgactccgcccacacgcgcctgcgc

SEQ ID NO: 7935 - DNA, 2261 bp, artificial
  synthetic oligonucleotide
agatcctgcctttggaactcatttgttaaggcatgaacaggtctgaaaaaactacagaatgaatagcattccctgttttccccaagaagtccatctagacagtccctaaagagcctgcaactccaggattaagggctacattcagcggctaggcacagggttcagaaacgtcctgcagccgggcgtggtggctcatgcctgtcatcccagcactttgggaggccgaggcgggcggatcacttgaggtcaggagtttgagaccagcctggtcaacatggtgaaactccgtctctactaacaatacaaaaattagccgggtgtggtggtgcatgcctgtaatctcagctacttggggggctgaggcaggagaatcgcttgaacccaggaggccgaggttgcagtgagccaagatggcgccactgcaccccatcctgggcgaccagagcaaaactccgtctccaaaaaaaaaaaaaaaaaaaagtcttgcaagtgcatatgcacaccaggtagagccgggatgatcctggcgcactagcaggagcgggaggaggagctcaacttagcagagcctgtggggccctgcaacaattagttggaaaagctgaggcatggagcaggcacttcctggcttttaagattggggcctgggagatactcaccgatgcacccatgatgatgaatatgtgtgtatccgactgatggaaggcatcgccctggaaaagctcttcccgcaggatcccgcacacctgggtccggctcagggccacctgctctgccatgacgctgtctggtggaagaaaggctcgttaacaaggcagaagaacaggagagcattgagaagttagcccctttcttgagagttcctctggggtctcacaccagggtgacacctgattgcccaaatcactccttgtgaacggctgggcattggggagtggttgatgggttagaaactgctggctctgggctccagccactctctcctaggcagccttcattcagggtgtacattacaaaattactcaaagcattggtgtattccgactacagcatcaattctggacaaccgagtaaaatccttgtggggcatggaactgcgtgcccaggaccatctcattcccgactgtagcgggaactccacaatgacctggagcatgggagatggtgcagatgctggagttcagctccagccctccccttgccaagctgggtgaccccggtcggcaagtccccttcgctctcggggtctcaggggctcaagagaggaggtgcggggtataaagggattggttaagaccctctcgattctgctcggttctcaagcacaacaaacagcgtgtattttaccgccgcgcggcgcagcgcgggacagtacgctcctccgcctgcgcggcgcccgcccggccggttacctgcgcttcgtcgtcgtcgccctccgcgctcgcagccccgaagtgtacgaccgtttccgggggctgagccccgccggcccatttaatcggcgggggcgggggcgggcgcctgggctgagcggacccgcctcaggcgaggcgtgcggggcggggcctcggccaccacccctcgtgcgggcggggcggggcgagggcaggtgcgcgcgcatcccaggccagcccctgcctctcgggcacctgcgctggaggccggcccgccggctgcctgccatacccgctgccgctgctctgcatccccaattccggcgggcacgggtgcagctccgcgtagtgctcccgaatccccatcgccggccaggccccgcccctactgtccggtttccccgcctgccccggcggcctcgcgcgctcgcggagggctccacttccgccggcagcgtggccacgcctcctctgggctgtccctcggctcctgggcggggccttctgccgcgccactcccccgggaaccctcgcctgttcgcgggtcaagccggccctattgggcagtctcttcttgattcctcccccggagagggcggggcggccgagcgccccgaggctagacgccgccgtccgagagacgagggggcgtgtaggcggtgacgccctgcaaagtggccggcgtgcttatcattaccgagcttccgcgggcctgcagagcctggcggactcagacttctctccggagcgggatgcggccctaccgcggcctcacacttctcgccggcttcccgagttctcgggggcggggcttgtgtttttacttccggatcccacagctatgacaccggaagccggaagcgtggt

SEQ ID NO: 7936 - DNA, 2488 bp, artificial
  synthetic oligonucleotide
ttgactggacggtttctgttttcaaaggatcgaggacatgaggaagcggcatgtcgaggtctcccaggcccccttgccccccgcccctggtgagtgagcgagaactgggcctgcgggaggaggtgggtggggagggcaggtgctgcgccgcgggaggtcacagttcgaccttcctgttgctctctggagacttgacggcgggagctcgtgtaggccaccccatcggtagcccacccccttccccgaggctaagggaggcatgccgtggtagcggcggctcctggtcttacatgagtggcctgtgagaccaggcctgccattgacagtcctgccaagtctccgtccccctccatcctccccttccctctgactcttctcttttcccagcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgctgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaatccttgtgcattagtcgtgcgtatctttggcatagattctgagaagtgacaccactgagcatgggcgatggcgtagatggtacctgagcccccttcctccttggagcttggtttcccatctctccccaccccctatttccctagccttgccaaggaggaggtgggaaagcccgtttgggtttttgtcattcgctaggccatgcagttctctgttaagagtgagcttaaacatctttcctgaggctttaaggaccttttttagttctgcttctgaatgggctgctcatatcatatatatatatgtatatgtatagttgtgtatatgtatgtgtgtgtgtgtgtgtgtgtgtgtatttttttttttttttttgagacagagttttgctcttctcgcccagactggagtgcagtggcgtgatctcagctcactgcaacctctgcctcctgcgttcaacctattctcctgcctcagcctccctagtagctgggactacaggcgcctgccaccacgctcggctaatttttgtatttttagtagagatggggtttcaccatgttggccaggctggtctcgaactcctgacctcacgtgatccacctgccttggcctcccaaagtgctgggattacaggtgtgagccactgtacctggccaatttttgtatttttagtagagatgggggtttcagcactttggccaggctggtctcaaactcctgacctcaggtgatctgcctgcctcggcctcccaaagtgctaggattacaggtgtgagccactgcgccccgctgggctgctcatatcttttatccgtttttctactgggttatcttttgttgctcagcttttagaaactctttgtccatgagcaggattgggtttgtggctgtgatagaaattgcagatatcttttcctgctttgacctcgctactagtgtttctttgttttttgttttgagataaggtctctgtcacccgggtgggagtgtagtggcacaatcagagctcactgcagccttcacctcctgagctccagcagtcctcctgcctcggccttgcgagtagctgggatcacaggcgtgcgccaccacaccctgctaaactactggtgcttctcagcctcgaagtttttttttctttatgtagtcacatttatccattttttcccccttttactgctttgactttggagtcgtcgtgaccaccttgtggtctgtgggagggatgcttcacacatgagcacttttctttttctaacaccgaagcgtgctcttgtcttcaccaagagtgttgttgcccagtgtgactggtgatggctgtttcatcatattccagaagtttgtgatgccatttcccacactggccccaattaggaagaacagacgac

SEQ ID NO: 7937 - DNA, 219 bp, artificial
  synthetic oligonucleotide
ataaactcagacttggaatagtagcgcagttttattttctgtagtaacaaacatttaagaaccagataaaacatgaggccctcccaggaaagtagcaactgtgggaattcctgccctagggaaggatggacgcactgcctacaaggagacgcaaagtgggacctcgctccatttgcccaggccaggcttagcgggaaacggggggcccaaagcgctgca

SEQ ID NO: 7938 - DNA, 225 bp, artificial
  synthetic oligonucleotide
acagtagttaatcctgaatgacagaacccaattgattttcattttcttccatttcctaaattgtcttcaatttccttgtactccttgaatatctgaattctagaacccccccccagcaacccaagcacaacaagaatattgggaggtgccccagctgcaaataaactcagacttggaatagtagcgcagttttattttctgtagtaacaaacatttaagaaccag

SEQ ID NO: 7939 - DNA, 1808 bp, artificial
  synthetic oligonucleotide
atgtgcacaggaggggtcagcaacctgccttcagagccaggctttccaactcaggctgagggaggagaacctatacctatctgcatttggagctctacgttttgatccttcaatactgctgtcatttcagcaatgacactttttgactgaatctgccaaaaggaattgtgtgggcctcttcccctcctgacccatggacgtgcttcatactgtcctggccaagagcgcctagagcgccaggattttggtgctcagattctgattgttctgattgcttacaggtgttggtctccttctgcgctgctttttcagtggccttattgaccaggtataggagatgcctcagattaaaagacaacaaggagaaaaaaaaatgttgctaagatcctacctgaaccaactgtgaaaggctttcaagttgaatgtaaattgatgagacgttggagatggaactagcttggggagcagttggagttacagatagaacacagaaatcctggaaaccaagccacacccagtaaacagcaactggctccaactttccctgggatcttagcctgtgctgacctaaactgtatgctctgtgaaggcaaggacgttgcccatcttggtccctaaagtacctccaacatctttaacagtcttggcatacaatacgtactcaatgtgttgttgtggacagcatgactgactaaagtatggctataaaggggcaacacaggggatctttgtgatggaacagttcagtattggtttcagtggtgggtacatgactctacacaggtgatgaaatcacacagagctacacatgcacacacatgcacgtgtaaggggtgacatctacagctgctcttagagggtatcaatgtcatttgctgttgtgagaccgaactagaattatgctagatggcgacactgagggaactggggggaaaaggtgcactggtttcctggacatttctttacaacttcctgtgaatctagtgatttcaaaatagtaagtttacaaaaagacactcaatccaaaggaaattttaaaagtgcagaaaaagaaacctagaaaagatagggcaaataaaaagcacaataagatgcttgactttaatccaaaggcacccatgattactttaaatgtaaatggactcaatgctcttgtgaaaagacatttatccaatgcctactgtgaaccaagcccggttggttgcaagggaaacagcgaagaatatgacccaggccctgctcctatgatgctcggtgcaatgaaccaagaactgggccaaatgctgttaatgagtgccacctggatgagttcgtaactgccagaggtttggagtgacggaagatgaagctagagatgtggcagtagcagacaagttgcaaggagaattaacaggactgggtcaccaaatgcatgtgggccaccagggagaggaaaggattcagactgaatcacagggttctggtttgcaattagcagataatactattgtgtaacatgctatcagggcctcatggaacaagggcaaatgagctttcactgatgacatttctttctcctacaagtttttatcaattgacattcctaatctcgtgcagtggtcagggcagctactaccctaactttccagaaaaagaaactggtactcagacagatgaagtggctttctcactgagtaacagtgaatctgaacccatggctcccccattcagtgttcaacaacattgtttcaaattatttgaaattaaagaagagagaaaacagagccacagtaaggagagggtatgtgcccgttcaagttggttgatga

SEQ ID NO: 7940 - DNA, 195 bp, artificial
  synthetic oligonucleotide
gcactctagcctggggagaggagagaatttgaatagcaagtgatttttggcacctgcattccctttgtggcttccccatttattttttgtttaaaatacactttgtttcacagttcattaacttctgtaaatcttataactacaaacttgtgaaaataaatgcctactattacagaagagtttctatctcaattt

SEQ ID NO: 7941 - DNA, 1077 bp, artificial
  synthetic oligonucleotide
atccacaaaagaacaaaagttcaaacaggagctgtcaatgtaactcaagataccatagaagagaaaccaggatttacagcatgttatgaaacagattgtgtcaaatactcaggattgaaaacatttgacttgacagtttaagatggtctcatcctccttggcctcagtagtccaacagcacaataaaacaccttgtcctcaaattcctggaactagagtggctactgactccagactatgacacagatgtatacactaaaaagaataacaaagcaaggcaaagaactcagtactcctctttcaccagcaagctccatgtttctttgttgtttagctcaaaccccaaaatgctaccaagtggtactgctgtcctttccaagtctaatgcaatgggtggcatgtggcaattgctcaaatattaacttactagaaaaatattggtataaataggtgtgaaagaaggctcagatagggagatggtggcactgggcaattcacatagagatcttatcatgtactgattctacagagccagttattaagccacaaaaagtctcttggcacactcacaaaaatgctaccagtttggaggattataagcttcatgccccacaccactgaacagggagtaaattattaatccctgaatcaaaccccacccagagctcccacagagtaccttgtctatggatcatgccaccatgaagaattctggccaccgtacaggactgtttttcattcagcttcagcgtgattccctgaaataaaggcgacggcacaataagctttattttaagctctttctgaggttattttagaaagaacttacggtaatttctcaggaaaatattttccatttatacccaggatagtcctcaactagaacaggcatgaagcctgctttgaggaggaatttgagataagaatgaaaagacaattttggggttggccaattccctaactccatgagcagcctcttgcattgactcttctggcccagtgactcatggggcagagagtaactggtgggcgacaatatgacgggggattaccatgggctcttctgtgaccttctca

SEQ ID NO: 7942 - DNA, 381 bp, artificial
  synthetic oligonucleotide
ggacttaggaccacggaattcaaagaaaccagtggaattaggccttagtctttagagggcagaagtcttcagaagaagctggtcagtcttctccttaggtctctgaagttccaaacagaattccaccactccttatgatatcactgattacatttaaccctcccccagtctccttatttgacagctaagcacacagacatcattttctctctatgtataaacatctgtgttgataccaaaacccatccttgcagtagttctatcctcttaggcttgaataattctaagatattttattcaccacatggtatctaactatgcattataataacatatatatgtggcatttcatatcagggaaaaagaccttatttaatatga

SEQ ID NO: 7943 - DNA, 2399 bp, artificial
  synthetic oligonucleotide
aaatggactttagcttctacaattctttgacagatattagctcagtactagatatagagattcttcttccaggaggttcaattagagatcatttcccccaaatgcctgtgtggttgtctgcccataaccaaacttccttgacacactttttagaactaacagttgacagaaatacctcagaagaaacagtcaaggccttccccgattttttccccaaccactgctctgagtcagttaaacagtaaatctgttgcctcttacctgaggtctccaggcattactcctcccttggaggtgaagtcgagcttttgaaggagaccaggtggcaaacatattggtaaagtaggatgaagcagtaatctgtgcatctgatattgctttactctccattcccaatggcatgctgcaacctcaaagaaaagaaaaaagaaggttatcacaaggacatgcttcagcctcagttatactgagcagcttccactgatattctagggctactgtcatcataatatcatttctcaggttttaacttttgcacagattctgttattggttttttgttttgttttgttttgtttttgtttttttgagatggagtctcgctttgtcacccaggctggagtgtagtggcatgatctcagctcactgcaacctctgcctcccgagttcaagcgattctcttgcctcagcctcccgagtagctgggactacaggcgcacaccaccacacccggctaattttttgtatttttagtagagttggggtttcactatgttagccaggatggtcttgatctcctgacctcgtgatccacccgccttggcctcacaaagtgctgggattacaggtgtgagccaccacgcccggccaattctgttattgctatctgttttccagccagctcttcccactttgtgtgactctttaattttctttgtttcttttcttcttctacttttattttagattctaggggtacatgggtaggtttgttgcatgggtaaattgcatgtcactgaggcttggtgtatgaatgatcccctcactcaggtagtgagtgcagtacacaatacataaccttctaacccacacccccctcccaacctctcccctcctgagtgtccatcattgtgtccatgtgcatttaatgtttagctcccacttatgagaacacatgatatttggttttctgttcctgcattagttcatttatgataatggcctctagctgcatctatgttgctgaaaaggacatgatctcattcttttttatggctgcatagtattccatggtatgtatgtaccacattttctttatccaatctgttgttgatgggcatttaggttgactccatgcctttgctattgtgaatagtgctgaaatgaacatatgcgtgcatgtgtctttatgacagaatgatttatattcctttgattatatacccagtgatgggactgctgggttgaatggtatttctgggtttgcccaggactatgctggttttagcactgacaattttgtgtcctgataccgggaacccctcccccagtctcaggataactagaacagttagtcaccctacccatggttgagggaagaaggatatgggatgacttggcacttactatttaaatcacagcccatcaactccatgcgaagagtgctgcgaatgctataatgagttgggtgcaaacggatgtatcgagcaataattggagggttaaaaatattgtgttttatcccagatgaatccacattgccaaagaagacctgtatggagagattagcacaaatacatggaaagtgaatacagagtaaaaagcaatttctgtcaatcatatcttccttctaatttgctttgtgcgtttctcaacagcatccaacatctacataagacaactatggttagatggatgttacgatggtagacacaaaggaggaaagcaccaagaagaagtgggaacaaaggaaattattaggtctggggcaagtgaagttattttctactttgagttcctgtaaaaggctcataaaagttgaggaagccatttgggctctgctactccagcatggtccacagaccaggagtagcagcatcacctgagggcaattcaaaatgcagcatcaggagaacggtatcagtgagttgatgggataggaggtccctagctcttgttcccccacaggaacaataatttgacaatgatctatggacaaaagtgtctttgtgggagccttgggattcaggtaggaggttgagaaaccctggtagagctcaagaacaaagatgaatactttaataaggcaggcccacattctagcggcaggcctgtcaactgtagttctggttgtggacccagaagcagcccaccaccctggggacttagctccagagttg

SEQ ID NO: 7944 - DNA, 1770 bp, artificial
  synthetic oligonucleotide
atgtcactatatctctctagttttcatcaccgtctccaagaaaatgagacagtttaactgtccagatactgtggcaagtgcacatcctacttggaaaaagatgtggtgggaaagggagaaattatgaatagaaaaaaatagaagaacaaatatctagtaaatagcacaataaggaaattataaaatacaatattctatcaggctgaaggaattctaaaccaaagccatgaggctggagagaagagggagaaaagaaaaagctctgtgccactagaattaaatactaagcattagactcttgcacaaatgtgaaatctgaatccttcagaaggaaagcaataccctgaactatgtaaaaaataaaaatgcaactcaaaggactaaacaaccttaaaatttttagaataatggatagtaaaggactttaactctggagaataatatatcactattactagaaattcaagctaaatatgaggctcaacccaaagttaaagggctaaagctttgagaggaggggcatagaattgtaacatatgccacattctggtaggtgagtataactcacattataacttttcaaggttcccatgcatttcgttcaggattttttttttttttttttgaaacggagtctcactctgtcgccggcctggagtgcagtggcacgatcttggctcactgcagtctccgccttccgggttcacgccattctcctgcctcagcctcctgagtagctgggactacaggcggccgccaccatgcccggctaattttttgtatttttagtagagacggggtttcactatgttagccaggatggtctcgatctcctgacctcgtgatccgcctgcctcggcctcccaaagtgctgggattacaggcgtgagccactgtgcccggcctgttcaggatttttagttgcatccagtgggacacacagggaaatgtggctcactccatcttaaacatcttaataatcagaatttcaaaaggcatatattggttttgaaaagactatactacttatccactaatatagcatgagaacactcttttatccacaagcccactagtaattataattttggcagtttgatgggtataaagtgctatcctattgttattctatttcgcatttccctgtaggatagtgcaattggaattttttaccatatttttgaccattcagatttgtggtatatataaatatatacacatgtgtatgtatgcaatgggctgaattgtgttcccccatcccaaatttataccttgcagtcctaaaccccagtacctcagcatgtgactatacctggagatagtgtttttaaataggtagttagttaaaataaggtcattacggtgggccctagcccaacaatactggtatctttattagaagaggagattaggacaaagatatataaaggagaaaccatgtgaagacaagggagaaagccatctacaagacaaggagagaagcctcagaagaaaccaacgttgcccacatcctgatctcaagcctccagagttgtaagacaatagatatctgctggttaagccacccagtctgcagtactttgttatggcagcactagaagactaatacaatgtatgtatgtgtttatatatgattatataattatagagaaaatatgtcttaaaatatgttacctgggcatggaatggttggtgaaaagatgtaatatagaaggagatagggaattaaaagggagagggaaatcaagtaaatattgaaaggaaaaaatg

SEQ ID NO: 7945 - DNA, 1306 bp, artificial
  synthetic oligonucleotide
ctggttttttccagccagcagcctctacactccatcataggacatcgagtccctcctcctcttctcccatgccttcttccctgccatggcaaatctgagtggcttctctaagcatctgctggtacaagtcaatgtggcaccatgagcttcatggtggcagaagagacaatagtccttagctctcctcccagtacaccccctacttggccagtctgtaggccaacaagaaggttcctttacccccatgcaagacacttatgagaacacattacaagatggctgaccgtggaggatgagtggatcctgaaaggttgtcccaaactgttgatttggaaaagaaataagcacatagataaccttattgtgtgctgcatggaaaggaactgaatacatttgcctttaagcatgaaagattttggtatcttggtgtctactttcttttttagttggttttacattacagaaagctatttaaatgtgttataattatgccgacaaaattggcagcataattactgtaattgaaaaatctgatattgtccaggaatgctttctaccgtacaggataatgtatctcatggctgtttccaaagggtttatttattgtaaaacaagtgatttaggtgggaaagggaagattttggatttttattttgtagaaaaggttttaagctttgaaatgtgaatgaaatatccttatcaaaacattaggggtggccataactcctctgtgccacttctactatttttttttttaatctagttagtatgaaatacaacatttaaaccggaattttaaagaagtagctttccagggattcagaattaagaaagatagtgataggacatgagaaataaatttccatcaagtgtaatctaccgtctcatgatgaccacaaccctgagaattattctttaaaagcttacacacacacacacacacgggcacacacgcacacacagaatcttaccacattttgctgtagtggcatgttaccatgtctacagtccctactagaatatcagtcagctttcagagggcaagacttctgtcttcaccattatactcacagggcctagcacttaataggtgctgagtatttgaataatgactttatagaaagaaaactcactattaaaggttagttttactcagaattgttaatcttggagatgatctcttgtgaaatatgagtgtgtttctaaggccatacatttaaaaatgtttgcattttaacccgtcttgagaatgatgtattgaatttgaaaatcaaaactaccagtggatgtgtggaactttacagaa

SEQ ID NO: 7946 - DNA, 1044 bp, artificial
  synthetic oligonucleotide
ttagaacacgtttgtatgatatccaaaatgcagcttagctcttcttaaatcagcaaagactcaataagctggaaaccatcattctcagcaaactaacacaagaagagaaaaccaaacaccgcatgttctcgctcataaatgggagttgaacaatgagaacacgtggacacacggaggggaacatcacacaccggggcctgtcaaggtgtgaggggttacaggagggacagcattaggagaaataactaatgtagatgatgggggttgatggatgcagcaaaccaccatggcacgtgtacacctatgtaacaaacctgcatgttctgcacatgtaccccagaacttaaagtataatgaaaaaaataaaaataatttaaaaagtctatccttaggataaatataagggtgtccttaagtgtgcgaggcatactttagcctgataaggtaccagcccaggaagacatcatactcttggggtattttctctttcatgcacacaatgatctctcagttacatttttgttgttgccactccctgctgtaacgtgtactttccccctcttttttgtttcagcaagttggaactgaccagagcaacaacattccatatattactcaggtcagtgtatctctcctatgtatttaagtgacgtttttgtctttgtttatgtgtgtttattatattaatcatcatctgagactctccatcctttgctatatacttatgtgtgtgcgttttcatttctccataagtaacatatatatgtgtgcttattatgtgtgtgtgtgtatgtgtataacagctagaccatgctttcaatattatcagtagaaacagcagggtatttggaataaagaacttagatttgaggactgccctgtccacctttcaggtatatggtctcaagcaactcatttccattctctgttccttatttctgcaactgcaaaatgggtatgatgcaccacctggctcatagtagtgttgtaagaatcaaaggagctcaggctttttttcttcctcagcaactagttctcagggat

SEQ ID NO: 7947 - DNA, 1314 bp, artificial
  synthetic oligonucleotide
tgacacatgtgcttttaaagggttgtagtgtaggatgacattgggtaagtccatgggcctagaagcctaggtggagttcttaggattttgtatgtagactatgaagttttggaaacgtttgagctggagagaagacattctgatcaaaggtggctttcaggaaaggctggtgcgacaggcagggtatttattagaatgaggccagtgaccactctgaaacagacacaaagtaagttcccttcaaggggcaggaagctccctgggatggtgagaccagaaaggcacagaggctgaaccctcgtgatggcgctaggtcccaggttcgctagcatccgagagaggggattgggtcgctccagaggccattgcgaaggctgctgccagttctagggtcggggtggggtcaggctaggtccctattcctagggctttagcaccgctcactcacaagaccccttttcccaggaggacgtatgggtttttcctgtcgctccagcttctctttcgcggcccttccacgcttgtcacttacctgagcgcagccaatcagcacctagaggttgggctactttcggccaaaggagaacggggacttgtgggggacgctccctgcgcaccaatgaatgtgcatggagatggagaggcgggcctgcaagtgcgaacaagccaatcacggaatcccggcggccggcggcccgggaggcagtcgcgcgctcgcatccccaagatggcggccgttaaggacagttgtggcaaaggagaaatggccacagggaatgggcggcggctccacctggggattcctgaggccgtgtttgtggtaagaggcacgctgttccctggcatcttggcttgaggccttggactgcccctttcttcccggctcccacccaggcctcgactgttggaaggagctgagccaagtgttcagggagggggcgctcggtctgctctcacccctcgcacctggacagattgagctctgctgggggcccgcccggaagaaacgtagctcgagaaggccgtagaagagaacggggtgcggggccgggacgaggggcgaggggcgaggggcggcgggtggcagggcagggcggcctgagggacctccgggctgccgccggttttcgtccccctgctggttggaaaaggggaggtggtgaggagctctcgactcagcatggatgctggagacacagtacaatgaataggcagaacagccagtgctaagatgtgaaaaccgggaatatcactttgtctgttgaaggaatgcagtggtctcgggaatgttgcctcgggaaatggaagaagaga

SEQ ID NO: 7948 - DNA, 173 bp, artificial
  synthetic oligonucleotide
caggtaggcaatgaccaaataggattttttttccagattttccaagtacacccatcttagactgaatcagtttattttccctagatcaaagctgtggattctagagtaaaagtaaaaaatttaaaggtaaaaggtcagtggataacaatctcttgcatttgtctatttttgct

SEQ ID NO: 7949 - DNA, 2217 bp, artificial
  synthetic oligonucleotide
taatctataaagtactcttacaagtccatattgcccaataaataaataagcagtggatatgaacaggctgttcatatagaaagaaattccaacaaacacataaaagatacctttctttgcttaggagaaatgcaatcgcaagttcaaagtgaacctgtacaaggatattttccacagtggtgtttgtggaagtggggagctggaggtaacttaagtttgtaattatttcttctccttacccctcttcaattacccaaccagtatcttctatgcttagttagttttcaatagataaatgagtaaatgatcataaacttgggctattgagttttcttgatctggttcctgctgctctactttagttcaaattgttctctgcaaagttttctgtgtacactctgctccctctcacttctgtctttattcatgctgtttcctatccctgggcgtttcctgtctttgcttaggcagtcatactcatccggtctcatcttctccagttaacctttcctcctctgtgttcatacatataattacaaataatacatgctacaatagaaaagcaaagggttctgagtgaaagtaaacatattcattgattattcaatgaattcattgattgaaattaagcatgttcattttgtgccaagtgttacagtagggagtgggcatacaaatatgagcaagacacactttcgtaattgctgattatctatttccctcaactatgttagcacagaagttccaagaatgaaggggctttgtctgtttagattacatggcatccccttgtgtgagtctcctcacactgttttcccaggaacaagcccagagtctggcacatagtagatgatcactgaatgtgtgctggttgcaagaaggaatcaatcgtatctatttcatgttagaacatatgttagcatatatatgtgcacacacacagatgtggaaataaaacataatacacatgtatttatgtatttaaatctctgtcagttatgttaggatgacctgggaacgtttttgaaagtatgtaacatagggactgagattgatgaattacagatacagagatcaattccagctagtttattagccaccaaagggcaggttggtggagttgtggtgcaagcaatatgtgttattgaccggccttccctgccagggcgcttctttccttgcactaaactccgggttagccgaaggtgggcttcggcagaatcctcaagacccttggtgttgccctcctggaccgcacctagaaccaggaagtcctctctccccagaggcggtgcaaaccccgaagaccctcccactgcttgcgggcccggactgcgctcccacctgaacctctcttgacccgcggtatcccagatctggagcttgatgcgttttcctggctcgatctccaccaagcgggagaaaaaatccacccccacggtggggtcagaaacctgggcaaagcgaccctcggtgaagcggcggatcaggcaggacttgcccactgtggaatccccgatgacaatgagccggaactggtacagccagatggcctccatggccgcggctctgcaggtctccttggcccggaccggggacggcgggagggggcgccccgccgacgcctcagagagcgcggctcggcaggatctagctcagccgcgagcgcatcgctggcctgggagcccgaagctgggtaggcccaggcgccgggagagcggagggatggatgctgcgctcgcaaaggtgatgaaatggcagcagcatcagcaccacgcactctgactcatcactgacaaccgggttactgtaatcccccgcgtagacgcgacgcctgggccgccgcactatctgtaagaggagcgcacacaaaatggctgcaacattagcgcgatccctccctttctaactaccccacccaccctctgttcattaaaactgttctctgtcgttcaaactgccaatgtcataccttttcattgaaactagcaaagcaatacaaaactgcacaaaaaagggaaggcacataattatatattagtctacaagtgtttccatgctcacataaacacacaaatattatatgtgtttgtattcctatatgcatttattgctgtttgtttttacaaaaattaaactggggccttactttcaattaataatcgctttttgcaattaataaagcatcataaatatctttccatttccacctaattt

SEQ ID NO: 7950 - DNA, 890 bp, artificial
  synthetic oligonucleotide
cttattagacaatgaagtagagttcagaaagaagtagactagtgactattgtcttttcacagagcagctgcgttgttatcaaaaggagagctataggatcaaaatgcatcacagttaaggcacagttggactaaaaaatcagattgtaaataaaaatattttaatcatttgaaaactgcctgaagtgtgtgcgtaagctccatactgttgatacttagtgaaagtcagtataatggccatagagcaggaagggtgatttcattggttgtgtttagtatttagagtagtgtgtatgtgtgtgtctgcatacatatacaaacatagacacacacagacatttattctaaaattccacctccaaaattactggtaaagctagcacagaatcacaggtatggaaatactgagtaagcttgattttgtaaaatttaagtgcttactaactattctctcaaacaaaattttatttgtaagtccaaagaaagttaggatttaatttaagaaaggtaacaggaaaaaatgactaagtaatagggccactgacaacacatacagcaacttttctaccagttactaaaagtcactttctctagatggattaattacaaaaaggtaccctcctggaaagacaaaatacaacaaggcactcctttcggtctgacacagtcctgtgcgagacacaaggcttggttagtatagcttgggctggatttctgcttctgctcgtgcctgctctgacacatacaacctgaactgttatgtatattgtaaccctgttctatgaaccgcagacataggctgcatcttcctgagatgtgtgtgtgaatacatatctgtcacgaatgttaaaggtctttgaattgcatttgttcagcaacttttccattaag

SEQ ID NO: 7951 - DNA, 1574 bp, artificial
  synthetic oligonucleotide
tttaatgcagactgttaggtgctagggctacaaagacggataagatactcctccagtctagtagaacagaaagacacaaaaataatcttggttctcatgaaacctaaaaatattcataaatgtagaaaatgaatttagaccgtgcccggtggttcatgccagtaatcccagcaattagggaggccgaggcaagtggatacctgtggtcaggagttcgagaccagcctggccaacatggtgaaaccccgtctctactaaaaatacaaaaattagccgggtgtggtggcaagcgcaagtaatcccagctacttgggaggctgaggtgagagaattgcttggacctgggaggcagaggttgcagtgagccgggattgcgccattgcactccagcctgggtgacaagagtgagactccgtctcaaaaaaaaaaaaaaaaagaaaaaagaaagaaaggaaaaaaaaagaaaatgaatttaaatacagccttttttctcagcataaaataatttctaaatataaaccttgtgtgaacaaagaaattcacttataacccaatataatcaaatctaaactaagaacaaatctcatttaaacattgttatttctttgcaataattattgcataccaaaaaagagcccactatgagttaatgttacttaaatagaacattgctcagcctacaaatgaaggtcagcagacaccagtgtcttggaataaaatagccctttggcaagaaaacgagccacaccccattaagtttttacaaaaataaaattctttccagctttactaaattgtagatgttgcgcccagcatgtacttctgcagtagttgattctgcagctgtggaaatattcatgtatgcagaagtccccaaaaacatctattcaccattacttgcacatgcagctcttatactttctgtagtaaagtattccgttaagttttattttgactcgtggataatagcaagcaactacaggtatagctgacaccttaatttcctgccttgaacttctggccacagactttatttttttattttttgagatggagtatcgctctgttgcccagactggagtgcagtggcataatttcggctcactgcaacctccgcgtcccaggttcaagcaattctcccgcctcagcctcttaagtgcctgggattatggtgcataccaccatgcctggctaatttttgtattttttagtagagatgggttttcactgtgttgaccaggctggtctcgaactcctggcctcaagcgatctgcccacctcgacctcgcaaagtgctgggattacaggcatgagccaccttgcctggcccattgtcacagaattcaaattgagcaggaatacgtaggatttcaaatctaacagttgtttcatttggtgggatagcatcaaagccatgtactgtgaccactgtatatggttttcttcaagagcagcaataaatttctgccatgtaccatgggaaagagctgtacttttagggagaaaggaaataagccctgagaaaaagccccattttcctagttcctttcacagttcacctggcacacaacggg

SEQ ID NO: 7952 - DNA, 500 bp, artificial
  synthetic oligonucleotide
acattgaagtccaaagtctctagtctgatgtaaccatttagattcaattgataaaaatgactaggcttatggcattttgggtagaaggattaattataactagtgagtaataatttgggtgagattaagcctcttccacaagtggttacacgcacattagactttgactgtgactgtttatactggcagaatgtcagtatctagggcactatcagaaacccaatgagatttttctcccaggagaacagaattctgttactgaaaataaaagggcagcttggccatggtgcttgagcaccaaagtggttctttttggtgacactgagagggtacaagaagaaagtccatttgccattatcccatattctgttttaggcattatttctacttggattttcatgaaatgtactgacagtgttcttagcacatatgataaattcatgagtttgctgttgtgtttgatctagcataatctatgtggaatgtataagctgaactgt

SEQ ID NO: 7953 - DNA, 3543 bp, artificial
  synthetic oligonucleotide
tttactttaaattctagaatttgaaaaataaactaaaattgaatacaacgtaattgagacaaatatatctgcactggaaaatttagcttacagagtcccttcatgctattgctcagtctgtaattttaagtttaagagcaggtggaagctcttcagcggtgaccgacagacaccataaaaggtagaaaactgaaaaagcctatttcctgtatctaaaaattttttgtaaagaattccagaagtcacaccaaacctttggccaattactgaatgctagaaatctcatttgggagcttactgtaaatgtgtgtggcaatgcactggctccatgttcaatccaacgccaacatgttgaaatcagtatttttgtgctggcccaaacctgaaccagtagaaaatctcccataacagaaattcaatgtttgtgaaagcatgattgccctcccatttctttttcaccttcctgtgcctttcataagttcttccagttggttaatcattaattaatatttaacaaggctttttcctcgtgccaagtcctctgctagtctagcctttaggcaatatatgaactccccaagttcttcccttttaagaagccttggcactcactacggattaatttctctaaggaaattcataatggcagatgaaataggggttccttttcaagaacattccattttaaagcctctcagcattttttcctggtacatgtaaaatgcgacttaattgaactaattttaaatgttgacagaactttccaagcacacatttcctcaacaaaatggttacgactggaacaggaaagggcttagactttttcttctacagctatcccacaagtcagtctcttgacctgaccctgcaaaatccctcaaactctggctctctgagttgattttggatatacgatgaaccataggtttggaatgcagataacctccacgtgtattaatgaaagaggtcagctatgacgtggaagccatctcctgggcagagaaggagaagaaatggcagtctggggagtagtaacatgtctccaaattttctctggtgaaaggagactgatgagaattgatacccatttccggtcaaaagagtggaaccaatgtacttccaaccacctcctctcaacccctctccgcatggacaaacataccagacaggtgatgtgggctaacaatttacttggcatgaggccaaaggcttgagggccctgccctgcccatattcttctcccttgacttcttaaggaaaggaatgattgctgatgtttccctctgcaccctttggcacctggactgattgttgcagatgtaattaggaatgttccccaacatgccgttattcttctcacgattctgggagaaactgtacccctcccccatagacttatataggtggcattcaaattcttgttcccaactttttcatctgtttattaatcccacaagattgtgtgaatgtgtactccgagccaggcacgttggacttctaacttcctcttagcccaagtaggaaggggagactcaggcgctggggaccattctcctctccctgcagcagagttgcagtccctatccctcctgggtgcccatccccgtgcctattttcctggatccccacccagttgatgtgacaggctcgtggcccaatccccttcctggttcccaggccgactgctagcaccacccgagccaatggcggcggccgaggggcggagggggctggcaggaggggagggagcgctggctttagagccacagctgcaaagattccgaggtgcagaagttgtctgagtgcgttggtcggcggcagtcgggccagacccaggactctgcgactttacgtaagtgctttgtaggcgccggcgggcactaggggagcgggtttcctgggcgtgggcaggagtgggtcccggggagagcatctcggttaagctcagcaggaacgtgcggcgcaccgtggggcgggggttgggggagagggaggtcggagaaatttcagttggagccctcgggcgcccgggcgatcggtcgcaaccgaaatgggtgtgagtgacggggagtttccctactagcatccgccgcagacacgttttctgcacttcactgtattaagtggtgttttcttactagttgctcttaacttgttgccagtcttgggctggagtcctagacgccagcccttgccctgattcccctccgcggctgcggccccgaagtggaaagggagcgcacaacttccctctgtcgtccttctccagctactgccatcccctcttccctcccgcccggactcaggaaatcccggagccagcagcctgctactcctccagcccccacacgcccgcctcgggtgacctggctggcttaagccgaccctggggctctggagagggggggccgtggccgagggaaggcacgaggtttgggttgcctgccttctgcctgcttccctcccttgtccttagcgagggcgtcgcgaacgcacctagtctccctatgagtaagcactttttttcctttcagtaggagaacatctctgggctagtaggacagtacctttccgttctcccctggccccacaccccctgtccttttttcagctcctttgactttgcggccccgggcgcgcggtcggggcggcggcagtcccggacctctcccgactcttggagagagagaggcaaaggggcgacgggagggaggtaatagtctacccccccgccctttccccgcacagctgcacttgcctgtgtttacttttctccacccgcagtacttaagcgctgtaatgagaggcccggggacgccgaccacccccgccctggcttctcgccagtcccaaagttgctgccgccgtcgctgctccagtgtgctggcggttccgaccgccgggctccgggacgtaagatgatcccagcccgggaggtggagtgggggttaatggcatctgactctagccttatgcgatgctccttgcctctcacctgagctgcacgatatccccagtggtgcagaaggttgaacttttgcagaaggttgagcttggagctaagtgggttggagagcctcgccatttagcgtcagacagacgggatgctgggggcgcccggcctgttaagagggattgggaggagggaagggagcctggctaacagtaggtagaaaatgtagggaaaagtaaaaaccattgaggggcaagcacttactccactttgctggatgtcacaatggactggggagcctaaacttgatcctcgagatgcagttcatggtgaattccaactaagtggctggagccccacacataccagttggaatcacgtgccccaagtctctgatggtcacatgacgtctttttactttaaagctggaatgtaatggttgaggcccatattccaaaaaccacctctacgtttgaaaaaaaaaaggtggggaggagtgtgaactagcttctaatcaaggaagtctactaggattttggatgaggggaccagaaagggaatttggtgctcagcttttatccaaaacaaaa

SEQ ID NO: 7954 - DNA, 1080 bp, artificial
  synthetic oligonucleotide
ttaaaacaccagtgatatataccatttttgtcagtcaaattaagaacgtttaagggattgagagaaatttcagtaaaatggataggtactcacaaacactgctagtataatagatggacaaattggtgtaaagtttttttttgttttgttttgttttgttttgaaacagggtctgttgcccaggctggagtgcagtggcacaatcacagctcactgcagcctcaacctccgaggctcaagggattctcccatctcagcctcctgagtggctgggactacaacaggccaccatgtccagctaatttattttttatttatttatttatttatttatttatttatttatttatttatttttgtagagttggaggactcacttttttgcccagcctggtctcaaactcctgggctcaagtggatcctccctgcctcagccccctagtgctaagataacaggtatgaaccagtaagccaagcctcaaactttctttaaaacaatttaagaattcttactatgaatgttttttgaaaaaaaaaaaaaatcacacacttagtctcagtaaattcctaagactctagtctaatcggaaatttagaaaaaggactaagaacaaaattattattattattattattattatttgagacttgagtctcactctgtcgcccaggctggagtgcaatggcacgatcttggctcactgcaacctctgcctcccaggttctagcaattctgctgcctcagcctcccgagtagctgggattacaggcgcctaccatcatgcccaactaattttttgtatttttagtagagacagggtttcaccatgttccatcatgttggccaggctggtcttgaactcctgacctcaggtgatccacccacttcagcctcccaaactgctgggattacaggcatgagccaccgtgcccggcccataattatttttaagatggaaaaattggaatcaatctaaagatgataaaagaatgattaaagaaacaatccatggtatatccacatgacaatgttatatagcaatttaaaatggttttttcaagcacttaatggtgcttaaa

SEQ ID NO: 7955 - DNA, 1035 bp, artificial
  synthetic oligonucleotide
ttgtcctgagtggcttttgctcagctgtcattgaggttttaaattgtacatcaggctgtggtattaattccctaacaggcatggaattgtaaccatctacctcattctagctcagcaaaggaaaatgtattttccctgcatcactttagaaattaaagctcttggctgggtgtggtggctcacgcctgtaatcccagctctttgggaggccgaggtgggcggatcacttgaagccagaagttcaagactagcctgggcaaaatggtgaaaccccatctctactaaaaatacaaaaaattggccaggcgtggtggcaggaacctgtaatcccggctacttggaggctgagacacgagaatggtaattccagctgaccttggtggtcttactatcagaaataactgaagaaagtggattgacatttgataggtgaatgggataatcttgataataatatggtactaagttagagaagtattgggtaatatagtttacagatcctgtgtaggcttcacattgatgaagttacggtgctgctagctatctaatgattaatatggtaaaaatcttaggttatctcgccccttcatcaattttttttcaaataaaaaagcatctgcagagcatagtttagtaacttttactcatatatgagaaaattgcttattttcttgtttcctgaaaatctaaaccaaacatgaaatttaagtgaaacaaagaataaggtttattaagtgtaactacctgaaatctcatttttcacacgtcaacaattaaaagtagctaatgttcatgtagtcaataaaattcaataaatatttattggtcacctcctgtggtgccaggaagtacactaggcaaacatcgtgatattggatgaataaaacgtggctcctggccttgaggagttcagcggaggaagtaaagctttacttattcataaagtatatctgtgataatagactatagttctaggtactgaaaaaaatacctggaaatgaaatattaggttagggatttggacttggcaaaatg

SEQ ID NO: 7956 - DNA, 424 bp, artificial
  synthetic oligonucleotide
cacactcttctgcctcatccctggacagataagtatcttttatgtagagatagggtattttctaggccactcactgaggtagtcactgttagaggattttagctttatgatagactctccaatcggcttgactgccttgcgtgggtgccaggctttacagcctgttttggtcctgccacacagtcctttaatactgactctaggccaccagggataagcagatacttccaagacaaaccttggctggattacctttagaaaaccaggctttattgtctggcctctgattgttttccttacttatcttcagctcagctccactttaaaaacattttaaatattctatccagcttttcaggcactctttttttggaagggtttccctacacacctatcctattgcctgaagcagaaaatgttctct

SEQ ID NO: 7957 - DNA, 669 bp, artificial
  synthetic oligonucleotide
gcatctgtgtgtttactgtgtatgccttgtatgcctggcaagaatctgcaaaagttgcatggtggaaaatgcgaagaaaatggaggaagggctttatcttctcttgccagcaaaattgtaactgagttaggtttaagattttgcaatatggtttcaagaagacattctcaagggcccctgctgaataatgtaagttcagatgctgcttcaatatgaccttttttgcttcaataaatgagaaaaagaggaatagatattcttttctgttggtttcagaagtcagcttgatctgaagccacctcatttacattaaatagtggaatctgggttgtttaatagagtgtggaacagtacagatggtagaactccagaaagtttttgctcccactgctgatgggtctagttagacttcctagagaaacatcaggtggtttatttttgacatactgccttttaagaatctctctttttttcactctgtgctgtcctagctctaacagaccagcctcattacaatatgtgctctctaacctgtcttctgtctttaagattaagatacctgaagaaataaatctctaaaagtcttagctcagtgctgccatggcttcagattttgtttaacatagagcaatctgtgtggcccacccataatgccagctctgagttaat

SEQ ID NO: 7958 - DNA, 954 bp, artificial
  synthetic oligonucleotide
tccacagttggaaaaaagatatccttgtaaatatgcctctctggacttcttcagccctcaggaagacgttcgaggagaaatataaacaaagaaaagcaaaatagaaactagttgtggtcaaatgtatttttaattaatgtgtccgtctaacattaaaaatgattcctataaacaaaaactatggcttcagtaatagctgagagaagattttccccctcattttttccagtctgcagcctccgaagcctccaagtactgcttttaataaaataaaacacaatgtgcttctgtgggtaaattatgattttcccctaatatattctaattcaaactattttcagagcctgatctgaaaattgctcccatatctataaaaagcacatgtattttgagaaataaaagatgagaaacaagacgaaaaagatactaaaaaaaaaaaaaaaaagttgcagcctgtctggttacagcttgagccaagaatctgagaaagaaaatgtcctgagaaaatcgttctctccaacagtttcaaaaaagaaagagcccagacaaaaataagcctctggcaaatggagcctgtgcaagaatccatccaaaaaatctaatttaaaaaatatagtatcttacttgcacatcatattttggatacctgaaagataaattattattaaattttttaaagaatgatcccaactttatcacagccccctatctctttgtagtttcttataatagggttaaagttggctggtttatttatttgtttttttttttttaagttgtttttcacaaaaccttagaagtagaaagcaaacctaccattcaatgtttcaaagctggctggtcaggaaacccagtttcagcaaagaagaaaagccatgcaaaacaaacaaagaaagagaaggcctgcaaagatgtatttggacttggttttcttcagccaaagggatagcacag

SEQ ID NO: 7959 - DNA, 1308 bp, artificial
  synthetic oligonucleotide
ggcatccttttgctagtgacgccattttataaaagaaaagatcccagcaacaatttctagaagggaaaagacagtttagaaagtcttaggctaatatttggacactatcagactgatcatttgtgcctcaatttttttcacttggaaagacattttaatgatatatagtttagagaattaaattgaatccattgaaactttgtatttatatattagttcatattactaaggattttgtgcttttcacattacgaaggattttgaattttagcactattcaaagggtaattttcaggatgaaatcatatatgtaatgtgctgaactcatgcctaccacactgtaagtatacactacattttgcttacttttcttccagtagagtatctagacttgtgacaatttaatgaagactgggatgggggaagagatgtccctgaatctgcactcctgtgagcaaagcccctcatggcagtcctccaaggttgtaaacttttacatttgaaaggtgcaccccgacaccagccctaatctaatcccacaggacttcccagctacttaagcaattacatcagttgcagtgaaattaagtttacacactgacactgaaaggaaagataacaataaaaattgaaactcaacttcgacattgacaactgggcatgattcacaggctgcaaaactgaagggacatgaattatctccagcttttctcagcactgaagagaagagcatgaaaagggctataaatcaaactttaatttagaaatttcctgggatttcactttcatttatgatcatcttattcccaaaggacttctaagtcactctcatcagtaaaagaaacagataagcacctcacttaagtacaaatcatggctgatgtgtctcaattccctagctcacttcccaaaaatatgtctgcgcctgtcgtttacgtttttttaaatgtgatcccaaataaattttacatttcaggatatgttccaatccaatgaaaatcaattctaaattaatcatgggctgggcacggtggctcacgcctataatctcagcactttggaaggccgaggtgggaggattgtttgagaccaggagtttgagaccaacctgggtaacacagtaaggccccacctgtacaattttttttttagttaaaatatgaaataagataagttacatcaggccatgctcttagtagataaaatattttaatttggtaaggaaagggatttagcacagcagttctttgtaaaaattattttccctttacccacgacccaagcctctccattgctgtaatttcatct

SEQ ID NO: 7960 - DNA, 1125 bp, artificial
  synthetic oligonucleotide
aacagattgtgaactagacatttgccaacttttcccccgtgccagaccatttttaagttatgtgtgcacagaatggcatttaaaggacttaaataactctccagggggagaaaagagcagaaaatagcccacaaggctcctataaacgggggcaggaacagcagaaacagaatttggggcgagtgttctgcttgtttttagttgcggcgggaggggcttttctattaggttgtgtttttgttgtttttgctttgggggtgaaaaaaggggacagagaacagaaaggaacctagtttatagtgacagctgtttaggaaagtcatttctagattagaggggagagcccctaggggctgcttctagattccactccttggggttggaggggccgggtgagcaggctttggggagtgcctgggtgactaccccaaccctgcctcaacggcaccccctccctgtgcaccgacaaataaatggtggctgtaaaaaaaaaaagaaataaatgtttttttaagcagtgcttcctgttatgttcaaggaagactagggccgttttattattaagcaattttctctttttaagtaaacacacacacgaccacattgctgcaaggctaaaatctcttgccttactcaagcatcgacgttttcaatctcctattttctcaagccctcaatgaagccttccaagagcttgcctatgtttaatttgcattccgaaacagaaaatctaatgtgttttaacattgtctgcttcagctgaaaaggaaactgtaaatttatacagtctggtttaaaaaaaaaaaaattggccattgcatctaaatgagtctcctccggaaagaggctgggtggcgcccctccccctcctccctctttcacttcccctcccgcttctccctctttcacttcccctccccctcctccctttttcacttccccttgtcctccctccctcacctcccatccccctccctcctcctcccctccccctctgcttttcaccccctccctcctcctcccctccccctctgctttttaccctccccctgctccttcccacctcccctccccctcccccgctgctttcaccccctccctccttccctccccctctgctttcac

SEQ ID NO: 7961 - DNA, 1813 bp, artificial
  synthetic oligonucleotide
tttgccccagattgtgtgttggttttattatttaaacaaattttaaattacaggagtacaaggagccctagaagcaaaagaaactattcagatgactgcttagaagctttcgtaaattctgcaaggtggtgataactgtcgatgactcggcaggtttttcggagaaatgtacaggaagcgaaacccactgcgtgtctaacgggtccagtatgtcattgtgcaacgtcccacaggccttcaatgtcctcagagctattttgtgacctacacactgcatggagatgccccaccggctttgattgcaccctctagcaaaagagatttccctgcagcttgaatggggcaaagcaagttctttgaaacaacaaccaaaaagatgcgggttggggagaaaagcttggctctttccccagactctctggatagcgcagctttccttttttctatcctcctggctttttgttctccatcattactctgagtcagcaaggaagaaatggcaagggactccggaaaaacatgtgtgatagggtgcctgagcaaaaggcaacatttcatcagttctttttatgaatcagtctttgatttggggatgtactgtccaaagtgaaagactccttggagatttgcctggtaagagagagacatgtggtaaaccaattcaaggtcaggcagatcgggcttgggttgcataggtttttgtagcccagccccccaggctctccactcaccctacagcacgcattagctgcgtgtctctttgcatagagtcgcttttcataaggatcctaaggtgcaggggagcagcagccaaggacagctgcccaaagtagcctgcttccaggactgcaaagaaatggaaagagcagcatgaaaggacccagtcatggcctggcacagtggctcacacctgtaatcccagcactttgagaggccaaggcggccggatcacttgaggtcaggagtttgagaccagcctggccaacatggtgaaaccctgtctctactaaaaaatacaaaaattagccgggcatggtggcacgcacctgtaatcccagctacttgggaggttgaggcaggagaatcacttgaccccaggagacagaggttgcagtgagccaagatggcgccactgcactccagcctgggtgacagagtgagactctatctcaaaaaaaagaaaaagaaagaaagaaagaaaagaaaagaaaaaagaaaggacccagtcacaccaactaacccatcgatgtccaacagggggctacgcttggttacaaaacacatacctgcatgttgagaaccatacaaatagaagtgtgtgggccaggcacaatggctcacgcctataatcccagcactttggggggcctaggcgggcagatcacctgaggtcaggagttcgagaccagcctggccaacatggcaaaatcccgtctctactaaaaatacaaaaattagccaggcatggtggcaggtgcctgtaatcccagctcctccggaggctaaggcaggagaatagcttcaacccgggaggcagaggttgcagtgagccaagttcgcaccactacactccagcctgggcgacagagcgagtctcgttctccaaacaaacaaacaaaaaacaattagaagtgtctgtgcaatactagctaatattctgcctgcatttccagccctgctgactcttgtacaggacctaaggtcaacagttcttgggctctgaggaactttgcttctctttctggcctcagctccacaggctccatgaacccaggtctagggatctagttcactcaaagggactacgaaatca

SEQ ID NO: 7962 - DNA, 1876 bp, artificial
  synthetic oligonucleotide
caattaaaaaagtaatagaccttaagacacgaaaagagaaatcaccagtaatcctaatattcagatgcatcttgttttgtcttcccagcctattttatgataggcaaaaataagatgatactactatagatactaacgagtttgttatctgcattttagatccaacccaccatggacattttctcacgttactaaatctttttctactttactatctgcaaagtattataataaatgattggcttcattttaacatatactaggtagtaaagtgtatttatgtactcaaactaatgaatcttccattgcttgacaacattttattggagacatggtcttgctatgctgcccaggctggtctcaaactcctcggctcaagcaagtttcccgagacaactgttttgtgaaatattttttattgttttcttgttttaaataatcatgcttattgcagaaatatttgaaaatactgaacagccaggcacctttaaaaaattacaatctgagtgtcataaatggacacaacattgcgtgaaagaaaccagtcacacaaaagcattgaccgtatgatccccattttgaaaaacaggcaaaatagaagtaagatgtgtggggatgcatgctgagatgacaaaactatgaaagcaagcaaggaagtgggaatattgtgtatctgaaatgaaatgctggctccatgggtgttcaccccaccatcgttcattgagctgcacacttgtgtgcttttctatatgtgtgtgacccttcacaatccaaatagcttagaaaaaactcagaatctctcaaacccagttaaaaatgtctcctaatagcttaggatgtagattttcagttcgatttgtatctatgattatatcgtacatattattttgaaacatgtaatttgtatttgaaatattacggacacctcccttttggtcacacagaatgtcaactagaatggctgtcatgaaaaacattaaaaataccaaatgttggagaaaatatgaagaaactggaacctccatcattgctggtgggaatataaaatggtgcagccacgtgggaaaacagttgagcaatttacaaaaagttaaatgcgcacttaacatatgaaccaccaatttcactcctaggcatctacaccagataaacaaggacatatgcccatacaaacttttatattcaagtgttcatgacagcatagtttataatggccaaaacatggcaccaaaccaaatgtccaaaagctgatgaatgaacaaactgtggtctacccacacaatggaacaccattcagcaatgaaaagggacaaccttctcatacctgctgcaacatggatgacccttggaaacgtgccatgtgaaaagagccacacaaaactcttataccttgtatgattccatttgtattgtcaatgttggcgtatagctccatcgcgtggacatagcataaattccttcaccaagccctgttgttggacttgacgttgttccccggtttccaatattacaagcaatgctgtgaggaccatctttgtggctacatatttgtggccgaccttattcatgtctttgcaccaatgcccagaagtggaactgccagtctgaaggtgtgtgcattttaaagctttcgggaaatatcgcggagcggccctgcacaaagtttgctcagactgcactcccaccagcagatctagagggtctagtgtctcctttctccaatacaacacctccctcttggcgctactcacccatgggaggctgtcccaggtcccagggtccccccgctcaccatgctctgtatttgtttgtagtttcctgggtgcgctgccaccatggtctggttctgcaacagtgccgactgccaattttcagt

SEQ ID NO: 7963 - DNA, 8608 bp, artificial
  synthetic oligonucleotide
actgtctttgagagccccgttcctataggactctgctgagcgaggatttatcatcttggcgagtaggaaggatttgatttgcacaaagctttgttctagaaggttatagataatatcactttgcctaattacagagaaagtgtggaggaagctaatggatggtgatagtgttttaaaaggttttacttctcgtacaaaagaaaagacatccagacataccttcccactccgcgagaatactcctctttacttctctttactctagactacatgctattcaaagagagcaggaatgggacagcacaaggcaggggtgaaaagtctatagaactgctccacagctggaaattgttaccagaggtagccattgtataaagattcagtcctgggcagcaggaaaataaccctagatgctaaacaagtggtgtcacttatgctaaaaagatactaaatataccttaagagcagcagatgcaaaagttttaaagaaaggggtaagaggaagaagccacatcttagtcaaatcacagggttagaaatagggaaaagaatatatcatccataataccatcatgcaatcacaaagcacggttgaccttttattttctttccagctttttccctttgcatccgcttagtcattgttggttttattttattttattcattttactttttaaaaatagtatatgttcattgtagagaaatttaaaaatgtagtaacataaaatcacttgagtttttagcaccaccagttttataattttggtatatctcattctggcctatttttactacatagatacttcataaataagaaaaataggattgtagtagaaatagtgttttgcaccataaagtttttaataaaaactggctgaagttactataaaccataaacaaaacgtggtttttgatattgtgttttatcaaataatagaaattatagatattctactatggttttcacaaggctaatggctttttaccctactttatcattctcctttaaagaaatcgtaagaacttgtttgggatttattgttctaaaagtactttatacaagtgaataatattcttttacaaaaaaaatttattgagttatgtttgacatataaaaagctgtacttatttaatgtatacgtttctatgagtttggggataggtatacacctatgaaacaaccatcaccatcaaggccacaaacatatccatcacctcctaaagtttcctctcacccctttattattgttgtagttgtgttctgtgagtatggtaagaggacttaacatatgatctaccttcttagcaaaatttaagtatataatataacattgttagctgtaggtaccatgctgtatagcagatctccagaattcatttatcttgcataactgaaagtttatactgtttgctacttctcatttctttctccccaagcccctggcaaccaccattctcctctttgcttctattagttcaccttttttagattccatatataagtgagatcctgtggtatttgtctttctatgcctggcttatttcacttaatataacgtcctccaggtctattaatgttgtcacaaattacaggatttccttcttttataaggctgaataatatttcattgtgtgttgtattagtctgttttcatgctgctgataaaagacatacccaagactggaaaaaaaggattaattggacttacagttccgcatggctggggaggcctcagaatcatggcaggaggtgaaaggcacttcttacatggtggtggcaagagaaaatgaggaagaagcaaaagcggaaaccctcgataaacccatcacatctcatgatacttattcactatcatgagaacagcacgggaaagactggcccccataattcaattacctccccctgggtctctaccacaacatgtgggaattctgggagatacaattcaagttgagatttgggtggggacacagccaaaccatatcattctgccccggcccctccaaatctcatgtcctcatatttcaaaatgaatcatgccttcccaacagtcccccagagtcttaactcattttggcattaacccaaaagtccacagtccaaagtctaatctgagacaaggcgtgtcccttccgcctatgagtgtataaaatcaaaagcaagatagttatttcctagatacaatgggggtacaggtgttgggttaatacagaccttccaaatgggagaaattggccaaaacaaagggtatacaggccctttgcaaatccaaaatccatcaaggcagtcaaatcttaaaactccaaaattatgtcctttgactccatgcctcatgtccaggtcacactgatgcaaggggtgggttcccatggtcttgagcaactctgcccctgtggctttgcagggtacagcctcgctcctggttgctttcacaggctggcattgagtgcctatggcttctctaggcacacggtgcaagctttcagtggatctaccattctgggatctggaggatggtggccctcttctcacagctccactatatagtaccccagtagggactctgtgtgggggctctgaccccacatttctcttctgcactgcgatagcagaggttctccatgagagccctgtccctgcagcaaacttcttcctggacatctgggtgtttccacacatcctctgaaatctaggcagggattcccaaacctcagttcttgacttctgtgcacctgcaggctcaacaccacatggaagctgcttaagtttggggctggcaccctctgaaaccatgggccaagctgtaccttagccccttttagcaatggctggagtggctgggatgcagggcaccaagtccctaggctgcacacagcatggggaccctgggcctggcccaggaaaccattttttccttctggacttccaaatctgtgataggggtgggtaggggctgccttgaaaacccatgacgtgccctggagacattttcctcattgtcttggggattaacattcggctccttgttatgcaaatttctgaagccagcttgagttttttcctcagaaaatgggtttttcttttttactacatcatcaggctgcaaattttccaaacttttatgctctgttttccttttaaaatggaatacttttaacagaacccaagtcacctcttggatgctttgctgcctagaaatttctcccgccagataccctaaatcatctttctcaagttcaaagttccacaaatctctagggcggggcaaaatgccaccagtctctttgctaaaacatagcaagagtcacctttgctccagttcccaacaagttcctcctctccatctgagaccacctcagcctggaccttattgttcatatcactatgagcatttttgtcaaagccattcagcaagtctctaggaagttccaaactttcccacatttttctgtcttcttctgagccctccaaactgtcccaacctctgcctgttacccagttccaaagtcatttccacattttcaggtatcttttcagcagtgccccactctactggtaccaatttattgtattagtcgtttttacactgctgacatacctgagactgggaagaaaaagagatttaattggacttacagttccacatggctggcaaggccttagaatcaggcaggaggcgaaaggcacttcttacatggtggcagcaagacaaaatgaggaagaaacaaaagtggaaacccctgataaacccatcagatttcatgagatttattcactatcataagaatagcacaggaaagactggcccccatgattcaattacctcccccaggcccctcccacagcacgtgggaattctgggatatacaattcaagatttgggtggggaaacagccaaactatatcatgtgtatataccacattttctttatacagtgatctgtcagtggacatttggttacttttagttaggagtaatatttagaaactgagatctgggaactagaatatgctcattgctaccagaatgttgttacttctggatctttcagcaatagagctaggaaaaaaaaatcacacatatgtatacatgcatacaaattctatatatgtctatatgtagaaatgtaaacatataaacatatagacatgtatgcatgtagacatatatgtgaaataactaattcattatgctgatctccaattgcaatccaatccctcagggctcttccagccattctacttttgtagagatgtaaaaattccttatagatgttcttccaaaatgagaattccagcacccaaaaacatcaatatattaataactcatttgcttagttgtataatacacaatggtttcggaattgtaatatctatactgtaatgtggagagggaaaacttatattcattcatgcatgcatgcatgcatttttttaacatcttatttggaaataattatagattcacaaaaaattgcaaagataatacattgaggtcccatgcagcctttactcagtttcccccaatggttacatcttacataactgtaagatcaaaactaggaaactgacgttggtacaatctgtatgtatagttctgtgtcattttatcacttgtatagatttgtgtaaccatcactgcaatcaagtagcagatatatttcattaccacaaagttttccctcatactaccctttaatagtcacacctactatcttccacaaccatccctaacccttagcaatcactaatctgtttccatctctataattctgccattgcaagaatgttatataaatggaataatataatgtggaaccttttgatattggctttttagagtcagcataatgctcttgagattaatccaagttacatatatcaatagttcattcatttttgtttatgagtaatattccatggtattgatacaccatggtttgttgaaccatttgcttattgagagacgtgtgttgtttctagttcatggcttttacaaataaagctgttatgaacattgcataggtttttgtattgacataaattttcatttctgtgggataagtcactgggagtacaattcttgggttgcatggtatatgtgtagttttttaagacactgacaaactaatttgtcattgtataaattaccatcttatagtctcaccaacagtgtttgagagatccagtttctttacatactcatgagcacttggtattgttactgtgttttattttagccattctgctaggagtgtagtgataacttcttgtgattttaatttgcacttccttaatggctcatgatattgaacatctttttatgtgcctattttctatttatgtttcttctttggtgaaatctctcttcatgtcattagcttactttctgatgggatgttttattttattttactattgagctttgagagttctttattatcctaggtttggatctgttttcagatatatggtttctaggctatttgaattttatgtattaattgtatattctactactctcgtattgattaagttttatcattgattctcagtgtgaacaatgtttttttgttgttgttgtttgtttttggagacagattctcgctctgttgcccaggctggagtgaagtggtgcaatctcggctcatggcaacctttgcctcccaggttcaagtgattcttgtgcctcagcctcctaagtagctgggactacaggtgcatgccaccatgtccggctttatatacatatatatatatatttagtagagatgggatctcaccatgttgcccaggctggtctcgaaatcctgagctcaggcaatccacccacctcagcctcccaaagtgctaggattataggcatgagccaccacacctggccatcatggtgaacaatgtttttttttttttgagatggagtctcgctctgtcgcccaggctggagtgcagtggcgcaatctcagctcactgcaagctccgcctcccgggttcacgccattctcctgcctcagcctcccaagtagctgggactacagacgcctgccaccacgcccggctaattttttgtatttttagtagagacggctttcaccctgttagccaggatggtctcgatctcctgacctcatgatccgcccgccttggcctcccaaagtgctgggattacaggcgtgagccactgcacccggaccgtgaacaatgtttttaatgcctacatttctggccttttatccatctcagtgcttctatatatcatttcccacccacagagacaggatgctgcatgtcagcaatctttgaagcaagtagaagaaattccttcaactgtgagagaattgcttgagaaattttctgtacttccggcatcaccttttccttcctatagaatcattctcatcttattagcctacatgccccagaaagaaagagaaaaaagaaaactctcttaacacatcgccatccaacaaccacttcatttcttgaaactctgctctgcctacacttgctcccctggtgatctttcctcttctcatacttcaaatgctaataacttccaaatttatatttgtagttcctggagcgctaaactgaactacagacttgtatggctaactgcctactcaacatgttatcttagaatcaaatatggttctcaaagtaaacaaatttgcaccccttcccccaaatatctacacttactacatcctctctgatctcaataagtagtaactccatccatcatgtttgctgatctccaggctttttgccatctctgactcctctctttttcatatcccacaccccatctgcaatagttggttctaatatgaaaatatactcggaatctagccacctttctacttgttatcactttacatccaagccaccacaaccctctcatctgtatgattttttggcccctgccccatagttgattctcaaaacagcaggttagagtgatcctttaaattctcttacttgcaagggcttcccatctccctcagtaaaggccaaagtgctcagaatcacccaccaggtactacacaatcagtcctcatctatctccaccccacagcttcactcgatatatagttatttctttaccacatctcctatgacaccccaccccttattcactttgctgtggctttcttgtgcgtcctcacatacacagacagcacgtgacctgcctcatgactttggcacttgctctctcctcttctagatggatatgtctgagttccttcaccactctcaagtcttcactcaagttcattttcacagtgagaaagcactctaccttaaattgcaaccgcttgtcccttctgtgactttctttttttcaagcactgacatcatttgacatctatttgtttttttttttaattgttacctcccccgccccatcaggactgttagctccatgagagcaacatttctcatctgttttgttcatagctatggtccctagcatataaagcagtgctggcacataatagaagccaaataagtatttgatggatgaatgaaggaatggattggcaaatcacaaagtaaatttagtttatgggaggaaccgatttaaacccaagttggctgatagataatagactttaaaatggtttttattatgttgttgttatatttccttctttgtgctttaaagtttgtcatctgagtttgttcatgccattaaaacaatcccatttaggataaggtgtgccagcctttgatctagcaaatgtaagtgaagtggcattctcattttttatctgtttcagaacaatgtttgttatctgttaatcaggatctagcattgccagcaaagtttcatcttaatcttggcagtgaagaaaatgattggatttgagatttgctttctacttttagactatctttactatctttttgtttactaaaatttatcgctcagaatacttttactcatacgtggtttcatcatttccaaacatgaagtatgtgaatttagaagtctgctttcagtagaatgtttattgttggaattatttacctaatttggaacacaagtctaattatacaatgggagaaaacatattgtacttcacggtcctcattttcatcatgtagaaaatgggtcagatttattcagacattatctgctgaatgcctactatgtaacagtcacagtatatacaacaatgaataggctgctcctcatggcatttgagttctgatagaaacagcagacatatgcacaaaggcttatatgagcatgctgtaaaccttaaatatacccaatttttatttgtcagttatacctcaataaagctgagttgtcatgccaaaatcctctgctttgagaatcagatggaccttgatctggtgtctgagctctgccatctactgactatattgatttgcgcaaacatttcatcttttaggcctcaatttttgtatcttttaaaaggaggatattatacctacagtatgaggtttgaggctgtgcacttagcatagtttttggaacagagaaaactttcaataaatataatttattctagtttttaggtgctgaattcttgccactttatttaggaatcattatttcaccactatcac

SEQ ID NO: 7964 - DNA, 1522 bp, artificial
  synthetic oligonucleotide
gtaaacagaaaagcatacaagttaaaaccaagcacgcatgcagcatggaataataatcaagctagactccttatgatgcaaaatgccagaaaacctccaagcattaggtcaaagtttacacaatagcaaaagccttttattctgtttcttagaggggcttgtagaagtttaagattcaagttctaagatagctctacctaaaaagcgaggtcaaagatgggttttcttctcaagatatttgggtaagtttgtacaagacggtttttttttttttttttttttttagaaaaagcagatagttgtcaccaagagttgtccggaaacagtggcaagggaattattcctcaaggaaagtgcaattctctgagctgtaacagtggacaatggtcgaatagtcaccaaccacgatctgggctcacacatagcaaagaggtatattaactaggatgccctacacaggcggtctgtggatgagaaatccctatgcccctcacttcaccagggctgaagagtacgcgatgaggagaaatgactaggaaaaggaataatgtgtggtgaggtatgtatgcgaaagagaaaaaggctggcggggacccgcggtggctaggagagacgtggcggcccaacggctgactacttgggcccgcgccgagccaggctttctccacggtgcgtgtgggagtgcacagaggggcctcgacggcttttctgtatgtgttataaataaaccccaatagtggaaagctccagcaggatgccctgagccctgggtcttcccagcagaagcggtggaggatccgcccctcgtttcccacccccgcgccccaccctgttcccgccccttctctcttaaccccgccccagcccagcccccgcctctttccacctcccttccagtccgctcccggttcctggctccagctaggctcggcagaaataggagcgcgcaggcgcgacgtgcggctcgcagaacggcgagtagcggagcgggacccgctgtgagtgtggcggccgcgctgggttcctagctggggaaacgtgatccaggcgaagcgccccaggaaggattggggtgtgtgggggtgacttcggttctgcgaggagaaacccgtcagatatgcggtagcgttggtagcgacgctgcctgtgggtgtccggccagggccgcgtggggagcggagtgcgtggtagcgggagtgggtgagggtgggtatgacgagaaaaaaaattgaaggaatggggtttacaggctggaagtccgcacacagactgggcaggaccgcgaggcttgccaacggtgctggagggtgtcccagcttcaagttcagtcccctgcttggtgcccatgagggacgtcccaagctcatcccttcctccagcgctgctttctctggtgcagagttgctagaaacattccccgtcggaggggaaaggatttggaggcggtgggctgtcggcccgggctagtcccaaggagggcgtggcgttcgtgtgactttcctttacccacccccgggaatgt

SEQ ID NO: 7965 - DNA, 2281 bp, artificial
  synthetic oligonucleotide
tgtatttatattttcaaagggagattggggatagaagatataaagttatatctttaaattttttaaaatatacatggatagttgcttttatttatggttaaactgaagaaatttagctatatgtaaaacaactataatgttcaatctttatttcataaaataaggctattaatgttgtatagctgtttggaatgaagagtatgaacaacttccatacacacacacgaagcacacacacacaagcacacacacactcagcatcacttattgtaaaatttaaatcttaattgaatttcaataaatgtaattgggactttaaaacaatgtttttaaaagtaattattttcaaagtgtcttggcgaaggtgaaggtacaagtccatacttttagctctcatttgtacccactaagtgctgaataaggatatagatcccttcatatagcttactcatgtatacccactaaatgctggccgtgggcacagggcccttcagtaactcaggcattagtatcaaatgccaggcatggtgtaggtctctgcatttagctcactcatttttacccatcaagtgggtcaatgtactggaaaatatatgtatatgcacaatcactaaaatatagctttgtttttcaaattaaacatccttatacgaagtaaaatttttttttacccagtcgtattatgctccttggtttggtccacttttgacacactgattctgaatacataattattacaaacactagataaatggtccagatatgattaggatgaggctattaagaatgtattgttgtgcaatacattcttgtattgttgtgcaagacattcttgcacttaatattaattgacaggtatcacactacatataaagctcagagcgttgcaatattcactttgtctggacctattctgaatgagttttctgagtatacgtggtgtaaatcttaatgttaggaggacaccagtataaacacaggtggtttcaggaagttctgcacaaggaatgagacttcagtataaacataaacatatatgcagaagaaatgaagaatgtttaaataaatcactgtgtaaattctactcacttggatttagatggtgattgtcagcaatgatcctacatcatttgtggtatattaaaatggttatacgtactatgggctgggtgcggtggctcaagcctgtaatctgagcactttgggaggccaaggagggtggatgatctgaggtcaggattttgagaccagcctggccaatgtggagataccccgtctctactaaaaatacaaaaattagccgggtgtcgtggcacatgcatgtaaatccagctactggggaggctgagacacaagaattgcttgaacccgggaggtggagattgcagtgagccaagatcgtgccactgcactccagcctgggtgacagagtgagaccctgtctaaaaaataaaaaataaaaataaataaataaatagttatacatgctatgtactttcataatcttcaaagcagctaaatatattttaccagtcatttctatggttacacttaaattctcatgaatgtgtttatcttggaaggtactatttccattagttggcgttcatactgtacaacagtcttatgcaagccaaatagattgctttcccttattatcagatggatgcgtagtttacagggagaatctctgagagattttttagtaaataattcttaattcataaagtgaaatactttctttattttccacattaattgtcactctaagtggtttcagttttgtaccttttccatactctacatggagaacagaagatgttaattatagtgaacttttccctacatgttttgaagtccctggatatttcaaatgaaaatttctccctctttctatccagacagaagaaatgtactggaagtatgagatcaatggattaactccaactaccgtgccaccaaaaaatgcaaaagccaaaattgatgctactcacaagacacatgacaacatgccagtccgtccacataattttgtccgtgaaaatactaaactcataagaacaggggtgtcttccaccatcaagggtgctcctttggtgaagaatcaataaaatttttttccaaaatatttcttggtctcaggtagaactttgatgactattatttcatcttttggaatatttctgaggaataatggtttaattataataggccttctatatttccttgtcttttaaaattcaatctgttctctgaatatattatacttcatttgtgagtt

SEQ ID NO: 7966 - DNA, 784 bp, artificial
  synthetic oligonucleotide
tttcaaactttttaaaatccaacagaaaatatgcaaaatatccaagaagccaaaatgaaaaaataaaatcttaactacaaaaatttaggagcttaaaagttgtagatatggaacatacatattagtgaaataagattaatcagaactttatttaaatacccatggggttgatagttggtaaattagtgttgctacaagaacatctctataatcagttaatgaaataatatgacttctttattaagagttaaaaattaacatgtaaacaaagaagctttatgttagttatagcggaagttgaatacctgatataattttaaagagaaactgttttcagaaaactatgatccactcttcagcatttctaaagttgaggcaaaggaaccaagtttgatatcttcagagaaaatctttttggccacagtgtcctatgcagtttgttctttaatacattcttctattttttaaagaaaattcaagaacattaaggctacccatggaattgagaaaattattattgatgactgtctctatgcatggataataaaaataatagcctcatttattaaacttttgtcacttcaaatttcaatcaagtatcttaaatgaacttgggagaagactttaattagaaatggggagagcttagactaatttccacgagggaacagagcagacaggagcctggggcctggaaccgcaacccttagtgaatgaggcagagggatcctctgtggaggaagaaggtgcaaggattgttcccttgatatgagagagaggctca

SEQ ID NO: 7967 - DNA, 2056 bp, artificial
  synthetic oligonucleotide
tatagcctatcagcaagtacactaactctgtgttttttttaacagttgaaatgtgcaactacttaagttcagtcacgtgggataaaccactaaggacttaaccaattaggaaggaaaaaattatttactgttttcaagcccagcaaatctcatacattgtccaagttcccaatgtgtcactgtcacagcagccactggtcactgccaatcttaagcccattttttagatgggcagtgggaaggtatcctccagtttttccgacttccatccatatagagtaggctctgtccattgggtacagggccacctggttgggctctttcagttgcacttctccttccagatcctggaaagttgttcatacactgtggatttcagcactgggatcacatccagacatgcactggttagacctctttgctctcagagagaagaaattgaatggagggacaaacagattccttgagagaaaaacaattaaatattcattgaaaaattagaaatacactagtcctcccattatcttcagggatatgtttcaagaaccccagtggatgtctgagaccacagatagtacctaatcatatatatagtgttttttctatacatacacaccttagatagaattttatttataaattaggcacaataagagattgataacaactaataataaaatagaacaatcataacaatatactgtaataaaagttatatgaatgtagtatctctttccctctcaaaatatcttattttactgtgctaacatgttttcagatcgtggttgaccttaggtaactgaaaccgaggaaagcaaaactatgaataaggttaacaccattgtacccattgcttgtccagtggaacaagtaataaggtcaacaagatactttaggaataagaaatggaaaagagcacgttagaggtttactgtctttactatacttttattcttgaagtccactccagaaagactgtgatttgagtgaaaccataatataatgaggcctacctgatatttatggtaattaacgaggtcaagagggctccagattctggtgcattctgtttcatttctgggatttcttgttgcattgttgcaaattttttggcttaaaattatcataaatgacggtgattgatagttgctgtttctgcttttatttaaaaaataccatttataaaaattaataatcctgcatctaaaaatcaaaattttatcattttctaatgtcttttctattttaaaaatgtactataaagttgaattagttagatttcggtcaataatatcaagtaacttactattcacattagacgctgttttgatttcagattaattgatgtttcacagtaggatctatgaccataaaaatatagttgtccacaaaaaaagaaaacaaatcatggaattggaaacactaaaagacatgagagggaaaggatgattagttttaaaataaatacgttcattataatgaaagaagtgtgcgtcagatgaccaggaggtaggaatatgggaaacttagactattctcactgggaccaattctaaatgccttttccatttccttgtcaagcattcatttccttaacaatgattacatataggcacaactcttcctccacatttgtattgtatttgtattcatttaaagctatgtgaagaaatgaccaggtgtatgtatatcaagcacatcattactgcagttttaatctttctgtctccttgtttttacaactacaagttgaatcttctggttacactgaagcaagtgcatgcctaccaacttactctcatcatggtggaattttggttatccttggacatcatcatcatgatacatcatttctatatctgttttggagtgtcctgtgcttgggaactcaatggaaaatggaacaccatagcctcagaaataggtaccctgaatagctgaaacattggtagaatgagcaggcttagcttattcttgctggagcttggagggctaagtgtagactcatgacttaggtgttgactgagacacagatcaagaggtcagagtagagaag

SEQ ID NO: 7968 - DNA, 1925 bp, artificial
  synthetic oligonucleotide
tgagagagagagagagaaagagagagaaagaaagaaaatcgccggcaggtcctctctctttatttccctttctcttcgctgacaccagcagttgaagaatcaaaattagaaaggaaggggtttgtagcgagaaatcataagttgactgatttttgctaagggcataactggggcgccggggaaggcaactggagggtcagggagggcggaaagcagtaaagccccctgggactggtagcctcagtagctaccttattctccactccccacccccatcttatccatttgcagctttcagcgctggcggaataaagcacaactttctaggcatctgtgagtagctcatggagaaaagaaaggtctggaggagagaagagttacttagagtggcagagaaagaaaggcaactcacaatcaacggcggcgtcaccaaaaaaggaaaggaaaacaagcctgtccctctctcaactcttcatatccatcaaaaacgtaaggaaataaaatccaaaccgaaatacattggtgaaaacgcagataaggtggagtggaaccggcagaaatgtgaacactaggcaaattcgtcctcgagagaggaaggaaaaagagtggggaagaccgaacagcgaacccccgcagcatctcggtggagttggggcgtttttgcctgcttcttttttaacgggggtgtggaaggcgtcgcatttttttacacagccacatggctctcgcctcaaatgataacaaatacccaaaatagcgtacgtgttactccagaacaggaggaatggccacggggaagggagagggcgtgggctgtcgctttaggtttggcgaccagggatggggagggaagaggggtggatgccagggaggtggcgggagccccaggatccgagaagggcctggacggggtgggacgggccagggcagaggatgcggggacgtggggacaggcggtgactgtcctggcagtggggcgcggggcagtccggggcgggaggcaggggtcgcggcgcgccaggccctcaccgctgctgagcgtggactcgcagtgccagatgtccaagctggcgggtttccggcaggactcccacaacgacaggtagtactggtggtcagctgtgacccaggccgggctcagcaccgcccccaggtccagacacagcgccaggaagatgcacaccagcccgaccagcttcaagggggtcagcaccgacacgcgcacctcctccatgccgctgcccgccgaagccattcctgggcgccgctgtcgtccgccccgccgcaggcgaggacgccaggcgggtccggagagccgggagccggacctcccgaagggagaagccgccgagctgccacgcgcggggactcgctccctcggggctctgcgcgccccctgccgcgcggccaaggtgggtctgcggaggcggccggccgggtgtgggtcgtcggcagccgcagcgacgtcgattccaccccggaccttcgccgccggccccgcgccgcgctctgccagcgcccgcgcccgctcctcccggctcggccgggctcgctccgccccggcccctccccgggctgcgggaggcggtgccgtacggggaggggcggagggccagcacttggtggcttcggctccagttcccagtgccggaggctcgcgcctgtcccgcccctaccccgcctctggcccgcgggcggagcccagtgccagcccgcgcccccgattcgcagcgcgcggcagttccttgaagcagccccgcgcccagcccggccctcgccgggcccccagcctcgctggctccaggtcgccgggctctcccctttcgcccagtcacgtgggtttccttttcttagggagcaggagtgggcggttttctagaaggcgccagaggtggattcctaggtttcctaagctgtgcctcttg

SEQ ID NO: 7969 - DNA, 1410 bp, artificial
  synthetic oligonucleotide
atacacactgaatttttagtctttctaagagataatacagacaagctggctttaacactctgcaaacgttgaaaactacacaaagaacaaaataccatatcaaaccctttgactaatcatttccaattgtgtgattagagtcggaataagggaagcctgcactacatctcctttgagtacattttaaaacagaaggttataaaagatatttaatagtatccctttatcactgaccgtgcaaaggctgtggagaatagaaggatcttgggagataatttgtaataaaaaatttaaaaatgttttcaagtaaaatcagcatgtcatattaagatgttttctaaataatatatattttgaaggagaaaatgtaatgaatatatgtaatttagaagcgttgtctaaagagtttacacaacagagacgacacaaattcaaaccacatccgtgaaatcacttttatttttatttttttccacatagatgacttcatgtcaactacaaaaatcatgaaatgaagaactgattgtgaaactgcaaactcaaaatcactggagtgataaacaggttttcccccagatgacttaaaaaaaataaccaggataccatgaattcatgtttaagtagtaaacatgtcatatatttaaaaataataaatatagaatagcagtacagaaactaatagcataaacagcatgaagtatattttacttttaagacagatgaaatttctaggcacagctttaggcattaaagaggacacagaggcataggttagagtgcactgctctgtacaaaaatacagtctgaataaattacattgctagccatacaattagacgtcacttaccagtcagttcattgcatgtttaataatatacaggtacatgctaatccatatatatcatttatattcaaacacataagtctctctatatttatgtctttaaaatttacatgttgaacttacaaaaagctaaataattgtgcaagaaatcggaataactagccctgctgagtattttatgctatatgtgtgtgagtatatatatgtgtgtatatctatatctatagatgtagatctatatccatagatatctatctaacaatgggtttgtggctaaaaattatgcttaagaacacatctaacaaacctaaagctgcaaagacataatgttaatgtaggtgaaaatttcacttgtgtttattctgatagacaaaattgtattttagatgagaagcaacaattttcatgttgtactgagattgttagtaatgaaatacttccaaatattagtgatggtagaaatctagtgtagggctctttgctgagaagggaaaaaagtcacataagaaatctacttttcagtaaactgcaaatatgtgtgcttcaacctataacatattctgtca

SEQ ID NO: 7970 - DNA, 409 bp, artificial
  synthetic oligonucleotide
atcatatttctgactgtaccacagtaaaaaaatgaaaaatactgctatctatactcttgaatcaaaatgatctgtggcaattataatacgcaaaagaagaaaaatcttaaagtactatgactgtcagatttgattggtaacttcctcagatttagaagctgtataggctatttttttattttctccttcactagatagataagcagatatctctcagatggttctctgaattttgcaattcagaatttgatcaacaactctggggtgcttaagcgtatacaatatctcatttgatgccaagcagcactgtgagttagggctcgtgcaaacattagagacaaggacacaacttaaatacctttttcacatgtcacccaactagtacaggacagaaataggaaacaaatat

SEQ ID NO: 7971 - DNA, 221 bp, artificial
  synthetic oligonucleotide
tattttatccttttcagtgtatatctttacttttagataactaatatatacaaaagggaacaggactgttgaaaaactgagtatttttagtaagctattaaaattaagtatatacaagcgatattatcttcactgtgaagctagtaacttaattatatcaacgtaagaaaatgtcacagcataaaaggttttattcacaaagaattcattcaaagacatag

SEQ ID NO: 7972 - DNA, 1425 bp, artificial
  synthetic oligonucleotide
attagaaagacccagttcctttgcatccctgttagctttcagtgttgtcactgtttttctttttttaattttagccattctgataggtgtatagtgataactcattgtagtgttaatttgcatttctttaatggctagtgaagctgaacatctttttatgcatttctttaccatctgtatatcctcttcagtgaaatgtctattaaggcttttcccacatttttttccactagattatttgtggttttagtgctcagttttgagtgatatttatatattctagatactagttctttgagactttacaaagatagattaaggaaagaaaaaggacatgggttaaaaacagtaaaaaacaaaatcaagaaccacaagtgaaaagcagtatgggaaatcaaaaaagggaacagcacccaatgacaaaaagcaaatctttattatatatttatatatgaagctttaaccaaaatgaaagtgctttgtcatataaaattttcataaaatgcaatcaaaatatcattattataacatattatatgtaaacatctgtaattatgttcattaaagcattacacatcaagtaacttatttaaaaatatatatggggaaacctaatgtgtttggttccaggtaataaagtggtgagcaagaacagttgaggtgtcttggttcatagaacttaccacataatccgactggcaagtattaattagtcacgtacatacatatggaatcataacagtgctatgtgttatgaacagatgttacgtggtagaggaatttgatgtacttaggggattttgatgtctatccagaggtaagcttgtaggtggaaaatggtgtcatcaaggtaaaaaaggggaaacggggaggttctagacaaatagaaaagcatacacaaaagtactgtagataaaaaaaaaaagctatacctagtcagggaacaaaaagaaagccagtaagggggcgaggcaaaggaaacatgatgggaaatgagataggagaggtaggcagtgtctagactttgatttttaaatgtgttttgttttgttttgtttggctttcctagcaaccaagagaaactactaacatgatttaacaagtggtggtatcttcgaatttaattggctgcatgaagtttagagagtggattatcaagaatacgaaagagaatgcagagaaactggaaaggaaaggctgctgtattcctagtgagagaaaatatattgcgctaggatgatggtagaggagataaagagaagtggatgaaaatatattagaggataaaacccacagtgactggcaatgacttagaaataactgggtaaaaaagatcagagtttcaaggatgagatatgtttctggcttgtgaaactgggtgaatggttgcaccattcaatgataagaaaaacaatgagaaggaag

SEQ ID NO: 7973 - DNA, 2886 bp, artificial
  synthetic oligonucleotide
taataatgtagacttcataaatcatctaacacttggaaaatattacgtaccatatagtaaactcttgaaagagcattttagtacccccagaacaatgcttgaaaatttaaggcaaattacttccaaatcaacacaattttgagtgtaacttaactctggcctttgatatggtaaactgccaattatagctatctagctcggatttaaattgaattagattaaactgtgacccagtgatttttctggtttcttatgtggtcagtgcaaacagttatatttaatggtggtaaagctgagataaaaacgttaaatgtaagagtcaattgcaaggtcattttctttccaagtaatgaaaacgtagtacttgatccgctgtaaaattacaggctaatgactcagtcctacagagtagctctcaaaccttgttcgatgtacccacactgatttaagcaaagacaaagtatcattttgacgattaaataatgacaaggagcataaatcacgtcttagatggtgccacaaaatacaaattttaaaggtctcaatagacatttttggataaaataatgagaaaaaaatgttcaatcaaaggtggatggtaaatatttacaaattttaaaaataaatatttataagtcctattacttaaaaaagtaatatagtacacattgtaatattttaagaaagttttagtattgttttctgaggcatcaaattccattttttgaaagtatcatgaagaaggatattaaagtactttagattgccctgccaactgtaggagaccgaaatatgccatcccaaaatatgtcacaaaatatgtcaagaaagcaggcttgatggccgcggtggctcatgcctgtaatcccagcactttgggaggcagaggcgggcgggtcacctgaggtcaggagttcgagaccagccgggccaacatggcaaaacctctaccaaaaataaaaaattagccaggcatggtggcacacacctgtagtcccagctacctgggaggccgaggcaggagaatcgcttgaaccctggaggtgaaggttgcagtgagccgagatagtgccattgcactccaccttgggcgacagagcaagactgtttcaaaaaaaaaaaaaaactagcttgcattttattgctggatttctcaagttgtgctcatagggcacaatggagaaagaaaaacatgttctaataacatattttcaaggttagccattgtcaaaagttttcattcactgaaataaaacagattaatgaatctataagaaagcatatgtatatttgcctttttctgttgttatttttatagatttaggaggtacagtgtagttttgttacatgcatatgttggatagtagtgatgtctggtcttctagtgaaaccatcactccaatagtgtacattgtacctaataggtaatttctcactcctcactcccctgccacaatctcaccttttaaaaaattttgtatttttaatttttgtgggtacactgtaggtgtataaatttctggggtacatgagagcctcccgccattttttttttttttgagatggagtctcgccctgtgcacccaggctggagtgcagtggcgcgatctcggctcactgcaacctccgcctcctgggttcaatcaattctcctgcctcggtctcctgaatagctgggattacaggcacgcgccaccatgcccgactgatttttgtatttttagtagagacagggtttaaccatgttggtcaggctggtctcgaactcctgacctcgtgatctgcctgcctcagcctcccaaagttctggggttataggcgtgagccaccgcacccggcccctctcaccttttgaagtctccaatgtctattattccattctctatgttcatgaaaatatgccactttgacacaggactattttgagctaaaggcaattcagaagaagcagatataagttctctgccctcccactatttgcctgaaaacagtacatacatttgcaaaggtgtccatcctctcctctctatcagaaaggacaaagtttgatcaccaatgacaactttagatctttatcagcccggagactgcatcagaggaatctacataataaattttcttaactagcctttatctaccatcagtttcccatatatttgccttcctgaaattggccactcatagagactcagggtccttttcccttgtcttgttacttctcaaaaaacgtattgttctttgtcagagaaatttattcatttttccttatatatctttcatgtatacatgaggtgtgtatgttagtaaactttattgtttttttcttgttgatatctcttttgttataggagtcccagttaagaaataaaggtagaggctagatgcggtggctcacacctgtaatcccagctctttgggaggctgagactgaaggatcacttgagctcaagcattcaagaccagccttggcaacatagcaagaccctcatttctccaaaaagtaaaaaaaataataaattagcccggcatggtggtgcatgcctgtagctaagctaccggggaggctgaggtggaaggatggctcaaacccgggaggttgaagctatagtgagacaagattgcattaccacactccagcctgggccacaaagtgagacccagtgtcaaaaaaaaaaaaaaaaaaaaaaaaaatcaaggtagaggtaaaattatgttttcttcccctatgcaatgtgtttcttttatttaaatgtttatttagcaaattgtttacctgatgaacaactaatctgagagtgagtagtatgagcaaatggcttttgtaaagattttctcaaatttacctgacttgagctaaccacattcagattttaattactttaaagt

SEQ ID NO: 7974 - DNA, 866 bp, artificial
  synthetic oligonucleotide
caaaaaagtaataaaaatatatgatacggtattattattattattattaggtctagtattctacttagagaaagaggaacttccactaagtatctggattaaaagaagcttttgttatttatacaactaaaacgttgtagaaattatttcccaactaatcaagacgcttttaaatgccttcacaatctaatcataacctgcttttctagccctatttttggtatttcacccaagcattcaagatttcagaaacatatagctacccattgtccttcccagatactatgaaattacattcctttaagcttttgtacatgttggtccctccctcctggaatgcaacccctactcctccataaccccaattcttcatttgataaatctttacatgctttgagatttatctcaaatattaccccattcctcctaccctaagcaaaaccattcatttcttttgcattatatatatttactattgcatacacaaaatgctacattctctatgacacactatactaggttgtgaactcatcaagtgcactattttttaatttttccattctttacacctaactcaagtctatgcatatatttttctattatatgattcatatattatatattatacatttattatatatattattttatactatattaatacatattaacaattaatactatatatatttcatatatgttaaattatgcattttatcttattacatattatatatattcatatgattcatatattatatggattcatataggtttgttaaattaacagtgaaagccccagtttttgaggaaattgtatgtattgcctatatcttggcagtcaactttactaataagctgctata

SEQ ID NO: 7975 - DNA, 1342 bp, artificial
  synthetic oligonucleotide
caaatcaatcggccaagcaaaatggattctatataaatattatgatcatgaacaatatattagaatgacattatatgcataagacataggtttggttattttacatacatgtagatgaaattaaagaactaatttcctgaaagattttaaaaatcacttagtctctgtatttgttgaatgactatgatatcatccaaattccagaataaaaacattctatagtgtaaattcatgagaaaataccctattgagtattattggccttataatgcaagcttcacttaactttacaattgtggaataattttctcactgtgatgttcatttcattgcgtgaaacaggttcagtacattattcatgaaactacttcaaaatgctttgttttagatttaaaaaatattggtattcacataactgctttgccaatgtgaggtttcatacgaaattcattgtttgattttctgaaaacttatcatattgattttgtgtcaaatctttatgaacaagcatttttataataaagttttattcttttctcataatctccttcccttcatatctcactatagattgtactaaatattgtatctatccttcatgtacatacagttctacgaggaaataagaaattcaagcggttcattgaattaatcactaataggagagaattgatcaaaatttgctgtaattttcttccttcaaaatcatcagaattctggtaaagctttgtatttcataatttggactccacatattggtgacaattcagacactgagagtggaacacaaaggaattgggtaacgagatcactaagggaatttttagcctagtaaagacagtttctcaacattcaagaataattcaattacataaaaattcatataatagtaattaaatgacaaaatacttttgaatacttattaatgcacacccctcagagacctgaaatttgcaagactatatagcttaatttgaatttgaattttcttacttattttagcaaaataaacttaaggttcataagaacatagctcttcattcacttatcttggtcgtaaatactgttaaacacaaaatcaggtgcccacagctcacaaatctacacatgacacatctctttacgttcctcctgacctacctcagcccaaatccctctctacctcatagaatttgatattaactttctgctaactttttgaaaggagaatagttctgttgctacgagtcacccttgaccctttgcaagaccaaacatgccgataatttaaaatgtgatgtaggctctaatcaataattaagtgttgttctattaacttatgatatatcacatactttatttg

SEQ ID NO: 7976 - DNA, 756 bp, artificial
  synthetic oligonucleotide
cttgattacacccctagggtataataggaggcaggttttactttaacgcctttcatcatacagaaagtaaactgctttatggataaaaatagccatgtacagactcactattgacaccagccacccctggtgacttcaaggctcatcagcaatgcacaactgttttaaaataaagcaaagagtcacatgtagaattggaattacaggaataatgagaagtaaacagaaagaggccacgttgccttgagggctaacctatagattagaaaaaaatcggggccctaaaagacacactactgatggggtctagggatagagctatttttaaagcagtggtaacaaaacaattggtgtcacgtaacactccagtaactaagataattcacttgactgcaagacaagcaaaatataggatgttaaatgtgcaactatgtctcaaggttacccaagttaaaatttggagcaactaaacatgtctcattttacaatgacaaaatgaacacttagttttcactgtgtttaagaaaagtgtctttgccacattaaatgcattatcaggagatacattattatcacagctgcaaggaaaatatttttcagattcaaagattcaacaacactgtggtacgcagaacttgaattgctgtcagatgaaaagttaaacgtcagcaattgaaacaacaaatattcaggacaaagtgtttatagccctttcttttgagggttttcacattgaggaagtatgctttttatctt

SEQ ID NO: 7977 - DNA, 414 bp, artificial
  synthetic oligonucleotide
atagaatggctgtataagagatgtttcatcctagctgggatttgctttaccttcaaaaacttgtaaataaaaagaagctgtggatacatttttacctagagctgatgtagagacaagaataaccacttagtagcatagtctcccatttctcaggattttgtattttgttcgctttttaaaatcacaaccaactattacaaatgagctttgctctcagcaaataccgcaataaagttatcactgcacttagaagtactttcttctcaataagtggctttccaaaatacattattgacagcagggataacttcatgctaaaacagccaccacaaagaatgcaaattggaacacagacgtagtgtctgagctctacagatataagctgagtggcattcaagtgaggataacaggtta

SEQ ID NO: 7978 - DNA, 3838 bp, artificial
  synthetic oligonucleotide
tctggcccatcctggaacagaagaaatatatcattaccaatggaaaaacacattaaatgataggaacataggaaagtcggtttaagataaatgggcccctagaaagatacactcgcacaacagtatgtacattatataaagatgttaagattagggatgtctgaaattccttaggagaaatggcctgctaaagggcaagggttccacgattgtaatataagagagttattcaattttactaaaaataagttaaaatatttttaataacgtaatcaacatttaccaagtaccccttctttcaagtaatgggactaagaccggagggaaagaaacaattcgtaagatgcaacttctccattaaagctgtttaagtccacagtcaattacactgaaacactgattccaagagcatcttaagttaatctggatttattctttctaggtagttctatcacttagtatacttatgtattagtccattttcacactgccataaggaatacctgagactgggtaatttagaaagaaagaggtttaattgattcacagttccgcatggctggggaagcctcaggaaagttaaaatcatggtgaaaggcaaaggggaagcaagcactctcttcactaggtggcaggagggggcagggaacagccagacacttaaaccatcagaacttgtgagaactatcatgagtgcagcataggggaaccacccatcccccatcccccaaatgatccaatatcccaccagttccctcccttgacacgtggggattacaatttgagacaaaatttgggtgggtacacatagccaaaccatatcattctgctcccggcccctcccaagcctcatgtcatcacatttcaaaacacagtcatgccttcccaacagtctcgcaaagtcttaactcatttcggcattaagtcaaaattccaagtccaaagtttcatctgagacaaggcaagttctctctgcctacaagcctgtaaaaccaaaagcaagctagttacttccaaggtacaatgcaggtataagtattgggtaaatgtttccattctaaatgggggaaactggtcaaagcaaagtagacacaggtcccacgcaagtttgaaatgcagccaggcaatcgttaaatcttaaagctcccaaatctgccttgactccatgtctcatatccagggcaggctgatgcaaggggtgggctcccatgaccttggacagctccacgcctgtggctctgcagagcacagcccccatggctttcacagtgcctgcagcttttctaagtgcatggtgcaagttgtcagtggatctaccattctggggtctagatggtgggcctcttctcatggctccactaggcagtgccccagtgaggactctgtggtggggggaagggctccaaccccacatttcccccctgcattgccctagtagaggttctccatgaggactccgcccctgcagcagacttctacctgaacatccaggtgtttccatacatcctctagacatctaggcagaggttcccaaacctcatttcttgccttctgcacagccgtaggcagaacaccacatggaagctgccaaggcttggggcttgcaccctctgaagcaatggtgcaagatgtaccttggccccttttagccaaggctggagctgaagcagctaggacacaggaagccaggtcccaaggctgcacagagcagtggggccttgggcctggcccaccaaaccatttttcccttctaggcctctgggcctgtgatggaaggggctggcacaaaggtctctgacataccctgaagacgttttccccattgtcttggctactaacattctgcttctctttacttatgcaaatttctgcagcaggcttgacttactccctagaaaatgggtttttcttttctgccgcatggacaggctgcaaattttccaaacttttatgctctgctttccttttaaagaaaagttcccatttcagataatctctctgtgaacgcatataaccgtatgttttcagaaaaagtcaagtcacatcttgaatgccttgctgcttacagatttctgccagataccctaaatcatctctcaagttcaaagttccacagatgtctagggaaggggcaaaatgccaccaatctctttgctaaagcatagcaagagtcacttttactccagttcccaacaagttcctcatctccatctgagactatctcagcctggacttcattgtccgtatcactatcaacattgtggtcaaagccattcaacaagtctctgggaaattccaaactctccctcatctttctgtcttcttctgaccccccccccaaattgttccaacctctgccagttacccagttccaaagtcacttctataattgctatatttatagcaatgccccactatctgggcaccaattttctgttttagtctgttttcacactgttataaagagtacctgtggttgggtaatttataagtaaaagaggattaatagactcacagttctacatgggtggggaggcccccaggaaacttacaatcatggtggaaggtgaaggggaagcaagtaccttcttcacagggcagtggggtcggggggaaggctgtcaaatacttttaaaccatcagatcacatgagcattcacacactatcacaagaagagcatggggacaaccgcctccctgatccaatcacctcccaccaggaccctccctctacacgtggggattacaatttgagatgagacttgggtaggggacacagagccaaattatatcaacttattaatgcagaataaattgtttccaatacaatgagaaattttccctaagtttttctatttgtgacacctcaaaactaaaccactgatgttctcaaatgcttaattaattaaacaaactcatccaaccaaaaatatgcttgtgcatgaaagctgatgttttatggttacaaaaagtaaaacaaaatagtatgaaataaggaaaacatactgcattctatgcactgataaaatgaatgaagctaaatgggtcataaaaaagtatatccagttttatagggcgtgaggcctatatagcagcataaatttgtcttttttttttgtttttacagtaattaagagtatgcaacacgctccacaattatctgagtaattagattttctcaattaaaaacgagcactgataagattagctggatttctaggtcactttgtttcgcagcattatcaatttatccaggtcagaatcttacatctagggatacagactggactggaagttcctagtttttaagtttggtttctggttggggggggaatcctaccaagctaggaaattaatgggaggatgcaattgaaataactaggatagtacttaatgtgttgtaaataataatggcagttattactttgtaaaaacatattttaagcaagtatggaatttctcagaaaacttaacctcaaagcaaaaattttaagattgtttatggtaagaatttaatatcattttccatgtattctcattcttactgttattatttcagtcattggggaaagttatgcttccttcagatggggtgattagaataaacaagaataagacctctgaattcaggacttcgcagttttccaaaagaaatcggtattttttaaacttttaacagattactcctttctattgagcaaatctttacctttccaattggtatttagacatgtaaatttaaaacaaagacattcttctgcaaggaaatttcagatgcttccataagcatttgaaacagcccaactgtttttgcatacttaaggaaagagctatctta

SEQ ID NO: 7979 - DNA, 416 bp, artificial
  synthetic oligonucleotide
tttgaggtgatagatatgttaactagcttgatttaattactccacattgtattcataaattctaccatcactttgtatgccatatatttatacaattatatattgtcaatttacaataaaaagaggcatataaaatttgcattctcttaaagtctttaatgcttgccaacaccatttctctgattcaattcaagctgtccaatgccgcattaatacataccattaaacaaaactactccgcattataggcatagtaataggattacatttacctggcttccaaccaaaagcaacaccgctaacattaaaataaaatattctcatcatgaattagtaatttcatattaacagaagctaaaggcacctagtattttttgaggctcatttgcatatgggtatatactcagatttctttt

SEQ ID NO: 7980 - DNA, 1232 bp, artificial
  synthetic oligonucleotide
cacatacaaaaattgccgaaaacttatgatacaaacaaattttggagagaaggtatttcaccactagccactctttcctgaaaacaaaaagaagtcagaacacactttttttttttttccaacacaatccattctccaaacaggagccaataataagcttttgaagacagagattgacatgaatcagcttgctctgttaatttctgtattaggcaagtcctgaagacattaaaagtgttaggcaactaggtgtccctattactctgtttggagaactgttggagggttgttggaatgttgcaaagtatccataaatctgtatgtccactaagcgttgtctataaacacatgtttaatgtgacaacaaacaagttaatgtacatcttactaggaataataaaagaaattcatcaaaagcttcacggatttgtgccattatgcttttcactccatcaatttttgttagattttctattaccatcgtgagtagagtgcttggaagttcctgaaagttgttgccacaaaaagaatgctaatattcatagagtttgagagccatttgactggagcaagggtcgccaaactttttctgtgataggataggtaataaatattttaggctttgtggactatacagtttgtgttacaactattcaaactctgccgttgtaatgcgaaagtaatcataagtgataaataaatgagtttggctgtgttccactaaaacattatttataacactgaaatttgaattttatgtaattttgacatgtcataaaatattatttttcttttgattattttcaaccatttgaaaacgtaaaaacacttcttggctgatgagccataccaaactggcagcatgctaaatttggttagcaggtcttagtttggtgacccctggactagtggatttgcttagccaagctgacacaaccagggagaaaaggcccagtgatttactttggaattatcaaagtaggtcataagtcattagttaatagagaagtactaaacatcccaaataatatatttgaataacttctctagatttattttttttcttagaacatctgacatggtatttttagatgtgtgttcttttcaaacttctctaccctggtatacacaaattctaatgtcaagtgttccatgagtttctaaacatatgctgcttaaaaacatacggcagattttaacgttctttcttaatcttagaattacaataactg

SEQ ID NO: 7981 - DNA, 1194 bp, artificial
  synthetic oligonucleotide
tcactcaagtctcacctgttatatttgtttgttttcatttttaaccaaatacagtcagtcatgggactcattagaagaagaaaatgaattgattttctaggaagaccactgaacttttgaatgccaaatttgcaattaaggcaaaaaataacttatacacagaatttatgccccaaaatgcaggcagattctgaaaaaagctgacatgcacaacaaaaacatttgttgtatttatttatgatgttcttgtaaacgtcttctacaaaatgaaaaataatcttatttggaaatagcattatccctgattttcgtaaaattttatctggaaatatagtagtatagcaatgataatttgaaagaaggttgtttacatatcatgtcaatgacacatttggtacacataacttttgaggcactgagtattagaaaagattaattttaatttattcttgaaaaagaaagacaaaaacttggctagctttgtgcttttatctcactctaaaaaagttacttaaaagtaaaggttatcccgaagagacttcttttttaaatgagaggaagtgataaaaagtaacacagaaaatgtcatatatattattacaaaacaggaatgacggtaaaacattccatataattttagtgtttggaaaaacatattgcaaaaatgatttaaaatcagatgatgatcagttttacacatataacatgactgttaatgttttcaaatttctgttaaccttattttcttaaattatttggataaattctagcagatttgcattaaaatttatttctctgctacagactgataaaatattctaccacatcccattttcttccaatgaactcaaagttgaatttctcctaataatttccttagcattaaaaaaagaataataaaaaacatacaaacaccttttaatttaaatttgtatttaacaagtgcttgtctgatataattcagctgataaatatgaacctatgtgtttatcaaatccctaagaagattatctaaatcaactcgtgtaattaccattcaccatctgttccaccagggcctgagctgatctgctggcatcttgcagttttctgaacttctcagctttttctcgctctatggcctgcagcatgagagcaaagatgagtaattcaatacaaggactgtgaatctacacaataattataacttctact

SEQ ID NO: 7982 - DNA, 294 bp, artificial
  synthetic oligonucleotide
taggaccagaaaccagatctctttaaactgtgaaatcttactgttataaaaaatatatatacaagacatggttgactgagctgaatttaggctctcgtcagacagcttgaaattcgcggatcttgtatcacattatctagtgattctcaactttgctgaataagagagctagttagagttagaccaattaaatcagaatctctggaagtgggccccaaacattgggatacttttcaagtttctcgggtgattttgatgtgcaaccaatgttgaaaaccacaggcaaacagaaag

SEQ ID NO: 7983 - DNA, 1040 bp, artificial
  synthetic oligonucleotide
gaagagaactagagtaggggagagtaatatctgacaaattgaacttactgttaatcacttttgatgaaagtaaacttaaaataatttactgaagttttaaatatatttttgtacctatagcaaagctcgttgcttcccgaatactgtgaaaagtgccaaagttctattatttaaaatagcagccgggcgcggtggctcacgcctgtaatcccagcactttgggaggccgaggtaggtggatcactttaggacaggagttcgagaccagcctgaccaacatgtgaaaccctgtctctactaaaaatacaaacattcaccaggtgtggcggtgggcgcctgtaatcccagctacttgggaggctaaggtaggagaatcacttgaccccaggaagcggaggttgcagtgagccgagactgtgccaccgcactccagcctgggcaacaagagtgaaactctgtctcaataaacaattaaacaaacaaacaaacatcacttcctctgtcccgtctctgtggtcattcaattcagccatttcttcatcttcaacatccaattactaaataaggatgtctataatttacaagtgtctttgctcccttatttcatacctagaaataagctcacatataccttcacaaatctacaactctttccaagattttaaataatatgtccactgtgggatgtatatacaaacattaattggctaatttgtcttctgtttaacagtttttcctcagtaataaaattttacatcagaagttgtgagtgttctctcagtcaaaaatttcaattagaaaaaagtcttcaaatgaaataaaatttcaaatgtataaaagcataagttaaaatataagataatatgaaattgttgtttcagggcattttcccctgaaaatgacttcagtatttcgatgatattctggtttgaaatatattgaactttattttttaaaagaagtgataaaattgctttctaatggtttctcagttttcatttctctgaaggactaacattagcagacagctggaagcactt

SEQ ID NO: 7984 - DNA, 1068 bp, artificial
  synthetic oligonucleotide
atcttcctgaaagccctcacgctgcctccatggcagaaactataatgaaaatgcattgaaaaatatcaatctgcaattctacaattaaatctaaataataaaacttggtatcttttctccccacacattccagatgtgataaaacacagacagcatttaaatttaaaacatagaagctgaatgtcagcctatttttgaacatgcctcatttccaaagtaaacctcacaagagaaaaaagaggttattaaatacagcaaaaaataacaacattcaaatgtgcaacagagaacccataactgttttccctttattaaaacacagcatacaccataagtgatgcatttacttcaaagcagaggcatttcaatgattaaatcacaaccgaagtgtacaaaggtaaaatttagaagtgcaaaggtatctttatcttccaagtccagttacttgttctggctattttttctaaactcttactgaaaggaaaacctcacttaataacttttaaaaatataaataaaaaataaatcattatcttctttacataaccgtatgttaattgcaaaattacttgaactaaagagatatacgatgacatagtatgcaactcaaataacttgttacaaagaaattttcatcctaaaacttgaacaaatcaaactttttgcagtagtatttttctcagataaaacacagtatagaggttcaacctagtgtttcttaatgtgacacaaagcaatttgatattccaaggaaggcagctatgtatatataaactgagaaggctgctttcagaaaacaatcaaggttctctaagcaaagcagggttttatgataaagtttcatggtactcacactgaattttaatgactgctttagtaaagcagaaagagagaaaatttaatgtaagcactgatactaaaagttaattgccgtcttaacacacaggcgccaagattcccctagcaggagtctcttaaaaaacacctttaaacgcagaagagggcacaagctttgaaaaaaaaaaaaaattgcctgttactgttaaactctattgttccctgatggag

SEQ ID NO: 7985 - DNA, 525 bp, artificial
  synthetic oligonucleotide
atacatttctaatgtgtgaatcttttgggatccatttgtttctttatttctggcaatataattaagtttctaactctaagctcaacaattaaattgatagttcattagcattttagaagaaacacttcaaacaacaaatttagctttagaaaagaacaggtaaaatttgttacattgatcacattttctaaattaattattttaaatgtaattgaataacctatgtcctataaacataaacttgactatagagtcataatttttaaacactgagtctcttcataaattaccacactatatttttcactgagaaattaaaactatgatattttagctaaaatgtatcattttgaaacccaaaatatagatttcacttttcatgttcttgagattatttttcctgtagaaaacgtatatgctgaaagtggtcattaaaataattatggctctaaaactgcaaaacattgctaacatactaagatctaatacagtttcatggtgtcaaaaatagagtatttcaaagaa

SEQ ID NO: 7986 - DNA, 1166 bp, artificial
  synthetic oligonucleotide
ttgccaagttatacaggcattaaacacaaattactcttttatttttccccaagccttaagttctgaggttaggtttcttgttttccaactcattatctgttgtatggtaatactactctccttcatggaattagatgagaagaggtgatgataaaaacaattgtgcctctcttgttgactgggcacgccctctgcaaatcaaaaaaaaaaaaaaaaaagaatgcacaagcatggattcactccccattatcagtacattgtacaatatcaatgatctgtattttattgaacaatatataagccagaggaacctaaggataaagcagacaaatgacataagcaagtcatctgttagatttttctcaattattcatgtgaatatctaaaaggttagggatatttgtaaaagagtggtgaaaactataggttttactttcttatcaatttagcttgtatgaaggaaaagattaaattatcaaatgtaaatcttttctaatttttttctctctaggaacgcttccttcttaggctaccacgtagcatttcaggaccttttcatttgactgaaacctcaaaggaaatattttcaagccaacatccacttcactcctaaaactggtttcttatattcattacattatttatttgaatgacatctgtattttccagtatggataccagcagttcaactttgttttgtccctttttttttcattcctccaatccaaattctattttactgatcctaattgttatacttcttgcccggttgattccatcgttattgcttttcctccagcctggttattcattacacttcacctatgttattaatacaccctcctaactgtttcatctcagactctttcactgcataacattctacacaatctttccagattaatcctccagatgcatagttcttctggtggattccctgctcaaaaatttatactgaatactcagtgcctgcctgttgaagcccaaatagcgtacataacattcagaacctcatagcatccctgagagatacctttttaggcttcttacaatgactttccaattcttcatccatgcttcagtgcaattagacaactcacagtgacgtcctggtcattctccagacctttgactattctccatcctccatcatgtgtgtctttacc

SEQ ID NO: 7987 - DNA, 473 bp, artificial
  synthetic oligonucleotide
aacttggaaatcttattaaaaatgctgactgttatttattagattctgcatttcttagcaactcccaggtgatgtctgtgctctggaccagagaccacactttgagtagcaagaaaatgaaacatctgttactcagttgtaggtgatggtgccaagagaaaatatagtaatgagtgcctagtagccagatctaaattttcaaaagaagacagaaatccatatttttttaaaaaatgaggtctctcaatttttaaaagttgtcaattatttaaaaacagtggctatgcaaaaatactgcatgcattcaggattcagcctgtgggtactcagtttccaaactctgggctggatggagagtcaaggtctaaactggcaatgagaaaaaaaggaagtttgagtacagagcaagcggacgggacagatcctgggggcaaaatgtgaatgtgtgagcaggcttgtagcactggttcaca

SEQ ID NO: 7988 - DNA, 224 bp, artificial
  synthetic oligonucleotide
taaatattctacattggctataccagactacgtgatatactagtatgctattttaccttactgtgtctctcttcctgtttcctgctcttatgtgaatatacagacaatcctttctggtgacattatctttgctctcaggaacaaagaatgaccttattacatttacctatatcatcactacccctttcacattttaattagcaccaaattgtagaaaaacaatt

SEQ ID NO: 7989 - DNA, 1319 bp, artificial
  synthetic oligonucleotide
ttcttgctgctggtggaaaagcaatttgcaatatatgataaaattaaaaatgtgaatactctaatgaggtaacaattccacttctaggtgttctcatatgtctatctgaggagacctacagagaatgttgtttcagcattgttcattagtgaagagctggaacaatctgattattcactgttaatctaacgggcacattgattgtttggtttctattaaaatcaagaatacttttaccagattacttctgtattctaaagccattaaaaatctttgttcgtatttttatggagtccaaagttctatttaagctagtcataagcaaagttaatgctactattcataatggactcattgaagatactaaagataataaaataacaatactatctctaacaaattggactttagttacaatggcatacacagtacaatgtccaaataacatctgttcagttttgagtgaagcacaggaacgtgtatgtatgtatgtgtgtgtgcataatttgtatttgtgttatctctccaattatgtaaatcactaatacttattactatgctaataccagaagacgtattgtaataaaggtcacatgaattattaatttttgtgtttcttatcacctatttcatcaaataattttaaagacagagatgctatctatccacactttctctacttgtcattcacaaaagttccttcaaacaaatcttaaaaattaaaagtatgcgcacatggctttgtagtttcatgtttcagtaaggagaattttacttggatcctatacattattgtgagtgcttccatgttttgccttcttaatgcttaccaaaattattaatgtcaagaataccaatcttggccaggcatggtggctcacgcctgtaatcccagcactttcggatgctgaggctgacggatcacttgaggtcaggagtttgagaccagcctggtcaacatggtgaaaccctgtctctactaaaaatacaaaaattagccgggtgtggtggtgggcaccagtaatcctagctacttggcagtctgaggcaggagaatcccttgaacccaggaggcggaggctgcagtgagctgagatcgcagcactgcactccagcctgggtgatggagcaagactccacctcggaaaaaaaaaaaaaaaaaaaaaaaaaaaaagagaataccaatctcattttaatgaccagcatgttacataatcaattattataaatgattttaagctgtttaatgttcaaattaaaacttttcttaaaatagcctaatttaaataattatggatgttttcattaactatattatt

SEQ ID NO: 7990 - DNA, 3419 bp, artificial
  synthetic oligonucleotide
ttatatgtgatcaaattgcattactatttaatactatggggtataagaaagattgttagcgacttccatctcactagtagataaaataactctcctccatgtaagcaacattggagaatattttctttttgaatatttgaaaggatggcatttggattaatgaattccgtaagaattcaagagaacttctgaagaaaatttgaaatcatgtctagattctaagaaagacaatctattgtgtaggtaaggaagaatttcatgtcttccctctaaatatttacagtctgcacatacaagttggaaaattagaaacaaacactatgaacacataaacacttatttttgtctgctttcttttctgtcactctaaagagtaaataaaatatatgacacacctaacatcaataattctcattttagaaaaataaatgcttgtactctacataggcaaggccggagtactggaactcaaggattcatgataaccatttgtatttctggatttaagaaaaaaaaatgttaagtttgggagctatggatttttaaagcttaatggtgctatttgcttacattttaatagattctttcttgctattaaaaatataatccaaataaatatttgctactacttacaagtaagataattgccaccaacactgccatcacccccatcatttactcagtgattcttatgtgctaggcaaggttcttcataaaccctcttttatttcacctttaccaaaccatcttcagggtagatgttatcatcccccttttaccaaggtaacgaaacttgttcaggatctcacattaacaagtgatgtttccaagacaatgtgcttaaccactgcacatatttctaagaatcataggacatcaggtatctttcttacatgtctcattcaatatgcaagaattattaatcactcaaatacttctaagagctatagcttataatatatggtatccatgaaatatatctaatatccattttaatttgggagagaagatcatttgatatagctataaaaatatggattgtaacaatcaagcgcatctggcatccactcacaacttaaatattacccttgagaaatatctccaacctgactttaaacatatccttccttcactaacttgaatagagaaataatcattgccttttcctgttttagttggcatcatctaagtgcccttctataactaacattatatgaattcatctacatgcgctcagtgaaaagcagggtttctcaatctcagcactattgacatttttgtcccagataattttttgtcgtgagtggctgtcctgtgcattgtaggatcagaattgcttgtcagtatctctggccagagctccctcctagatgtacaaccaaaaatgtctcctgacattaccaaatgtctcctgaggaaagaaaaattgcttatggttgagcatgtctcaattaaaaggattttccatctctccctacccacccacctctcaaatagctgcttagaatttgtgctggaaatcatttatgcctatccaattttttttttctcattcctcagaagtagaaattaagagaaattgttaagggcttctctttccaacatgatattgggcaggcactgaagtatccataagtaaaccacaaacttatggctgccaaggaataataaataatattacacaggaactgtcttagtgacaaaaatgacaacatctctgctggagagtaaatgtccacagattctcctcttgcatctacacttttgtcaagagatattccagattctcccattaagagccatagtctgtttctccactccttgaatatggattggtcaagtcacttgtttcggctaatgaggtatcagcaaacatgacataagcagaggcttaacaatgcttgggtgttgggctatgcttggaactcttccaccgctatggaactatgctagcctgatgaataattacaggcaagtgatcctgtcacccacaccgtctcaacttataaccaaaaagttataccagacatatgaatgccacatgtggtcatcaactaccagctgaccacgagtgcatgaatgagcacagctgagtctagcaaaagaatcgcctcgatgaaccaagccccaagcagaatcaagaatcatgagctaaaaaaaaaaaatgattcttattttaagtctctacatttggggtagcttgttacacagcaatagatagctgacacagcatccatttttacctgttaaacacttgtacgcaaaacaggatttaaaattcccttcccattaccacagaaattaaaagaaaaatgcttatccagcagagagaacacagctggaaaagacggagtctttaagttaaaatgtggaatggaattccacagagaatggaagattcacatagtcactctatgaggtcaataaatcaggcagccagcatttgacaggatatttgaagaaagtaacacttttagcagaaactcactattaatgcactaagacctttgtatatgaaaaaagtagagtatgtaataataagagccaagaagtaggcagcccagtgcagaagacaagggaagaaaaagccagatgaaaccataataaagaccacgctattgatgaagggtggtcatcaattgcaaaactgatatcagaataaaatccatataaccatttgagtataaccagctagagaacattgtgtagttcttattacagaaaatacactgctattctaccaaaattctgagcaccttaaaaaactcctgaattaaataatttattctgatttgggtttgtttattcaattttttaaaatagagttcctcctacctgaatgttagagacaagactctgcagtgaaaactaagcaaaatgaggtaagcagtgttttctacagaattcagtctaaatctcttatttgtttgggagagctacgttttcaccttaagcagaaaaataattagtgatgtgttttgaaagttgttatataatgaataagatcctctaccatgtgtcaggccctcacaagcctcatccaccagaggagatgataagctatttgagataagtatcagaatcatcttttccttcctcacaagaccaaaggtctgaaaaataacagggtctcaatcaaaatttgttgttgttttcacaattagaatgaggtgcaagttgcaatgtactaagcagagtccttaagtgtaatctcgttctctctctaaatatatatatgcatatgtatatatagtctaaatatatatatttagagagagacagagaagttatataaattaatataacagagttatgtaactgtgatttacagtttcctcagagtttcaatctagaacttcatcagtgagaaaaaagaggaaccattagtgcaatgtaaatgcgacaatattaaatagtct

SEQ ID NO: 7991 - DNA, 1730 bp, artificial
  synthetic oligonucleotide
gaccactgcttttcagcaaagtacacctaggtcactgtgcttcttccacaatacaggctgcatgtcgtgtctgaaaatcattttgcttaaagctgctttgttgggaaatattacttgcttggcttttctagcttgactttgagttatttgagataaataagtaagagagaaagttgaccctttctctatcatagtctaaaaaataaaggttgctgttggaaatcaacacggacccacaatttcttgttgaatgtggaattataattatccctcatgatgaaatgtaatatagacagtttgccatatggaatagatgaaataggtgagaggccagagctgtcagtttgagagctgtcattcatatagtgatgaataactgaagccatgagggtaaagaacaagggcaaagccttgggaatggtctgaagaggcagatcaaatgcatgaaattgaaataagacattcaggaaaggttatattattcttactttcaaggcagaagctctggagataaagcatgacaggtggtcctttgacgaagcaaagtgaacctcttgggtggtcactgatactttaccaaagtgattaggacatggctgacaagagattggatgtaaagaaaatgatagaaatgcttgtagagtttattttagctgttaaaaaaaaaaaaaaaagcaaaaccagacaggaaacttaaggaatatgagctacctcattgtggaagcaaagactcagaagaagtagagaacaagaaagtaggaggttgagtaaaatatcaggtagccaagttagtcaacaaaagtggaagatttccacttaaaatttacaaaaaaaaaatgctaaaagttagaattttggaaaacgactgaacttgaagattgtacatattagccaggcagttactctaaactcatactcttatataattattaaaaggagctcctttactaattaaatctctaacctgattttcttttttccaaatcctgccatctttttttgcttttctatcatttccacaaaaaccactcctctcctctctttcataatctctgagtttatcaacatttttttttggttacgtcagactctagttttcctatattccacggtccatttgaaagcactaacttattacatgtaactagtgccaatggaaaattccagctagcaataaacgcatctatgttagtcactgtaggcagaactaatgttggctccaatgataagaatgctcctatggttttctcttggctggcaagcagttgctatattgctcctgaaaattagaaagagttgtgctgtgaagcagtagaaattacatacactgactaatacgttagctgcaaatttctatatggattctttcaatctgaatacagtttgggtaatagctttgtccttaggtatttttgtacacacagataaagtatgttaaattttcttgagacaggcattagcaagaggttcagaacagaattagcatagttgtgttccaaaacaaaagatagctgatataaacttgccatgctgccagttccaatggtattactgaccttttaatctcgttgtttttttttaaatctttttattttttctctgctaaatctctgcctcttgctgtttaataagctaaccgttatttggaacctaatgaaaggatttttttccctcagtctaaaccttcctaaatagcctcttcattattctatttactttgaacattaaaa

SEQ ID NO: 7992 - DNA, 1158 bp, artificial
  synthetic oligonucleotide
aggacaacagaagtaggttgcatttggagaaagagattggaagaaggcaaagatgagtttagctttggacctcttcaatgtgaagttcctgtgggacattaacatcgaaagaaagcagcaggatctacatgtctaaaactcaaaagatcattctcagctggaattatagatgggtagtcatcaacagactgaaactacacaagtggatgaattcttgcaaagagtacatgtgaagtgagaaaagaacagggaagaactttatagacatgagtcagaagtagcttggtgaattgcagattctgtacaggctaaaaatgtgagttggcttctaaaattctcatttactttacccataggggaagtaagtatatgcattccttagctgatagctttttggaaccaagccaaaaaatataaactggaagtcattcccatgaagaatccagagaccttgataaaacaattttttaaaaaactgagagagtggcttgggccatcaaggagcatgagaatgaagagaggggtctgtcagaaagagtagtatagatagactagatcagtgtcctcaagctctagtttcataccatgagcaagcttttttcttggccccttagtttatattacctaaactcatcaaattaatctctgactttaatttgctttccccaaaagacttctctttgagaagcagatatttcccactaagatctaatggttgactctctgataccaattgattccatgtgaataattcttcctgaacctaatctgtccctgtttaattgaacacatataagatctgtattttgagaagaaagtccaagccttgccattgagaaaaagtagttactatgagaatttttccaaatatcagctccatattcaagtttgccctttctccaccagggtctttttcatagggctccaattaaaacttcccaactttaggttgaatcttcttttccatggtcttttccatctatacacctactgtctggaattcaggattagagttgctctattccccagggtgaccagcttaaattcagcttcacaggagtttttactctctaatgtctagctcagtttcaaaatttagttggccgcttaatttccatatatcattatctcatttctcctaagacttcctactcttag

SEQ ID NO: 7993 - DNA, 1134 bp, artificial
  synthetic oligonucleotide
tttaatccaatattgaattgttgaattgggagcaaagaattgaggtgaaatgtggttggctcctgagagcaactgaaatgctgcttcctgcagagaataactttctttgtaactcccagagaataatatatttgcaaaggtgttggaggtgaatagatattagagaggaaaaagtaaaatctttagagaactgaaagattatatttatgtgactcagatcattgtaagttattataatgctaatattgaatagtcaatagtcaacatgctaacagacctctcaaggacaaccacagactcaggagcaaacaaaagtaatttgttgctttctcactatcaagaaacagacattcttccatctagactaatatgatctccagtgggaaatgatttatgtctcttacattcatgaaactctctctcataaccaggcgtaatgacttcttttacctcttcggagaatggctgatttatgcacagacctttgtgcaataacttttctttaaagattgatgctgttaaacatgaaaaaaatgtgaactttctgacattttattttaatataatttagaaaaccatgtaaactgcaaaaggacctcatgtggaatgaaaatcacatgctgataacctaaattattttcaataccattaatctttgactaatacctggaatgttttattatcagaattatgaaaggcacaagagaggcactaatgtagttcatcttaaaaataatttaaaggacttaagattctttttttatcccctcaatttacactttgagaattttccagtaggatgggtagtgattgttacctatcacatagaggaatatcattttttttgttttggtctagaaagtctgctcccaaagaccaataaccctaaaaaattattcaaggttagaggaagggaggaggagaaagtgacacaaaattctttgacatttttctgtggtcaaacttttcctgaccttttcaattcttgtttggagaagaagttctgaaattatgtggatcttgtccaggttctaatggagatcaaagaaagttggcaaatagtcccagccttctcaatgttttcattgccactgccccatggtatgcatttaaaacaactttattaattttatt

SEQ ID NO: 7994 - DNA, 1716 bp, artificial
  synthetic oligonucleotide
gaggccactttcacacatatttttagcttgaaaatgtgtatctgcatcaattgttaaaaaaaaccttttttttggataaatgggaaagtataataaattcaattttatttttaggacatgaatggatgataatttgtgggcacaaaaaagaataatttgctaagctttagtagcagtgtaatacattaaaatgcctgtatctcttgctctaaatgaatcaattttaaatatatatgaattgaatgtatcaattgagatcttaaaatgagcaatgaatgtggtaataccaggtacagataatttatgtgttctaatattatttagaaaagcatgccataagctgttcttagctaaaaccaccataattgagaaagaaatacttgagaagagattagatattctctactagttgaatggagcagtgaaaagtagattttggtgtcgtggttttatgaaaaagaaacatcagaaaataaagttctaaatcatttccattaaacaaaaacaaaaaacagagtttttggtatggcttggctgtgtccccaccccacaatctcatcttaaattgtaatccccataacctccataatccccacgtgtcaagggagagaccaggtggaggtaatggaatcataagggcagtttctcccatgctgttctcatgatagcgggatctgatggttttataaggggctcttcctacttcgctgggcgcttctccttcctgcggccttgtgaagaagatgcttgcttccccttcaccttctgccatgattgtaagtttcctgaggcctacccagccatgtggaactgtgagtcaattaaacctctttcctttagaaattacccagtctcgggcagttctttatagcagtatgaaaatggactaatacagtagctttgtttaagcaacataagtactgaaatgaatattcaaatataaatcatataggtggataaactgatcttatgaaatggggttctgtcatagtttttggttacaataacacacaacgtacaatgttattgattactgagttagctaagaggacttctcctgttataatattatacataatatcacaacacagttgctttcgttataaaataaagtaacatgtacattctatctgagattaagagaccaatggtgaatatattcctcttcatgggatcactgcactaaaacccacggcttttatttattttacaaaaatttctagttaatgatctaaggatttagctttttattttttcaccaaaccaaggtatatattgactggaagtattctgaaactattatataaaacaaaacagcttttgacttttttgtatcagttgtttgtttgaaagttgttcttcaagtgggaacatgttttcttccattttaaattgcagtcttacagatctgtagttttcttttcatggggacaaaattcgttttaagaactctggtatataaatctctggaagagagcattcacaaataaattccgatcaacagattgcatacatttctcaatcagctgtgcagactgagcattttcacggctccagtcatttcataaagatgattcagaattaatcagtcctactgctacttttattatttatatattcacagtattgacagatttcattttcttcccactctttactcctcctctataggaataacactcatgatgtggtgcgggcagcaggaagacctatcat

SEQ ID NO: 7995 - DNA, 805 bp, artificial
  synthetic oligonucleotide
tcctttatgaaaaaatcaatactttaatagactttcttaggaaactattttgagaaactcaatagcattgttaaataaagtagaatgtcccatcagattccagtattttatatgtattctctgacaaaagggtaaaataagaagcaatgagttacatgataaaagatttaaaggggtgtgtgtgtgtgtgtgtgtgtgtgtgtgtgtgtgtgtgtatagaaaacagcttttaaacattacagtattctgagctaagggtggaaattcacctcagagaatttttaattgtctgtctgagtcctgatgcctcaaatttagcatgttattaatcttctaacattaccatgttctattgcaatatttttaaaatattgtaatttttaaaaatctgtctccgctactagattgtgagctctgacttcaaagactatatcttatttctacttctttcctcggtatggaacatcacacctggtgtacagtcacactagctatatttcaattgctcagtagccatatgctacagtactgcacatcacggatataaaatatcttcatcatcgcagagaattcacatcacagtcctgatttagagcaggatgtctgaaacttggcactactgacatattggaccaaataattctttgttgtggggggctgtcttgtgcattacaacatgttgagcagcatccctggcctctgcccacttgatgacagcagtatccccgcccccaatgtgacaaccaagaatttcttgagatactgtcaaatgttctctggggatgaaattatatcaggttaagaa

SEQ ID NO: 7996 - DNA, 2218 bp, artificial
  synthetic oligonucleotide
tacttgtcttgttttgtgctaatactatactatttggattacagtagctttacagcaagtttaatattggataaggcaagccccctcccttattattgatgcagagacatttattatttttcatgcattcctgagatacttgcgattatttattatttcatatgaactttaaaagtctcccctcctcaatatatcttgccttcaaggcacttgaaatttacagggaatttaaattccaagatttaaataaaatcttgataagcctaaaatactataaatctattctatgaaacagacaccaatattaaggcaaaacaatgaaagtgaaaaccaataaaatgttcagagcactgcttaaatagattatgatacatccacaaaatggaacaatatgtagtcattaaactaacggttaagttctttgctatgggttgaattctgtccaaattttctccaaatttaaatgttgaagtcctaacccctggtacctcagaatgtgaccctatttggagatagggtcattacagagataatcaacttaaaatgaggtcatttggttgggcctgagtccaatatgactctgtccttaaaaggggaagttggagacagacacgtacacagggggcatgccatgtgaaaatgaaggcagacatctacaggacaaggagcaccaaagattgccaacaaaccatcagaaactaggggaatggaatggaacagattctccttccgagccctcagaaggaaccaaccctcctgacaccttgatctcagacttctatcctccagaactgtaagacaacagacttcttttggttaagtcatccagtttgtggtatttcactattgcagtcataggaaacaaatacattctttatgtactgatacaggaaaatgtccaagaaacattgttgagagagaagcataattcagaagaaaatgtgtatcgtatgctaccattaatgtaaagatgcatatatatagaaaacagacacacacatatacataacataaacttatgcatattcgcttgaaattcgtacatatctcctgaaggatatacaaacagctgacaatactgattggtggtgggtaggggaattgattcgacagtgcatagaggtaggagaaataatttttattttatacctttttgtaaattttcatttttgaatcatcaaaatgatcacctagtggaaaataagtaaaattaaaaacaatcaaataagaccccctaaattatcagctttctttttactatcttaattaaatcagataacttgaacagatcttcttttgtactttctgtgtggaaagttatatcagactgaaacatgttaatacaaagtatttgcatatagacatagacctctatctttcccatttactcagacaacaacttttacaatgttaacatgtgttcaacattgcttgaagtaatatgggagttaaaagaatacaagacatactttctgtattacagaagctcttaactgagtgatggagaaaagaaaaaaagacttaggtgaagcatgaaagtaagtcacttcagtttctttgtgcctgttttctcaacagtaaaataacaaatgagataaatgactgttgaagtcttaaaatttctgaattgttttatttgttttttgaaattacacttttagttttgagataattgtatgttcacatgtagttgtgagaaataatacagagaaaaccagtatacccctgaccccgtctccctgaaggtaaaaccttgcaaaaatatagtacaatatcataaccaggatattgacattgacacaatcaaggtaaagaacagttccaacactacaaggatgcctcctgtgttgcccttttggagtcacatccatctctctctctctctttcccctgttgtcccggactccttgcaatcaccaatctgttcttcattctttaattctgtcacttcaagacggctatataaacagaatcattcattatgtaaccttttcagatgagctgtttttactcagcataattctgtggagattgatctaaaagttgttgcatgtataaatatttcattccattttattgctgaatagtattgcctggtatgtatggatgtaccgtagtttgtacaaccattcattgttgaccgtctgggttctttccagtttttggctataatgaataatggtggtatgaatatttttgtacaggttgtaagataaat

SEQ ID NO: 7997 - DNA, 4631 bp, artificial
  synthetic oligonucleotide
ttttggtgtaaattaaagatgatctgaattatcagaaaatcaggactgagaacaactaccctgaaaaaaaaaaatggattactttagaatgtgaaagaatggccaaggtctatgcaaagttatttttgctttgaatagaaaccctgagtgcaatgtttaagaatataaacctattcccaacatgcaaaaattctatagaattcttcaaatgaaccctccaagtcagtattttaactctgctactgtgtatgtgctaggtttcccaaatggaattctctattcccagaacaatcttttctaaagccacaaaaaacacaaatagaattcaaagttcttatgcttgatatactttatgccttctttcataaaacacatcacctagttttcacgtttctctgaatatcctatgttgtcacaaaagatatatttctcctaagttaagctaaaacgcatgattttaagacaacctaaatgaaaattgcaaacacaaaacacattcataaattcatgcttatgaaattatgacttacagcataagttattcttgatatttaaaagaatcgtttatgagtttttgtcatcatgaatgtttgacaacaagattatctgtgaacaagagattgtgtgggcttacacagtattttcaactaaaagttacggtattttgtttaacacagaaaccacaccataggttaagtttgagattattttgaaatatctgaactactcagcaggtaaaaacaaataatacagcccatttatagctcatcagttttttgttttgagtcatctaagcaataactcaaggaaggtgagagagagcatttgccaccctccagggtggcaactgaacttcaggaattccctggagatacagccaattgatgcttcacatctctcaccatgctctgccatcaattctccattgccatggaatccacaatggaaatgtgccacacttaggccacttttcatttcagttcttttatatattaccctcccttttcatattctccttggaactgaatgagttactgtttcaaagaatgggggccctgtactagggaagggtggggtataatgacaagcaagttcatttgtttggaataaaatagtcagcaacagaacaataaacacagaagtctgctagaagaggccttcagtttatcaacacaaagagttttcttcatgacttccttggatgtcagttgcatttaaatatagagttgctaataatttcctttcctctttactcgtttaattatgcaatcggatattaaagcattgggtcaggtattttgcccaattttagctattttatttgtattttaactatttccaattttaactgttcttgatttatatccaatttatttccaatttatattggaaatcttggccagtaaataatttgagtatagcatggtttaatattataaaggttatatatacatacacagtctctctctcccatgtaactatatccactaaagtcctaaagtaacaatgcctctgtctgttatggtgactcagtctgggtttcccatacagcagactgaggtgatcctaggaaacactgtagggaacaggaaaggaggagaggaaaaggaagaaacaatccagagttctttattgggctgggcgtggtggctcatgcctgtaatcccaggactttgggaggccaaggcgggcggatcacttgagatcaggagttctagaccagcctggccaaatggtgaaaccccatctctactaaaaatacaaaaattagttgggtgtggtggcgcatgcctgtagtcccagctactcaagaggctgaggcaggagaatcacttgaactcgggaggtggaggttgcagtgagctgagattgtgccactgcactccagccagggtgcagagtgagactccatctcgggaaaaaaaaaaaaaaaagaggtatttattgagtagattactaatctggggaactggggctcaatgctgttggggatgctctgaggatctttggaatatatctcaaaattatcccagtgaggggagagaaagctgagatttgtacccatctactctcccttattggttgagtcttgctcctgttaataccctgtcactttgggcttggtccatgtgcccatctaccaccccaaagctaagaggacatggaaaggatacctgcagcatctgttctacatggtatttgatattaccctcaatatgtgcccacaaaacagtatacaggatcatggactcaaaatgacagcaaaataaacagatgcacacactgttcacaaaggatttgattgggtttgcaaagctccctacatttctttgcatataaactagactcatcccttaaatttcaaagtaaaatctcaccaactgagcgaaagctgtggcacagaagttcctcagagttttaaaagatgtgctttgggtttaattccaaccacatacatataaaaccatgtcagtttcaaagtctaggtcagggctcttaaagctgaaacagctagactcaaatctcagagcattttcataactggatgatctgtactcacttgcatttgcaggcaaaattgtaaatgaggaattacaatatatacattcagaacagagaagaaatttccctaaagacaagtaccaaaaatgttaatgtaaagatttgccacttaagaacaaatggaaaaaaaaatcattggtgcctaactttcgacacataatctaaggtctgaagtctttttgtgtttcacaatatgaaggtgccctggccacaatatttatactattcctagaagattgtaaatagtatctgaatgtgcactgtgagtttctcagattcaaccccaggaacaattgcgcaaatgctctcctgcatatagaaactgctagatcctcttttcagagctgctgctttttgtttttctggagacagggtctcaccctgctgcccaagctggagtgcagtggtgagaccacggctcactgcagcttcgacttcccaagctcaagcaatcctcccacctcagcctcctgagtagttgggattataggtgtgtgccaccacacccagctaagttttttatttttattagagatgaagtcccactagattgctagggttggtcttaatttcctgggctcaagagatcctcccgcctcagcctcccaaagcactgggattacaagtgtgagccaccacacatggcccagagctgcttcttaccaggcagacagagaaatgggaggcagcacgaccttggagaaggaggaaatagtcattgtccccttcttttattagggagtgcaggccccaccatactactattctaccagcacagtgcctgctcctctgggctgctccttccaacctcactgctgccctcagcctcatattcagaacatttcagtggtgaagatcagagcacataatgagcttgtctggaacaaattaagattccgggctttaaagtcaaacagacatgggttacatgggtttgagtctcatttggctctgcgatcttcagcaaatttcttatctatttccttatccgcagaatggagatgataataccaccttcctcaagggacttttgtgatgtatatatagtgctgggtatttagtactgaaaatatgctagaggttgctatttgtagtagtagtagtggtagtagtagtagtatggaaagaaggaagcaagctaccgcacagaagtctcctgaaaatctgaaaaaggcttggggaaatccagcagagagagctttccctttcttcagagcagaggtttttaagttgtgattcaagggccggcaacatcccctgagaacttgttagagatgcaaattctcaggccccatcccagaccaactgacacagaaactctggggatggggcccagccagctacgttttaaaaaggcattcagaagattccattacaggtcaacttttgagaagcactgctctagcggaatagcaggaagggtaaatgctaagctgagcttagttcatatgggacgttaacatttcctctctcattagtggtcccctcctgggcagatctagcatttgagattttcatttacatttcttacttatataccatgcagtcttgggtagggcccgttaaagatggaagtagataactattaggttggtgcaaaagtaattgcgttttttttaccattaaaagcaatggcaaagaccacaattacttttgcaccaacctaacagctgtaagggattatttgttctctgtccaaaaccagaaagactgactagaaagacttttacaggccattttaagtccttgtttgttttaaatatgtacatataaaaatcagtatctatgtctatataagcacttcagtgtgttaacaatcatataatcacgcccatgagagtatcatgtaattgacattgcaccatcattaccattatgttgaaaaggtgagcaatagctactctttaaatctacttagaaatcatacaggattgtgtggtaaattctgtgtattaacataaagtcagatttcaaatcttaaaggcttgtagaataacattttcacagccatatggttaatagttgtaaagaaaagacaatgtttttttactgctgagaaatttgactac

SEQ ID NO: 7998 - DNA, 2077 bp, artificial
  synthetic oligonucleotide
ctgtagaaagctaatagagcctccctatctttgaaaatgctattgccattgttgctcccagtgtaccaccaccaagttgacacaaaattcatatacaaaatagggagataaggaacaatgtctgggaagccagggtgcaaacttgtgaaaaacaaaacaaaacaaaaccttatacataaaaataaacctgttctactcctagcaatctacttctcataaaaacaaatccttttctactcctagaaaaaatctactctctatttcatcctttcaattagtatgcatttctttgtagaagtttccttctttctttatatgctacggtatcatatggtggttaaaagttcagactctgaagtcagactccctgatttctttttcttttacttttttcttttttcttttgagacagagtctcactctgtcccctaggctggagtgaagtggtgcgatctcggctcactgcaacctccacctcccgggttcaagcgattctcctgcctcagcctcctgagtagctgggactacaggcgcgtgccaccatgcccagctaatttttgtatttttggtagagacgggatttcaccatgttggccaggatggtctcgatctcttgacctcgtgatccacctgcctcggcctcccaaagtgctgggattacaggcgtgagccactacgcctggcccacccagactccctgttttcatcttgtatcttccacttgctaagtgaccctaaggaaattatttagcctctctgtgcctcactttcttcaaatgtaaaaagaattcaataataaaatctacctcttagggttgctgagagcattaaaccggtcaatgaatggaaagtgcttatggcattgcgtggtatgtaggtacatcatgtaaatattagttgctatcattatttcatacttgatgcagacatttacaatagtgcttctgaattactaaaaatgcagattttcctccttatagaagtatatatgttaaaattttggacaagttagaagaactataaagaagaaaaaaaatctcccttctgtaatctttctacctagaggtagtaactactcccgtcatttagtgtatactcccataactattattaagtccatttggtcatcttctacctcccttcattatcactttttctctagacacagaagaaagcacaaaatatttttaataaagagaaatgaattaagaaaggcaactgcttagaaagcaggaagcctggctttcattccccgcccttgctagatcatttaagttacaatgggcgttttacttactatctctatccttttgttcctccacggaactattgcaaaactggtataacaagaacttccctctgccctttttacaaagatgctatgatgcatccattaactaacttctccaaagaaagctggcacatagaagggggcaaaatataaagtatgtgagtatactacaactaaaagcttagtttacagaggatgtgttttaacaaaatctgagaggaagcaaaagacaggaagttgctatagtctctctttaactgtaggagctatctcctctaaactgttaattataatgtgttacaggttttatattatataattgtaatgtgttataaagggttttaaagactgtcctctggtatgcatttagactaatgccaaaaataattccataatacatatccgttaattttttatcactttttgtataaccctgtgatatgccaagagagaaatttatgaaactagaatagctgcactcctcatttaaattcactctgatgtcttaatatgcatgtctcctatgtttataaaacattaccactttaatctaatctgaatcctcaagtatcatctccataccaagcaaataaatgattcatttattcaaaatacagtgaatcattctgaaattggatgatttacgtagacatgtgagataccagttacttgtgctaagacaatgaggaaaatttggccattttaattcatttgtggcctttttgctccacatcttttcctacctaatgttgagagactttttccgaagttcactccacttgaagt

SEQ ID NO: 7999 - DNA, 2512 bp, artificial
  synthetic oligonucleotide
aaatgtgataggaggacaaaaactgaagcgaaaaacttacaaaggacagagaacactgagtaagaactgaagaggtgaaaggcagccagagaatgaattaaaacagcatatacaaatgtattcaacctaaagctctgggtctcaaactatagtgtgtataagaaacatttgagtagcttgtttaaaattgagattgctaggtgccacctccagactttctataattctatcaacaatctctgctttcaacaagaaccttcacaattccacaggtaagctccagaaccattctttgataaagcatttattaaagcatttctgatatgccccaaacattacttcttggtctccacagggcaaaggtggcatttgtcagtgacttgattttgaagatctaaatgtaaggaacattgtgagctcaaaacattttctttgaccatgttaagcccgtgaaatgttttcaagtcacatttctaatacatttatcggaagcagttgccctatttttattttcatgagtgtatataccagatattttgaaatgattaacctatgtttgcatgtggaatatctcctcctgaaaatgtttctttgtatttgtaatgacttttttttctggttatatcatacataggctgttggggttggaaggaacctgagagattatagttcaaccttcttgttttgcatatgtagaaatcaagattgcaaaggtataaaacagctgctgaaaaacataacttgagctgtcctatttagatatgggaaatagaaattacaaacctttgttagatgagaaaatccttaaaccttagtggttttaaccaaatgtttttgatctctgaacaaaaaggcttgttgctgttaaattaaattaaattgggcctaaagctgactctgtacatagcaaactgcaacccagcttggcatgtaagcaatatgcaacttaagagtacattcttgtaacaaatagctgagcctcagccaatcccagcagtcaagtttcagctaatcacaggctgtaaactgatcagctcatgtccatataaggcaaatgcctatttacactatgcccaagtaaggcaaattctaagctgtaaccagtcaagctgtttctgtatgtcacttcctttttctatctataaatactgcctgcccaccttgctgggtggagctttctgaacttctaattctgagtactgtctgattcatgaattgttttttgctcaaataaactctgcaaaacggaatttgtctaaagtttgtcttttaacattgctaattgtcaaatatattctgcttactcctacccactcaacggaaaataaaagaggtggttcaaaggggcatgcttagcttctatctatgtctattaatctttattagtgaagacaagagcttaggggttactaccgtttaacaaggcaagtgctaatctctaaaaagctgataatttccacaatttgtaaggtttaggtaaaacgcagagcctttagatgtgctggagtatattgcttggtctttaaggaactcctcagtgtcaggacactaagaattataggggctgataaagtgattgttatttctctagacacagatatttcaactgtgatttggttaatgcctagtttgaaatccttaataaaactttactctgaaaggcatgcattcttaaagtgaaatgtgttatattgaattcatttttcactttgacttcctttataaaactaatgatatatccctataaatctttagtaccctcatgtaataaaatagcacttaaacatgcagaaagaaaagggaggaatgcagaaataataaagaaccacaatactgccataaaaacagacacaaagacccatggaaaagactagagaacccaaaaacgaatccacacacctacagttaactcatttttgacaaaggtgccaagaacatacagtggggaaaagacagtctcttcaacaaatggtgcggaaaaactggatatccatatgcagaatgaatctagacccctatctctcaccatatacaaaaatcaaatcaaagtagattaaagacttaaatgtaagacctcaaaccatgaaactactacaagagaacactgagaaaaatctccagggtgtcatcaacagatgaataatttgaatttgtacttcagaaacaaaaaaaattaaagaaccacagaattaaaatgggagctatctctttaaatagagagaatcccaaagagaagtcaacattttttttttctagacaggtcttgaactccaacatccaaacataattaacattctaaaagagagagaaagaaggtcagagatattcaatgtccaagttgcagttttctctcaaaggtagaccccacctctttttgcccttcttttgttctccattatacaaagacactaactattctaacctctaatagcaagcactccccaatagatttatggcttctacagactatataatgtcagtgtccttgcctcttaatgttcacaattgtata

SEQ ID NO: 8000 - DNA, 1322 bp, artificial
  synthetic oligonucleotide
aatgcagttctaaaaataatttttaagtcatttctattcagcatccctaaatatgactgcataggatatcaaacttatacaaaaatgatgaagaatagatcaaaaagacgtctatttcctccaacgcggctaaaaagacaccttagagtagatataactaacagtcaagtggtttagaaactctaagaggccaggtcattgaatgttagaatgaatcactctggccgggcgcggtggctcacgcctgtaatcccagcactttgggaggctgaggcgggtggatcacgaggtcaggagatcgagaccatcctggctaacacggtgaaaccccgtctctactaaaaatacaaaacattagccaggtgtggtggtgggtgcctgtagtcccagctgaggcaggagaaggagaatggcgtgaacccaggaggtggagcttgcggtgagccgagatcgcaccgctgcactccagcctgggctgcaggcgagactccatctcaaaaaaaaattaaagaaaaaataaataaaaagaaaagaaaaaagaatgaatcactctatcgcaacttttggttgtttttcagaggtgatagggaacaacgcatttttcttaacacagagctgacttaaatcttaacattcacaaatgacatccaaagatattttctctttctgtaaaaagaaaacacagaaaactcgtcaagctaacatacatactaaaatgtatcccacgtaagcaggccagcactgataacagaatgagcctaaataaatgtataatctacaacatgatttcaggataattttattgaatttctcagcctgtctctcactttgtggtgacttctgaagaaatcgaacatgcataatatatgacctgacaaatgaacaagtaaactactttattcaagccttttcatttgtcaacagcatccaagcaataatggctttctgtccactcttttaataatgtatgtattgattacttccatctaaatcttaaccagaaaatctcgggaagctttgaaggtatccttaatgatctctagggaagggattatagagatttttttaattgaaagatgaaaacctagtgacaaacaatttcattagtaaaaaggcaaacaaaaagtcattacctacactgttgttacaatcaagatctaatctccatttggatttggggtaggaggaagggagttgaataagctgatgttttattgcagttctccttagaaattccccactatgatttgctcctttaaaactctctctaggttaatcacagaagtagacaagtaataaatatcactttagtgactgctcaa

SEQ ID NO: 8001 - DNA, 2029 bp, artificial
  synthetic oligonucleotide
ttttttttatttcctttacttttagcttttacaaaactctggccagtgggcacatcagactagatattatagttgaaatatttacataagagcaacctatagtttagaatatgttagagcagtttttcctacatcttactgcagtattttgggagaggtgctttctaatttgttttaaccctgtgtatttctcaataacattccaaaaactggagaattgccacataataaaagtactacttagtatctgctaattgagaaaaggctattagctgataaaaacttgtatgctttgtaacacaactgctttacttacaaaaaccagtggtatatgggcaacataattttgtattcaagctacagacaatgcttgatgcaaaaatatatttttgcacctctctgtaaaactctatcatctgtagtttgggaatgaatttctatatgtggttacaaatagacagcatctcctgggagcatgatagaaatgcagaattgcaggcctcacccgatactaaatttctgggggcggattggtttaacaagctttgcaggtgattcttatccatgctagattttgaaaacttttaggccaatgctatccaacagaaatataatgagtgctacatgtacaattttaaatgttctagtaggcacatgtaaaaattttgcagaaacactgcccattgttgtagccgaagcaacaggctcacttcattcattttcaagaaaaataaccaagtttgaataatcataataaatgagtgaaattcattatgacattttacccaagcaaatacataaaaatactatcatttcaacatgtaatcaatataaaaataatgagatattttacattctttttttggtactaagtctttgcatcctgatatatatatatatatataacatatacatattacatatatatcatatatataacatacatattacatctatatcatatatataacatatacatattacatgtgtatatattacgcttactacacatctcactttcgactggctacattgaagggctcaatggccatatgtagctatcatattggacagcacagttctagaccatgtgatttgaaatacagtaaatataaatccatatagcagcaaattgtgtttctggggatctattaacagtttcccttcatcctccacgtttccctttatcttcctctttctgcctcatagaaaagttaagtgcttggttctccatgatcctgcagcacttgaacactcctccaacacagagtttttgggatggcattatacttaatttccccagagtctaaacccttcacagtgtcttacagaagtcatatatatatttttttaacttttaaatttgtctgtacctgacaagtacttaacatagaacaggggttatcaaagtgtggtccatgattcagcagcattagcctcacttgaaagtttgttagagatgcagattctcaagctccacaccagacccactgaatcatttgaaacttggtatgtggagcccagttatctgtgttttaataagccttccaggtgaatttgatgcttgttaaaatttgagaaccactaatgtaggaaaacatatttatttggagaatggcctcatatttatcattttctcctgagttctgtggtagaaccacaagctgaatcattttagtcttcttaaagaaagaaaaagtcaagaaggacatgctagaaagacatcggtagatgtcttctccttatccccagttagtgataggccgacattatttgtaagagcagatggctaggctctctgtccagaagtgaccccataatgcaaaatgattagtacaggatcattaaaaaacaaaaaagaaagatatgaggaaaatgttcaaaatctgtcaacacatttaaaggatcaaatcctgtgctcaatgatggtaagaacaaacatacatagatacagataaaagacctgcttagaaaatcctatctcaccaaagtaaagaatataaatggttctgatataagaattgcttgt

SEQ ID NO: 8002 - DNA, 1355 bp, artificial
  synthetic oligonucleotide
ttatttgcaagaccatgtgccagatgagatgctttctgctgcaggttgtagaaaactgatatgggttggatgtttgttcccttcaaatctcatgctgaaatgtaatccccagtgttggatgtggggcccggtgggggagactggatcatggggctggatccctcacgaatggctcagtgccattcttgcagtaataagtgagttctcactcagagtgagttcatgtgggatctgactgtttaaaagagtgtggcacctcccaccccctcactccatctctcaccatgtgacacgctggttctcctttcaccttccaccatgattgtaagcttgctgaagccctcaccagaagcagaggctgtcaccacacttcctgtacagcctgcagaaccatgagccaatgaaatctcttttccttataaattacccagcctcaggtattcctttatagtgatgcaaatggaattaacataaaaacccaacacaaaatgtcttgactagtcaaggcccacagaggcaaagctgctccaggactgggtaatccagaagcacaatgacattattccaggttcctcccatccttccattctgccattcttggtgaactgtccacatactcacaacgtagctactgaaattctgatctattcactcgttcattcaacaaatatttaccacgctaagatctattcttaggtaatttggatacattagctaacaaaacagacaatatccctggcctcatggagctcaccttctcatagtgaaagacaatttaaaaaagtatattaggccgggagtggtggctcatgcctgtaatcccagcacttgggaggccaaggcgggcagatcacgaggtcaggagttcgagaccagcctggccagcatggtgaaaccccgtctctactaaaaataaaaaaaaactagctgggcgtggtggtggatgcctgtagtcccagctactcgggaggctgaggcaggagaattacttgaacccagcaggcggaggttgcagtgagctgagatcatgccactgcactccagcctgggcgacagattgagactccatctcaaaaaaaaaaaaaaagtatattacacatgttaatcctgcagaatgagtgtatgataggaaaaaccagaaaaaacaggacagatgttccttttgctatatatcaccctagaacttactggctaaaaataaccatttatcagtattgctcatggttctgtgagttgactgtgctcaggtgggtgtttcttgcttgggttctttcatgtgtttgcagtcagatagtagccaaagctgaattgatctgaaggctccattggaatggctgttacagttttttcacttg

SEQ ID NO: 8003 - DNA, 778 bp, artificial
  synthetic oligonucleotide
cccagctatttgcctaactaacagctatttacttcttgttccttggtaaagaagctcaattatgttcagatattgggcaacaaaggacacagctctgaggaaaaaattaaaatctggtctaagccaatcacagtaagcttgtttctcatagccagtgattggcttaaagaggttcagtgagatccagttctagttgacacataagaagaaatttgttggggagcttctgggaaacgtttgcttttccaaacacagacacacaggcatgagtacacacacacacacacgcacacaatacagttatccttgaaccttattccttcttgccttggttattgttgtctgcggatatgttgcttggcgcagtgggaagccatcttgggaccatgaggaaaaagacaagagaatcccagagaagctgacctcaagtcttgatatagctaatctgttgaattaaccagctctaggtctgatggtctttggacttcagtttattttgattagtggttctcaaagtgcagttcctgaccacaggagtagcagcataacttggcaacctactagaaatgtagaatctcggactccacgctggacctactgcatcagaaacgctgggagcagcctgccagcctgtagtttaacaagcccccaggggattctgatgcatactaaagtttgggaactgtgctagattatcaaatgtctctattatttctaatgtgtctattattaacgatagggttttcacttcttgcctgattccactggagttcgtgtt

SEQ ID NO: 8004 - DNA, 2234 bp, artificial
  synthetic oligonucleotide
atggggcagttttaaaaaccacaaatgtttgtagggatctgttttctctattaagcctctttctcctgcgaaacatatctcctgaagcatggagaaataacttatttttctttaaactttttttttttttaatttgagacagagtcttgctttgttgcccacattagagtgcagtggtgcaatctcagctcactgcaacctctgcctcccaggtttaagtgattctcatgcctcagtgtagctgggattacaggtacgcaccatcatatccagctaatttttgtatttttagtggaaacgaggtttcaccgtgttggccaggctggtctcgaagtcctgacttcaagtgatccgcctgcctcggcctcccaaagtgctgggattacaggcgtgagccactgcacccggcctctttgaacttttttttgttttgttttgttttgttttgtttttactggtttatcttactacttttattatacaatgcttttacaaaaaattttattattattatacttaaagttttagggtacatgtgcacaacgtgcaggtttgttacatatgtatacatgtgccatgctggtgtgctgcacccattaactcatcatttagcgttacgtatatctcctaatgctatccctccccactcccccaaccccaaaacattccccggtgtgtgatgttccccttcctttgtccatgtgttctcattgttcaattcccacctatgagtgagaacatggggtgtttggtttttggtccttgtgatagtttgctgagaatgatggtttccagcttcatccatgtccctacaaaggacatgaattcatcattttttatggctgcatagtattctctggtgtatatgtgctctttgaacatttgatcttggtatcttaatgttatcctttcccatccaaggaaaggtatctagcccattttctttgcgtttactccctccagatgttctaatgtctgctccaaaatgctgggtgaccccatcctagagctgctcacatggtatacaggatcatagcacttttgcttaagtgaattgacttatttcttgtaagtcatgcccagcagcattaatacttcctcctcaacacaaccacaagagctctggagggaacccctcctttactacaatgggggttttctctgctttccagtggggaaatgggggcttctcccatgatttactagcctctcaagactattgtggcaatttggtaagataatactttgaaaatgctcagtcaactctaaagtgcaatgcagatataaagtataagtaatagctactgaaatattttaaatatccttgggccctaatacaatcatgataaaatcagcagtcttctacataggaacaaataaaacagattctccccattaagtaaacaaaacttagggtaggcttgaaaaaggacaagttgtgaaattaaatttccagatttttaattcaatttaggtgttttctggtgccagatggtttgaagttcttaaaccatttttattttattttattcatttatttttttgagatagatagagtcttgctctatcgcccaggctggagggcagtgacacgatctctgctcactgcaacctctgccttccgggttccagagattgtcctgcctcagcctcccgagtagctgggattacaggcgcccgccaccatgcctgactaatttttgtattttttagtagagacagggttttgccatgttggccaggctggtcttgaacgtctgacctcgggtgatctgcccacctcagcctcccaaagtgccaggattatagacgtgagtcaccgtgtccggcccttaaaccatttttaaagcggcatgcatctttaacctttaatgtaaagaacatgatcatagaaaagtatttaaattttgaccttattcatgcaatgcaatgctttaaactgtagatgtcaactttgcactctatgaccacaaaatatgcacatatcacccttttattatagaactcggtaccactaggtatgatataaatggttactgagaaacagagtttgctgcatcgtgcttctagtgagaaatagttgcacagtatttaaggagttgttcattatgtaatgggaactttgtgcttagaacagctccacagggagaagcaatagagctagatgtaaaaatgttctccatttcacaatgtagaagtttaatttttgcagtatacttttccttatactatca

SEQ ID NO: 8005 - DNA, 532 bp, artificial
  synthetic oligonucleotide
ttttactaggaaattagtttgcctgcccaagaaatgtctgcaaggggttttatgactatttcattttgatcctctacatattgaaacttgagatgctccagctgacttattcattatcttgggggagtgtagattatttgtgcaacaggcatattcttattttaagccattttatccaacgtcatcaaatgatttaacaagagacttttaaacttctcagaatattcttccttataaataacaggaggtgccttagtttaggaatggcagacaaatgtaaagcacttgtaccattattttctcatttaataccaatggtagaaattactaatcagcctatggcactgtattgtagtcttccccaatttgctttatgctcttttacaataaaccactctaggcagctgatatcagtcaataagagcttgcttgtgagatgaacaatatttaccattccagatatagtgcagtaaggaataagataaagatgccgaaactcagattctattataatcacagattatccattgat

SEQ ID NO: 8006 - DNA, 2308 bp, artificial
  synthetic oligonucleotide
cttcaaataattctcatcaagtctgttcttaaaatggcaaacttccaaagtcccttgagaatacacaggtctcaatgagaagaaaaagcggctgataaaacattaggctttccaaaaattgcccatttctcctcaaaattcctacatgaaggttcacaaggtttaacgtacaggttgttggaagcacaaacaaatctacctcaggagagttaattcacctcaggaccaatttctcctctgctggtacatctactattcatttagcagccctgcttggataaagcccagagccatttcaacggcagtaggaagggacgtttagagagttatcatcagtcatttatgcctgcgctgttaacaactgaatcaataacatcagtgctatggagagcaccttcagagcctagttaggatgtctgcagttgtcagattagacaggcaagatgttttggaaacatatttgtttcaggaaatgtttaagtggtaagcatccacagggttctgtggccatcctgttcacaaacatggatatattaatagatttaatttggttgactaatgaagatatttattgttgctttaaaaaaaattcttataatttttgtaggtacacattaagcgtatatatttatagagcatatgagatgttttgatacaggcatgcaatgtgaaatcagcacattatgctttttatattaagagatgatgttcagagaaatgcaaatcaaaaccacaatgaggtaccatctcacaccagttagaatggctatcattcaaaagtcaggaaacaacagatgccagagaggatgtggagaaatagcacttttacactgttggtgggactgtaaactagttcaaccattgtggaagacagtgtggcaattcctcaaggatctagaactagaaataccatttgacccagccatcccattactgggtatatacccaaaggattataaatcatgctgctatgaagacacatgcacacgtatgtttattgcggcactgttcacaatagcaaagatttggaaccaacccaaatgtccatcaatgatagactggattaagaaaatgtggcacatatacaccatggaatactatgcagccataaaaaaggatgaattcatatcctttgtagggacatggatgaagctggaaaccatcattctcagcaaactatcacaaggacagaaaaccaaacattgcatgttctcactcataagtgggaattgaacaatgagaacacatggacacaggaaggagaacatcacacaccagggactgttttggggtgaggggagggaggagggatagcattaggagatatacctaatgtaaatgacgagttaatgggtgcagcacaccaacatggcacatgtatacatatgtaacaaacctgcacgttgtgcacatgtaccctagaacttaaactatagtaataataaaaaaaaaagaagagatgatgttgatgggggttggttttcctatgtctgtgtgaggctgaaaagctggtattttcagttttctgtttttcagaaaatgccttcccctttgggttctgtattatgtaatcatagcacttttaatgccttacctcatttaatttcttcatatgggagggaggtctaactctgctagtctttatgctccctggggacaggggtctaatccatctctgtgtttccagaatttaacacagtgcttggcacataatggatgctcaatattgtttactgaatcactgactgtatgatgaatgaatgaacacatgaagtaaaaacatgatttagagtcctgatctatctaatcacaaaggaactctttggtttcaatctatcaagtagttgtgactgtcataatggctttcagctgtctttagctctgcagtagtttttttaataggcttcattctagacacatatactcaggtgttcctgagctgcttccttaaggcatttcctcggtcagatctacttatggttgacatctcaccacaactaacatgaccaccttgggaatattgctcttttttgcgtaatgtttgggccaacaggttatgaagccaaacacagtgattaggactagtggacttgggggcttcctgggggagcattacaggtgacacaaaatccttggttgacattaagtacatttgtggatttgatgcttacaaatccagctgtgactcccttggcaagttcaagtcttagactctataggaagctaaaaatggtcattgttccatcaaatttggtatgatctgaaatctacagccatgctttctgtcattttttaaaaggcacattga

SEQ ID NO: 8007 - DNA, 958 bp, artificial
  synthetic oligonucleotide
tttcaaacatgattgaagctccctgcctcctctgacaccctggatattacgtctccgtaatctgattttttacaccaatgtttctaatctccacacatctctttagactttagattctctcatgagctgaaatcaccctggcataggctctgaggaactgcatggaagcaaacagcactattttccttccttcctctaacaaaacagatctctttaaaatcaccaccataacctttcgaaaagcacatcaaactgcatcatgatacaaaagaaattatactctgtcggtgccaggttgttgaaaataagggattgagatcaggagtctggggaagttgacagatataatgatgtgcttagatatcctgatggattttgacacagattctctgcttgggggtgagtgtaattactatttgtacagagagcagagtcaaggtcagaaaatacaggagagggacccatcaagctaaagtagaggactttaaagtggttggggagtttttgttattcagaagctcaaactggtcagcaggacaaaagaatatacagagtcagggtatgggcaggggccaatatccaatatccagaaattcctgtctagcaagaatggagaggaaatgtcagagcatgggttggaatttggaatgaagttatatgaggaaacagacaaggtacaaaacgtgaccaagaagttggaggtgccactgcaaaatttggaataaaaggggtagtgccaaggcaggtctgaggactgatcctaagccagtggttgtttcttctgtcctagttttaagcagctttcctagtgagggtggatgagggccaagagcactgggcttctccccagagtcacacaggattctgcaggttttaatgattacagcagagagagcttggtcccctggaaagcccttgcggttctaacccagcaaaatgcattgaatctgacaggcca

SEQ ID NO: 8008 - DNA, 1879 bp, artificial
  synthetic oligonucleotide
aattagtaccataaaaaaatacaaatctttactttcacaaaaacattagggagggtgacatttggtataggtgactacagaatctcagaaatgacatgtcttgtctttaagtcttaggctattgtttttgacaaatttttaaagaagcaatattgattaatagataataaatcattgagtgatatttaattattgataattattaattaaccagtggttgattaatatttaattatgggctgggcacagtgactcatgcctgtaatcccagcactttgggaggccaagttggctggatcacttgaggtcataagttcgaggccagcctggccaacatggtgaaaacccgtctctactagaaatacaaaaattagtcaggtgtggtggcgcatgcctgtagtcccagctcctagggaggctgaggcaggagggaggctgcagtgagcagagatcacgccactgtactccagcctgggtgacagagtgaaactccacctcaaagaaaaaaatattaagtatcaaagaagtacaggcaaggcttaaatttgggataaaatagggtgggtagtaagataaaactaattttcggaattcagttttcagtggacttggaaattattaagaaatatacctttagggggcatgcagtgaaaactgccattcttttcttcctattaggtttttctataatatattgacacagtgtgctgtcaacttagtgagttctattcttggtggggaagaaaggaataattttacgggtgacatgctatacttacttatttggcattttgccaatccaatataagtggtggctccaggcatcctagctctctaactctggattttgatttagttgtgaacagtccatgctaaactaggggttgatcagagcttgcacagagcaatcagaactcagggggtagttcccgtggtgtgcagaattcccgagaggtaaaaatcgatgttaatctcatcagaaaagtggctcaggtagcctggtctcaaaccaactctggccttccaatatcaattaagtgcctagtgtatatccagaacaatctcattttttcactctctccctagacttgcccatttttgcttggcccaaatacgtggataaccaagtggggttcccctacaatgcaggatttactttattttatatacacaaaagcatgagggacatatcaaacctaccttcccaaccttatgaccctgcactcccaaactctacctgctaagcccaccaaaactacctgcctgtcctgcactattccatccaatataactcttgtgcgtggcttcttcatgctgctccttctctcggcaatgctcttaccccacttctctcccagatcaatgctgttagtgtttatatgtttacttcctcatctcccaggttagaattaatggcttcctcagcattctaacagtatatggtttatacctgaagcacttctatcatataattcattttagttatatggacatgagtgtgtcttgcaatagattggaaacttcttgatagcagggaccattttttgtttacctttctcttcgaatgtctccaaccctttctgcaggaggcacatagtatatggtagcaaatatttgtttaatgactagttgaccaaacaaatggatgagtaaatgagtaaatgtggtacgtgtgtgtgtgtgtgtgtgtgtgtgtgtgtgtgtgtgtgtgagagagagagagagagagagagagagaagagaagagaagcgatgcggaacaaacaagtatgcctactgacactgagtgcactgactgcaggtctgtaatggttaattctatgtgtcaagttgactggactatggggtgcccaggtaaaccactatttctgggtgtgtc

SEQ ID NO: 8009 - DNA, 1246 bp, artificial
  synthetic oligonucleotide
acaggcatgcattaagttatactatcaagctgatagtaataatgatactaatgctaaagctaatagcaaacacttgaatagcacttactatgttccaggcactactctaagggttttacaaatattaactgtttgatcttcactgtaaccctatgaaataatacagccatatttcaccgaattcaatatcccattggtcgtatggtgcattctgatttcagaactgttgaaacgtgggtggaaaagtgtgtcttacaattgaccaaatatgttactattatccctattttaaagatgaagaataaagagaaagaaaaaagcataaagtgtctgagtcaatatttgaacccagtcagtttcattttacagcttttactcttaaccgctatcgataccattttgataaggcagtttttagcccagaggtgttgagagaaaaatttaggttatgtaaatcaacttaggatggccaaacgaagaggaatatacgagagaataatcgttggcaatagcagatagactagacagttattggcctgggcatttcttcttaacgggtaaggcagtgtgatgtgtggcttggatgtccagaaactgggttccagtcccagtattataactatctttgtgaccttggttatgtcatttgatcgttctgcacctatttcattatctgtaaaataaggaaagggctcgaatgattcaatgtttctcaaactatttcgactgcaacccacagaagaaaaacgttttacactgtgatctggcgtgcgcgcgtgcgtgcgcgcgcgcacacacacacacacacacacacacacacgcatgtacacacatatctaacaaattaaccaccgccaaaacaacacttaaccttgcttaggtaatgcactctgatattttctaatctgttccattccattccattccataccagtcaaaaattgttggttgtaagtcattaaactgattttaggatttgctaatgagccacacctcagagtttggaaactactggtatagatactttctaagcttatctccagttaggaaactccacagcacaagagggctcctgggtgggagtggggctgggaacttcagtaaagagagggacttgacccttttgcctcataaatactcattttctttttaattggatcacgtttctacaacctttagcagaaattttttgtcattaaagcatctggcaaataccacattaaggcaaagattcactgtgatccat

SEQ ID NO: 8010 - DNA, 822 bp, artificial
  synthetic oligonucleotide
agagggagctggatatagcagaaaatgtccagagtacagattcagaagaactggatttgagtcctgactcccctatcacttcatgatcttaagctagtctttttcctgcctaagccttattttccttatattccaatgggaataatgatatctccctcaccaaaatgttgtcaggataaaatgaggaaatcaatatgaaattgctttgtaaaatgttaatcaccacacaaataatgtttgtaatcacatagctatgatgtgttgtctgaatgatggttaattgtggaaccaattctttctctctcacctgggcagcatttatctgcagccttgaatccactcctaactactgttaatgtgccacatgtagtataaagtatggcagagagaaatgcctttgaatagtatctaactgcctgggcttatggtacttctttctacatctctgtcttcctagaccaatgacatctatacaacagatctttcattcttagctagaccatttatccaccattcatcagcatgaatgataaacagattagtctatattttatgcagtgaaaatcagaggcccatagactgattagcatttggcaatcatgaataaagctggtatcaacatttgtgtacaggtatttgcatcagcataagtttggttcttttcactgaaatgcaagtgaaaggacaagaccataagtactagaatcatagcagatgctatgagaatggctggactctttaaggaaggaagatcgtacaaagagaactgcatgtatacaccacattttcatacaatggaataccattcagcattaaaaaaaa

SEQ ID NO: 8011 - DNA, 444 bp, artificial
  synthetic oligonucleotide
gtagtaatgaatgggcaaaactggccaaatgaggtcttcaggcagagggctgagttgagcttaagagatgactgaagaagaaacagccatgtgcaaaggcagggccaacgacagagactctattttgtgttgatctagatctattaattgacattctttagatgtcattatttaatcagcttcaaattcagcctattagccagccccactgttctttatcttgtacccaatattctcaaaagagaacttgaaaaatgtggtgtaaaatcctaagttatgctgtctctaacagtcttctcatctaaccatcaagcagccataaaaaaaatgaaaatgaggtgcatgtgacatggcagattttgagagtatcacgctgattcccagcagcatgttatcctatgtaatcattaataatcagtacgatgtcattttccaggattttgt

SEQ ID NO: 8012 - DNA, 1278 bp, artificial
  synthetic oligonucleotide
tggcctggcagctgctgagttccttgacctgcagccacaagtcttgttggccagtcctttcctacagcaatagcattccaccagttacgcaaaccattcctccctttatccctttgggcaaaagtttaccattccttgtttttttttttttctcctagcctgcctagagccttgtaaatagccttttcattatactctcttcaagtgttccgtttgaatgtaccatctgtttctcccaggaccctgaccaaactgagacccatccagccaaagccaccctctggggcaatagacttgatgctgagtggggactactgatagaggagaaagtcagatccccccactctggggctaaaaagcagatgagactcagtcattggataaatattcagagaagcctcctctgtaggcccacaaagagcttctggccttttgagggtaaaggcatatcaacaattatgatggtgacaacagcagatgtgagggtaaaaaggatgcaaccagcttgttctttacaagagcttcaacggtctgcttgatcttttggagagaatgtcaagataagggttagagaaatgggcaaactggaaagggcttagtgtgacaatctggagtttgacttgtatcctgaaaggtatgagggagctttttaaggaagaaagaattaaagcatgagtgtggctctgtccggtttgtcttttagaaaaatcactcaggcaatggtatgggggcttgatcagaagacaagagtctgaaattcagacatcaggtacaaggagattgcagtatgaggaggatctgaattacagcagtggcagaggaggtggagaaatgatacaataaggttccaactacaggagtcttgactgactggatgtatgaatggaagagagggaagaagtaaagcaatagtcctcaagcttggccgccctttggaatcactcagggattgttaataaatttagatgtttgggtctcaccaccctgagattctaatttaattggtcttggacattaggatttctaagactctccaagtgattctaatatgcagtgaaggttaaggaccattgtccttgagtgacaacaaagattggatgagtagcattctccgagctaggaatttcaggaggagggggcagaagagggttaggaaagagatgatgaatccagtcttgaacataatgaattggaggtggtgatgtaaaagtgcaggtatccaagagacagttggacatctgagtcttgagctcagagggaagatgtctgaattggagc

SEQ ID NO: 8013 - DNA, 1252 bp, artificial
  synthetic oligonucleotide
agagacctttcatataaccgtgttgcttcatttgctccactcgcttctccaacagcaaatgtatcctccaaagaggggcttgagtaaaaggcaataaaaaagctaggcaaaaaaagaaaggttgattgggggtgtggggggggggggggtgggtgacaaggagagatgacagggataaagcagaagaccaagaagagtttattgcccaaggaaaaatgtagatttcacttaaagacgccacttaaaagttcaccacttaaatcggatggatttttttcatgatgtaaaaacagtttataattaatattatgcctccctcgagcaactaaaccccttcaatttaaagcttcaaacttaacttcaaatttgactaatataagcaaagtgttctgccctttttattgccgtgctgggattgggagtgacaaactttgcttgaagatgagcacagacacctggagaaatgcgagagaacaccctagaaatgactccacacccaatcccgaagggcaaaaaaaaaaaaaaaaaaaaaaaagcccaaacaaacaaaaatccccaccccctgaaatctttgacttctgggctttagttgtttgttctttctttcctgatttctgcaggtcttggggcatggaatgagcacggtagaaaatgcagcgagggaaatgtcagttggaatcctcggaagaaatcaggcagaaagttgaccttttggcacttgcagtgcaatggaaggtagcgccgcgtgcgccccttccttctacgagtaagagcgacgatttaggaacagccagccttgctcacgtccacactggcagcctggaaaggagtgaaaagctcccccggccccaatccccgcgtgaggaacgcgttatcccctctggggacggggagaaatcagctttttctctccgagcccgtcccaaagccgagggaagaggttcccccactagcccggcgcctggggagaaaccccgggggcgcacctgcagccgcgccgcgggaacccgcgggagaggttcctagacgcccagccgcccggcgccccgggtccagccgccgcgcctgtccaagttttgaccgcctcagcttgccccctgctcgcgccacaagtgcacggattgcggccatcagacggggccggggccgcgatccacttaccctttgagctgttccctcatggctgcaagggctccgcggtcgagtgtgggtacgagtggaggagtgagcttcccagagccgccgggctccc

SEQ ID NO: 8014 - DNA, 931 bp, artificial
  synthetic oligonucleotide
ccagaaaatgtaactgaagtaagaggctacaaaagccttaactgacagttagaagcaagaaccttgaaaagaacatgggaactgtacacacaaatgttttgagaagataaaacagtctgctagccattctacctggagagataagttaaaggtaactaaatatttacatatcagttattataaaaattaaaacttacagaaacccatcataaagttgagtttctgtataaaattgcttgctaagaagggcaaagttgttcctgtaattcggaaagtttacaaggatacttgccttgtcaccttgacaccatacatatttggtaaagaaaattttatccattaagatatttgtggtagaaaactattgatttaaattcatagctatatttttcataggataaatgttacttatcaactttctgataactgactgtctgtttttgaccacactgactttattctgtaacatcacttatacataagtagcttgttggacagaaggtattataacactttacttggctttcttctcagaagcttgttagtaataagcctccagattcttaaagatttccttccataaattcaacacgaatttgacttttctttgtcacaattttcaaaaattgggaaatatttttttacaaaagtggtaccccaataaactgcaactagcgaaaaataacatctctgaggaactaagaataagagaagacttatgattacagtaggatacaacactttaaacattctattatctcaaacaactatataaaaatgcataggaaagaagaccggaagcaatcttttaaaatgtaaatagtggctatttctgggtactgagatgtgaggtgattttcattttgtttttgcacttcaccttctaaaatttctagaatgaacatccatgttttaatgttcaataaaagta

SEQ ID NO: 8015 - DNA, 1568 bp, artificial
  synthetic oligonucleotide
acacaacaacattgcttttatactaccttatacacctaagctctggttggaattctcagtcctttgaggcaaggaatcaatgctaattaagtaaatctctcatgcatctagggggaaggggcaattcaattataaatgtagttcacataaatagaggtaaatcccgctcagtaaacacctttcccagtaataaagaaatgcaaacttaaggctttagtatattttacaagttattcatggccagttctaattaaatattaagaaaaaaacaaaaatagtggttaatacctatgtaggtttgtgcaaaaatacttttccacctatattgcgcacacatttttctcttttaaaaaaaggaaaacagaaaatcctggagtttccccagaagcatgaaacagacatggtggtggaagcaggagtctgcactcctcccttggaagggaaggcccctctgtttttgctctgaaatactctaaagatagagaaatgacccttttcatggaagctgagactttctttaaagtgggaggaaggaagataacttgggagacttatctgaagaatcaagtgagaaaaataataaagaattttaaaaagcaatgcaaggaggcaggaggacgggaggacgtgaggagggaatggctgaaagaagactgcgtgggaggctggagcgaggtccagagacaaaagactcaaacttttcttctctctctcttctgtgtgcttgttttcctcagagggcacatactcaagtgcacgtagtaggaacacttagaaacacggtatgccagctccattactggaagagaggaatggatttcttccaaacaccaatattcccaacatgtttccttatatactgaaggaagctatgggtggtttgaagtttttcaattattttcttttttgttactctgctttagtcatcataaatattttgcctctgatccaggcatttaagaagtaactagtgaaaatttttcgaatcacttttgtattaagagtcttatttagccgtgtgatggaaatgaacagagaaaaactgcatgcatttcattttatggggcctgctcttatctctgtacaggtgaatgggtaacacatagaacagcaaatgttgagtagaaatagctccagaggggagcaaagcaattgctctgaaattacaggagcagaagatgacacagttaggagagaaatactgtgcagtgtgctctgctaaaactggatgtggttaaacacaagaacaatccatcacagaagactgaagagcacatttccctaaacaaacatgtcaaacagaattcaactttcatggagctattttgaaaaaatttccatttaggtatacacaatccatgctatggacccgaaaaggaggtgagaatatcaatagggacaatttaattgccatgcatatgcttttcaaaatgagcatcttagagaacacacctagactttttgatgaaacattaaatgtaatgattagctctttctaggaccctcaataagcaaccagcagatacagttgtgtgaaaccattgtttccttaagctaggaatttccat

SEQ ID NO: 8016 - DNA, 2203 bp, artificial
  synthetic oligonucleotide
gacttcatctggacttagaaggtatgtacagaatgatctggcttaaaatataggtatacacaaaattcacacttggggcccttgaaaggaactgcacaggcagatagcttttctctaggtcggtggttctcaaccggaaatgatgccgtaccccagaggaaatataacaatgtttggagtgtcgaccaaaaaacatcagagaaaaacatcgccaaatatgttaaatttattttggaattagaaatgaggattacaacccaagatgcatctgaagaggagactgtagagggaaacttttattggtaaaaacagaagtttacataagctgcttggaaacatagttcgtttcagatgctcaacgccagaactggtgtcagtttattagtggggatgccattactgggcagatgttcttttgagagcatattacgtgcactgctgcagtcctaacagaggaatttcttgtggggcgattttagaaagtccttgagacagtctttatctcaggcatgtaaccatgaaccctcctcctttcatgctgccctggctctagttagtttgggactgacaaaaagtgatttcatcctggtatcttttacgggagacatttttggttgtcacaactgggcgggggggggggggggggggggagggggagggcggggagggggtgctactagcatttagtagatagaggccaggattctgcaaaacatccagcagcacacagggcagcttcccacaacaaagaactagaatgattcgggccaaagcatcagtagcaccaaggttgagaaaccctgccccaatgttaacatcttacataaccatatggttcacttgtcaaaactaagaaatccacattgattcatcactattcactaaacaacagacttccctgagagtcctgcaagggcatttaataagccggcaactatcctctacaacacagaaactgggaggctaccataggcctattcaactgccgaaatgccacactcgttcataaactgagggtagagagagcaaaagggaaattaaaagccccaaactagaagtcacaaggaaacacgctaaaattgtagactcagatttgaaatcaagttgcttctcaaactgacaactctatgcagtgtattccaggataaacagttgcagaaatttatttatttaatcatggcagataattatcccaagcaaggtaaagcaggtctgctagtacaatgtgtatgtgtgtgtgtgtgtgtgtgtgttttgattttacttagtacaggtcataaccatttagagaaaaaataagaactaaatatgcaaatattaaatacatacatatccataaatagaattcctaaacatttttattgacagaaaaaggtaaatttatggaaaacattgtgggcaaaccacagatttttaaaaagggtaatctctcctttgtggctgatatggtttggctgtgtccccacccaaatctcatcttgaattataactcccacaattcccacatgtcgtgggaggagcctggtgggaggtgattgacttatgggggttggtctttcctgcgccgttctcgtgatagtgaatgagtctcacactatctgatggttttaaaaacgggagtttctctgcacaagctctttttttgcctgctgccatccaggtaagttgtgacttgctcctccttgccttctgccatgattgtgaggcctccccagccacgtggaactgttaagtccaatgaccctctctcttttgtaaattgccccatctcaggtatgtctttatcagcagcgtgaaaacggactaatacagtggccattttcatttgctattttcattagtaacatgttcccttcataaatccaaaaaatcatttcaatgtcattgccattgttaataggtattggcattaatagctgacaactcaacttttctagccctcgttataaaaagccttagcatttggaaagatttgctgaatttaaatttataaaaactgttttttgaattacagtctgtacacaaagatttaaaactacaaggagaacggttagtcagggtcagacagtataggacaggcagtccctgactgttccctgatctgttattacaatttctttaacaacctctaaatctaccaagggcatcagtggaatattttacataagagagaagtctgcaccagcagagaacataaaaggag

SEQ ID NO: 8017 - DNA, 1162 bp, artificial
  synthetic oligonucleotide
attcaccttgatttctttctttttccaccttgatttcttgtgtgcttaatatgttttttgttttttttttttaccacgtactaaactgaccttaccaatattttctagagataaataaaagcttgagcctagaataaaagtgctttctccagagatgattctcctttgcttttgccaagaaccaagaagcattacttattccacagccaatttcagttgaatatatgacatgggaatacttagtatcacacaagtcatgggtatttgagctgcaaagccaagttgcttctcttgtaatgtggtttcctaataaaggacatatccacatttcagatagaaaggcaggagggtttagactgacaggtcatttggcttataacactgatcacctcaacagcactccagtcattacccctaattctaaatttagcaacactataataaactgtttaactttggatttcctagctgcaaaatggtatcagttcaaacttccgatcaaatgctactgtttaccaaagacctagaatcaatctaaatgcccaccaatggaagactgaataaagaaaacgtggtacatatacaccctggaatactccggagccagaaaaaagaatgagatcatgttctttgcaggaacatggatggagctggaggccattatccttagcaaactaatgcaggaacagaaaaccaagtattgcatgttttcacttataagtgggagttaaatgatgagaacacatgggcagatagaggggaaaaacacacactgtggcttatcagaggatggagggtgggaggagggagaagatcaggaaaataactaatgggtattaggcttaatacttgggtgacaaaataatctgtacaacaaacccccatgacacaagtttacctcataagaaacctagacaggtacccctgaacttacaagttaaattttaaaaagctgttgctgagcacttttctctgtgtagagttccatcacagaggtactttgtggaaaaaaaagtttataaagaattatgcaatctaaaaatgaaaaagatcatgcaagtccattcatccttttggcatggcaccacagagctgtaagactttcaggattcactgagtccaaactcagcattcatcgagtccaaactcttacccatgccag

SEQ ID NO: 8018 - DNA, 811 bp, artificial
  synthetic oligonucleotide
gaggaaaaacttaaggaagaatctgtcatcactttaaaggcacaggttttgacctgtgtttaagcaaaatgccagaatggggcatcggtgctacctgttgtataacatggagcagaaggtcctatcatatgttaaaaaggccaggcttagacaagccattcagccaaacaagacagcaaaagacaagctaaaggattagaggaaggccgggcgtggtggctcacgcctgtaatcccagcactttgagaggccgaggtgggcggatcccctgaggtcaggagttcgagaccagcctggccaatatggtgaaaccccatctctactaaaaataagaaaattagctgggcgtggtggcagatgcctgtaatcccagctactcaggaggctgaggcaggagaatcgcttgaacctgggaggtggaggttgcagtgagctgagatcgtgccattgcactccagcctgggtgacagagtgacaccctgtctcacaaaaaaaaaaaaaaaaaaaaaaaaaaaaaaaaaaaaaggatcagaggaaggaaaggttggtaatgaagccattttacattcttgttttagcttttaccttgcccacattactattatataggaccagacttgaaggggaatctgtccttctataaaagcttccagaggaagatgaatccactgcattcagaatttagccagggtggttgttattgaattctttcttgtatagcatcccaaattcttcaagctatgctttaaactccttttctttgattctctcttcagaagaagtggggaacaactggtcatcaccttcaatg

SEQ ID NO: 8019 - DNA, 1766 bp, artificial
  synthetic oligonucleotide
actgagggggttgctatgctgcaaaagataactgaagtacagggttagatagttttatcagtacaatgggtccacaaaggaagcaaaaggatgaagaaagctcaggagtgccctcataggggtgacatttgagcttatgagtggaaatttcccaggcagaacttgaaagaaaggagtttccagttcgtgattccatgcaaggaaaggcatagaggtataaaactattatgcatgtacagagtatgacaagcagtttgtgatggatgacatgtgaataaagggggagctacaggtatcttgagagaaatcagaaaacctagaagcctggtcttgggatttattctttatccagtggggtgcttgggtctttttaaagcagaggagtgtcaaaatcagatgttttctctcagacagattactttggaatgaatgactgggtagactggaggggtgtgagactgcagagaaaaagaacagccaggagacttttgtaatgatcgagtctaggaagatgaggtatgtggagtaggcagtgagtgacatgggaaatggagaggagagatgggatgcaaatggcattgaggtggacagctaaaagaatttgaatatgggtgtgggtaatgaaagaaagaggaatctaggactcccagatttcaggctttggttcaccatccttggagactggcaatgcaggaggccaagcagtccagaggaagaagataatgacttgggattcaatcaagcccttgagttctgagtcatccaagagaagatgttctgtaaaaaagtgacttgtgattcagagttcaggagaaagggctcaattaaaataataactttaagaagggtgtccagaacctgtggaaaaatgaagcccctttgtaggcatttattctgttaaagagtagtattttagagaaaaacatatctgaaagatatcgtgtttgtaggcaggaccctggagagatgatgtaaccagtaagaggtggtgttaggacttatttttccattagtagtaataggttatagagagctagagacatgcttgtccatgcttctttatggctaatatgacagaatttgtcttgtgatcacaatttgggtgtagttggtggctaaaaaagattttctctgcatgaagctaactgacccacctgggcttaagctcagtcttagctttattaggtccactctccaagcacctgagcaatctcctggcctaaggctgcataatatgccagtcattttcaatgagatgaggtatctgaagattaggagcaatgggaaattactttgatttttctgaaagctcatcatgattaggtgattcctaagaatccaactttgtaccacatgttacttaattacgtgattattttgaagacaaatggaatactttgaggcaggtttcggaagcgctgtaataaagactattacaggctttctgtgttatgttgacagagagttgtttatattcgtcactatgtacatgaagagcttgatttgaccttatcaggtaatttgttggagatctgcgtgcatgctgtaaacggaattttactacttttaatggaccctgagcagagctgagtgggcatttgattggaatctcgaccagcctgtttattatcttgctttctatttatgtacagtcactttcttctggaacaatacccaatcatgtcattaacttgctcattttttagtcttctggctctgcctgtcacatacaggaatatttgcgcttaatttgattatttaatagg

SEQ ID NO: 8020 - DNA, 1056 bp, artificial
  synthetic oligonucleotide
ccacgttttacactttaccgtgcccatgcacccacagccaccagggcccaagagtgaccaccccaccccatcccaccccacataccctggtagtttacaaagggaagactaatgtgttttccaggggcccataaaataccattccactccacccctgcaaatcctgagctgcatgcagatggggcaggggtgggtggagagactgctggatacctactttaaacctgcatggggatttgccctgattcctaaaaggtgagagttgcaggtgtatcaaatggacacctttattgctttgagaaccagataacttttttgctaacaatggtaaaactgaaagataaaactgaagagaacgttctgaaagggcaacatgcacgccccgcctagtggcctgacccagggaagggaccccgtggctgtggggcccatctgggctcaagtctctttgacgcggccgcccagggtgagcttgtcgaacaggtactcagccaggccggcttccggggaacaaatcttgcgcaggttgctcacgtagccacccagctctttgatggtcttgacttgctcgtgcaggtagtggctctccaggaagtggcacagctgggggtcgcccttctccacggccagctggtacagatccagcaggctctggttgacgttcttctccaggtggaaggcggactccatggccacgagcccgctctcccagccttggcactctggcttcctgatatcgtgaaggcagatgtggccaccgcgcaggttctgcagcctcatcagcttctgggcatgctccattttgtcgtccgacaggcgcaggaagtagcggaagaagttctccagggccacgtcgtcccggttgaagtagaaggccatagacaggtacaggtaggaggtgtagagctccagcgtgatgtggctgttgatggcggcgtcgcagttggtgtcgtacttctggcgcacctgcgacggctgggcggtggccatggcgggcagcgcaagtgcaggcgagcacacgggcgaagtcggtgcggtagcgagggcagcagctga

SEQ ID NO: 8021 - DNA, 384 bp, artificial
  synthetic oligonucleotide
agaataccatagtatgtgagaggtggcatgcagtggaggcctctgttgtccaggttatgcttttctattacagctgcagctgtgggagacagtactgactaaagtcagtagtcaggaccttctccaattccaggaacacaaaaaacccatgctaaagcacagcccacagttcagtgttcctgggggccactctcaagccttggggaaaaagagacaatggataaatactccagcctgtccaacagacaattctgaaaagtcttttgtggactttcagtggtctttgtggaattgagtccctgtaagtagaataaagcaccctcacactagctagttctcattacccatctcactttttcttctccttcactcctacatcctggt

SEQ ID NO: 8022 - DNA, 332 bp, artificial
  synthetic oligonucleotide
tggtagggatgatggctgcctgagagactgtgataactggggcagctgccctggattgagacatggaagccgtatcttgagaatttcctatccttggactattatgtgagagagaatacacttacatcttgtttaagccactgttttttaaaaagtgggcgagaagggaaattctagacaaacaggcaggcatgagcaaaggcagaaaactggaaaatgtgctaagcagagcagaaattgcaaggatcccatgaaaattgaatgggcagtagggctagagtgtggaaagaagaaggttgtagagagattgttggaaaggtagactggggtaa

SEQ ID NO: 8023 - DNA, 1516 bp, artificial
  synthetic oligonucleotide
ttttccccagttttaaaattgtgctttgattttctttacagagttttaaaaagaaatgtattgatgtttttgcacttaaacttttttgtaagtttatcatgacttttctcctacgcttttttggtaagaaatgtttactgtaccccctaagttatgtaaatattcatccaaattttcttaattttctatattttaacatttaattacaaattaatatctggaatttatttttgtgtatgggttgatacaaggctctttaatctgtcccaaatacttgtctaatagttccaggaacaggaccatctattaagtaatctccacacatataaaacaccaaatgtatcatatactaattatttataggtactgtttgaggttgaacaatttgggattgcagttttagggtcaaaaatagtagaatattggcaattccatatgattcatcctaatactaacttgtggcaagagttaaattcccttttattaaagaataatgtagaatactttcataattgaaaaaataagctcagtttaaaaagaattcagatgtggccgggcgtggtggctcaagcctgtaatcccagcactttgggaggccaaggcgggtggatcacgaggtcaggagattgagaccatcctggctaacacggtgaaaccccgtctctactaaaaaaatacaaaaaaattagccgggtgtggtggcgggcgcctgtcgtcccagctacttgggaggctgaggcaggagaatggcgtgaacctgggaggcggagcttgcagtgagcccagattgtgccactgcactccagcctgggcgacagagcgtgactccgtcacaaataaataaataaataaataaataaataaataaataaatgaataattcagatgtgtataaccaagaaattttagctagcaagaataaatgagttgtagatatgagatcaagtcagtgcgtggagttgactcaagcatttttctgcttaaaagtaaatgctgcacactgcatttttaaaatataatattcttttctcccctgtggacttttgggtccacttcacaacagctgaactggctcactgagcaaagctcttgctataaggtctttccagatctgtcttttccctgctggtctcattattaaaaatgtgctactgtcggatataaatgatgtttctcactaagtacgctcaatagcattttcctttcactctgtttttcctctgaatctaacaataagccattttcccttcgtgaaaaaagatcccaagcctctctgactgtttcctggcttgcgacttggcatgactggcagtctgagtgattgatccataacctttgggcactcaggcaattattaagttgcccataagctttgctgtgccagcagagcaaataaaaatactcgaggatctaactctgggtcagcaaatctctcttttcatgtttttatatgaaataaggatttttcctataagatagaattctttagagaacaataaatatatttatatttttc

SEQ ID NO: 8024 - DNA, 440 bp, artificial
  synthetic oligonucleotide
agagtacaaaatatctataatataacgtatagcactgacctcaagggtataaatagtattctcccaacatttgtcacatttcctaacactcatcaatatacaaattataattgtatattgtttgttgagaaaatttacatttaagcaaatacagctctcttagtacaactgcttatggagaaccagccttggctgccctctgtcaattgtgatgtttaggttttcaaagatccacaaataaagatgattaaaactggtaaagactaaaatatgaaaaaaaaccccacaatcttggacacacttaaaactaaaattgaatacattttttaaaaggccaacttgtcaatatgtatcaaaactttaaaaagcgtatggtttttatccaagcatcttcactttcaggaatttttttggaagaatataatcatataattgaaagg

SEQ ID NO: 8025 - DNA, 1427 bp, artificial
  synthetic oligonucleotide
tatttgaagttatatcttgtcctctctcccagttggatcctaccaccaatgaggagcttggagtcaaggaagcaggtgtaacccttctctttccgtcccttaggcttctacttctcctaccctatcttgctaaccatagctgtatctcctccagggatgaagaggatagaaatggaggtggcaaggtgttgctttactgatcctttcataagatggctttgtcctctctggacatggcaaatgccgaaaattggctctttgttgatttcttctgtgagttcttcttagggtcccactggggagattcaggagtacctctcaggacacaaatgaagctctttcttccatctagcctctctctcctcagccctttgtctctcttacttttcaatgctgctgtaagtcctctattggttgtcaatgccttctatgtgactggcatccgaatgctggctctcatagggtgagtatgattgttcaggacccccttcactgcacatttcttaaatatggactcaatccttttaaacttctcctcagcccctgtctcttgtggaatacctatagtttcttactgccagtatcgcttcaccaactggcaagccctttggcaggcacaagcaaatggctcaagttattttgccttctgagacactcacctgatccatgagaagttcacaagtccttgccatgctgaacaacagacatgctgccttgtcattgctgctccagcaagttttctgccttcagaattctgacaagaggcagtctcagtgtctatactgacatgggcctccaaactccagggatacatagcaggctctctctaaaactttctctccaggttggacctacagatagcttcagttcagtaaccaagcatctggagggtgatatatcttgaagacattcttaatcagctctcataggccacctcactctcatttttctcattggcttcccctttttcaatgggagagaaaatgtacaacaccccctttaaggtaataactaataaacctctcccttgtagtcttctcttatttaggctggaggaagtgtttgagtgaggccatagaaccggttttgtcacctcttggtgagtcctgtagagaagtgcctaggagctctctttggaatgtgatagtacttagtatgcattcttttcacctgtatcatcagacacatcttatgtaccatttcagatatttttagcctcacctgttgtatcaatattccattgtcctgtaacaaaccacttcaaaacatagtctaaaataataatcatgttattttctcattatgctgtgggtcagcaaattggggtgggctcagccaggcagtttttcttctggtctcacatggggtcactcatggtagaaagaatagaggctattcatgggaccaacgacattctgtgtcacccc

SEQ ID NO: 8026 - DNA, 2524 bp, artificial
  synthetic oligonucleotide
tcgccaaagaatattggaggttagtattgttctgtgcaatcggcataacattatctttagcatagggtagctgtgaggatctccagtgcctgaatataatcgacgttagctctgtttgctccaacaaactgtacacaatgtggtatctataactgaggggaagactccatcaaataaacatatggatgaaaattcagggtgactgaatgcagattatgttctttcagatgtgaagatgaaaatcacatatttaatatttaccttcactgaagtctttcccttgattaagccagttgtaagcaagtgggggcgggggctgtccctacggttgtaaagattcatatcacacactgactaaaaagcatgtatatgtatgtgcctgtattcttccggtgttcataaaacacaccatcacaaaacttaccatgggtgatgaggccctttataatttaacactgtgcaaaattaaactctcatctcaaaaaaccctttcttcttccacgtgttcttgtatactactgcaaatcattactaaagcaaagaaaaaagtaaattctcttatcctttcaaaatgaaaaagtgcgcaaagaaagctcagtttgccaaactgttcccttttctcattcattcttgttcttttagaaaccagaagtaaatatactgtatgccaaaatgactgcctgattgacaaacgtcactgaagaaacacatcgaactgacaagcccggtctggaccaaaggtggcaagttttcttaaataatttaaataagttacatttcagtagaaacagaaggatttacactttaacacattaacaaactttggatctttttatgcagcttactttatgcctcacctgtccctcacccttcaaatcctgcttttacgcactttatgagctggcacacggtagtaaactacagaactccaactgggaataactctaatctgttgttggacctcagaggactgcttgtgcgatctttaaaggaaagcagtgttttctccttactcaacacctaccaacagtcatctggaaacctcctctccaacaattcttactatactgctactaaccttcacatctctcaacaccctcaacggcccccacgctggtgctgctagtcctcatcctcaaacaccttcctgggggcttaaagccggtccacagaggctcactctccgcaatgcctagggtccggcgaggaagggcatcgtcccctccgtttgggggaccaaggccaatcaagtcgacaccccaccccagccactccctctcccctcggcctctcggggcgtctggggcgggcgcggacgcgccaggccctgcgcaaacctccggcagccccgcagttcccgctgtcagccgcagtcccgggccggggtgagtccccgggacgccgcagttgcgcacacgcccaccgtctcaggcacagggtcactgggacgatcccgggggcgcccccgacgtccctgctcgggcaggtgccgggcctccccgcggacactcaccaggcggctgctgctctctggccgccgccgccgccgcctcgccctcacgcccgtcgcctactcccgcggggggtccgggccggcgccgcttccccgcccgaacccccagggtacgcgccgtgcagggccgggatccggtgtgagccgccgccgccgccgccgccccctttcctccctcctccctcagtgcgtccctcccaccgaggcccgcctcgtatttcctagatccggtctgagcgagagcttggcaagcaagctctggcttcagggcttccgtcgggcgccgtcgctcgccaggcacaaagatggcgccgccgggtactgcccagggcgatctcgcgaggcttcccccacaggaacaggagggcgggggcccaaaggaaaggtgataagttagggaagcctgagcaaacgcttcccatatcggaaatgggcagtaccagttaccgaagaagttactgcgcctgcgtgcgcgggtaatgacgcatgcccggaacggcccctaaagtaggacctagttctccaggttttacctgtttccactagtggcgcggggcggggtaatgaaacccagtcaagaaacccagtaaagggcttggcaggaccaggcaccaagtgagaggcgtcccttaaggcttggtcatccctcaggagcccgaatggccaacacactttttgcgtccccgggagtcttctaaccctttgcttgtccttatgggttttgtcaccgagtattctgtgcaaagcctcagctgcaccttcttcatcctgttatgggttcacattattaatcaagagcttcttgctgtgtgcttgcagatggcctcacagttggcagccacagtcctcctgtttcccacatcaccatctaactttctctttcatttttagtgctacatgagccatctgatactaataattctttttcctattttattttttcttgctcattcattcaaacgtgtgttgttcagtttcctatgtgccagctactgaggaaatgctgtgatc

SEQ ID NO: 8027 - DNA, 901 bp, artificial
  synthetic oligonucleotide
atttttaaaatcatctatttgaaactcagactttgcctttccaggagacaatgatcaatatgctaggtttccaagcccgctcacaaaagcctaaatgtccaaaaggttacagaagtataacaaaacacagaacctgtgtgggcaatgtttctacaggaaaatcaatttagcattccaacttaggataacagcaactactcctgacccatttagccctggaggtagaaaaaggaaatcttccctcccataactggaagtctgagcttccctaggaccacagacctcggcttccactatgaaggagggcaaaaaggcagagctggggtgggaggagatccagggatgaggaaggcaagaccaactgggaaagaaggatggagcgggggatggcagctgaaaggagtgaggaaacagtgcgaagatggcggcctgctgaagaggatgagtgtacagtgcctgttcctgcagcacgtgggcttttaccaactttcctccttggtgtttaaggagagggaagaagaggagaaaccattggagggtcttgacagtgcctccctcactcttggctattctcatcctccttttcaagaaagaacagggtggggtaagagatcttatccgcatccctcttgacctcctagagcacgggatggtggagaagggacttggaggagttttggtgccttccttgttagcatccaccctatcaaagacttcagtgtcaatggaaaactaagggtgccaggtaaatggtaggaacagcatcagaaggagaggatggaaagtagagaaatttgaagcagggagggaagtaggatgttagagttggacaaatagaactgtccatgaattaaactataataaatgttcttatttaggattaattcagtttgatagttcc

SEQ ID NO: 8028 - DNA, 1208 bp, artificial
  synthetic oligonucleotide
cacattttattacttaaagagattacttagaacagtgtttttcaaatggtgggttttgatttattaatgtattgtataacaaatgtactacgtgatgactataaggggaaaagaaaaagaaataacagaaaatatcgaagtgtttcacacacagtaatggcaaatactcattcaaaaaacttgtttcaggtatgtgcgtatgtactagatcacgattaaaatgtatttcttactgtgggtttgagaaatagtgacttcaaatatggtgatatattttaagttatacaaggaaaaatattactactttccttgttaccttcttctaaatagatggaagcttgctgattaagaagcaaaatggaagtactggagaaaccctctggatatgacagttgaaatgacttaactcttcacgttatgaatttctgtgtgatttctctcaagtgcagcctagatgtgttcatgtagcatcctcacgtacctataggaggctcctgccttctaatatatttaaaagatttttttaaaaaatgaataatcagtctcattaaccctgaaatccaagatcacaactatgggaatttcctagtggaagagtttgaaagattaacagaaatgctatttataatcattaactaaacaatttctaacccattgcccactcatttaataaaatctaagcttggcgatacagaagacccatgtcctcgtagtgagagaaacactggcagttataatagagtggggttgagttctataataagtagtcagaaaaagaaacaatgaaggtagaacaaagagaaggagagctgaggaaagcttcagggaagagatgacatttaagctggattacaaaaaataggttttttgtttaaaataaaaacaatagaattataaagctggaagaaactccacatcatctaacccagtagttcccaaccaggggtgacttttccctgcaagggacatttggcaacgtctgaagatatttttggttgtcatactgaggaaaggtgccactgacatctgacaggcagagtccagagatgctgctaaacatcctacactgcacaggacagcccctgacaacagaaaattatccagcccaagatgccaatagtgccaaatctgcgaaaccctgaactcaacccaaatacaaacatttcacacaagaagataactgaaggctggagggattttaaaacttg

SEQ ID NO: 8029 - DNA, 1147 bp, artificial
  synthetic oligonucleotide
tttaactagtttaattttactactgacattcagtgtagagaaaagtgcccccaaagagaatatgtgggtaaagtatgaagctggtaaatgcaagagcaatacgatatatgataatggttatgatgtccgtaaatgaaagactttgaggccaggaaatacatgttttatgcatgtgactttcatattatcttaaacagtgcacatgaggaggagtggagaattataaaacctgaatgtgttattccaagaaagaaggaattaaaattaggaaccattaggaatggcacatgtgctgagattagcagttggcaacgttttctttaaaaaacatagaggattttagggtaggaatgacaagacactggaacattgaaaaagttcagagataagttcacacataagacttgtgtgccctggggagaaataggtagtaaagacatgtttgtggctggcagagaatcctgggaagctgtttcactggactttgcctgcaagcaaagcaattttacttggcatgaaggaatccaattaagatagaagagaaaaaaggaatgcccagggaggaacccgtgactgaagaatcagattgaaatagctctaaattagattctgaagaaaagttaaaatgacctggtaaagataggtagcatgagaggcatagaatagtgactcaaggattgtgagtaagaaagtagccagcttattgatggtaaaattaacatagtgaggaggaataggagattttagttgactataagttcattgtgatcccatgttgtaaagttgtcacacgcacaaaaaaattacattcacaatatgtacccatagagctgctgcagaattcctttatttgccctccttagctcagtcccattctctgaaactgttactctactctcttctcaataataatgaccatggcagcagcagtaggtaacatttattgagtgcttactgtgtaccaggcatgtgttttaatatacattgactcctcactgtaaccctgtaaagttggaactattattctctccattttacaagacacaaaactgagacccagagtcacactgctaggaagcacaggaattggaatttgaatcccagctatctggcctcagagcctgagctctactgaatggtgccccaa

SEQ ID NO: 8030 - DNA, 1801 bp, artificial
  synthetic oligonucleotide
gataaggtcaggtcagggaggtaagttgggacatccaagactgagtacatttgattcatcctgtaggcactgcaacgttctggcaggtaaggaagctgattcaccacatgatataatatggcaataaagtgcaaaattaatttcagcagagtgagattggtattaaggacccaagttaggaggctgttggattcatcccagcctgagatgactgggacaggaaccaggagggaggtaggagaaaagaaagagaaggaatgcatttgagagaccaagacccccagacatggaagtgaaggagagagaggagccaaaagtaactctgagtgtgggtatgtaggggaaatggcaccatcattgaccaaaatgggaagatcaggaggagctgtggaggaagcaatgggtttagcttagctcttcttgagcctgacaagagatagactgtctgggtgcaagtgtgtaattgtccattggaaattcaggtaggcagctcattagagaagctacttaaagtccacagtgaagtcaccttccacttgcaggcagtaggaatttatattgggggcttgaggagctttctaggtttgtaacttcttctatggggagcctacctggaacagtacaaggaggaaggagcagcagcaagggctttgtaaagactacaagagctttggatgcattgaacaagtcacattttaaaaatctatattcgggccgggcacggtggctcacacctataatcccagcactttgggaggccgaggtggatggatcacaaggtcaggagttcgagaccatcctggccaacatggtgaaaccccgtctctactaaaaatacaaaaattagctgggggtagtggcgtgtgcctataatcccagctgctcgggaggctgaggcaggagaatcacttgaacccaggaggtggagattggagattgcagtgagcccagatagcgccactgcactccagcctggcgacagagcaagactctgtctaaaaagaaaaaaaaaaatctatatttgaaggcaaaatttaatttcatactcattcaggcaatatacatatgtggtgtatatatataaatatatgtatgttacctagaacatctcatctacaaacgtcttccagtgtcttttccttcacacttaacaaatcatggagaattgtatatattttataaaatatatatgtgtgtgtacataaatactctctctctcacacacacacacacacacacacatatatatgaagagaaagagagagagcacgcactagtatttaagagaccagagttctctgatcttgtcactagcagtggttttagtttagttgttgccagatctataaaatagctaacatagtactagctacaacccagataatattctaagtgctttttatgtactaaattaattgatcatcacaaaaaaactctaatatttaggtactattattatgctcattttacagatgacaaaattgagtagtgtccaaaatcaccagcagtcaggaaacagagcccaagttcatgttcttaacctctcagacactcaacttatcatctgtaaattgagaatgtgggattaaattatgtctagagtaccatcaaactttaattttgaatgagattatgaagaataaagtgagcattaatcagaatcaaaattaatttctgaaaattagcagcagagggcagcagagagcacactaaggaggcttttaaaagacctttctaaagctatgcagagtaataatacataaaatttataaacaaaaatacatatattaacacatttaat

SEQ ID NO: 8031 - DNA, 519 bp, artificial
  synthetic oligonucleotide
ctttcattttttataactggtatgtttttcactctacaggtagaataaaaattaaagtttagcccaacctggtaactccattaagtcttaatttaaataatttaaactgagttttatttgaatgggcccagacttcagattttccttgcatctactattgtttctaagaagttcacagggtttactctacctcgtggcattgtgggaagacagcgttgtccataacgtggtattgatccggtcccatccttgggtactctattggcacttgctgctgaagattttggctgatgcaacttgtggactgctcttccagacaacttggctctatcttagttctcaggggtgcctatgaaacccctcaagaagtctcagtatgtgtcagttggctttagtagcgtgataaaatgtttttaaatttagtggtttaaaataactatctagctcatgattctgctgggcacttcattgtctggaccaggctcaaggaatttcagttgggttgttcatgcattcatg

SEQ ID NO: 8032 - DNA, 1710 bp, artificial
  synthetic oligonucleotide
ttgttttctacatgctctctcaggaggacctcagcggaactaaactccagctgcctacaacagtaatttgcaccttttattgtctttcctctattcctaactccttctctacgcttcctggcgtcactaccaaataaactatgtgcattcaaatcattgtctcagggtcagcttttggagaaatccaaaccaaaacaacaacaacaaaaacaaacaaacacccagtgatgtacccaagctgtatatacacacatgtaaatgtgtttcaaagaaaaaaaaaatgagttctaagcatttttactagtttaattagcaacacatcaaaatgaaaagaacaaagacaagtctagcctattttggttttattgcaacagtaaagccttttacagctgctggcagccctgctgctattcctctggggtccttctctttatgaaaatggaagttcaacataggggaattgcctcagtaaggaaagagggcatctctactccagggattttgtatccattctaaaatccctgtaagaaaacttgaactgggtgctgagagctggttgaaccaattaatttactaattggctcaggaataatatattaagattgcatacttgaagacccaagaattagaaatgtatcttagaaaatctattcattcattaggagttgtcttttttttttttctttaacagccaatttaagccaatttagtcaactatttttcttcactttcaagggcatgtgaggggcagagagaccagtgagtatctcaatattttacacaaaacagatcccagcccaggaggtaatataaaaaaagatgggggtgcggctagtaagcactttgaccatcaatcacacgtaaatttcaacctctggccacaactttgcatcaaaagtcaatttattccgacctgatggcaatggaggggcaaaaaaagctgttttattttggcatgtggaaaattacaaaataaatctcaaatgtattcacctgaactcttggtcacaaacaagtcaaacatgctaactacagcatgtgactaatagcactttatataccaagtgatgttggtaaagtcatgtttttattttcctttaaaagaaaacaatttccaagccaattattcatcttctcaagtagtaaatttatgaagtttggcggtcattaaactaaaaaaaaaaaagaagaagaattgatgtgtcccgagtttcagaacaataaatgccttttttaaaactaccatatattctaaaaccaaatccccatcttcaaatctatgagtgcatcctattttattagatttcagaataccagagtatctttctctctgaaagtataatattaatagcgaggcattgtgcctaatattttacatgtatgatttcatttaatgcctatgacactgtggtacagttattgtgattacatacattttacagacaagaatgctgaatatttaggaaagttgcccaaattcaagtctgtctaactgcaaactcaagcccaaccaggtatcactgcattataaacaaacacaaaatctcaatggcatatcactgagaacatttatttcttacatgtctgcacatcagctgaactacctcagttcaattattcttggttgagctcagttgagtggcttcaagctgcaggttgaatccacctctgctccacatgtcactcaaccccgtgggatcagcagactag

SEQ ID NO: 8033 - DNA, 1394 bp, artificial
  synthetic oligonucleotide
cattcagaagaagaaaaagatctcagagggattcaaatatgtttagttgtatcttaagtttaacatttgaagaaaagttggtgacagatgaggttttgagaggtgagcctgagcaacctcaatatggtcctatgagccctgttaaaactctataaacccttggcaaccccaagccactgaagtgcttcaataagggattatgataagatttgtgtcttaaaatgattactctacccacagggttgagaatataatggaagacagaaagaccagagggagggagaccagaccctcaaggtatcaaactgtggtgggctggtagctctaactaaaatggtggcagtggtgatggagaaaaactgatctgattggagcagtgattaatcagtggaatcaataagattggtgattggttgtacctggaaaacaagggcaacataggtttatgcaggggtttctgcaccttggcactattgatattttgggccagattattctttattgtaggggactgtattgtgcgttgtataatgttttgtaacatccctggcctccatccactaagcaacagagaagctctctcctcccagtgactacgaaaaatgtctccaaacattgccaaatgtccccctggaaagcaaaatcgcccttggttgagaaccactggtctagtcaaatgacagtttttcaaccttagttccacattaaaatcacctgggaagctttttcaacacactaatgctttcccctcatcccctacccactagaataaaatctctgagggtaagaccacagctactttctaaaataattctaaagtgcagcttgagagagctgttgatataggtagtttttaaatttaaatttgaaaaacccagattaacatgcctccacaaataccacaccttttattaaattttaaacattttgaagtaaaacttctaaatgtccctctcttcatagtgaacataatgtaaatattcccttgtaattcagaacgacaatgatgaacatttgaaaatatattaatattcaatatatagaaactgttgttaggcattattacaatggcccaagactatgattcattgctggttttccatttttaaaaaaatatttctagctagtccaacaaattatggcatttaagggccatttcttgttgctatcaatgtttctataattattattttcttcccttactttctctcagcaatctttattcactacaactcccactctaatttggggttttaattagctgtagactgacctaaataataaccaacatggctttcaggaagatggtaagaatgtcttctgcaaagtgatataatatttagtacatgggaagcttctcaactcattctgagagtcttttataaggcaagcat

SEQ ID NO: 8034 - DNA, 415 bp, artificial
  synthetic oligonucleotide
acctgattggttgcgccaaggtcacctattcatatcctagctgcaggggctgctgggaaattaagtgtctggtattttcagccagtacctgggaggaggccccacttcctattcataacacagaaacgtctccaagaacaagaagtggatcagaagctggcagttgaaatatttactagacttctacctccaaaaagaacccctcccccaactttttttttttttactattaacataccaacctcacactttcctcctctgaaatcctagagcaacttatttttgaaccacgcctttgatatttgtcttctgcaaccttgaatttccagaatacatgggtttttttctccacctaaagtgtaagcagtgtgcaggcagtggccatatattatgtttctgtgtatctagagtgctt

SEQ ID NO: 8035 - DNA, 813 bp, artificial
  synthetic oligonucleotide
gtaaataacttggtagtattaaaagattaggctgttttagctcatttacatgcttaatatcagaaatacccaattgtttattagcaaaccttaaaccaaagaaaatatcaaagcccaatattttaagtttgattgagcactcttttacagtgaatgagaaaagtttattaaaattctaaaaagaacctgaaaccaatttgtgtttggagggattttgcctccaaaagcactattcacaatagtcaagatgtggaaacacactaaatgtcattaggcagatgaatgaatgaagaaaatgtggtatatacacacaatgggacactattcagcctttaaacagaatgatattccgcaacatgtgacaacatggatgaaccttgaggacattatgttaagtgaaatgaaccactcacagaaagacagatgttgtatgattccacttacatgaagtatctaaagtagtcagattcataacatcagagtggagtggtggttgccaaggggattgaaggaggaggcaacggggagttactaattaacagacataaagcaaagtttcagtcaagcaagatgaataagccctagagacctgctgcacgacattatacctagtcaacaatactgtattgtacttaaaaatttaagcagataaatttcttaccacaatcaaataataaaaaaacatttaaagctgttttgaaagtatatttcagatgtgagctattacccatgaaactatgagccgacggcccattttgatggatagaaacatgtattcaaatcaaatttcattcacagccccttctttccttt

SEQ ID NO: 8036 - DNA, 3289 bp, artificial
  synthetic oligonucleotide
gggaagcataatcttacttccacacagccatgtgctctggtaaactcagggattctattactagaaaagaaagatgaaatagatttttgagtagacaaacatctctggtacagaatacgttctgaaatctaaaaataaataagtaattttatccaatatgtaaaatgatatatgccttttctaagtcttggctatcctcctcttccctgcacttgtcacccaccacccatcctatagcccttattccaaatcttcaagcatttctatgattttgtgatgtgtggcttgatcaaagaaatgtaagttatatgtttactacattttgagacggaattttgctcttgttgcccaggctggagtgcaatgacccgatcttggctcattgcaacctcctcctcccgggttcaagtgattctcctgtctcagcctaccgagtagctgggattacaggtgttcgacaccatgcccagctaatttttttttttaatgcttagtagagacggggtttcaccatgttggccaggttggtctcaaactcctgacctcaggtgatccacccgcctcgacctcctgaagtcctgggattgcaggcatgagacactgtgcccggcctactatgttttgaaataagtgttttcctagagttctcaatctaatcactgacgtataagagtaattctctttggggtctaaaaatttacaatttatcaaagattattccaagaggatctcttttattgattcacataacacaaaatttagcatttaaacatttttatgtatttttcagtggcatagcacattcacagtgctgtgcacccatcatcactaactaattccagaacattatcatttttccaaaaagaaacctcctactacacatcaaggaatcatccacatttccccttccatcaacccctgagaccactaatctgctttctatgtctatggatgtgcctattttgcacatctcatataaatgcaattatacaatgtgtggcctttagggtctagcttatttcaattagcataatgtttacaaggttaatctatgttgtagggtgtatcagcacttcattcctttttatggccaaattaatattctattgtgtgaatataccacatcttgttcatccattaattagttgataggtgcacggattgtttctactttttggctattatgaatagtgctgctataaatatttgtgtacaagtttttgtgaagacatatggcttcatttctcttgactatatacccaggagtagaattactggatcgtatgataattctatgcttaattttttttaggaacttccaaattattttccacaatatgtgaaacattttacattcctatcagcagtttatgagtttcacaatttctctgcatcctcaccaatacttattttctgttttgtttttaattatagcatcctagtgaatgcaaaatggcatttttttctagttttgacttacatctcccaaatgcttaacgatgttgaacatctctcttgtgtttgttgaccatttgcatatcttctgtggaggaatgtctatttgagtcgtttgctcaatttttaattgggttgcttgttttttgttgttatttttgagcagtacaacttctttatgtattttggttcagtctcttattggatatatgagttgtgaatattttctaccactctgtgtgttgtcttttcactttcttgataggttctttgatgcacaaaagtttttttttaatttgataaagtccaatgtatctatttttgttgttgttgttgctcatgcttttgttgtcatatttgagaagccactgcctaatacacagtcacaaagatttacatgttttcttcaaagagttttatagttttcgcttttgatttgattctttttgatgctgttgtaaatgaaactgttttcctaatttcatgtttgtattgttcattgccagtgtatagaaatacagctgtttagactgggtgcggtggctcacacctgtaatcccagcactctgagaggccaagatggaggggtgggtggatcgcttgaggtcaggagttcgaggccagcctggccaacatggtgaaaccctgtcactactaaaaatacaaaagttagctgggcatggtggtgtgcgcttgtaatctgagctacttgggaggctgaggcaggagaatcacttgaacccaggaggcagaacttgccattgcagtgagcccagattgtgccactgcactccagcctgggtgatggagcgagactccatctcaaaaaagaaatacaactgtttattgcatgttgatttcgtaccctgcaactttgttaaacttgtttattagcacaaattgtgtttttatgtgtgactctttaagttttagttttacttctctctttccaatttggagaccttttttttaattgtctaattcccctgtgtaggacttccatacgctattgagtagaagtggttagggcagatatctttgtcttttctttgatcttacagtaaaagcttttaatcttttaccattgagtatgatgctagctgtgagattttcataaatgccctttatcagattaaggtagataacctccattcctagtttgctggttgttttctcatgacaggttactggattttgtcaaatcctgtttctgcatcaattgagttgatcatgtgccttgtttccttcattctattagtatggttgttgcattagcaggttttcatatgctaagccacctttgcattcctgggataaattccacttgggcatggtgtataattcttttaaaatgctactgaattcattttgctagtactttatcaagcatttttgcatctacattcataagggatattggtctgtagtttttttcttgtgatgtcactacctggctttagtatcagggtaatattggcctcatagagtgagattattcctattagccaaaacatgaaaacaacctaaatgcccatcgatagacgaatgaatgaagaaaagattacatatgtttattatatatgtatatattatatatttagtgttatatattacttatccatatatatcaatatatggggaacagagttagttcaggctttttgttggatgatgataaattcagaaaaatcagagagtagcgtgaagtggcaaattcaaagcagcgcccagacaggctgatggagatatcattttaagtcaaagaattccataagtgacatgaaaattcaagtagggatgatttaaagggaaaacaagagatgcctatagtgta

SEQ ID NO: 8037 - DNA, 2758 bp, artificial
  synthetic oligonucleotide
tcctgggccagctcaagcatgagcagggacgcccagcagttgcgcaccagcaccagctgctggtccaggggcagcacctggaagcagggcaagtacttgacgaagcgcagcgtcttcaacaggcccgctgaggctgcctcgcagaccacctgtggactcttgagcgccaccggccgcagcgcaccagaggaggtgtcccaccagggggccctcggccgctcctccggagccgcctgcgcttgatttgtgctcgtgggcacgcagtagagggtgctgccctgctgcgggtggtcttcaccgcaaaagcagcagcggtacagaagcgccgtggcccgcccgcctggtagcgcctctttaccccctggcctctgcgcgaagtaggagcggtcccaccacgcgccccctggccgtgcctcgggcgctgccggagccacgtgcgtttgctttgagctagtgagcaagctgtagaggatgctgccctgccgcgggtggtcttcaccacaaaagcagcagcggtacaggagtgccacgggccgcccacccggaagccccgctctgcccaccccgggatcagagccgcacgaacagccccagcacggacccagcgtcgcctcgggcgccttcggtgccgcgtacgtttgctttgcgctcgtcagcatgctgtagaggatgctgccctgccgtgggtggtctttaccgcaaaagcagcagcggtacaggagcgccacgttccgcccgcccagcagcccctctctgcccaccccgggctcatcgccgcacgaacagccccagcactgatccaccagccgcgtctctggagcctcaggagccgcgcgcgtttgcttcgcgctcataagcatgttgtagaggatgctgccctgccactggtggttctcgcccgccatggcccgcggcgcccgtagcccagttctgcccagtggctgcctcctgggacctatttatacctagcgcgcacgcaggcgcgtcggccgcctcggtctgggcaagggcgcggaggcgggcggtgtgtgcgggggggcgcggtgctgcgctccggtgtgttcgcccatgacctcggtggttcgaaggggcgggtgctctttaaaagctggaaatggaagaacagcagcgtgggagctcctggacactttcctccttcctctcattacccctttccctgtctcaggaagaccggaggagagcgagcgcctggatgctgttgcaactctttccattgaaccctcgcatctaatttgttccctttattgggagggcaggggaaaagaggaaacatctacttctatgctctttgtaaactttcattaaattatcacagtttgtgtgacttatatttgtatatggatagggaggtctcattttctgagaccttgaaaaatacagaacatagacaagcatcatatgggaactcggtggaaatgcccaatctcaggctccaaccagactttctaactctgaatctgcattttaacggtgtccccagggattcacatgcacctagacgtttgaaaagcactgctctaaatatgctatcataagcgctcagtttaatgccatcagtatttataagcgcccactatgtcctggatgctgtgttaagagagctgggggcagcgagcaggatgtaaaagtgcctaaaacttaggaatataataattacgaggggataatattgttacagtgagaattgttttcattttagtatatatttttttttcttttaacttttaggttcaggagtacatgtgcgggtttgttatataagtgaattgcttgtcgtgggggtttggtgtacagattatttcatcacccaggtaatagtatccaataggtattttttctcattctctccctcttcccaccctccaccttcaagtaggttccagtgtctgttgttcccctcctagtgtccaggtgatctctttatttagctcccacttgcaagtgagaacatgtgatatttggttttctgttcctgcattactttgctaagcatgatggccgccagctctcattctttttcatggccgcagtgagaaattttgatccttgtaaaagtattccattggtaagtgtgtaattagtatttcttttcccacccttcctaagtgaataatgataaatagaagcatcaggaagcctggatccattagtcttcacttgccacacagctgtgaagacatggggcagggaagggtgttggtatataccagctgatacagaatcatttttactttttccctccctcccatcctccctctttctttttttgctgtttcttttccttccttccttccttccttccttccttccttccttccttcctttccttccttccttccttccttccttcctttccttccttccttccttccttccttcctccctccctccctccctccctccctctctcactccttctctctctctctttctttctctttttcttcttctccaggacctggaattctcagcataagaggaaaacctaggagacccccattttgcttgcagcgttaaatttcattctgcctgtgagaggccctaaatagcacagtggttaaatccctggaactagcactagattgcctcagttttaatcctggccctgccactttgtagcatcataaccttgggcaatgtgttagtttctttgtcgctgctttacttaccacaaatgtagtggcttaagtcaacacaaacaacacgaattttttatgttataattctggaagccaga

SEQ ID NO: 8038 - DNA, 1018 bp, artificial
  synthetic oligonucleotide
gtatattgatacatgctaaggaggtgtttgttaaataaataagtgtcctctatggaaaggaactgatgatagtgaaaaggctatcaacacaccatggtcaaaagtattccatctaaatggcctggcactaagatttgtgtctttcacagatttgccagtaaactgttaacaaagtgcacctgctggtaaaacaaaactggtataaaacaattatccaaatattttcaaacaaatagtcatttcaacagttttttcagatttattcaaccacctgcttcactttttccctggcgatagtaagaagctggcaaaaattggaggttcactactgggggaaaaataaagaataagaaatttaaaaggagaaataatttatatctagccaaaccaaagtcaaaatgcaatagctgaggattcttgtttaggtgtaaagcatcactatgtggagtacttcggagtgaaccatctctacacccatcagatcttaagctccttgatggcccattattttgtacattgtagggacaatgtacaaaggatttcatttcaatccttatttggattgaattgaatgttacttgtgttaattacttgctgacctagaagctctagcctgaacttgcacaatccctaccaaaatgtattaggatacattttgaggacgttaatgtctggtataaatgattaacaatctgggattcagttttatcacttgttacaatttgtttatatttttggtactatgaagttttctaactaaaagacttcatgcgaactatcagcagatgagtttaccaggctgccttacttgcatctttaatttccataaaatcaaaaaagaaaaaaaacaagtttataggggtccttccagtacaccatgactcaagtttcctagtaccatctaatttgtaactttacctttctctgacatcaacatcttgatggaattaaagactaacgtttttcataatttaacttgccatcaggatgcaatgaaaccagagcagaaaaacaaata

SEQ ID NO: 8039 - DNA, 739 bp, artificial
  synthetic oligonucleotide
cctgtggccaaagtactaaaagcaggcctcttagtgaaaggaaagttaaaatgagaaacaaagttttggactgtctgtggggttcattggcctggggttttcccgccttagcccacaggttcctctagagctgactctgctctggtcccagcacataagtctagtccagtgctttccaacattacagtgcccttccctggggtcttccccagtgtgcccccctgtccacactggaactgacctactggtcaacttcactgcatctttctctggagcctgcacctgctcccagaggaaaagacagcccagactcacctgcgttttccctgacacagagggttccaactgcttggaggtcccacccctcaccacagatgccctttgatagcaacagcccctttcgtgtaattgttcacttcaaacagtgaaacttagacacctcttcatgtctctgggtactgccaccacactgttaaagtgttttcaaatctactggtgaggagtgatttagcgcagaatctactgtttcttggtttataaccctgaggctagaaaagaggctttttaaaaccaccctgatatttgcagtaggattttaatagagtattttatttgagacaggccactgaacacatacaccaatgagtgaatttacctatgtggtcaacatccaaagcctccctcttaagtggtagataaggaaagacagaggaaatcactgtgtaagcaaacatctact

SEQ ID NO: 8040 - DNA, 378 bp, artificial
  synthetic oligonucleotide
agaacaatagcccagtgaatacttagagcagtgttctcaaggaatcctgcagaggcggcttctgaaaagccaaggtagtatctgcctgctgaaggtgttctcaggatttcatttgctcttctccaggaaccacatcacctgcccttctgcctacactcctgcctgctgtgcctaaccacagccatcatgcctcggggtcagaagagtaagctccgtgcccgtgagaaacgccagcggacccgtggtcagacccaggatctcaaggttggtcagcctactgcagcagagaaagaagagtctccttcctcttcctcatctgttttgagggatactgcctccagctcccttgcttttggcattccccaggagcctcagaga

SEQ ID NO: 8041 - DNA, 529 bp, artificial
  synthetic oligonucleotide
ttcatttcaatacctatttattaatttatattttaatcttttatgcattttgtcaatcatctgatattattctggattttggatactcagtggttcttatcattaaataaacagtgtttttttactcctagtttggactacattttgtttttcagatagctaacatcaatcaggaacttaaagccagagaagccttagacttcagtaaacatttgatataatccacagtttaagcatccatctctgtagatcacaaaactagatttaggcctttagctttcagtcagaaatgtcacatcaaatccaacatattaagtaaatatataacatatataggccacctggccattgtgtgcttaatagatattaaagtttggagacaaatttcatcctacattagatgatctcagtcaaccactgacaaagactgaagttcaaattctgatggtggattttttgtttcctttattcttggtctttgaatatttcatgtaattttttggctattttctccctagggttttttctt

SEQ ID NO: 8042 - DNA, 494 bp, artificial
  synthetic oligonucleotide
agttaacattaataaattgcccatatattcaaagcatttaattaagactttttattaaaatacactatgcagtcattgtgatatgtacatactaaatagcttattagccagacagtcagctccttaaagggcaagataattatgctttttgtacactagtatatctataacataaatagtctggctcgtcagaaggaatccaatatgtacttattaaaagaatggtaaataattggaggaaagaagggaggaaggaaagaaggaagggaggcaagaagggagggaggaatgatttgtatagatcagcactgtccaagagaattttctgcactgtccaatagaattttctgcactgtccaatagaattttctgcactaatggacattttctatatctgtgctgtacaacataagagccacatatgactattgaacacttctaatgtgtgtggtacaactaaagcattgaatttttaattttatttaacttttatt

SEQ ID NO: 8043 - DNA, 1021 bp, artificial
  synthetic oligonucleotide
gtgtttcatgtttaaaagttattttaataagtttagtttgtaaataatttgctgatttttccctgttggaagtttctgaagcatattactggttgtcgttgttttcattctagtttacaaattgatcactgttgggtaggaggataatgataaaagagagaagaggactgggagtcgcaagggctcaatgacagctctggctctgctgctaattaactgtaggactttgcatcagccatttcatctttccagccttactttcctcatctacaaaataagaataataaggtctaccatacttttctcacagggcatatattgtgaagatcaaacgtgttcatgcatatgaaagcccttttactcatataaaatactatacaaagtacttggatgaaaagacatgaaacctctgtgagaaatgttgctccaccccttcccaggcatgtagtttgggcaggctccttaacacttctattcctcagttccctcacttgcttaatggggataatgttctctagctcctgaaatttttattaagattaaattaattgtgaataaaaggtgagagtatacctgttaactgtgccttgatttgacatttattctgcctatgagttttgttcttttattttcaacctgggggagatgaatttacttgcattgtttaacattagataggattcagactctcatgtgttaaagtcttttacagctttgctatttgactgattgtccccaggccagcagcagcagcagcacttgggagcttactcggaatgcagaatctcaggccccaatccagacttacagaattaaaatatacattttaataagatccccaggtgttgtgtacacaattaattttggaaatcatggtttaacaaactatccagttgttaggaggggattcaaagagagcaatgtacaaacatactgaaaactttgatgctatttcctcctgttcattttcctttgtcttcagtcccccatctctgttttactataaaaatgaaatgactca

SEQ ID NO: 8044 - DNA, 582 bp, artificial
  synthetic oligonucleotide
ttccctgaattaaagaaatataactagtaatttgtatcataaatgtaaatatattatttaacaaaaatttgaaattgacatagttgaaaaaaaaatccctgcagcacaaccatgtagagatataaacattaatattatggtattcagttgttttcactattttttttctttttttttgagacggcgtttcactcttgtcgcccaggctggaatgcaatggcgcgatcttggctcactgcaacctccatctcccaggttcaagtgattctcctgcctcagcttcctgagtagctgagattacaggcatgcgccaccatgcccagctaattattgtatttttggtagaagcgggggttttaccatgttggccaggctggtcttgaactcctgatctcaggtgatccacctacttcggcctctcaaagtgctgggattacaggtgtgagctaccgcgccccggctgttttcactattcttttttagggacacacaaacacaatttttctcttagaaacactgggctcatattgtagatactattttgtaatccaaaaattacacttgataatatattgtgaacac

SEQ ID NO: 8045 - DNA, 1991 bp, artificial
  synthetic oligonucleotide
ggtttctctgagttgaacgggaatttggggaggctaggattttgaaacagaatagcagaaagaagggaggtacacagagaaagagctctggaaaactaccttgggggttcccctgagcctgcagctgagtactgtacttgtatatagagtaaagttctgcaacgctggacacagagtgatcagggaattcataaggagcgattcctagcagatcaagtctttttatccatttgtgttacccttgagcaagttgagattttgatccctattttagtgaaaaggtgatgatttttagtttgaaatgttattggaacatctaagtaggcgtatgaaactgacaaaagaagacacattttaaacacagctttgttgcagtataatcaacatacaataaactgtacttatttaatatatgtaatgtaatgagtttggacatatacacagatgtgtgttgaaagtgggtgatagaatctgagacccagatctgagagtcgatccacagagggcgtaactgaagtcaatttcctcaatattctcttagtgaaggtatgtaaagaggtgtgaaaatgaacaattactaagcatgctttgtgccaggactgaagtgggtgcattcatatgctgtgttaccttaaaacatcctaacagtcctattagctaggcaattgaataccaattgtaaggatcagataattggaactcaaaaaggcaaagtaattttctaaatgttctacaattggaaccaataatttactcaagatctcaacaacagttactcagacatgtgtactctaaagcccaatctcatcccactaaaatagactgacagtgtttctgtactgagaatcagagagggaaagaaaattgtcttgatgctcccaaaggcctaacctggcctatgggtactttaacctggtctcccaatactcacctctcattcactctggtcagacaaaatggatcatgggtattgcatgaagacacagagcatattcctaccttaggtaattactctcatcatcccttccagaaatgcacattcccaggatatctttgcggtttactttctcatttcattaaggcttctgtttaaatactcatccccatgaaattctgccttactgccccatctaaaataaggatttcttccattctccatcttttttactttgctttattttgctccatagcacttttttctttttctttttttttcttttgagacagggtctcactctgtcacctgtcacgcgcatccatgtgaagagaccaccaaacaggctttgtgtgagcctgtgagcaataaagctttttaatcacctgggtgcaggcgggctgagtccgaaaagagagtcagcgaaggaagatagtggtggggcagttttaaaggatttgggtaggtaacggaaaattacagtcaaaggggttgttctctggcggacaggggcgggggtcacaaggtgctcagtgggggagcttctgagccaggagaagaaatttcacaaggtaatgtctgcagttaaggcaggaaccagccattttcacttcttttgtgattcttcagttgcttcaggccatctggatgtatacgtgctggtcacaggggatatgatggcttagcttgggctcagaggcctgacatcgcccaagctgtagtgcagtagtgcattctcagctcactgaaacctccgcctcccaggttcaagtgattctcctgcctcaccctcccaagtagctgggactacaggcacacaccaccatgcctggctaattttcatatttttggtagagacaggtttcaccatattggccaggctggtcttgaactcctgacctcatgatccacccacctcagcctcccaaagtgctgggattacaggtgtgagccaccgcacccggcctatagcacttttttctatcagataatatggcatatacttgcttatgttattattttctacctcctcaattacagccaatctccatgaggt

SEQ ID NO: 8046 - DNA, 844 bp, artificial
  synthetic oligonucleotide
tactttgtaacaaccaaccaccgcatttcagtagcatacaaaaacaaacattttttggccatatatctggggtggtcccagatatatgctgaccatctatcagcagctctctggatctcagctaagtccactcatatgtctaaagtttgactgactcatggctgatctaggatgaccttggctagagtggctggagagacttaggactatggtatcaatgtcttttatcttccaattcacgagcttgggcatcttctctgggcaatggcagaagaacaagacaatgagcagaaatacacaagtgttttgccaagcctctgataacatcccattggccaaagcatattatatattcaaactccagaattcagaatctataggaaggaaggggtttagacatgggcctagtaatatctaccacttggaacatcaacctatgttttctggtttgaatccaatctctctctctctttattttaacctttctaatctgtttagcttccaaactgaaatggctggtccttaaagaataaatgtgatttctactgagatgtactgcatgacaattaacatggttatctttcattctctttcactcaaaaatatttattgcctactgtatgccaggtactatgctgagaagattgctatttataaatgaatagaacagtcatttcatcttttaaaaaatcatgtatcaaaccttcatgtttaatcatgttagtataaaagttcatttatttagacaaccaaaattcgatatcccaatatcagcacttgaaaaataaagggaaaaataggctgtagttcagctgaacagttctactcaattatcccacagagc

SEQ ID NO: 8047 - DNA, 1125 bp, artificial
  synthetic oligonucleotide
ttcattactcttttcattgatttttctcctacttttttcacaacaacaaatcaaaattcaaccctttgtacctccaaactagttttagaatcattgaactcaatgaaacttaatgaaggcttcatttttcggtctttcagaaatgggacatttggagacgtttatgaaaaaaagtgcatgttttcatgtcctattgttatctttgtagagtagtgacttcgacttttctttggaattttttgacagacaataaagattatgatgcatacttatcatacaccaaagtggatcctgaccagtggaatcaagagactggggaagaagaacgttttgcccttgaaatcctacctgatatgcttgaaaagcattatggatataagttgtttataccagatagagatttaatcccaactggaagtaagttaatgttttcatttgagagtgtgcatattcatgtgagtgtctgtgtagtcatcactttttcatggaattttaatgtttggttctttacttcaaaatttgtatctgttagtttccctagaaagaaacgtctttgtgtgttcacatgaaatttaatttttgctagctcagagaaaagatactccattactgtataaagcatctcattttgtgagccttgacattgaaagaaaccaaatgagagatttgtaccgggaaaaaaaaatattgctgacattaggagaagcaagtcccaaactctattcagtgaactagtttcatttaatttctgaaagagaatctactaggactttctggaccaaattttccattcactcattttgatgcactcttttatcttttgtagcatacattgaagatgtggcaagatgtgtagatcaaagcaagcggctgattattgtcatgaccccaaattacgtagttagaaggggctggagcatctttgagctggaaaccagacttcgaaatatgcttgtgactggagaaattaaagtgattctaattgaatgcagtgaactgagaggaattatgaactaccaggaggtggaggccctgaagcacaccatcaagctcctgacggtcattaaatggcatggaccaaaatgcaacaagttgaactccaagttctggaaacgtttacagtat

SEQ ID NO: 8048 - DNA, 2326 bp, artificial
  synthetic oligonucleotide
ccagtaaattaccatggtaacttgtatagattttagtgttgagaattacatttgccatctgtgggaaatatattatctttttgtatctaattttagggcatgtgttctatttttagcatgtgttctatgaaaaataataaattgggaggccaatttggataaattaaaagtggatattaaaatgctataaaaatagaatttatttttaattcaaaaagaaaatccagtagtacatttaggaaagcacacaaaggtcatttttaaaaccacctcaaaattgttaccattaagcgaaatttgatatgaatgagaattgactaaaaagtgagaaattctgaactgtgataaaaaaaaatggacagttacctgagagtattttgcttttgactctttagctttgtgtgacctagagccaatctctttgtgtcattgttcttcagttttatcatttgtaaactaattgcccctagccgcactgtgggaatcttgaaagagcatatatgatactgggtgactaataatatacattagaccatttgtcagattttacagattctctgagtttttacacattgtgcctcaattttgccaattttgaaagtgagatatggtggttgctcttcctagggattttcttatgccttaagtgtttgaaaagttgactcagatctttagatggcaagtttctgtaactgcaaagtagaaattacaattccttacgacatgcaactgcagttcaaagtaccgacttacaatggttgccaaattcatgcaaactaaagtggaagaggccattttcaaagcctgaaagtattaaatataaattacctgacttaaatcagcttagaattataattctactctgtatgtgatgtaaaatgaatttgacttaaaaatttatttataccacctcacaatttcaaggtaatgactcacaactgcttgggtccatttctaattctccccaaacaaatatgtctgtaacatttaaataccttaatgttgaaagcaacttaaagaaatacattaaagataccgcaataaaattctatttagttaggcttcttcggtagactgctaccactggcaattcagcagtcacataaaagttggcagtattaaaatacattttcttctgtgggctgttcacatactagtttagtttcttcatctgaaaaacaatgcaattagtcaaaatgaaatttgaaatttttacctcctctaaaatcagatgattgactccacgttttatgtgaatattcataaactgttgccaaaactgattattatttatgaagagaaaagctccacagtggtgtttaaaaaattcctgttagacttgcattgctgaaccaggcatctttaaatgatagttgcataaacagataggcaaataaataaataattaggctaaagtggttaccaagagaactcttagcagaacatagcttgcaaaccacactggacaaattccattccaaactgtccagaataaaaggcaaaatataagctattttgtagtactagtatttaaagccatagatcaattacctatgttaaggctacatgaaaacctaatacattagaaagagatgcattaaataatttagtgaagtattaacagtggttacctcgaggtggcatgattccatgtgatctttaatttcttatcatccttatgcatttttcaaattctttactaaaagcatgttttatagagtcagaagaaaagtgagaaaataaatctattttggtatagctactgaatatttttgaaaatgcttataggaaacctatcattactctctgctataaaatcaagttatttacacatttttcaagtatattgaaatctatttgcttgaatatgtactcttgctcccactttgtctattttataaaaaaacattttaggggacaccttacttctacattattttctcaagccactgctagttttcatatgctgaaaatcaatacatacagtgggatgataaggtaatgctctattctttgtgaagcagagctatgttatgctattttggtaaaagataattcattattgaggacaagcccttcatgtataccagtacagaggccactaaactatgtgagccacagacttcttctcaagtttgtcatggtttaaggaaccatttactgctccctttggatgaggcaagtaatggtagggtctcctattggtagctcccaaaacatgctcattttttcatagattgttaatggggaggggggattttttttttaaaggttaacagagtcttgaaagcatctctttacaaaatgagaaagaaaggcaaattta

SEQ ID NO: 8049 - DNA, 1467 bp, artificial
  synthetic oligonucleotide
ttcaatgtgtttacttatttattcatttaagtatcaattataattcattcaatgctagctgtaattatgctttggcatagatacttatttttattcataatgtaaatatgcaagaacgttaataataataagtaagttacaaccacatcaaaatgatgattacttctaaacatactcccatctaaagattgcatcttctgggtatatacaaacattttaatcatggtcccccattctaaatgtcaagacttttaaaactttatcaaaggtaaaaaagaaaatgattttcaatagaaaaataacacattttctattgggaccttctttctggcaacaaatacataagaatattgtactctagaatgccccagtgggattccagaaggctagatggacaattgtctaatatgtactaaaacatttttctgctgattttcgtatttaaaacttcactcttatcttttacccatggtctatgaaatgctaaaataaatgaaggacaattaacctcctaacttttaccccctctggctttgtgtgtgttcagggaagtttctagaaaggtagtttaattctgcatttaaaaatgttgaacagagatgacaacgaggttagtgagcatttaccattaattttaatgtcagagttaaatacttcaccagaacttttagtctacaggtttatagtttcacgttccttcaaaaacaggcaatttgttagtatcattaacaaaagtcagactgaacatttcaactgaaatgtcaaaatagctcagaaattttcttttcttttttaaaaaattaacctgacatgtaattaggccttcagcctgagacattagaatttttatctcaacttacataatatttcttcttaaagggaaagcaatttgtaaactttttcttcaaggtctttctcacctctttattatgacagtgtgattgtcctgctaagggagataattaactgcaacttcattagcatctacaaagacaagcttcctcattacaagtgaagaagaaaagggcataacttaattaacacagcatcaattcatagccaaattagaagcacagattttgtaggtagttttacatcagattcggattcatctacatttctttcttgtttgtgtatgtgtctgtttgtgtggatttttgttttgttgctttacattttagaattcttaaggagcatcttggggaacaggaagtttccatctcattaattgtggactctgtggaagaaggtgacttgggaaattactcctgttatgttgaaaatggaaatggacgtcgacacgccagcgttctccttcataaacgaggtgagtgtaaccttctaagcttcggtggtcaactgaatgtatgatgggagaaaaaatcattgggaaccaagaaacaaatttagttttgtttttctccacaaagttctcctaaataaaataatcatatttgcattagagcc

SEQ ID NO: 8050 - DNA, 1994 bp, artificial
  synthetic oligonucleotide
agagtacttgaaatcccctgtatgttactaatcccaaccaatgaataagaatttccattctgcaataaatatcattgctatcccataacctatgtttcacttgtacaagaaaatacttcttcagcacaaagaaggaatgattaattcttaaaatattaagaaaacagcctaataaagtctctcaaattccacttgtaaaagcagaaaaaatattagagtaaaatcgccacagattgtctcctcaaatcataggaacatgaaaattggaaactttcagcaaaatttatttttaacattgttcaactgttttgtatagaacatttaacgttaagaagcaattttgtggtttgaactatttgcatgataatttctggtgtggaagatgccttagagctgtgttgcttcaacttttcacatcagcacagtaacagtggggccaatttggtctctttatgtatatttcaacattaaagttatttttagacaaatctaccattggaagattattgttgcattggtggtggtgagtgagattcagctatgtcaaatctctccatttaaaaaaatgaggctgtcacatatttcaggacttctctgatgaggtgtcacagtattttgatttaacagactttgtataactatgtggatacaatagcaaaagtttattttcatttttttttttgtaaattgttttgagctaggtcagaatgatttctaagcatacacacgctaaaacaatgctaagacatagaaaacagcaaatttttcaggctattggtagatagtttaataagttcgtcctcttttgagaggtctagtcacctgtgtctagtgttggatggaaaggggcttggatccactggttagtcttccttattgtctcagagaaggagaaaagggctttatcgtgaagaaaaatgactgatggagctctatatacacaatagtataatttgaatttaataatcaactaatagtaccaaacaatttataacccccataaactcctaacacccgatcttcattttcactgtaataattctgtcgcaatacaaagtgttcatagttttttcttgtatttgtcaataagatggctcaattttggatgagaatttcaaccactgttgtttacagaagttaggattttttttttaccaccatgttgagctccttgaaaaaattaaaggtaaactttttgaggtgaggtagcctttgtgaataacattgcaactgaggaatttttttttttttttgagacagagtcttgctctgttgcccaggctggagtgcagtggcatgatctcggctcaccgcaacctctgcctcccgggttcaagcaattctcctgcctcagcttcctgagtagctaggattacaggtgcccgccaccacacttggctaatttttgtatttttagtagagatgtggtttcactttgttggttaggctggtctcaaactcctgacctcaggtgattctcccgcctcagcctcccaaagtgctggggttacagatgtaagccaccatgtctggccacaactgaagaatttgaggtcaaaatagtcctaatgaaggctatcattcttcagctctgcctttcatgaccctttcagtgtacatattcatctggttatattttcagtcaatttcttggctcacccaagaaaaaaatgcatatcttgttgaaaaattcctcgccaactattttccatcaaacagtttttcataggtcttcacagggagcgttattttaaatactgagactccaaggcaaatgaaacaaccaattcattatgctataataaaaccataagaaaaataacagaggtaatctgaatcgagtgactggttgttccacagtgtttttaaaagacgcttcttgttagtgttagtaaataaaggtgtctatgtttttcagcttagctacctctttttggctcaaatcagattctactatccagtttttaatcaaattttctcttatctataattaa

SEQ ID NO: 8051 - DNA, 10235 bp, artificial
  synthetic oligonucleotide
cgtctgtttatgtgctagtttgtttaagtaaaaatattatcttcattttaaaaaagctgagcatgtaaaaaggccaaaattcggggttttggctatacttgaatagactgcatttgattttctttttgcaagctatacccttgatgacagttaaactgaacgagcattcattgagcaactatttagtttatagtcactatactagaatatagtgatacaaagatgataaaccatgatccctgtcctcagaaaagatggacgtatacatagcaactgtaatacggtatgtaagaactatacaagcagtatgaattgggttactcagaacaatcgagtgagggattcttctggcgcaggaggaatggaagtggcttcacatagaaggagctgagaatgcagaatgatgtaacagggctttccaaggttacccccaggttcagtgattcactaagaggactaacaggactcagcagatagcatactatggctataatttattacagcaaaaggatacggaacaagatcaacaaagggagaaggtatgtgtgagatgactaccagaggaaaccaggcccacgcttttaagagtcctttcccaggggagtcacacagaatgcacttaatgccttcagcaggaagttgtgacaacatgtgtgaaatgttttctagtaaggaaattcattacagactcagtgcccagagattttactgggggttgttcatgtaaacgccctaaaccatactgtctgcacaaacagtttaggcatagtaaacccatttgttatcagaaaatgctgggaacctttctgatatctaagttttcagaagcataaatattatggcaatgtactcaaaagaactgggcctccattttaggattccagctgaatgctaaccttgcaagcagtcctttctaaggacagcagcctcaggcctgttagattaactcttttctgcacaggtgaatagatctgtccagatatagttggtggagaaatgaattcaggctgtggaaatttcaagaaagggctcggatgtgtggaaaaccgttcaaaacatttcattcagtgagatgtttaatcttaagtgtttctgggactatttggagtgtcaagttcacactcctgaggcctgacatgatttcaggttccctgaacaggccccatcttgtaaagaggattaaaatggcaattgtgttaattcgaaacatttggcctctgttgtgtacttcattcatgtgaagatgtgattctaatttagaatatccagatatttgttttagttcagtgttttgttgtcacagtatataaagtttctgaccataacacctttgaagttgtatagttcaaaggtccctgttacagtgcaacggagacttcagtttcctggaggagagtatgtactttcaaagacgacatttcagagcatagtacattcatacaagtgatcgacacaaaatgtcatttttgtcactagtacttgtggcattaactataagctgtggagttgtgcttttgttttccccccagccagattgacatgcttcagtgcctttcagatcctacacttgtacaacccaaaacagaactatccctgtatttcactaggagaaaaatgaaaactgttaagcttataaatatttcactacagattgctgtatattcgctgctcactgttgaattcagctgctatgaaatgctaataactctctactgagggcttgagaacaacctctatttcgataaatattatggcgtgtactgaattatgagttccgtacattcactgatagacaagatggaatgttagccttattaatgcaactggtgcaatgtactcaaaagaactgggcctccattttagagatttagctggtaaggtacatgaccactgtaacatgcatgggccttagtagtataaaatagatatgaaatattgtacaaataatatctctgctgtggtttggaaatctattggaaaatatatacatttgtcttatcttctgatttgttaattactcttaggacattatgagtgaattttagaactaaaaagtcagtataaaaacagatggttacattttgtgattattagcttcctgtgactgctataagaaattgccacagacttagaggcttaaaacaacacaatttttttatcttatagttgtggaagtcagtccaaaatcagttttacagggctaaaatcaaggcgtaggcagggcttggtcttttctggggactctagaaggtaatttgtttccttgtctttttcagcttctagaggctgcctgtattccttgacacatgactgtttactccatcttcaaagccagcagcatagcaattcaattctctctctttctcacttctctctctctcttcaattctctctctctctctctctctgtgtgtctctctctctcatctctacttccatcatcacatctccttccctgactcggaccattctgcctgcctccatcttataaagatccttatgactggacccacccagatattccaggcttgtctctccatttcaagatccttaatcacatctgcaaagtctcttttgttttgtcaggtaacatagttacaggttccagagattgagattaggacgtggacatgttttggggatcattattttgtctcctacaaccccaataactctattttgtgttataaatactgtgaattattcagcaccaatacatggtattcaatcagattttgaccatgtctgtctatccatccattcagtaaatatgtattgagaacctaatatatgtcaggcaatgttctagatgctgaggtgcagtaattaacaaaggagacaaagtctttgttctcatggaggttgcattctagaagggaacacatataaattaatattggatatgtcctgaatatttggtctataacaaaaaataaggcaggattagatggcatactgtgttagtatatgtatgatgaggggtgccattttatcactaagtatggtcaatgatgtcctctctgaagaagcaatgtgatatgttgaatagtggcccccaaaatataggtccaagtcttaacccccggtacctgtaaatgtgatcttatatggaaatacagtcgaccttcagtatccacaggttttgaatccatggatttagccaactgtggatcaaaaatattctaagaaaaaacaaaacaataaaaacatacaaataaaaacaatgcaatataacaactatttacatagtatttacattgtaataggtattataaataatctagagatgatttaaagtatacaggagaatgtgcataggttatgtgcaaactacataattttatatcggggacttgagcatccttggattttgatatccacagcgagtccaaaaccaatccttcttggatacaaggaacaactgtattgtaagatctttgcagatgtaattcagttaagaatcttgagatgagattattctggatttgggtggagctaaattgaattataagtgtccttataagagacagaacaggagaagccacagagacacacaaagaggaaagccatgtggtgcatttacatgccaacaaatgccaaggattgtgggcaaccaccagaagctaggagagagacatggaaagggttctttctctgagcctccagaagtaacgaatcctatagacagcttgatttcagagttctggcctccagaactgtgacagaatacatttctgttgttttaagccacctagtatgtgtaatttgttgcagcagcgcaaggatactaatacaggcaatgtttgagcaaatacctatttgaaataagaaaacaagccatacagatactgaaaggaaaagcagtataggcagaagacacaataagtgggagactctctgtggtattcaaataacaacaatgggagacagtgtgactagaacccagaaagccagggggaagagtgtttgaagatgattccagaactatagtgctaaccaggtcgggtagggagggttttgtgggccatggtaaggactttgaatttaattctgtttattatatataagctagaataattatgatttactgaaatgtagtgtttctgggcatgacagttttaactgccagaagcaaataatcgtgacacaactgaatattaacacaaaacatgaaggttgaattctggtgagctccattgtgttcccagtaacttaactatcacatttttaataatgttggtcctggcctgaataacaaaatatattggttcctccacccccaacacgcaactactgtattaggccattatcacattgctataaagaaatacctgagagtgggtagtgaaaagacgtttaattggcccacagttctgcaggctgtataggaagcatggtggcatctactcggcttctggggaggcctcaggaaacttacaatcatgcagaaaggcaaaaggtgagcaggcgcgtaacttggcagaaacagcagcaagagagcaaggggggaggtgccacacttttaaacaaccagatcttttgagaactcacttagtatcatgaggacagcaccaagggcatggtgctataccgttcatgagaaacccacccccatgaaccaatcacctcccaccagtccccacttccagcactggggattacatttcacgtgagatttgggcagggacgcacatccaaactaatcaactacttatttctttttgtgtctgcatatataaaatctgttaggtttggctttccgtgcaacactgtttcatgtgttattagtatcgctgttacactctgatactcccacaagataaccctacccatcaatgagaattgaggccagtactgcagaatgaggatcctacacaaaatacagaaaccttacttgttcaccaaaggtgtgaaccagtagtaaaatgaatggatttgtttcccgtccccttgctggtccctgctaactctgactcttaaaagccataacattttagccaaagaggacggaagaaatagactcaaaagttgcttattaaaacttgcaatatgtgtgccaataattgctagaactgtgttagaaataaggacattgtaatgagataggatgttatttttctaacatgatgtctctatgttaagagataaaggtcaagtcctaggaaatgaagggctactttttaatggcgttgaaaccacgtaatgggtaggattgtctctagaagatcagtaatgcactgatacataatcaatggaagtttcttaggagatactttatttcttttagcattggttcctctccctactatgtcaaatataaatatttcacattgtatagccattaatcaaagtaaaactaaccacagtctatatatatatatatacatatatatgtatatatgtatatatatgtatatacacacacacacacacacacgtatatatgtatatgtactctgtatgcatatatacacagtgaattttagcttatgtccctatgggcagggaagagaacaaaagatgcatataataattcatctctgctcattttcccatgctccttcattttgtgtatcatctcacatgcaaattaaaatgttctaaatgacaaaagaaaatctcagttgtgggaaattaagcataaaatgtggactgaatcttgattttgaaatcctaagggttactaaaaatagaacatttcacacccctttcaagggagcacctgctaaattcatttgagtcaaatgtagaaatctctgtaattcgagtagataaggataatctagaaataagaccacgagcagaggaatggtcaatgttttttgtagccaacagctttgaaatatgcttatagaaaacattgcttaaatcaggactattttaattcagaaggaatctacccatggcctactaaattatcatcagagaggtggtcaccacacattggtttagtgaccaagcttgacatcagaaggcctgaattctgcttctgcttttattattagtgagataactgatctcatgcaggtcatttaatttcactgtaattcaagttctttatatttacactgagttgtgtaaaaattttaaaaaacaaaatacagcatcattttaagctgcataaaaggtagaaaatatatcatttttaaatatcaccaatgttatcaaaatcatatatccagacaagggatctaagtaatttatctatatagatggcatagatagactacatacactacttatgttcctcattttgaatgtgaacagattagccatagcagtaaattccatcgctgaagaaagttaaatacctttaagaaaaatacaagcctgtccttccagttgtaattttctttcttaatgtgctttatctttgatttgacataatgaaggtttttatcctgtgcccagaaatacaaaaacatgagatctaaatatcttttttggttacttccccgtgctttttcattttgttttggtttaatatacaaattaaaatgttttagaaaatattgccaaatttgtacattttgaagttttattctggaaatatgatccattctgcttattcttttaaaatactacatattttcattaaaaaatgatctgatgtaataaaaaaaagtttttgcttgagaattgtatcagtagatacaattctcaaatagaagagttcaactctttacagatgatcagaagtatatttcctttaaaaaagtgaaacttaaaaatcacacatttttagatgatgacagtttcttttgtaggagagtgtgtacctttacaagatacaaagagaaagaacatttgttatcacaatcataaatgcaaattgtggactcagcctagaaacttaaaagatctgtgtagaatgatttttctccccttttatttccagtttaattgttttctgtcatagacttttattgaaacaaatacatgctactgattcttccctaatcttacgtggctaaagctaatctttcttactatttgcttagtagaaaaaaagcaaacagcaccacatattttttttcttttccaaaatatagcaaaaaaaaaaaaacatcctattatttcattccaaaagcagtagtccttttcagacttgtgcagagcagcttatcccacagggatttcaaatagtaactcattggatgcaggtgataaggactttctatgaaaggccaaagcaactaaatagttatggtttttgtttgtatttaatattattttgttgtggatgcgttagtcatattttttcaaagggaagcaatcaagtgtgatagaaattatgatggaatgcagactggactactgtcaagagagctgagctctggtctggactctgtcactgacttagtatgtgcctctagtttccatgtttttattttattttgagacagagtctcactctgtcacccaggttggagtgcagtggtgcgatctcggctcactgcaacctatgccttccgggtttcaagcaattttcctgccttagccccccgaatagctgggactacaggtgtgcaccaccatacctggcaaatttttgtgttttcagtagagatggggtttcaccacgttggccaggctagtctcgaactcctacccttaagtgatccacccacctcagactcccaaagtgcgggggttacaggcatgagccaccacaccctgtctccatgtttttaaaataagaacagcaagatttgctcttaccaacctcatgggaataacagcaagaaaaaaaaatgggtaagctaccaaaaaaatcttttatttttaagaagaaatgtagttttctatttttggtatattatcaaattctcccttatgttctgacttacattaaaccattacatgtaaacatgtaaataaatattgatagtctgtcttgaagcctgactctgatacctgaaacctgaaatacagtcctaattctatagactgtatagtctgaaatgtattataaggaagagactcttttaggtgctgggatacctggtgaccaagataacccagttcccctacaagtttgtattctatgaaatagacaggccctatacaatgaaacaagcaaatattttctcaggtattgattagtgctgtaaagaaaagtaaagccagctaactgaatagaaagtgtcagaggaggggggacactttcatgaagattggtaagagaagacctgtctgagatggtgacataagacctgaaacctgaatactgagaacaactgagctatcgaaagctttagagacaaacattccaggcagagggaacaacaggacataaggctcttgaagcctgaagaagcgtgacaagatggaggaacttgaggcttactggcctggacagaaatgaagggggaagagagctttggatcaggtcgaagaggctgccaggggctagatcagacaagatcttgcaaaccgtgaaaaggagtttttattttattctcaataaaaagagaagtcattggaaaaataagcagattgttaaaatgacctcaacatgacagaattgagttggggagggtgtcctcagagtattacccagagaacttggccccaaatcttttacagatttctcttcctctcctcaaactttcccactcttgagtggctaaaatcttaatctctttctctgtctctctcaacaagagtgaacccgatgcactgcttttccttttaacatcttctttggcatttaagggcacctgagtgtagtcccttgggaaagtagattttcttcttcttcaaataaggtcatcacattcttcaaagaagaaaattctggtgagtgaaattcttcctttctgcccaccatctacctacttacttaaaccttagcagtcatctgtcaaggggatcagtgtttatttgtgcatccagtagcactttcttgtcatagccccatgaccctgctccttcagattttctcaaggacctctggagatgtttccaggttaggcatagccatgtgtttcaaaatgcagtccaccagttccaggacccaggacagaaagaactgcctgtgccaaatcttgttgaggcttaattgggaccttaaggacccttcaggacctctaaggcctttccaaagagcaagaacatgtgattcccggatgaaaagcctcatggttcacggctgccacaattgaggtggtgcagaccaccctctcccctgctggagcccgtaaggctcggtgtgggtggcgactgtggaaagcagggcaggaatacattgccttccagaaggaattcaccttattgctgctcgtggggacagtgttagctggtatgctttggcttcaggcagctgtgcctcagttcacccttcagccagtttttatttttcagtcttgagcagcttcacagacagtaacaatgcagcctatattcttccactaaacgcagtctaagattattcaataatatttggctattagttgttcccacaataacttcatctcgaacttcgagccttccaaattcagtgttttgtttcatcctggatagaccttgatgagagttcttcctattctttatgtaaataataccaagaactttctccctttcctttgaggaggtaaagttaggaatttgacatctgaatcccagtatctgtccagattgccatgttcacctttaagtcagtaagaaaatatgccttcaaaactgcattttgattcgtttctaatggaaaaggtggggcagtggcataaacaaaaatcttgaagaccctcatatatacagtctcagtacttctaactttaaaatcatcttgacccatatttctgtatctctctggttgtatttttaaaaccaccaaggctcctgtctgatttatcatgcccctttatctcttaaatcctggagttatgtcagccatgatgaaaatatacaataagctcagctttttatccaagttgtggctggatacctttgggacacaattctgaaaaagtagtcccaaatatcgcccgattatatagtacttcccctcaaaaggctggtaatgcacccatgcaaacaagaacaaattgaataactcaatttccagaaggccactgaaataatgtagagccctgaaggagaatttctataggggatttcaactggtttatcatactgaaattattttcaagaatccttctagacatttattggtttctcaaaattgtcctgtttaaggcagtaaccaaaacatcttgccttttctgtcatgc

SEQ ID NO: 8052 - DNA, 1078 bp, artificial
  synthetic oligonucleotide
atttccaaaatatctcttcatgattgccccaaatactggatctcctttcctgttggactgtatgtatctaaaatgtacagagattattgaaaaataagttaggatagggactattaacacaattttgttctgaaaatcttcccttaatacatcacatgggtttttgaggcagatgtttggagggcatgatttttagggcagaaccagcacaagttgcaagcaatgcctggacacctgttgagcccttctgtgccatctgcttaaagggaagtacacataaccttaaaatcgttgctgcttttggaggtcattttatcaggattgagactacatcccccacaacccacaggacttaaaaagagagagatttatctcagaagggcattgtctctaagtgtgatcttcatttttatgagctgagcttgaagtccctgacatttagaaatgatagtgtgttgatgtgaggttctttcgaataatccttctaagttttatcagctttgcaaaatgttactaagtgctagcatttagtttgtgaaatgttttaactattgagaaggtgatgttggtcagtccttaactaagatcgatcaaagtaagttcagtaggtgactgttttacaagtggcatggtggtggtgttcctcaaaggttttggagagatacaaaaggactctctagttgtggttttaagttatatactcagttttatatcctgttaaagtttttataccatattttaaaattgctgtttggaattacaggaaatgtttaattcacaaatcatttatagttacaggaaatataattctattattgatataatgaattgaatggtttttaatacatcgtagttttaaacacttaaatattcacgagtaatatttgggaactttaagaatagcatccaaaaggtctacgtgttcatgtgtatgtctgtgtttgatttggtgggggccattggccaaagtttgatcccactcatttgaacagcttgctcagtatgtgcatcattggggaaaaaaatcggcatggagcgttcggtagctagcctctagtagaattatcagaggaaaact

SEQ ID NO: 8053 - DNA, 3044 bp, artificial
  synthetic oligonucleotide
ccagatctgaggttggcctttgcagttaatgacaacactgcgttttcaaaatggttattattgatagtacaaatactcaaatggcctacagagctaccttcatctgtaccatagttcttttttttggagatcactgggattatctaatcagaccaacactgccaccatatttaagcagtatgtaatgtatggtagatatattgcaaaatgccaaaagaaaagcacttgtagtagtttctacttggaaaacagtattgttactaaaagttatggcagaaataatattttattaactgtaggccttgattgtcttgattgcaaatgctaggtactatattatgcacacagcttgaaatgtatgtggcacaatgaataaaagcttactttcctaaaatataaaatgattgaggaatttgatgatcacatttaaatattttcaaaaagggttattttctacccagcagtagaataattgatagataattacaaaagaggctatgccaaaattattgctaggccctttatattgagacaatggtctttatatagtgtttgatgagaaatctatcatttcccttggggtaatggccagttatttaccaccgtaacaacttaaatgactctgtttctagacttctagttaggggcacttcttaaatcttgaaaatggggcaaagcataaatttctaagatttacttggttgtcttcacccttagtacatggggtgagtttcagcttacaaacctggcctctcctctgaaactagcaaggaagaaccaagtgtcacaatatagcaggagctcttaatccgtctgcacaatcattgcgagatggggagtggataggcttcccagtcagtgcctctgatttgattggtccagatctggggtgtggacaatttcttataaagctctcaaggtgattctaatatgcatccagggctgagaaccacttcattagtgattattagatcggttctcaaaatacagcctaacattgatggactctgtcgatggcaatatcctggttgtgatatcgtagtatggttttgcaagaggttaccaccagaaacaattgggtaaagggtacgtggaatagactctgtctgtattatctcctagaactgcatgcaattctacagttatttcaaaataaaaaagtttaacttatttgttaatagtctgccagtgaactccattaaacttacttgtgactcttaaaagatgcagacttttgggccccatcacaggtctagcaaatcggaatacctgtgggtatgtcctggaatctacatttttaaacaagctcaccaggtgattttgctgaaacactgatttagctacttacatgtttaggttttgagtaatactgggcacctggacagtcctaggtaagtgagaattaggcaaactggcacactaagttccctgccctattcagtattctgctattcctgctacacttgtcttaaaaaaataggatttcatataccaaggtgttatgatgatactaaggcacactaatgcataaaaataatatataatgaattattcagtcattcaacaatttttttattgagtacctattatgtgccaggtacagttctaagcattgcttttaagaatgagtataagaataacatttgtaagcctatcacctcaggcattctgatagtacgtggatttcttatttaagcttcacaaccaccctgatgtaggttcttttattctcccctctttgcacaagaaaacactgaaacaagctgttttatgtacattgctaaggatctagaagtaaaaactttgaatctgaaatcagatttcgactgtttctttatggtaaaatatacataacataaagtttacctttttaactatttgaagtgtacagttcagtgacattaaataccttcacacactgtgcaaccatcaccaccatcaatctctaaaacttctccatctttccaaacagaaatccagtacctattatacaatatcaggggctgtttttattatacagtatatgacacccccccaccaaagaaacctttaattgtagaactttatacaaaaggtaaagaaaacaatttgggagaaaagcctctcgccagcatttcttcaatcacacaacatattatagaaaagctgctgtgtgtaagatcagccttgatctggctgtatttttattgaatctaaaaaaaagtaattatcagaactattgttataacttaacccatttgtgctgcaattgcttctcatttgtgaaatagacactaataaggcatactaatggaatctttagtgtgagtatttattaaatcactaatgtatgtgaaacacttagaacattgcctggcatttcctcagtccacccacccaatcccacccacacacagtcaaaagttagttcttatttccccgattgtcaattttgtatatatcacttgatgcacatcattttcccacatctttgtcactgattgttagttttatctagttcagtagcaagcacaatatctaacaacctgaatttatttttattgtaatcatttcaaagaaattagagtcaaatgtcctcaactgtatgtctccagtaatttcacttagaaagtttttcaggcactgaattcgttcttgagaatagagtagcattcccctgtctgtaatatttgagcagaaaggacattgcttccatgaagccttgtttctgttcttcttctgtttgttagaaaatactctgttgatggcaaattcgtgagcaatctaaatatataattaattagaagaacaaattgaaattgaccaaatctctcagagctttgaacaaaaggactcttcaaatggtcaaaacaattacttagaatttaagcgttcattgaaatgcgagacagtgtgcggtagagatacaaaagagaaaccaggctcccatgatattgtaaatgctaaccctgctccttaagcaaacaaaagtctctttctattgtcagtagctgtcttctaggacaaatagtttggtattttataaaagggagaaaaacttatca

SEQ ID NO: 8054 - DNA, 1405 bp, artificial
  synthetic oligonucleotide
cagtcctggatgctaggaagtccaagatcaaggcactggtggattcagtgtctgttgagagcctgctttctggctcataaacagtgccttcttgctgtgttcttataaggtagaaggaatgagggatctctctcagggctttattttttataagggaattaattgcattcatcagagttctagccccgtgacctaatcaccttcccaaggctccacctcctaatgccattagctttgggttaagattttgacgtaataattttgggggaacaaacagtcagaccataacagatggatatggaaagagatctttagggacaccgtagttgggatggttatatctacttagaggggctggacaaggctccttcagggagacagtgttgactttgagattcaaaggatgaatataacttctccaggtggagaaatgtacaatgaccaaaaacaatatctgcaaaactcatgagcagggaaaaatcttaagtggttacaatgaagaaatgccttgaaatagaattaatgaaatttcacctttaggtctaactatgacagtatctaacatttactgaggactactcatgtgctaaacacaatgctaagataattatttcatttaaaacaccaactagattataaatcacattttacaaataaggagcttgaggtacagagaggtttcccaaggtcactaattattggagaaaatgagacttgaacccaagaagtatgatggtaagactcatagtattcagtgatatgctaacaacaactgacacaaatagttctttctgtcagctatagttgtactttggtctccagttatataatttgaagatacttgcagtcatagttcaggctgctatagcaaggtaccataggctaggtagcttaaacaacaaacatctatttctcatggttctgggggctagatgtctgagatcaagatgtcagcatgatctgtttcttggagagggccctcgtcctggttatgttctcatttagactttccttggtgcttgcaaggtggcgagagagagagagagagagagagagagagaaacagagagaatcttttatctgctcctctttttaaaaggagaataactctattatgaaagattcatccttacgtcataattacctgccaaaggccccaactccaaatgccaccacactgaggattagcgttacaacatatgaattctgctggtacacaaacattcactcctcagcaatggggtaccgagagcagcatcacatgtgggactgtggttgatgatggtgataaagatactgaaacttatgctattcttattgctaaatcatgaccacactttacattttaatggaaaacttcagaatagatggcaatgtatattttcataataaaaataaaatctct

SEQ ID NO: 8055 - DNA, 1292 bp, artificial
  synthetic oligonucleotide
aagtgtgttctcttagctggttgattccagtgatggctggaatctatgcatagtgtggtgtttcacagttagacctgactagttatcctggcactttgaaacagttggtttcaggtacccttccacacatacatacaaaagatgtgctgatgatagcactgacttttcagagtggtcttttcatcataattaaaagttttttttttttttttttttttaaagcctgaatacacaatctgtgcatggctttgatgattctgtagttaagaagggcaggaacagccttggggaacacttactaacttggaatcatgaagaaagtcacaagcacctacagatgagcagaaaagcaagattatttcattcattttacgtccacaataccacagggactggctggtcagttacttgcgcatgttgtcaaagctaacctttaaagacagttcatctggctaaaaatcaaataccttatacccagagtattagatatgcatcagcgggtggccagggtcttaaggcaggaagtatattataggtggcctggtattttgcaggctcttctgagccagaagcattttttatcagaaaggttttggaaattatgctcagcccctggcatctttttggtcctctcttgatcgctagtccagctgttgaatgaaaagaaatgaagctgaagagacatcactgtggctacagctggtgttacggaggttggtgtcatgctacaagataacacacacatcatttttactcatgtggaaggctgccttgctgtgcatttccacggctgtcagaaagattgattcctgaaatactttgaaaaaatgctaagtactagctactttgggtgtttacccaggggcaccacagctgcctggcattgtagtatggcagctgaacagtaatcactgctatttctctgatttgtttgtgtctttgtcagcatctgagaggagggaggttcaatcccagagtggggccctcactccacagtgatctcattcagcccatggctttaaatactctctgcaatgctaatgactcccaaatttatgtctgtggccctgatgtcatccctgcatcccagactcatagatccggctgcctattaaatagcactgctttgatgtctatgaggtatctgaaatttaacataagcaaaaccaaatttctgatctgtccacccatatatgacccaacttatcatcccaccatcttcccacaggagtaaatggcaactccattcttgtggttgctccagccaaagccttgtgatcatccttgacccc

SEQ ID NO: 8056 - DNA, 633 bp, artificial
  synthetic oligonucleotide
ccctagccttcaatgatcatcagtcatctatgttcctcttaaaatcagagccaattggcttttagtgtaaaccagtttactgtttcttaaggtttcacgagtcttaaattaggtaacaaagtcttctggaatgcatcaatataattagtcaaaaataaatgttcaatgtatttgttttctttacttttgaggaaaaaagaaattaacagtctcggattatgtatctcctttatacaaagctgctgtctgccaccaaacttattgggaatgaaatgaacagcataagaatctgcttttagaaccagagacagggcagatctagggatccaggtgtcaagaacctcccagtattttcaggtattgaccatcaggatgaattaaatcttaccatttttttttatttttctgatacattttgttcataaattaatttgaagagagagtgattggcagagcttcaaccacacacactttctacttgaagtatgagggggagtgggtctgatgaaaacttgaatgacttcctatcaagactagtgagagagaggtaattctccaaaacagactagtgaagcagttatcagaaaagaaggaagcaaatgttaggcaagcatgtaattctttctttatatt

SEQ ID NO: 8057 - DNA, 1356 bp, artificial
  synthetic oligonucleotide
gaaaagtattttcaaaatataaatcagatgagggcttttatccagaacatagaaaatgtataactcttgataataataagaaaaacacatttaaaaaaatagcaaaatatttgaatagacacttctcgcaagaagatatacaaatggccaacaagcacataaaaagttattcaataccattagtcattagggaaatgcaaattaaaaccacatagaaataccacattgcacccactagaatggctagaatccaaaagactgacaatactaaatattggcaatgaggtagagaaactaaagttgtcacacattgctggtgtgaatgtaaattgatataaccactttggaaaacacttttgcaatatatttttaaaattaaatatactatggatatactatatacgtaactataaatacactatatacatatataactatacaaaaatgtactgtgtatatatgtggaaatatatgtatattgcataaaacccagcaactccacacctagatatcttcccaagaaacatgtttatacaaacacttgtaatttaatgtttagactagcagtattcagagtagcccaaaactgtaaactctccgaatgtccatcaactagtgaatagataaacaaaatatgatataggcatacaatggcatgctactctccccaaaaagaaataaattactgatatatgcaaagacatggattgatctcacaggcattatactgggtgaaagaatccagacacaaaagtgtaggtattttattatttccattatatgacatttctagaaaggataaaactatagagacagaggcaaaatcagtgggttcctgggaccaggggtagaatcacagattagctacaaattggcatgaagaaactttggggtgatggaagtgttttaaaactgggttattgtgatagttgcacaagtatataagtttactgaaactcattaaactgaacatgtaaaatgggtgaattttattattatatgtaacagaaaagctgttgaaagcatagaatactgttatatgaggagattatttctgtttaaaggtgatttttctagaaagattttataatgtctaaaatataaaactggcacatcatagaatgagtacatataagtaaaactttttttttgcaggcatgcatatgtgaaattgtatggttctatttatggcaaacagaaggaaactttttacagtgaaactatgttcatagttttcaagggaaaaacagctccatgaaataaaatattgcttggggagttctttcataccgcttgtcaccagcattctcactggcttataagttataattgctctgtgataaaggcgtatgcttt

SEQ ID NO: 8058 - DNA, 1327 bp, artificial
  synthetic oligonucleotide
tgaaaaacctgcaggctttcagatttatttgaattatttttgaccattgagtcacacatggagtggattagttaggaaataattataggagtcagagttaaaataaaattaaatccagattggttataactcacacatttcactcttttatattttagcttccttttttttacataaataccacacatttaatagttttaacttgttattttggtcaaaataaattttgtaacgctgattcttctgttgtgtttagactatttggttgaatcaaggattttaaaatttgagtttaccaagttaagcactaaatcgaagtccaaaaccatatctgctttttatcccagtactttagacaataactagcacatagcagttgctcaataaatatttatttagtgaatatgtggaattactatacatttattattaatttgtacatcaaatgatctttcatcttttccttgaaaagtatttcctcattgaagaaatgctcaaattctgatacatctttcttcctaaaagagtatctttctaaagtccctaagcttttaagggtgctattaaatatatgtaaataatgattaatgaaaaatcaatctaattttaagatagtgatgcataccatctcacacaatgtgttttttcccagcttatgataataaaaaaatgtctctgagatgagaaagcatactgtatctgaaacctagccaaccacagctgacatcctcactgaaggttagctggtgttgactgatgcagggagggtacagatggaacaactgtagagtatagaatctagctctatgcgattttcatcttcctcagactaccttagatatgttagcaggtcaattggagacgggcaccaaaaaatggaagaaatgtgtaagtattaattgaagcctctgctttatgacttcgcattggctcaaacaggtcatttagtgggctcataaccagagtaaagtttccttaggcaaaaggtgcggatacagtcacagatggagtcattaacacaatcaacctatcatataagctaaactaattgtatttatttccataaattacatctggccttcctactacagtcttttgattttctactgagaagtgcatgctaaaaactaccttaaacacacacacacacacacacacacacacacaactttaactttctgcttactttcatttctgctaatattgtactttgtgctaatataattcattagctaaaatattcatttttgtagagactgagcaaaaggatagcagtcttttaaatagaaatatcatacagtatggcctttgtggtcagtatacaaga

SEQ ID NO: 8059 - DNA, 352 bp, artificial
  synthetic oligonucleotide
acctaggctcagactactggaatgtccaggatcagtgtcctcaggaaaaatgtcttcagtgggccacttaaccctttgagctctgattttacttagattttgggcataggaattcctatcttgtgaactatttgataactttagaaaaaaaaaataacccagtgttgttccttattttcagtggaaaggttgctccaattaaccttgcttgccatattaatagaaatagaacttccctgttatttctcacttaggagttttctcaaccagattttatatttaacatttcaaatttcttggcacaattctcattctctgaccctacttacttgctactggcagctttattttt

SEQ ID NO: 8060 - DNA, 3244 bp, artificial
  synthetic oligonucleotide
ttaccaaattccaaccataaaagatattttgtacataataggtactcaataaatgaacattacatttgaaaagcaatgacctgctttatatttcagtctaaatgtaatcgatatgaatcaagcagtaaagaatatggcagagttgcattacaatttgcagtccaaaaattcttgagtaatctcaggaaaaatgtactctaccagggctttccaaagatcgttttcaggaatactagcctgtctatgtgctgccaaagcgagcacaggaatactagcctgtctagatcaatgcagttaacacaacccagtagatctctgtgcttgatgatgaaaatattctatgtctctgctgttcaatacaatagtcaatagctatctgtggctgttaagcacctaagatgtgactaatgcaactgaataacaatttttttcatagaaattaatgtaaatagccatatgttgctagtggctacggtactggacaacatagctccaaagttctcaagaacaaagaaaaaaatttatttatttttctttaaagaacaaaattttgtctaacctagcatttcccaaatttagttcatcacgaaattcctctttctactttgagaagaacattagggtacacttttcaaaaattttatattattaataaaaaggaataagatgtttaaggccatttacacatgattccttattttatttgctgattcatttatgtatccactcaactaacatctaatgagctaggggcttggcaatattgagatacagttttgttcattattgagttatatctaatgggacaggcagattaatcaagagataattacacacagtctggtaagttctaagaaacacagaggactgtgggaatacacaggtgggtgcagaatcaaaatttgtcatggggaaagtttccagagggagaatggaggacaagtaggacattgtctggttaaaaagaggtccccggccaggcgtggtggctcacgcctgtaatccctgtgctttgggaggccgaggagggtggatcgcctgaggtcaggagttggagaccagcctggccaacatgatgaaaccccatctgtactaaaagtacaaaaaaagaaaaaaattagctgggcgtggtggtgtgggctgaggcaggagaatcacttgaacctgggaggcagagattgcagtcagccgagatcgtaccactgcactccagcctgggcaacaagagcaaaactccatctaaaaaaacaaaaagggtgcctttgcatttttatttctcttattcccctccccagggtttgacacttagtctgtcttattcaagctaagtccttgaatcacaactatgcctagatccttatgggttgcttatttatacctttaaacaaagagaaattcatctgatttttacagattgatttgagaattagaggctgttaatactatttcctttttgccaccccaaccactttttcctgttctaacttcttcatactccagtatacaccacagaaacagaggctgatatggtttggctctgtgtcccacctagatctcatcttgaactgtactcccataattcccatgtgttgtgggagggagcggtggaagataattgaatcatgggggtggtttctcccatactgttctggtggtagtgaataagtctcacgagatctcatggtttcataaggggtttcggctttcgctcctgtcttattctctcttgccaccatgtaagaaatgcctttcaccttctgccataattgtgaggcctccccagccaggtggaactgtgagtccattaaacctatttttcttcccagtctcaggtatgtatttatcagcagcatgaagaaggactaatacagaggccattcgtactttaaatgtattacggctaattatagtcaagagattagaagtcataatacaaatattaaccacagagaggtttaaatttctctatataatctacagtcttctcaaaatagccttcaaaattttgacctgagagcaggaacaggcctttcatgttttaatcctcaataaaacacagacatacaagcctgtgtgtgtgtgtgtgtgtgtgtgtgtgtgtgtgcgcgcgcacatgcattctcacgctcatagtctgtcttttcccaacttcgacaattgtcccactgatttctctgtaccttcctttctattttaatcaaatctccgcaaaataaataagggatattctaaaatgtaaatctcattaagccctcccccagataatactcttcaagagtttcctcagtttccttcaaaatatgttctatggccattagagtagtttaaaattccctgtataatctagtccaagtttatttctccaacctcagagcaaacaattctagaacagtgtctagcatataataaacacccaataagtgttggctattgttttaggaaatggttgtctgtccaggaagcctaaaaaggtgtcaaaccacaatattagggaggcaatgcatagtgcagccaattcacaaaagagaaacaagtcctagaaatgttactaagagctcaccattcatgacaacactaatctcctcccgcaactctgccctcacccttcattctttgaggcttcaaaggatgaagtttatccattcatatcaaaaccttcctttttcacatatcaatgcacatttaaaataatcttgtagacactgttttctccttaagagtctgagagttaggaaacaattctgtaaatattaaaaacacaggtattgtaagactgattggaatcttacaaactaattttgttttactaaccaagacagtgtaggatagttacacgaacccaggtctagtaaataattcattcgcgattgtgggattgagtgcaaataattagtgtaaattgtcactttctcaaaacaaccgccataatagcctgttgattaagcaacgctgagtttattacttagtgcagtaataaagatcaacacttgacacagggtcttagttctctgaagacagtggttgaaggtagatattttttatagagttttgagggggtctaggttcaagtggtttaaagaagttctttgaatgcagagatttgattgaaattgggcaaaatccaagatataatagacaagaattggtggacccagtgagtccaggttcttagaataagtcttgatgagtaaatagctgttgaataagtaagggagttcatcatgttaacaatccattgtcccat

SEQ ID NO: 8061 - DNA, 4713 bp, artificial
  synthetic oligonucleotide
tcccatctgcacaaatttctggaagacaataaatgtttcttcttctttcattaatattttaactgtggaggtatctgtttcaaaatgtaaaatccaataggtaatcagtgaggaatataacctagattaacttttttttttcaaaataaccaaagcacactcagtttaagtttcatgttaaagtgagccaaatgccagttaccaaaatattggatggctatgtatataatcctttgctgatgagtaatttagcatcaatttagagatgttattttttttctaccagatgctcgaaagcattaaggcaagattagaagtcattgtcccttcttctgttatcagtggtcccacaatatttgtttatatcaccattagaaacaaattgtactgtattatagttatttttttgtttgtccctcctattagagagtgagttcactaagggcagacattatgttttatactttattgatgtggaaagcaggcagtaaagaaagaatgaaggactgattattggacatttgttattaatgatcttagcttattattttcctccaaatgaaaatgttttagtgaacataaactgggaaaacagcaggagcaattcagttaatactcagttaccttgaagaggttgaagcagaaagtgtttgtgtcagttgttttaacataattgccagtaaagatactgaaagtattccctcatgataatgagaaaaatccagaacacaaggcttgattactcctacaatatttgcctgctttgactctgactgtgcttaagtatatccaggcatgctgtgcaaagtacagaactgaaataaaataatccctagtccaatcataggcttacgttactaggataagtcaagtttgtggtttcacctgaagtaagaaagcattaagtcttcttatcacacccaatcatccatattaggcttgggatagaaaaggcactagagacagtagggataagatttagtccagggagtaagtacttggtttcattaaaactaccctagaattggctcaccagtattaattaagtcctttttatttgtaatctcattcatcattctctctctctctctttctctctctctctcccccccccccgctctcatagagcaatgttaaacaatgtacacttctttttttaaagttatagatttctaaatttaaaatgttctgatatagtctagctctccaattagggagaagtagaaacatatgctgctcagcttttctaaaatcttttaaagtaatcaattagcatatgggctaagttcactttagatggatacacacatgcactatatatatatattttctttagacatgttaaggcagtggataaaatttccttttgcaatcctttgctcatggtatattaatgctgatagtattttatgctattttgtgttgatgctctcagcacaaattggccccaaaatattctgtattcaaaagcatgtatttttttcctaagcgtactatgattttaatagaagcagaaatgagtgtttccttcttttgtgaatttttgggagggcatgcttccctgcagtctctggagtgtgtgttgacattttttgtgccatgatttcccataagtaacacactcttttgatagtgaagcagtgagggaaagttgctaagttccatctgtaagaaagcattatcagaagtggaagaagggaaatttactaagttccatctgtaagaaagcattatcagaagtggaagaagggaagtgacaagaaaagattcaaagttgttttgttttagctccagtagatgctttataacacactcctaaaaagagtgtgaatataatatagttaatataaaatttattttatataaataatttataatcttcaaatataaatttgtttttactatataagcaatgtaacattgacctaaaaattgaattgaaaaaatataaactttcttctcagaaactgggttctcaattactctctatgtacctgtttataaaatacaaaccatctagataatcattgcaccacaatttgtatcaaactctgtttcttagccatcctagagtacaatcaatatcattgatcttttcgaaaaaccagcttttggtttcattaattttctttattgtagagttctgtttctttaatttttttattattatttttgagaccgagttttcctcttattgcccaggctggagtgcagtggcgctatctgggctcactgcaacctccgcctcccgggttcaagcgattctcgtgccccagcttcccgagtagctgggattgcaggcatacgccacgacacccagctaattttttgtattttagaagagtcggaatttcaccatgttggtcaggctggtctcgaactcctggcctcaggtgatccgcccacctcggcctcccaaagtgctgggattacaggcatgagccaccacgcctggccctgtttctttaatttttagataaggatctacctttaacttatgaatataatatataatatgaattatgaatattatgaatataatatgaattatgaatattatgaatataatatgaatggcattgttgtagggtgataactattttaattcaccttcttgaaatagataacatttggcttttggttagattttagatttatctgttaatgttcagaaaaagataaaagataaatcatggaatctttttttttatttttttattttattattattatactttaagttttatggtacatgtgcacaatgtgcaggttagttacatatgtatacatgtgccatgctggtgtgctgcacccattaacttgtcatttagcattaggtatatctcctaatgctatccctcccccctccccccaccccacaacagtccccagagtgtgatgttccccttcctgtgtccacgtgttctcattgttcaattcccacctatgagtgagaatatgcggtgtttggttttttgttcttgcgatagtttactgagaatgatgatttccagtttcatccatgtccccacaaaggacatgaactcatcattttttatggctgcacagtattccatggtgtatatgtgccaccatccatggtgtaaaaatgctcaccatcactggccatcagagaaatgcaaatcaaaaccacaatgagatactatctcacaccagttagaatggcagtcattaaaaagtcaggaaacaacaggtgctggagaggatgtggagaaataggaacacttttacactgttggtgggactgtaaactagttcaacccttgtggaggtcagtgtggcgattcctcagggatctagaactagaaataccatttgacccagccatcccattactgggtatatacccaaaggactataaatcatgctgctataaagacacatgcacacgtatatttattgcggcactattcacaatagcaaagacttggaaccaacccaaatgtccaacaatgatagactggattaagaaaatatggtgcaaatcatggaatctttaaaaaagaaattttattcctgtgttaatgtgtagttttaaagatttgtttaacagtgtgtactaatgaagcataatagataccaaaatgttttcattaggaacaaaggtcaattgtgcgagaaggagtcaccatttatgacctgacaggttgaggtaatgcaggcagggtaagacaatacatgagtaagcaagcccccctcccaacagtagtcatcattaataggaactcactgcatttagggttaacagatatatgatgggtttgaaaattaccaaagtggaacccagatggatatgtagatttcagtatcattatatacttggaaattgaggaaatagtgtagaaaaatacataaactggaaaaaatcttatcagtcaagaattaagttctagggacttgctttgacctctcattcattcctttatggcctcttaatttctctactttttctaagcttctctctgcatatatcttcactcttatctccctaagactagctttctctacttattcataggttcctccttatcactttagattacatgtggtcatcacaacttctttggccctaagtctaccttaagccttttgtttatactcagaaaggaggactctgattgggctagctcatcttttctaatgaaaccaagagataggttacttgcctgcataggacttggctgcccttggttaaggggccatcatagcaccaatcagtcatgtctggtctggccatggggatgcataaataaacaaatggtcttacctttccaacctcttcctcaatcactacctaccctaggaccacaaactctatgttctatccaaaccactcttttccacagatacctaatcatttcactattcacagtgttaacctgccttttctcacttcttgaaatttccatcacagaatgcatgattaatctcaaagcctcatcccttgcatgtccccatgaagtactcttttactttcctaggaaaagttaacactctgatagtgctttgtttatgattgaataaggtcacttctggtattgtatttccactatgagagtgatgtacatgaactattgaatataaaaacatacctttgataccattttgttgtatagtttataaaagaaagctatgacaccatagggttattaacattatattacttaaagtagtggtaaaaacaacacacat

SEQ ID NO: 8062 - DNA, 1195 bp, artificial
  synthetic oligonucleotide
ggtatataataaaatgcttcagcatacaggttctagagtaaaaccttgggtttagatttcagctctaatatttcctagctttgtgatctcttggaagatgtatgactttactaagcttcggttttccaatttataaaacatgaataacttttaccactcaagactgtattgaatattaaataagacaatgcatttaacatattttcacagtgcctggcctatgcaatagatcaacaagtattatttatgattataacatttaaggccctttactatatacctttccttcctgtcctccagccttatgaagctggcacccttgtgtttcctgcctttgcagcatgatggagagtgagatgcatggatacttttaaagtgtccacttctacgcatcccctgctaaatgaccttgagcaagtttcttcccggtctcagtttggttatctgagtaatggggctaatttgaatacatagttctcgagtttgtattgagtcgatccctgcattagtcagtcacattgaacaataaccaaatattggccactgaggtcacttactgcaggaacaatataatggacgtctttcataacattatgaagacccatggaaaacttttcttaatattagaaatagttgtgttggtactgaacaatcaacggttgttattgtttttatctgaccaggcttttctctttgaattagcttctagttgagacaatctgtactgactctagttcagaccttgttccctgtctctgtgtatttccttttttctcgttacaaatttctaatttatgttttcctgctatatttaggtaagttaccttaaattcattctttaaaaaaaaggtagaagtaagtatataaaaaccttccatggttgttacatatgtaacaagcactattcctgtgtcatttgtgtgagggtatgtgtgtgttttaatggtgagagttaacaaattatgtaagaaacactgacattggaaaactgattttaaaaaaacaacttgcaaaatttcatcaaatgagtcttgtttcttgcattgaacagatcataaaagcaattcataaaaaggcaaatatagtgattcttacatcacccatttagttaaagtatcccaaatgctatagcataaggaagtacatgtgctaggcagcctttgagttaatgaactgatgttgatgttaaaactgg

SEQ ID NO: 8063 - DNA, 1742 bp, artificial
  synthetic oligonucleotide
accaagtcttaaataagccaagtaacttacccagaatcatatagccacagaaccgagatttgaattcatacattatgacagagtcagataagctagccatcctgcccctacctccagttccagaatcagtgattggctttggtcttactcagcactgtcagttacagaaattggtgtcatcagattatctgtctgcctaccacctctggagcatggcaattacagcatcattgatttcgattgtcctaaaatggaggaaaacttgctgctggcaaaaggaagacccataatcattcatcagctcaataggcttgaatggctaaagtgctcacagccatcttcctgtctcactaattgctgccatttaaagataaagggggaagaaactaccctttacttcagtttacaaaacccaccgaagttaagatataccaaaggatgtatccaagaacccagaacttctggatggaaggttctggaattgaatcctcatgccctgcagtataacctccatacacccacatggcttgggcctcttagttttgcttggctgctactacttttaagtaaaaaaataaaaattggttatgcagttttcagaatgtctttcatttcaaatacattcttaatccatcaaaagggacattctaaataaagacttgtctctacatgatgtgttaatgaagaatggcaggggcaagtaaaacaaaacaaaaagctatgtagtgaggttctttcaagccaaaccacagctgtttgaagaatgacaatatgatatcatgcaactgccactatccctcattaattgattttacagatttttaggtattcactgatgtgtcttgtacttatggctgaaaatgcacactaacaatctgtagcaatgttacaacacagatagcatattgtcaaatgctgccatggatgaaaacttctcatttgctgtggatctgttaagataaacctcttgagaattacagatacatttattattggcattttcaaaatggcaaagacatctgttgctaaaagtctctgactggaaaggatttgggaccaagggtaaggttagctaacacttcttaaactagacaagtatgaacagtgaacatctgaaactacctgtgaccacagagcccaagtaatgtttaatggaggcatacatctttaaccattcaatataaattcaacctttttttttttttgagatggagtctcacactgtcgcctgcattggagtacagtggtgtgatctcagctcactgcaacctctgcctcctgggttcaagcgatcctcctgcctcagcctcctaaattcaacctttttttaaagttttcctcattaactgaattgggcacttccccccctataatctcttacataatttgttttaattcttttgacgtatgcattacataccacccttgtattggaactatgtatgtatctctttttcattcactcccctttccttccctgtcccattccttaagagaactgttatcttccatgagggaagcactcctgcaacttttacgtgtatgtgtgtttgtcaccatcttctaccacgtattaatgtcacatattaatgtgccagcccatattagtgtctcattctatgaatgaatgaataaattaatgaagaatgaattatgtatgtaatgtagttcaacttactacataacaccaagtaaactaaaccatccaagataagtttttgaatcaaagccaccatcctact

SEQ ID NO: 8064 - DNA, 2376 bp, artificial
  synthetic oligonucleotide
ggattcctctactcttagttggttctgaatcatcaagatagacactgaattttatcaagtgctttcaatagacttttaatatttttaacatgaaatgtgcctttttcatgtcgttttctggagtaacatttatactagttttacaaaataagttaggaattcatctttttagtgctttgcagtaattttattggctttagaatctttcatttctggaaactttccaagtgtttattggtaaaattattgaagcctggggcttttcttagaggaacttcttcaccagtgtttttaattcccaatatgtattttaaaaatcctagaataaatccatgcaaagtatttaattcttttttttttttttctttattgagacagagtcttgctctgtctgccagactggagtgcagtggcgggatctcgcctcactgcaagctctgcctcctgggttcacaccattctcctgcttcagccccctgagtagctgggactacaggtgcctgccaccacgcccggctaattttttgtattttgtttgtttgtttttagtagagacagggtttcatcgtgttagctacccacagtagctgggactgctaattttttgtatttgtttgtttgtttgtttgtttttagtaggacggggtttcaccgtgttagccaggtcgatctcctgaccttgtgatctgcccgcctcggcctcccaaagtgctgggattacaggcttgagccactgattatcaatttgcctttccaatgttaaatctccaataatttttaaaggaagtattgttatagtgagagacagacacctatgacacatccatggagcagaataatgaatgcaaaaacagcaatgaatttagatccaaatgtaacatattaaaaagatttcatttcaaataagggcaaaaatagtttatttttcaaatgatgtttgtaattatgataccatttagaaagaaaaaagttaggtacctactatatagcatacacctaagttaactttaggcgggttaaaaatgttaatgtaggaaggcagaaggcggagaattgcttgaacccaggagtcagagctgcaatgagccaggatcgcaccactgcactccagcttgggtgacagagcgagactccttcttaaaaaaaaaatgttaatataaaaataaagttgcaaaagtactagagaaaatgttacatgaacattaatatagcattggagtgaaaaaaatgctttaaagttataaaccataaaggaagaaaggcatactggaaaatgactaatgaatttaactatatcataacatttaaaggttgttcttaaatatttgaactactacccaagaatgcccaaagcccgtggtggaaattctaatttttattgtgatatgtttgtcatatttaaatgataggtttttgttttaacattccaaaatgcagctcccttttctgcctttgactgccttctatagaaattcccccagctgccaggccaaatttctcatccagattcaggtactcttattgactatccaatagggcattgatgctgccaagttcgcattaactctcttattagcttcgagaagacttgagacagaagctatcaacacttcttcattggcatctatgtggctgtgaaagatggtcacattttagtcaaaagacataatcctgtccagttatatttgaagagaatcatagctaaagaacacatgccatcttccactcctgtttttacagtgttcacaaatataaaatagttactaacttcttatactctttccacctgtaacataaagatggaattctgcagaaattgagaaagagggcaaaaacgcggattttctgagataatttaaaacagttaagaatctgcagccaataagaatttaactcacaaaggcagagcaattgaaactgtttccggccatcagtacacaaatagcaagccaagcttcataattctgtgtttaaatgcaagagttatttaaaacaatttggttttagtttattttcttacatctcttaattactgctggaaaatattgtcaaggttgggaagttcttttaatcaaagtctagaatattaaattttagaatctatagaggtagaaacatcacaaccatttatttacttttatctttgaataagcattgggaattatgattcctttagttttcttacctgcaaaaacctgtatgttcttcatctaattcaccaaaagtctattattctcaaaattctattattttgagaaataatagaatcaatacaggtcaatttttaaaatgtgtgcaggactcagaaccattaatgtgctaatgtgcattctgatgttccaaggggcattcataacatccagcctgtcctataaa

SEQ ID NO: 8065 - DNA, 1192 bp, artificial
  synthetic oligonucleotide
tcctgcatttaattctttcatgtttatggagagggaggtggggtggagagggagactgagagagaactttcaccttctatatgtgataatatgtttaaatgtaattaactgttctgcttttgccgttaaaatgttattttgcattcccatcgtattgattttaaattgaaactcaatgcttttgcaaagacagtcttggggttataaaatgataggttttattgcaaagagaggaatatttatctgaacagatacatgagtgtttccataaagaatgggcctattttactttatcagcaactaaggggaaggttaatggctatgatgtatcttttctgttgtgtgtgaaacatgcagtgttcttgctgttgagatttatggtgtggaggacaaagcaggtgctattccaagccttctttcaacagcggagtataaactagggcctgaacttatctgtcaaaaagtaagttaaaataacgttagagaaagcctagaatttcacacttttccataccttcctgtctctagctcaggaatttaggcagggtgattaatgaccactgttatttgtgagctttccaagtccctacagacataatgaacttgacttttcagccacgtagaaggaaacaggctgttagagctctacaacatgacatgttcataattatgagctctctgcaattgggaagaaagaggaagaaaagagaataatcttctcatgtcccatagtctcaacttcaaacatcctctactccctctctttcttctttccccatcttcttcccgcctacacacacactcacacacacagaatgtatctatacttttattaatccagaaacaaagtctgactctacttaatcttgcctcttatttttccttcatatcaagcaagcaaatcatgcttactgatttctttgtcagaatatcgtatggatttgtccttccctctgttctattcaccctgtcgtcttgtgtttatgctagcccaatccctgagttaatttaggctccaggcactgtatgctttttgaggtaatacaacctcttcattttcctgtgtcttttattttaaccccagcagtttattttcttgcttttcaaaatcttttttattctgaccccacctccaaagattgtatatgctccctctttttgttatcgctaatgtaaatatctcttatccttt

SEQ ID NO: 8066 - DNA, 1156 bp, artificial
  synthetic oligonucleotide
tatttttgcatattggtaggaatttagcagtggaataaatttctagtagccaagttccttgggcaaaaggtatgtgcagtttgtttctagatatttccaaattattcccccaatttttacactatttgatgcagcataaatttgcttctttgctctttaagtgcaagttttaatttttccattttatttttctttctggattttttctcatttcttggcatctcaaaatgttctccttttgtgagacctaggtcttctcttacatcctatttgggtaagcaagtagtcttgaaataatttccataattcttttttttctctaaggtttgggatcagagtcacagtttatggttttgaagtagttttttaattgcgtacatgcatgtgtgaatttttcttttgactatttctggaatatacaccttagtttagttctcactaaagataacttgtttgtcttgttcttggctttgtatactctccacttgtgtagaattgtaaaagaatgttatacacacacacacatagacacaaagctcaatctcatattacattagctcagaagtcaaagtcctttaagaaatgggtgaaatggtggtaaacaatttatttttcatccatacttaggaaatgctcattccccatactacaggttgaaaaagaacttcaaatttctcttttaaacatcccatataatagaattgaaccttaatagtaagataattattaatgtgcatatgagtaagtttattatttaatatccttaaattagcacctgcatttcaaggtacagaatttgggttaggttccagtttgatcatttatttaagaacatgttgagcttatagaaggaaagtgagccttttttctctctcagaagacaggcaacaacattaaaggtctgaaaaaaatgctttttgcataaaatagtttacttaattgaacagttttttgctccccttaattcagttcttttacctagtagagaaaataaaccttaggaattaagttatagtctctaaggacagcttcaaaacttcacaactcattgaactggcataatatcagagagacttgcacttgattttattttaaatcctctagttctttgcctataagattggcattgatttcagcgtagctttcaaatgggccc

SEQ ID NO: 8067 - DNA, 797 bp, artificial
  synthetic oligonucleotide
gagccagtgagacaattataagtaataacgggaagaacaataccagagtaaaatcaaataggaagaaagtggtaggcgtatttacactaatagaaatagagttcgtcagttagtggaaactggtgacaacagcagagaaaactctggagagctataaactgcgtgaaatcaagtgcattggaagttacagaaaatacgcaagaacaatgggaaaagaactccaggaagtgtaggggaggggcagcgtggagaagaaaggatgtgacgtcactgagataaccagctcggctgttagcaactctgttagcaacgctgtttgtctttctcggaaacaacaggtgagaattccccttacagacctgcccatgctttctaaagtggctctcccaaacctacctttgtcctaactcagttgtctgtgattctcaatatagtaacgataagcctcttggaatatggaggccgctgcggacggcccggctgagacccaaagcccggtggaaaaagacagcccggcgaagacccaaagcccagcccaagacacctcaatcatgtcgagaaataacgcagatacaggcagagttcttgccttaccagagcacaagaagaagcgcaagggaaacttgccagccgagtccgttaagatcctccgcgactggatgtataagcatcggtttaaggcctacccttcagaagaagagaagcaaatgctgtcagagaagaccaatttgtctttgttgcagatttctaactggtttatcaatgctcgcagacgcattctcccggatatgcttcaa

SEQ ID NO: 8068 - DNA, 2168 bp, artificial
  synthetic oligonucleotide
actttgtgtgtttgagaagcatgagagcagagctagaaacatggggcagttggaaaatgcaaatttaatataaatgcaaatattaaaatgtctcaaaaatctatattaagtgattttaatgtaaattcctattctagaaaacgtcattgttgtaaaaattttctgctctaaagacctgagaaaactcaagaatctgtctcaaattcagttttattttaattttgtaattatttgagaagaatggtaataagatgctgtgctaagctaagcagaagttctgagacctttctctcttcagtttatgaatgcagttgtcacgtaattatataataccttctaaaccaaatgtgttttctatattataatgtaaaaatgacaaggcaggtactgggattttgcagcatgcctgatttgtttacttttctatatgatgtgaattaacataccttccttcccctagtgtctatattaagatccagatggatggaggcttgtttgtttgtttgatttttggatattaagtgtgcactttgggaaggaataatattattctatccacatactttcatagcttggactgatttcagctgatgtctgttcctgtggcacctttgtttgaaggaagcagatatgtagcttactgaatagtgtcattactcatctccatacatcaagtagaagaggagtgtagttggcatcttttccttgaaagattaatagctcaatcttcatacccagcccaacctataaaaccagcagcaccatggccaggggataaaaatcaatttttgatgtttgattttacgtattaaccaagaggacttcttatctttcttcttttgtcttatcatttaattctcttttgattctttattttattcatctttttgaaaggtcagtaaacatgactcaaaacccaatgcttttcatgtgtcttttactagaatattatttttagttcactgtgaccactagaaaaccagaactagatattttaataattaggaacatatacaatattatattacacagagaaatattgatttttaatggcatgttaattttgtagagtgtttactttagattaacacatatggtcattccataaaagtagatattgttttctcattaacagaactaatttgaaagcaataggaggtcttattacacaagctggaaatgcattatttttatcacattggcttacagtcccatcgctgttaatttaaggaacagattaaatataataaggcaggccgggcgcgttggctcacgcctgtaatcccagcactttgggaggccgaggcgggcagatcacgaggtcaggagatcgagaccatcctggctaacacagtgaaaccccgtctctactaaaaatacaaaaaaattagccgggcgtggtggcgggtgcttgtagtcccagctacttgggaggctgaggcaggagaatggcgtgaacccgggaggtggagctcgcagtgagtcgagatcacgccactgcactccagcctgggcgacagagcaagactccatctcaaaaaaaaaaaaaaaaaaaaaaaaaaaaaatatatatatatatatatatatatatatatatataaaaaataaggcaattatatcattataacattcttgattgaaatattaaaatgcaactttataacattttgttttaaatatcacttcagatatgtacaatatgtatgacaactaaggactatatctggtctctcaggtaaagtcctaaagttgtgcctacatttagaatgaagacttttaatatctatggaagcacatattcagcattcgttacacaatagattttatcctgggacaatttcatacctattttttttagtttttataagtagcacttgatgaaagaggctaagatgaccaatattaccaatccccgtcaagcatgtgaaatattatagcaattcagtaagtaaacatctcggttgctgtcatttttagaattctgaaaaaaaatcccccacatgtaaagcaaacgcttgcttggagaatctttgtatctcaaccagttgaggaaatttagctttacattcttgtttgttggtccctttcttcattccttcctcccttctttccctttttgttctttccttccttccttcctttcttcctcccttccttcttctctgcta

SEQ ID NO: 8069 - DNA, 1006 bp, artificial
  synthetic oligonucleotide
aagccttttcctagccactattcccctaagatgggtagtttctctgctttgccaaatctgagagaaagacctagtgtctcaaaatacatttagttgctcctgttgatgataatgttatggaaatggactttttctatgcacctttgcagttccactgatctcttgtttagcagccttgacagtgtctttatattgttgttcacatggtttctgattaaaaccccatgatactaagctctgactagaatacgaaatctaacccgaattagtttatcatgatttcttttgtttaatttcctttttaacattttattgaacattgacaattatacttgtatatatttatcaggtacagagtgatactattatgtgtgtgtgtgtgtgtatatatatatatatatatatatatatatatatatatatatatagaatgtggaaagattgaatcaagctaattagcgtattgctcatcttaaatacttaccttgcttaaactgtaaaaaatactttatcttaaagcatttattgactaacttgattttaataaatgaatgtagtattaagtaaattaaaaaagaaattaaaacttgactttcataaagatataaaatgaacttttgtcaaagttttatttacatcactaattaatgagggaactagacaagatgttacacctgacttgatggagttgtcaaagaaccacaaatttatatgcaataaaggaatattgaactcaattgaacacagcatgtctatccatagaacaataatcaattgcattctaccagacacaattaataagcatttccatggataagaattgtttgcattgctattagctttctagatgttcactgtatctttacagagatataaaatagcttattcaaaagcaaagttacacatataagatcagataattcccagaggctccacctttccatggaaaggatagctaataatctctcttgcttgtttcagattctcaaatgtttccttaaagtag

SEQ ID NO: 8070 - DNA, 251 bp, artificial
  synthetic oligonucleotide
tggatttagggtacaccctaatctgttatgaccccatcttaacttgattttatctgcagagccactctttccaagatcacatatataggtactcagagttagaatttcaacatatctttttagaggacaattcaacctgcaacagtcccctaccttaaactacaaatggctttttactacaaatacaataaaatacaaaatacttactctgttaataagcctttacatgaattggcctcagcctattcttt

SEQ ID NO: 8071 - DNA, 1258 bp, artificial
  synthetic oligonucleotide
tctcagctccattccttgcagtatttgactctcgctacccaggaaaccagagaacattcttcctagtttcacttcattttcttgccttctcatataggccactgccaatcagctgcctcatttaaatcctgcagtgtatgtttatattggtcttaccttgtcctttcttcctaaataaacctggggagctttggtcatgttcatttttcaacaaacctgactaggtattctaatttcgtaaattaaccatcattcttgttttattccactggaaattgacttaacatattattcactttggcccaatctgccaggcaggcatgaggatattgctttctaagctaccttctaattgaagaaatatgaagatttcacaggtcaacacataggcagtgtgaactggggagcttttagcatattaattgggctctgaataattcactatagttaatgaaagttgtgcttgttatctaagatatatggagggcactgctgtacctttcgtaggacaattcaaaaaaacaaaataaaacattaatgtaaaatagataagcaatgcataaatgggttgcagctcatattataagagttttgaattcattttatttcattcccatacttctcaaccaatccagctacacccacatcttatttaattgacagatttggactgtcttgctggctaggaggataaaggcaacaaactttctgactgatcctggattttcctcaagagcaagtttccttagttattggtgtgtcctctgggtatcctgcttcctgaattccacctttgatcctcctggttcttaaccatccatgttgtcttcagagtctgcttgtctgctcattcctgttaatttttttttaacttgatcttcaattgtgagtcttctcacttcctgcctgttctaacttgggctcaaccttgaccccagtcttcagctctgcaggtgggagatgtatggaataactgaagtactccacacggtgttcctgcttataacacaaaagccattgtcatttgacaaacagatgataaagaatctattgttattatttttactttttacctcattattactagtattagaaaatgctttactaagcttttgccaaatattagaccgtgtgctgggagttctacgtgtcatatctcttttaagcctcacatcatttacagaggaggcactgagaggctgtgttgcctcccctggccacatacttattaaatgaaggggtaagaatttgaatcctg

SEQ ID NO: 8072 - DNA, 1231 bp, artificial
  synthetic oligonucleotide
aatagaattatatgcattataggagtaagggatgccccattatgtgattttaaacaaggaatttgcaaaccagagaaatgaagtgaagtttccaagatcttacaatttgttggctctctcatgatgcatgatttcagttccttcatataagccctcagctgggtgttctagttatatagcaatatgtcctggcatacagcattattttttattagtacagctaatgttggcatatcgaatcctttggcctctagcttactttaccgatttgtgatcagtcgtctgacttctgcactcagaatctgtggactttatttttcctttacgcacacctgatttttgacctcatttgatccctggagacacaatacaaaggagagttgagaacataggtcactggtgggtcttcttgtcttttccatactgtgcttttcccattagctttgtatctttccacctgcagggaattgctcttctttggagcctctccactttctggactttcctgaacatccctggccatctttgtctcagtgctgcatgctaccttcttgcttccaggggattccactaaggggtcctatcaaaatatcttctagctacactttatcccactttgacgatattgaatttcatatttcatttcttcatcaacagggtcagtctgcttacataaacaatagtgaaccaattttggaataatgaagacagtaatattttatcaagtttgccaagctacaatcatataactactactaaatgaacaagatacagctggtgtgtgtgtgtgtatcctcatatcctaatgactgcattaatatgtgtatccacacacatacatgatttttgttgaaatgtttgacaaatgaatcatcgttaatatgctaaagaggaaagtttggaataacaggctttatccctttgtattataatagtgacatttctagaaaagatgccattaacttctgaccccgaaaaatagcttgaaaggactgcattttagatgataaggtggagacagggctgtggaggacatacttttgttcaggctgaatcccgcagtgccctctagagttactgggtagggagctggtagcatacctgtatgaagaaatgacactggctatgaacactatgatgcttacaacctctctgccaactttatttcagaagagacacagtcaggagagctaaatacagtggtaaaaatggaaaaactgagagagttaga

SEQ ID NO: 8073 - DNA, 1629 bp, artificial
  synthetic oligonucleotide
ataaaatggcgatgactccttacaccactataatattctctgatcagaaaagaaaagaaatgaaaacaaattttaaaagctaaaatgaaacaaagcactcctctctcaaacacatactatgttctaggtactctatggagtatacatactacaacatccccaggaggaggtaatcccattaacttcatttttttacaggaggacattcagactcagaaaaggtaaggaattttctcaaggccatatggtgataggattcaaaccagatcatattatatcagatatctccattatgtcctcaacttatctttttaaataaaaggctgacaggcgatatggctgagtcatgccagaaaagaactcctaaaacttcctagctatgtaagcttgaataactatgtcactttcctgggtgagactcaatttcctctgtctaaaataaagagattattcaaggttgtctctagagcccccttcaaaaactgattctatgattttaaacacttttgagttctactaccagaaccaatgttatttccttctaggtacaagaaaattggcctacttagatgttgctctttattactggtcttcactcttttgtgatttttatcttgctttatcgataaacctcaaggtcaccgaaataacaccttctctgttcagtcttccctgattcttttaggctgaattcagatctctcctagagtacttaccacagcatgtattacatgtgctgtttgtgggtcactctattgctagacatgagctccttaaagacaaggactgtgccttacacatccctagagcctcaacaccctgcactgtctgtcacatagcatgtaattaataaatgatagacaaatgaataggtgaacaaatattactatctccagtcacataggctgaatatttgaaagccagaagtgggacctctatgattatttctagttaccctctatctttcattcccagaaaccaagcaagagtgtgactataagcacagtcccagcctcagctctccacaggagggagagcttggagtataaattgcaccacagagttttttcaaactatagtaaaaagagccagggtttcatacttccacatcagtcagttcttgggtaaggtggaagagggtttcaaattccaggtacttcctgttctcatcacaggcatgacacacagtgctagtagcccaagagcaattgttaaagagggtatgggtgctggcctttagaagcaaactacagagaagagggtgatggctgtgagtacacagagctagtctgggctgaactttcacagcccctgccttaccttcttttcccaatctattttcctctgaaaaatattattaatctaggtaatttgagtgatactgaaatttgattccatattttatacttggaaacattagctcacactgttctcttccttcatcaaacctattttatacgctgtaattaccgtgaaatgccctgaatcatttcagaggaagtgatcttccatatatttacatcaataccgtttcatttattttcccaaacccagaagagtatgaattctgccctaccacccccaaagcattcaatgcaggaaatattattattttacctgcttcaacca

SEQ ID NO: 8074 - DNA, 481 bp, artificial
  synthetic oligonucleotide
aatcatgtcaatgggatattcagtaactattaaaattatagaaaaattaaaattaaaattagaaagatcatgcaatgaaatggtgaatatttttgagactattataaagggaaaaataggactcagaattttttatccattatgatcactgctatatggaacagatgatactataattgaagggaaaattgtaggaaatgaactaaagtgattgaatgtgttaaatggtagaactactagtgtttttataagaagaatataaatgaaagtattataaaataaagagggagaaaaataaatgctctcagagaggagtgcgtgtgatttccaccttattgcattatcctctctgaagaccaaaaggtaaatcccacttctctgttgtgacaggcactgctaattacctatccattctccccctttaacttactaaaagaacttccttttgtttgggagttggggtgggcaatgtgtccaagac

SEQ ID NO: 8075 - DNA, 1595 bp, artificial
  synthetic oligonucleotide
aacttgttttttaaaaatattgtggtaaaatatacataacatgaaattcaccatttttagttatgtaattcagtagcattgttacattcacaatgttatgtaaccatcaccatcatctgtttcctgaactttttcatcatcccaaaaagaaactctgtaaccattaagtaataattgcttggccgggcacggggctcacgcctgtaatcccaacacttagggaggtcgaggcaagtggattgcctgaggtgaggagttcaagaccggcctggccaacatggtgaaagccagtctctcctaaaatacacaaaaattagccgggtgtggtgacgcgtgcatgtagtcccaggtactcgggaggctgaagcaggagaattgctcaaacctgggaggtggaggttgcagtgagccgagatcacgccattgcactccagcctttgcaacaagagtgaaactccatctcataataataataattgcttatcccctcctcccacattcctggtggcctctattctactttctagtctttatgaatttgccaattataggtacctcacataagaggaatctcacaaaatttgtccttctgtgtttgccttatttcactttgcatgatgttttcaaggtttatctattgtagcatgtatcacaattctttttgttttttccaggatggggtctcactctgtcttccaggctagagtgcagtgacatgatcatatttcactctcgcctccacctcccaggctcaaatgatcctcccagttcagcatcccaagtagctggaacaacaggcacataccatgtccaactaattaaaaaaaaaattatatacacggggtctcactgtgttgcccatgctggtctcgaactgctggtctcaagaaatcctcctgccttagccttccaaagtgctaggattacaggcatgagccaccacctccagccccagaattctttttagagctgaataatattctctataccacattttgtttatccattcatctggtgacagacacttgggttatttccaccttttggctgttgtaaataattctgttatgaacattgatgtacaagcatcaaatttgtttttaaggtaaagttcctgataggctgtgagggaaaagtctattgccttcatctttaactaatggcgacaacaaatatctaccttaaagaacttaaagtttggtatgaacaaatggacttttgtcaggtcataatgctcagtttcctcatctgtaaaatggtgatactgatagtacctacctcacaggttgttaggaggattaaatgagttaatacatataaagtgcttacaaatgtgtcaggttgagtgcagtggctcatacctgtaatactgacactttgggaggtgagaggatcccttgaagccaggaattccagtgagactagcctgggcaacatagtgagaccctgtctccataaaaaaagagaaaggaaatgtcagtcacagtgtaagcattaaacaaatgtagctctttctatcattagtatcatcattctttatcttttagggacacattatcttgctgttactgtaagtataattttaccatccccat

SEQ ID NO: 8076 - DNA, 368 bp, artificial
  synthetic oligonucleotide
ctacagacaaatgaagtatgcatattttaccaagagaacggaactgctgtgtggatctgaaactttgaatacatttataagtaccatgtcctttgcctgaaatatcctttcctcatgtacactcaccttcatcctgcaagcctcagttcaatgtatcctcctctgtaaaggggtttactcatcctcccaaacattggtgacctatcttcatggttttatggaaacaataggcatgtgattcagagtcagaatgacattggtttgaaatatgactccaccttacaactggtgtgtacttgagcaaagtaaactttttgagccccaatttcttcttctgagatttgtgagtacaaaataccaagccaaca

SEQ ID NO: 8077 - DNA, 871 bp, artificial
  synthetic oligonucleotide
atcactaccttttccttagattcctttttcagggccaatattttcatgccttaaattgagaggatgattaataagacatgttattttcccttacaaacccatgatgagataatgaggccagccctctgagaccttactcttgatagtgcctcaccaaactgtagtgagggttttatctaaaattttgtttgtatctcaaagaattgtttattgaaaatatacttttaaagccaatgctttaaaatttggacttacacttctataaatggcaaacttggtgataatgaccaattctcacattctgaacagctaataaaggttttaaatgccttcttcaaaacatcaatgagatagcatgatagtcaagaaaatctaagagaaagcaaaaacccagaaaggtaaactgagctcacaaaactacttttgctctgaaggtgtttcctgaaatggaagaaacagctgagaaacaaagctacagttttgtttagcctcactgggctacagaaaaaaagtctagggccttcctaatgtagggactctgttaatcctttcattgaaaactgaaataacaaagtcctactccctaatgataatggtaagctagatttgccattggtaatctggggctctgacagcttggataaaatgatattagatgctcctggcagaaaaaaacaaagttcctcttagagaatcaccattatagttcacagacttttttccacaaatatttttgtaacaaaaattagtgtccagtactggttccaggtccagtatataaggggggcttagacatcttcactgtgtcctaacaggtaaaaggttgagcaaactgaaaaataaacaactcttcttaaaccacctgagaagt

SEQ ID NO: 8078 - DNA, 1531 bp, artificial
  synthetic oligonucleotide
taacagagctcttccctctttctctatgttcctacagcattttttcacattatttttatggtatattacttggaaccgaaatagtttatttgtatgactctcctaatagacttatatactgacagcaaggaacttgtcttaatttatctttgtatattcaggatatagatcaacaattgatacacgttaagcctcaaaaatgtggaattaattcatctctacgttgcctcagttatcattttgaatacccaaatctgtaaaatgttgaataaattgaaccgaatctttatttcccaaacattttttcgatcagtgatgagaaatgatgttagatttattctacctctgttgggcagctagtgtctctagagcactacttgaaatgccacatcttgatgaggagaaggcagaatgtgctttgtttaattagtcatacgtgttactggtataagaaggttgatagttggatttgtgttatcaatttgccacccccagtcttatttgtattcctatatttgtgatatcaatttctttcataccatgtctgcttcttcatggaagtcaaatgcaagggacattagagaatgaaaatatacagctaagaatttctaatttaatattttttaatatgaatgttgctaatgtacaaattctgcttatgttgtaaagcatgctcaaaatgtagtctacaatcaaatcatgctatagagatttctgttctcacatgattgatctctttaacatcgtaaaattctaaataatttgttaccaagtgacgatttgtgaaaacagatggtatgttaaagtaataatgtcttatattcttaattttcaaaaggcaaaagtgaggaaagaaaaccaagtagaaaccaagaaactgatgtgaagagaaaaagcatgacatgcccacagattagtaactttttatagtcatttaaatgccagaagggatggataaattattaataagtactcaaaattccttatctataggtttttcagtttacactcccttgattcactgcctaaagggagtttgatagcaagagtaagatccctaaatctatagccacacagtactttccacagataacttatgcgctccttgtgggtaatatggacatcaatagaagtctcaaaagactacctcttgttagtgattttgatttctatccacttgtttcacagtctaagttgacaacaaaatgttatcttgtcaggaatatttagaatgtgtctttacatataatactttcttttctttcttgcctttaatgtacagttatagaaaatggggacagtctttaaaaacaatgtctctagttatgaaaaagtaaatggaaggttatttaacaacattcataaattttggactatgtattaaaataatatgccttctgagtgaggaaatatttgtaatggaaagattaaattaggctccttttctttcatttccccaagtagtatattaattttgaaatacgttcaacttttagtcatatggtatttattagccatttattaagcacaa

SEQ ID NO: 8079 - DNA, 247 bp, artificial
  synthetic oligonucleotide
cctgtgtaaagggcattgaattaagtggctgaaaactcccatttgtttgacgtgctctccagggagctagttatattacagcttggaaatgtgatctggcaggtagttgctgagcaacaaagactggaattagctgtggatgaaacaaaacttccataaaactttattaaagactccttggagtatatagtgtatttatcatgagattggattgtagtttaaaatggcaataatttagattgtggta

SEQ ID NO: 8080 - DNA, 870 bp, artificial
  synthetic oligonucleotide
ctgtagccacataaactcagggaaccaggtaaagagataaggaaaacgaggacaggagttaagagagagcttcacaatggtagtgaatattgaattatactttaagtacaaatataagtcagtcctccattatctcaatgagaaaaacacgcacacatgcatacattcatgtataagtatttcagtcaatttaaatgtaaaaccttaaagatagaaaagtcaaatatttatattttaattttattaagttgcatgtatttaggtatcataaataattttgagatatttctgtattccactcacatttaatgacatacttatcttaaaatgcttcaactctaactccaacatcaatgtcctctcatctccttgatcccttttctgtattctccaacacaattttctaaagcatatattcaccatttcagtctaagttatttgagacacaacacatttttgaatttactgaaaataaacatctttattgaaggtgttctatttgaatattacagagaaaaaacatttttcattggtatacatttgtgacttgtacaaaataaccttccaacaattctttctaaaataatcttggaaagacttgttttcagtgacattttccaacttaaatattgatgcgtgagaactggtttctaatgttttttgtggtggagaggggtgaggggactgctaagtcagcattttctaaagttaaggagtactgtaaaatgttcatggtctaaaagttttgcgtcatgttaatttaagctttttggaaactttatttgctgatatgcagtgtgaatgttcaggaagaagatataataagtaatatttctttttttaaaattacataaccttttttttggttct

SEQ ID NO: 8081 - DNA, 1200 bp, artificial
  synthetic oligonucleotide
gacaacttgtttcttttgttacagaaatctacatataaaggtgtatcttgcccaactgctgtacttaacaactaccccagagcctcttcatctacagatggacctgatttagatagtgcaatttgaatttggagctgatgctgtaatgagaacagagttttggggatctttggaagggatgtatgtattttgcataaggtagagacaggaaacaatgggttctacagggcagactgcaacagaaaaaaaaccttatgggtccccagaaagtcccaccttctggtggtcatgacttgtgtactcctaactttaatgtaggtggggcatatgattttatgctaaaaaatagattatgacaaaggtgatgggatatcactcaagcaattacattagaagtcagagtagagatgacactcatctaataacagatacgatgtaagacactattttgctgtcagataggctcttgctatcctgcttgtcttgaagaagaaacctgccatgttttgaatggcctgtaaagagggaaatgtggcatgacattgcaggctttggttaggactgaggttggtctctaagcaagagcttaaaaaacactcttagtcctatagacaagaggaaatgaattatgcaaaaaaaaaaaaaaaaagcgagtttgacagtggatattttcttgtccactttcagtttccagtccaacatgtaaggagcttagacatgtgtcacttccaacctaccaatcagaaaaaagttgaacaaactgaaaatcaaccacctttcttagaccaatcagttaactgaggtcacagagcaaatggctgtccccacaaaaggaagacagactagaagatacagagaatccacagctcactggaacagaaccccaggagcagaaaccactgctagagctggtaccaggataggaaaatgtaagttatgtttgacaagttactgaatcttcagtgtagactagcttcacagttaaaaactctactggggcccagtatattagggggccttcttactcttttgagtttttcctccagtggtcctaataggttctcacagtgaagagtggagatcagataaaaatgcccttgtcctttcagcagggggaggaaaaaagccattttgaaatgtgcccagagcaacctgttccttataacaaggcctgcttaaagataaacctatttaccagag

SEQ ID NO: 8082 - DNA, 1143 bp, artificial
  synthetic oligonucleotide
agtatctcaagagttaggcagtttttcttttatagagagaaataaacaaagctagaaagaaccaggtgtgtgaggaagtgggatgaaaggctgttgtgacttgatagttgattagagaatttttaccgaggccaatccatgctcaagaggggttgcatactggcttagccgagagtgggccaaagttcaggagcgttgaggaaaaagaaaatcctaaccaaagtttggccaacaagtattttgtttcgattgattagtagaaacaaggagtttatttatcatgtacaaggaaaagaaagggaatattgaggatctttggccttgtcatcggtaaaccagagaggcttccatgagtcttgtctaagtcacgtggtgaagagtggttctttccaataaacctttttctgctagaatacaaagttgggggctcaagggggaaaagaaagcttcttaaccttcactgtttcccaagatcacagggcttaggtaaacatcaacattatcatataagaaagaaaaacaagttttcttgagtaatcattaaactggaatgtgatgcacatcataggcaatccactaaagagataccaaagacagaaagcaatatccaccttttatatagccaagccgatacaatctgttaaatacatattcttcatataaagataattagtcctcaaggaagagaacttgatggcaccatttgtcacacagagtcctttctaaattcacttaaaaattaaggtggccttctgtgttggctaattgttttcatcaaaagggaaaacaatcctgagctataaaactggcaagtggcttatttagcttataaaagaaaatattttatatttatagtttctctgaagtaaatgctctaagaaaaaagggtagggaaaatcctcactcctttttctacaccaggagagaggaattaaaacaaagtcaaagtatcagttttgtattgctctttagtttctgaggctaccagcaaatcatcgaagtattaaacaattagagagtcccctaatgggacaaattactctaagttttcctgtaaatggctagagaaaattgtaggagagtcctaaagttcttgaggaatcctttgccataaatactggacttctgtataagcaaacacaa

SEQ ID NO: 8083 - DNA, 1685 bp, artificial
  synthetic oligonucleotide
tgataaagatttttctcatgaaagatggtgtgttattttcctgaattgaaaaaattgacttctcagttggaagtcaatgacatttgggcccatttcttaaaggattctaagattaaatcttctaagtagatttatttctttacagataaaacaaataagaacatgctatcacgtctcccaggattcagttttgtgggtctattaggcaattattaatggattaggaaaaaggaaagctaagtaaactcttcaacttatattaccactttttgtaaagataccaagcagattcaaaggcactccagaagtgtctacatactttgaagggctgaaaggggacaggatgatacaagtgaagtaaaacattttcaaatgcaaaagaaaaatagggggctgagagataaaaagaaatcaaagatgagaagtaagggacaaacaggaacagctaatgtttccgattacattattaaaagtgagtttatgtatgtcacatagaaaattttaaatttgttcctttattcttggagagcaataaaacattgccttacgtgtattatgatcataaacagtctaaattttcaacagagtaataatctccgtttcatgtaggaaaatcttattttacattattcatcaataaaatatctcagatatgggaaatatcattttacataaaatgaacaaaaggtatttaaaacatatacattctattatttaagcacagtgaggaaccctggtgaggaaaggtggaaaagggtggaggggcaagatatgtcatctgaaaatgcagtctctagaccaattctttggtaatgatgctagaagtaagggacagtaggaaagtcttgaccttagagtgtagaaaaaagtttgcgcctgtgtgggagagttgctcggggtcttttgggagataagagtcatggcatttttgtgtgatgcttagtggtaccagagattctctttcagtacatcccagagaaagttgttctcaactctaagagagatccaggttcttctcttgggagcttcataaaacagctgtcaagttcacagagagaaaaaggtcgcaaaagttggttcctgaacaacaggtgcttgctgcggccacagcagaatcgttagcagccaatttaagcagttttagtgggcccattggaatagatctaacagactctgagatgaaaacaaagccccctttggaagacagatttaaaatatgcacacacgcattcacatgtgtgtgtatgggggatatctatatatgtatctatatacacacacacacgtatatatagaagatacagaaggggtttgtgtgtgtatatatcttcttccttttcttctctttaaaacaaacagaggaattccattttcagctaagaaggaataaggggcaggatttaacctcctgcctgaaacaataacagtaaaaaggaaaaataaaataaatgaactcctgaacatcaggcaatgaagggcacagatctctgggagataagaaacaaataaggagaaccatatgataaatccagcttactgcctgcagaaagtttcctggccatggtgcacgtatgggagtgtaggagtggaaatcaggcaaagtccagtaaactcaccaatttaaggagaaagctgagagtactgggagaccaaggtgactagagattccaggacagaacactaga

SEQ ID NO: 8084 - DNA, 341 bp, artificial
  synthetic oligonucleotide
agaagtcctggtttcatgtcaatactataaatggaatgggcactcagaacttgttaaatgtaattgcaatacataaaccataatgcatgaattttaatagtgtctataaaatatacgtcaattaacacaaattagataattgctacactgaacttctgatgaaccattgggctgcaaaatacagagttttaaaaaatatatacagataaataaaaatttaataatgagagtgctgagtgggaaattaaatgggaatcctgaatgggaagaaataagggaggatttaaaagggcaacctattgtataggagaaagaaatagtataaatattatcttatagaa

SEQ ID NO: 8085 - DNA, 479 bp, artificial
  synthetic oligonucleotide
tttccattcctgaaatgccttttctccacttgacctgcataactcttactctttctttattgatttagcttcagagttatctgttctgggaggttatttttgatcctcacctagccctcaaagcaagagataatatcatttctgtgtaactgtataatactcagtgtttgtatccatttgccctccatcacactatagtgtaatttcctgttgagggattatcttctcattaaaccgataaccccccgaagacaggaatgtgtgttactatcatcattttgattttatcttcactaaaattgatggatcaggcaagataatctccaaaatccttcccagctttaaatttgtactcatataattcttagatttgatattttggaggacatttatgataagttgcataggtattgatagatccaatttgggcatcagtattactatcctatttcagatttggctgtttagacatgcttgtg

SEQ ID NO: 8086 - DNA, 976 bp, artificial
  synthetic oligonucleotide
cctgagcaccaaagtatatgtcaggaataaagctagacatgccacctgatttagatttattttagggcatggcaggggtaagggcagaggcaatgacaaagaaagtgggagagaggtctcattagtgtgtacacatctgctctaagtatgtgagtgagagaagacctgtcttggtggcttcagttcatttacaagacaaaggcaggtgcatcctggcctgtgtcaccatgagaagcatgagaggtaatgaagctctgatacaagcccgaggagagctgggctctgtactttgtgggccaggctcttagaatatgtgtggagatgatatcaatatttacaagactaccaaggtgctgcaagctcatggccacagctgggtctgaagtgggtaccccagtgcagactagtatttcactaaccttactgatgacaaaattcccctgagcacatcttaaaaatatccattcctaggccagactccagacctattgcgttagtatctccaggggagaggcttcagatttatattttgtcatgagcatgttacatggctcttaaggaaaagagaggctaagaataatttgacctcacatacaaaagatttcttagtgtatcagaatgagcaacagtttggagtacggcctaagaagatagctctggagaagactgcctgggtttgaatctgtgcctcagttctacctcctataacatggggccagcagactctacttcttgaggttgttgtgtaaagccctagatgagtatctggcacatgatatgcacttaataaatatcgactatcattgtaattatttttgaacactccaccaggaatgaaaagatgagggaacactcattgaaaagtagcaacagctaccatttgtataggctctttattgctttcaaatgtatgatatttaatacttgagacatataggccatgggaaacccatttagtcagaaaattcagccttct

SEQ ID NO: 8087 - DNA, 376 bp, artificial
  synthetic oligonucleotide
gaaattattttagcagaagcacaaccagtttacaatttacaattgcatctcatgtgtgtgtaacttttttctttcatactgaacttgttagttcacaaacccccatgtctaccaatcaaaagttacttgattacttccagatttaaatgtcagttcaggatttaaactcaatcaattcaatatttttctatgcttcttcactttacctaggggtattataaggtcctgcagaatttatgtggaattcatacattttcctggctgtatcagttatttattgctgtgtaacaagacactacagaactcagtggctttaaataataaacacgaattattgctcacaagttttcagctgggtgtttcttatggtctcagc

SEQ ID NO: 8088 - DNA, 7202 bp, artificial
  synthetic oligonucleotide
ataagttattttaatcatttcaaaagtatgatattttaaaaacttttttattgtggaatttttaaaacttacacaaaaatagataaaataatgtgataaaattcagtctaactgccttaacaatttcccctgtcttgccttttttttcactcattctctccttttctagagtattttaagttttagatattgtgtcatttcaccctttgaatacctcagcatatttctgttacacgtattgatcgctaagtaaaccaccccaatactgagtacatgattcggcaatacggtctggactcagctgtgtggcttatctctgattcacatgatgttatttgggcttactcatgcattttcagttgactgtcaactaaactagactggaagatccaaaatgtctccgctcaaatgtctgacatttgttgatggctgtaggatggagcatcttgatttttttccatatggcctctaaccctctgatatgctagacctggctttttttcacagcaaggtctcagggttccaagagagaaaaaaaagtttcataagcactagccttggaagtcacataccaccacttcctgctgcattctattggtctcagcaagtcacatggccagcccagattctgaggggaggaaatagactctacttctgtatggaagaaggggcaaggtcacattgcacagaggagtgtggggaatgggaggaattgttgttgccatttttacaagcacatctaactgatcttctggcttttaatatcatcatgccactaacagagttaacaaatttaacaatatttcctttttaagattaatttttaaattttgtcatttttaaatttacatacagaaattttttgtgcgtatactttttatgtttcattttttgtggttttcatttgcatttatctgatgaataatgatggtgagcaccttttcatatacctgttggtaatttgtatgtcttttatgtgggctcaggcctggagccttggtccatagaggttaatttggcattggggtggccctggaaccagggtctgtggggaagtgtgtatgtgtatactgctgtgagattcgacaaatgcatagagttctctaacaaccaccatggttagaatacagaaaattccctcagcaaccaaaagtcccttgagcttcccacttgtaatcaaaccctcctccacctcctaacccagtgatccccaaccttttaggcaccagggaccagtttcatggaagatagtttttccaccgaccaaggttgggatggtttcaggataattcaagtgtgttacatttattgtccactttattattgttacgttgtaatatataatgaaataattatacaagtcaccacaatgtggaatctgtgggaggcctgagttttttttttttttttcttgcaactgatcggttccatctaggggtgatgggagacattatcacccaaagtatgttgcttatgtccaatctactctgtaattttgttttagttgctgtcactgcagaaaaccctgcttcacaatgataggaagttggaaatggaagctggcttttcagtacttttgtgacagtcttgggatagtctgccttgactttaatccagaacgtatggagatttgaagttgtctcaaacgtacttttaagggcactgtcatttgcaatctcaagcagttgattctcttctagcatggacaaagtcaattcaccctgctttattcacaaatgggtggcgtatctgttctttcccaatttggggagtctttgtggttggaaagtaatgctcaaactcttttgaaagctgaggtaggtaatcatgcaccagctggaaaaaagaaggccttggtcagtgtctttcaaaatctctactaatgtttgaaacgtgtcagaaatcccaatgttcactcattgtccccataattccagtctggctttgaatgcccccactttatctgctggactggaacatagttgtcattcccctttgaaatgacagattgagttcattgagcaggttgactgtgtcacacaagtaagcaagttttgtgacccattctgtgtcactgaaatgtgctgccagtggtgactgttttcctaaaagaaatctctggagcagctcttgtaactcagaaactctagccagtgagtttagaaacctttagaaagccatttcacttctgtgtacaagagaagacgtgtgctgtgcgtccatctcctcacagagctgcgcaaacagataaaagttaaaggcatgtactttaaagtagttgataattttaatcatatcctgcataacattgttaagttcgggtgacatttttcggctagccagcatttctttatggatgaaccagtgtgtggattcacattcagaagcaacctctttgacttgagtagtgaaaccagaaagccatccagtcatggcagctgttccgtctgtgcatataccaacacaaaatgaccaattcagttcttctgatatgtaatcattcaaagacttgaatagttctgcagctgtattgttagttgggaacaaaagtgtacataacatatcttcgtgcacatcctcctgaaaagtatattacataaaaacaagcattgctgccttgttcttaacatcggtacacaaacctggatcatgtaccatggtgactcgttaatcctctctaacaattgttcctcaatatcctctgctattttatcaattcgtctagttatggtgctagccgaaagaagaacaagtgccaccttttgaactgcagcctctccgaaaaggtcatgacaaatgtccgtagcagcaggcaggatcaactcttcaacaacagtaaagggatccttagctttgtcaatgtggttagccactaaaaatgatgctctcagtgcagacacatttgaggaagtggtggtcttcaataattgcttctgttctttgtgctattttgttcttttgaaaaactccaaaggcttgtcttttaattcagggtgcttggtctccatgtggtgaagcagtgtttttttttttttttttgagacagagtctcactgtatcacccaggctggagtgcacaatctcagctcactgcaacctccactcccccaacccctcgggttcaagcaattctcctgcctcagcctcccgaatagctaggacaacaggcatgcaccaccacgcccggctaatttttgtatttttagtagagacggggtttctccatgttggccaggctggtctcgaactcctgacctcaggtgatccatccgcctcagcctcccaaagtcctgggattacaggtgtgagccactgcgcctggcctggtgaagcagttttgaaggtttgatggcttcatgggatacccagttgccacatacaaagcacgcttggagactgtcagtcacctgttgcagtgaacccataattcaagtaagactcttggtattttcttgtaaatgcagctttctttttcttggcagtcttagagtcttctgctgtcttgggcctttcccccttttcaaagaagctctccagcgacatttgttttttactcattttggctagggttagcttgagggcttaccaaaactgtgactgagactagagctcagtccaggaaagaggtgcagatggaagtaagtgaaataataggcgggcgacacatagattaaaataagtgtcagattctgacttagagcctgtcaccagatgcagctgtacaatcaaagtacatcaactcacttgccactaagcctgccaccagatacagcataattgtcacttgccactcaccgatagggtcttgatatgaatctgcaagcaagtgatttattatggtacctgtgcagtcaaacctctctgctaatgttaatctccatttacagccactccctggtgctagaatcaccgcctcagctccacctcagatcattaggcattagattctcataaggagcatacagctagatccctcacatgtgcagttgacaatagggttcacactcctatgagaatctaatgctgccactgatcggacaggaggcagagctcaggcagtaatgtgagcaatggggagtggctgcagatacagatgaagcttcagtcagtcgcctgcagctcatctccttctgtaccacctggttcctaacaggccacagactggtacccgtctgtggcccaggggttggagaccctttcctaagccttagaaactgctaatttgttaccagtctctatagctttgcctttagaatgccatataaatggattaatatagaatgtaatctttttaggttgtgttttgcacttagcataatgcatttgagatttatccatattgtgtgtgaatcaataatgtgccccttttttgctgagtcatatttcattgtaaaaatataccagaatttatttttccattaatctttttcattcatcaggtgaatgacgttggatttttctggttttgggagattataaattatgctacaataaatatttatgtacgggtttttatgtgaacataagttttagtttctgtagagtaaatacataggagtttggccatatggtaggtatgtatttaacattttaagaaattgccaaactgttttccagagtggctgtaccattttacatttccataaaatatgagaaatccagttgcaccttattttcccctgcactttatattgtcaggctgtttatattagccattctaataggtgtatagttgtatcttgtgattttaatttgcacttcctaatgactaataaagtatcttcatatgcttacttgcatttagtttatcttctttggtgaattttctgttcaaaacttttgtccattaaaaataattggtttatttccttattgttgaattttgaggattctttatatgttttatatataagttcttcattggataagtgatatgcacatattttatcccggtctgtacattgtcaatttattctcttattgtgatctttagaagagcaaaacagtgagtagaaggatggctaccagatgctggggaatgggcagagtggtggggaaaggttagatgttgatcaaaggatgttaagtttcaggtagactggaggaatacgttttcgtgatctattgcactacacggtgactacagttaataataatgtgtatttcaaaattgccaaaagaatagatttttaaagttcttgccacaaaaaaataacggtggatatgttagttagcttgactgactcttcctacagtgtatatatagattaaaataccaaatcataccccataaatatatataattattatttgctaattaaaaacaaaatgttaaaaagagcattttttaaaatattttgagaaagtccaatttatttttttttcctttcatggattagatctctttgcctaacccatgatcataaagatattctcatttgttctctactaaaaatttggttaattttaaaacttatatttgtgtgtatgatatattttgagttaattttgtgtaaggtttgaatcataggtcaaagttcttttctttggaaattggatatccagttgttcagcaacatttcttttttaaaaatttcttttaaaattatttttaatttttatggatacataatagttttacatatttatgggacatgtgatattttgatacaaacatacagtgtataatgaccaaatatcggattaataacccatattagaattattatgtattttagaatatacaaggaactcacctcaaaagcaaaaaaacaaatagtctaattttaaaatgggcaaaagatctgaatagacatttctcgaaagacgacatacaaatgattaacaggtatatgaaataatgctcaacatcactaatcatcagggagaccaggtcatttctccattaaagtatcccacattctgctttgggctgatttgttccctaatggtgtcattaaaattgttcttatatctctcatatatcttgtgaaaaggtgattagatcttgattggatttgggtttacattttgggtaggcaactttgcaggctactttctaagcattatgtcaaggacctaatactttggttgtcctagtttaggtgctgctatgtttgatcagtgggagttttcagctatatccaaccattataaagttccccatcaatcttttttctattggcattagcagtcattgatgctgtttctttagattcattattttattaaggattgcacaatggtgatattctgattttaggatttattttgcattcattagccagaaggtttatatacagaaagactttcctttatcaactttttagttactctaaaatatatttagcccaggaaaggcaggacaagcatttgaatctttcctttatctgtcaattttcagagtagtcagttaataccctggaaacttataattgagactgatgattattatttttatttatttatttattcattcattcattcatttgagacggggtctcactttgtctcccaggctggagtgcagtggtgtgatctcagctcactgcaacctccacctccagggttcaagcgattctcctgcctcagcctcctgagtagctgggattacaggtgcctgccaccatgctattttttttttgttgttttgtatttttagtagagacagagtttcaccatgttggccaggctggtctcgaactcctgacctcaagtgatctgcccccctcagcctcccaaagtgctgggattgcagacgtgagccactgcacctggctttcattattttttatcattatgaatttatggatttgtatgaacttgatatatttaaatccattgaagtcattattcttattgatgctcaaattgtcttagttcattggaagttcttccaccttgacgttaactcagtctttaatagctttcttgatttctggcacaataataatgtcctaagctcatcttgtacattttctgtcacattcctgaattcagccatttctccaaggaatccttggaaccttttaatggaagatagaatttggaggccacaatttgggaactatggcaaaatacatagattttgaatgttggttggttggcggtttttaggcttaaaacctaaatcaccataagatcctcaaagtttataatcataatcttctcataatatattgttaagacctaattaaaaagac

SEQ ID NO: 8089 - DNA, 869 bp, artificial
  synthetic oligonucleotide
aaaacctagaagagaatattaaggtgaagttgccaaacaaagatcaggctttcatgcaaatgtctttggtaattaaggggagggtggtgctaaatgtgcaatattccttctaagcagaattgtttctaaattcaggggtatgttcatgctgtagtctatgaggcaacagctgttcttaagagaacgctgtcaatgttgataagttacttttaaaactaaatctgtttgctgagctcatgttgtttggaaaactatacagaatgaaatctttaatgcatttttttcttttgaaaaaagggaaaaatcctatcaattgcaagcaaaagcagaattctaaaagcccacaaccttagtgagagcctaggctaagctcatttatatgagggagggagaaaaacataaagcacattggaattctgagtccctaatctgtggataacaattttaaactctgaaaatgcactgattgcattcttttagtccttttttgggagtggcttagtgtgggactgagtgctattttcataactgctcttttgtttgtttgtaggaatatactatttctcatgggtttatttgtcatttgtgatatgctggccaaagcagtcttggacatcattcttctctttatttcgtgtgatacttcaggcattgtttaaacacaagggtaaaagaaagcatgaactctagtgtccaataggactatacaactctggccttagggaaaaaaccgtgagaaattttctctttagtattataaccccttcttcattccactcaattctagaattgcttatagttgtattcaggagctcaataccagacccaagagacccagtcaactacattctgatttcttctaatttgtg

SEQ ID NO: 8090 - DNA, 1463 bp, artificial
  synthetic oligonucleotide
agagcaaggcaacactgttcctttccactttgtgtttcttctttggcctctgtctcatggtctatctgctttaactgagccacctccttcctgattaatgagtccaatgtgtttgctgccatgcactctcaggagcttattggtatgtcactttggattacaggaagcttcagtgatatataaagtgcacatgtagtaggaacttctactttaataattgttactcaccagcatttctgcaccatattatttctaagcaactaaatttaagagtgcaagggagttacttagtcatgttaaagagtatcagagttctaggttttatctatgacatcacggcaattctgagagacggattcatttagattccctgggttatatattttgtgcacataaaatggatgtatttgccctctcccagatttgaatgacaacgaagaatagccaaatatactgcaaatgaaaaccacaaattatgtaaaatataagcagggctttaaattctgaggctttattagtcagtttatatatcctcacttggacaccaaaagatgataaaaattgttacctatactgttccatattttggaacttgtacaaaatttgtactgcctttatgactctgcaactcatttattatgacaagagttacatatgaataatagaaaaaagttttcagccatatgcaggttgttgcagttaacattctatgagaatggagattcatacctaatggaatcattttgttaaataaggagggagcatctcatcaggcattcaaggaactgtgggtttgacttcagatctatttatatttctgcaattctcattaaatgtatggttacagatactggaaatatgttcatgtttctttgtgaaagtcttctttctaaggggcaaaacacacattaaagatgtgattctaggaaagtaatctgatctgtcttatgtcaaacaggacccaagtggcaaaggatagaatctaaagtactgagtctgaacaagaatgggttcctgcagtggatggtgggaaatagtgccttcatttgggagagggtgtcagtggactttgggaaggacatagggaaactacaaattattgaactctgttgtgttcaagactctggacttccttatttacatatgtcacattgcttaattattccaacaactagcatattctgtctctgcaggcaagctacacatgaagccaaattacattcacagggttctttggtgagcatggaatcagaacaaaaagagttggttgtataatatgaatgtttaatatttgtaataacttccctgttaaacataagcctgcacacatagatcacagaggttgtgtccttgggtctgatctacctcactccttgtggtacatcttgtcttggataggtacaatatttgccttttagactttctctttttcgtgttctgtggctgaccatccccattcttat

SEQ ID NO: 8091 - DNA, 330 bp, artificial
  synthetic oligonucleotide
taaaatttcattttggggtctctcaagaaggttttgcctagggtagggaggatattacttttcagtagcatcaacaacatggagattgccaaggaaataaacctgggtttattgagcataagcaggcaatcttgtattgttgtgcacaaacgctgcagcctatgggtactgttgagggctgaaattgaacccagagcctcagccttgatccagtggagcagtgtttatccaccagaacacctttttctaattcacaaaaaggcatcaaatatgggagttgcaaccctgagtacactcttctccctaggaatatttgcatttttgagaaga

SEQ ID NO: 8092 - DNA, 573 bp, artificial
  synthetic oligonucleotide
agtttgctgaattagtatggtaaagaagtgtgtaatggaaacatagctgtaaagtgttagagttgggtgttagattaattcattgacatctatctttattttgttaatccacttcagtggatacaacacaagtattgtaagttcattttcaaaactgtgcgtgcgtgtgtgtgtgtgtgtgtgtgtgtgagaatgtgtgtgttctaccacacttaattacaacaacatctagaacacctttccctgtctccaggtaaaacaaatcaaaataaaaaaacagcctttttttcatatttctattggcattcctaatcttttctcagtactgattttatccacagttttctatagatagtgagagggtaagtcattaggttgcaaagattacagagattttactctagaaccctaaaacagaaatgcattgacaatttttatattgctgtttttctcatttgagctctcagtatttaattacataatgttaatactataagtggaaagtttctgtaaatagtattagctcttcgggagagaaaatttctgaagaaatttagtgaatacatgagataa

SEQ ID NO: 8093 - DNA, 1514 bp, artificial
  synthetic oligonucleotide
atggggctgggaaagtagaaggaaggggtattctaccttcagtattgttttggagcagaaaggaaggtttaattctatagtgttttccatttgaaactgtcaatttttaaataaggggttttcatgccagaacattgatattttcagcaatttgtagtgatttctcagcattcataggattgatcgctttgctacatatagatcctcatgatagaccaagaaggaagaaggcagcttgggtagtttggataacactgaggtggagagtgagctacaaactaatcatgaataggtgtgtattcacccctatctaagcaccatagcatgaccgttcgagtttcccatagatagacaagttaaagtgggaaggcagttcttttgctgtattctcgatgttacattgtgactgtattcttggatattacattgcaaagatagcatcctcggcttccaagcacttttcattgcagagtgccctctgctgaagaagcagggaggttcacgaagaattttgcaagtgaatagcactgtacatctctccttgtttctatgttctgttatttccatctgtattaaagagcacttaaactcattaccttttaatagcacaaacctttatctggcattaaagtatgccacacatgatacttgccccaaacacaaaacaaaacaaacaaaaccgaacataacaactatgaaatcgccttgcctcttgtatacatttatactgatgcttgtcaagaattacaagcccattgaaatccctactttctacagtgatctgcaaggtgaacagatgcttgtagtttctttcttacatgcttttctgaattatttgcaaacccttgattgtccttgtttctcattctggctccgaaacctactttacaagcatttataaataaacctactttacacgtttgcaaaatcctttaaagagggaatggtatgttgtggtttagtttcttctgtttccagtttcttgtacaaaactactgcaaatttttcctttagtcttttgcgtaacctttgtgaattctgaatgtagatggtgactctaacttttcttgaaaccaagacatattttaatcaaaatttatcaaaatgcttataagctttattattattagaaagtaaacagaaatagggacactttctttagctcttgaaactagcttaatgagataaaatggaaacatccaaactagatttttattaacatgattgcatttcttttggtgaacaacttttataaaactggttaatgctacatagcaaaacaaaaacgcaaacaaaacacacacacatataatattttaattgatttaagaataaagaactgtaagaccatgaattatacatttacatatattttttactttatattttcattagtatagcatctcataaaattaaaacactgtcaaacactatctctttaaatctcacagcatgctgtatattccaagtaaaaattggaaccgcttatctcttttggcctgtttgatgataga

SEQ ID NO: 8094 - DNA, 465 bp, artificial
  synthetic oligonucleotide
atctaatacttgttctcttttctcctttcgaatggactactcctagctgtatcttacatgtccagggctacctgtaacagaccttttttgtaagattccttaagaaaattgtaaatttagagaggaaaaaatgcacctttctttaatatgagaaacaacttctggaatcttccagtttgacatcctctaatagtactagttaccttccaatgaggaatattttggcatacataaaaatgctcccccaaatactaagatatatcattaccttgcctgtagatataaacaaatgtgaaattgtttagggaaatgagagtctgggagccttagatgggtaggaggggaacagatattgttgtagttagcttgttggacctctgaggttatgaaggaaataaaagagggagagggaaggagagtggctgttaagaaaagataatttatttatcaaggtttgttggggct

SEQ ID NO: 8095 - DNA, 988 bp, artificial
  synthetic oligonucleotide
aaaagtagcaagaatatcaagagtagctgttagttacagggcatttactaactgctaggcaaaacactaaacaattgatgtggattatcttcttatatccacgaaccaaaatactagatcttgttattaccatttttcagaggaacagaccaaaactttaggaagtgaaataatctgcccaagattacacagataggaaacaggaaatttttgatgaatgagtgaatgaaatcatatacattaataaatctggaattgaattatctaaccatcaaattataatatcctaagagagattatgtgagtggtataacattgtctaaacaactgtcatgccataagcaatttcaactttcctttggaaggaatcaggagctcttcatcctggtcttccttcaggaaagttagcatttagcattataaagcattcatttctaccaattacaccagcttctcctcacaaggccctaatctcttgactgggatggagacaccttcacttagctacattgctcaaataaaaataggctttgttctcttgcacctgaatatcacttttctacttttgagaatagggtcttgaatgtaaataacccctcttgtttgcacgtaggctagttccataaacattataaaatggccacttcctatttccttactttgtaaatttcattcctggcagtattacatttttacaactcatatttcattaaatgtttggttatatcccatgtacctcattcagtagacatatgttgaactcttagattcagtcacatctattataattctcttttattctttaaaataactttctgggatgtgtatcttgtttactgagtgggatacctgggcttggacagtttggcatatggttcaaggtcacatttatctaaggtcatagagtcagcagagcaaatataagaattcaactactttgacaccatgtctcttgtttgttccacaagaccagagggtttccttataa

SEQ ID NO: 8096 - DNA, 884 bp, artificial
  synthetic oligonucleotide
agtattctgctcctgtaaagataatgtgctcattggcacacagttacttcttccaagctagaagtagtggttatttgctgtctggcaggtctgtgattctcccccttcactttttggccagaaaagagtaccactgtttctaatttccctcaatcagactattttgtgtatttgtctactgagtgtgatttttctgtcacctggagctgcatcacattgtggaaaactgggctattggactcatgtggctgtgtaaacaccagaggttggtgcacagagcccctcagattgccaaaaatatgaattagttgatgatactgttcccaacgtcttcctcactattctcccgcatggcctagctttttagatccagctattaaacagtgaggtgacaaaaataaaattaatatgacagaatgacagcctcacttttggtagaactagatgatgcaaatgcccttaattagattcaattccatatgcctagagagtaaactcttcttctaaaagatagaatactaatgtcttgcattgatgaagggcctttcatctgggagttttctcgcagggtttacagaccagtatggcacagtaaaagcaaagcaaagacaacatcaaccacaaatggaatgcaacaactgcttaatggtctatgacaagacagtagaccaggagctataagaagctgttaaaaacattgttaatatttctctagaatagaaagtgttatttgatacaaaaaatcaaattttaacaaaaataaattcctggagcctaagagctagctgttttaaactctgaggacagaacgagtagtcttccaatgtgtcaggatatttttatacttgatctttgaaggtgattagagagtttatctcaatgtc

SEQ ID NO: 8097 - DNA, 1568 bp, artificial
  synthetic oligonucleotide
ttatgtcctataattctattagccactaactcaacgtgaaatgcagatttattgtaaatacatttaaaatatgtattagatattatatacatgtatttatattcatgaagatagacataaagaagtatacataaagataacctaataattatatttcttcatttgaactttaggaagtttttggtaattggaagcatttgaggtggtcaaccgggttaaacaacttaatgagaagctaagcaaatgttgaaagaatgttatttgtaaaattaataagacttttcttttcctttttttttttttttgagacagagtctcgctctgtcacccaggctggagtgcagtggcacgatctcggctcactgcaagctccgcctcctgggttcacgctattctcctgcctcagcctcctgagcagcggggactacaggtgcccgccaccactcccggctaattttttgtatttttagtggagatggggtttcaccatgttagccaggatggtcttgatctcctgacctcgtgatccacccgcctcggcctcccaaagtgctgggattacaggcgtgagccacggcgcccggcccaagacttttcttactaatagtttattttgttgcaatgagtggtattgacgtgagaagaaatagtagcaatatcttggtgagacaagatgcaggttttgctttgtctattagctactataataactagattgttatcccaagggagttaaaaatgcatggttctcataggaagtgaccatgggtagccagaaacagtttttgggatatcctaaccctccctcactgaatttacacagagttttggggttaatcttgctacccactggatgtcactgttgctgcaccaaaaatgtcaagtatttgagcattttttcagtcccccaaaaggcacacaaggaagcttcaattaggaatatcagtgacaatgctgtgagatggaatagagaagaccaatagctaggtttctgggttgataattaaaatgttggtctgtatcattcttgattttcgcaatgacagtcaatgaaatactttcatgttgagactagagacttgtggagtgacccagagctgtctttgatatcacgttggtgttttcatcattttgaagtggggcagatgtttttacatctgttgcttcttgtcccaatgagggttgaaaggagtcttgcttgattgagtccccttagatgaggaatatggaaattgtattttttaaccttggtgtgacttgactgctaaataacaagtagaataaaatatctttcttttgatggtttgtgaaagttttctgcttcagtggtatggaattcatctatattagagctgtcaaatcttctcaagaattaagaatacaatttttgttatttctcatttgtttacctctggtcagttgaaatgctattacttattggtatataatagacatgcgaaagcattggattcacaaaagagttatgatccttgaagtttatttatagttttgaaagaattcgaaacataggagaagatttggacttaaaatattagaactggaaatta

SEQ ID NO: 8098 - DNA, 205 bp, artificial
  synthetic oligonucleotide
gccttttccttgttctatatccccatcactaatgatttagttcaaatacacatcttctctagcatttactatggcacaaaactctgttttgttctctctgcttctacttttgccttacctctccatccatgttccatatcgccaccagattgattttttcttaaaaacaaatctgatcatgttatttctttgtataaaacaattc

SEQ ID NO: 8099 - DNA, 307 bp, artificial
  synthetic oligonucleotide
tataggtattattttatccccattttatagaagatgaaactgacaaaaggagtggttaaaacacttgcccaaggtcatgtagctgatgtggtaaaaccaagactagacctgtggcagactgcattattgttaaaaaacactcatgttcttgcttacaccttcaggaaaggagtatatttgcccacaccagtgatgttgggcatggctttgtgacttgctttggtctcgtggtgggtggaatgtacttcactacacatcgtctttgagcttggccatggacttgcattggccaatgagatattagcag

SEQ ID NO: 8100 - DNA, 1155 bp, artificial
  synthetic oligonucleotide
agttttggaggccacatacctctttgaaaatcaagtgaagactttggaccctcttccctacaatgcacatacattttacatatacatttctgggaggggttttagatttcttaaagcctatccatagatccagattgattacttcagctctacttgatgctacctgggaaggtaagaggtctgggttgttcttggttttgccattaactggttaggccactttaggcaaatctgctaatttctttgggcctcactttccttattgggaatttataagggatttatcatattttaatttcagcaagccagttctaccatataattctattctgactctgtagtcttttttttttatcaaaaggaacttggctttaatctcagaaaaagcctgaaatcactgtttcttacagaacaacaacaaaaaaaatgggaacaactaaaagtggatggtgtctagagacattatcttgtcttttgttaatacaaacatgtattgagggcctattatgtgcccagccctatgcaaagcactggtgtttcacagataaatctctccatccttgcttcctagagtggaggaggtttcactgcacttacacatacattttctgttttaggaagtgcgaaaagactaagttatgtgagtttccctgggcctgaatgaaatctgcttaaatggtttctattcaggcgtttcctggcagctatgcttctaattcagctctctccttcaggggaaaagctaatgtatggagaaccaggcttctttgccattctgcaactcgatgcttgccagagggcagcttttaatccttaaagggaccaaggctttcttctctgaaaccttcgaaaacacctctccacagcacagtttgcaagcagtcaagctatagtttcctcacacccacattgctttccttactcccaagccagaagaaaaagtctgcagggatgaattggtttataaggatacaatagaacattgagaagttctcatttttatttacttatttgataatctgctacttgttttatttttcctcttttgttcagtctttgtctttctccctttgatactcacccgattctgacagcatgattacttaatacttacctgccaaattaactgacttattttaccaactgggtggatat

SEQ ID NO: 8101 - DNA, 181 bp, artificial
  synthetic oligonucleotide
aatatctctaaaagttaccagcagcacctgaaataatggttactagatgccacaaatccaacactgactagcccaccttcttaaaaagcttagggcggggcagggcaatgggagtggtctacctctagtgcgggcagtgaatgagagcattgtctacagagaattttaaaacaagatagct

SEQ ID NO: 8102 - DNA, 367 bp, artificial
  synthetic oligonucleotide
ttaggattatgggtaacctcagaggacctgtggtttgtggtggtttggaccttagaggacatgtgggtgtgtggggctggactttagaaaatgtccaaatggacgttgttagtgtgcaaagagatggtccctgaatccacgctacgtatgtggaacagagattgcaaactccagtgcctagagcggccaggcaggtaacatgtgagaatgcaggccagatgcatactttgggtcaatggttgggactgtctactccagctgtattggaattgcatggattttcaactgaattgcatggattttcaactgaaaatggaattgcatggattttcaactgaagccaagaatctggattttaccatgaaat

SEQ ID NO: 8103 - DNA, 724 bp, artificial
  synthetic oligonucleotide
agcttccccctgccacccccgcctcaaaatatggtgatttaaaaaactctatacttgactctagttctcctaactctatgctcggtatcttccccctcactccagcatctctatctcttgcctgtctgaatggcttgaactaagacgacaagaatacatgagaagaaaggtaatcctggccgggcacggtggctcacacctgtaaggcgggtggatcacctgaggtcaggagttcgagaccagcctggttaacatggtgaaaccccatctctactaaaaaaatacaaacaattagccaggtgtggtggcgggcgccttgattccagctactcgggaggctgaggcaggagaatcacttgaacttgggaggtggagtttgcagtgagccgagattgtgccactgcactccagcctgggcaacaagagcaaaactccgtctcaaaaaaaaaaaaaaaaaaaaaaaagaaagaaaggtaatcctaaagcagtgcacatctgccatgctcggcaaggtttggaagacatctgtaacagaatgtgcagtatatgaggccctgggctctggaatcaatgagacagggcttggagccaattctttccacttctggctctgtagccatgggcaatcaaattaaccttcagtttcttcacctgaaaattgaagatgataaaagtacctgcagcactgtgctacactatagatgctaaataaaagtcagcttat

SEQ ID NO: 8104 - DNA, 25860 bp, artificial
  synthetic oligonucleotide
tcttgtccctgcctctagattataaacaccctgggggcaaggaccatttctctagaatgtgaggcatttctaagtactgtccccgaaaaaagctaatgcagcagttgatgttttcttattgggatctgttagaactctaggcacctaaggattccagaattttgtggaaagttgaaactgcaactttaagaattccagtgaatctctgttagaagttgggagtatcacatacttatttttctctgagagatgtttctactccttgatttgtgtggttgatagtgcacccagcagaactgatgcggaaactttgcccatcttatttgtaaggggagaggtgacctgcaggtctccatggactccggcacgtgtcctaaactcaaattctaaaagtgaatggatgaagcaaaccaggttcacactagagtgagtggcagggactgtggcaaacaggagtgagcaggtcctgtccaaaggggccagcagctactcagtgatgctgggagggacagggcccagtatggccacatgatcgagttttcaagagaagccaggaatccaaatattccacaaagcttactgatttctaaaccttgacaactaattttttaaaatgaaactttaaactctgtgtgggccagagtaaacctctgggccaaagtttatctgggccagttgggaaattataccctaaaagaaccctgctcttctcagagccccctgcctctggaaagggcactttttctgtttaatttaggaactaggattttacctgtagcagatacttgtacacaagcttatcttggacacaatctgctaaccctccactcttctacatataaggtgcatagaggggggccagaagtggaaaatcccacagagtatgcttgataagattttaatttgtccagaaaacagatggagttaatcttgtgactgttgcccaggatgtgggggttaatcaaagttccaagactggaatttgggagaagttgaaagggaatgaattcactgcccctcaccatcacccctttctccagcccttactacctcttacctccaacacacacaccatgctcctcaatatacttcttcaaacatcatttaaaattagtttggcggaagatgcaacagtaaggaaactccaaaaacagattttcctgtttgttttagggttttaagaaaaacaccaagccccagaccctcttgtcaggatgcccgaccctttaattcgatgctcccatcccaaatttaaagctgccattccctgctcctcactgtctctctcccgccccctctttcttctctctctctgtctctctctctctttctcaccccctctcacctaaatatttcttaattgaacagtttgtggtggagcttccttatagcagtttaatagattaactcatctcagccagcctcaaatttcagattaaaattccttcatcccgaaggcagcattatcaggttgttggaggctgttttcaaaccttggttttgaatagcagcggctctgcattaatttaaccactaagctaataagtaggtttcgttttgttatgctaagctttattgcttttcttttgatcagaatggtgttgttgagcaaagcagcagacaaggcattctttgatgagggaattagcgctccattcttcctctattattcatagcgcagtggaatatgtaagtacctgagggtgtcaaaggagcgcaggttctattgcaaagtgctcgccttgtttctctcaatagctgactatgagatgataaaccgcttaatacactgtgctaattggatgagagcaaaaagagatgggaattaaggcgaggcaaaaggagaaagtgcaaccagccttcaattcactctttcaccactttaacagcaccaaaggaggcacaagctttctataagcagactagaggttttgtgcagagataaaatgaacgtgttagtggattcaagtaatacactaattattgcacagtataaataccactactggttttataacagggaggtaaacttcttttgagagggttataggattgcttggcagtggtgtagaacctaataagggcccagagtaataaccccctggattaacaaaattgctgcttgtagaagtatgattcaggcttttacgaagatttccggagaatgaataaaaatgactgaatgacatttcttaatgtataaccggtaatcactcccatatctttaaaggaaaaaaatgtatacttcaaactggacccttaataatgtccagggagggataacaagacttcttcctttgaaaaatgcttccccccaccccacgcccccgcccgctctccccaccgtcaggtagtgggttttcttcttcctgtcccccagccaggctgtcactctcagtgaaatatgcagttgttctggggacttctgtgttccaaaatattattttaggccccatttaagacccccttcattcagacacactcacttttgggtatacacataaacacatgctcatggacttttttttctcctaaagcaagttgggctaacctattataatttgtttttctctcacatcagccccttttgtcactctagtaagatcacatttaaaaggatactaaaaagagaactacaggtgctttggctcttgatactacaaatcaaaaacaacgttagccccagttgggtggggggtgattagtacctgaaaaaaaatgggaaactgttccgagccaatttcagcatggactttagtttaagtctgagtttcaagtcccaaggaggcccaaagtttctcaacagtcactctccctaattattccacttacctccccacacacctaagatgcccgccctgactactgtccacagttcgggccatgggtagttggtgatggaaggacacctctgataatattatgccaaatgcgccctttttgccttccaggacctcctccagatctggctaacctgtctgaaaatgtagcaaattaacttactcctttccctcaaccctcccacagaggcctgtcccaggcttcaattacccctcaccccaagatgctgtgggggtggccctgggaaagcaggtgttgggccattctgccttgggtgtgataggacacagccatgccctgaactgggccctcgcaaactccctggggctctgcatgtcctccatggtggaagaggtttgcttaaggttggggggggggggtcagccgctcccagcattgtgaccaagttcccagatattggggccaaattgggttgccattcattaataatgctcacaataagattaaatcattctggaaaatctcataaaatccccctaagtacgctccagtggctctttccaatccccatcattcagcacttggggaggtttggaaggagaagaaaattggtttctttgcttttaatgctgctttgaaaagatactcagagtttttcatgcgtgacatgtcacatgtttaatgtggacttgctggaagtcagggggtctttagcgtgtgatatttatggggaatattaagtgcagaatgaggtccctccagctggggaaagttgaaagaataggaggcccaggactgggcttgtttgcagcatcagaatgacataggattaagagtttgtaaaacaaggcgaggggttctcattggccagtaataaatgtaatccttggaggtaatttcacgcaatttgcttctgttccatggaagggtcaaatgagaaaaaatgacttaaaaaagagttcattaacaggaagaatggtactgtttctcgtataccatccaactagcagcctagaggggggaaaagaagccctactaaacaaaaaggcaaaatcgacgcaaaattgatatcgaccacaacacacacacacacacacagacacacacacacacacacacacccaactcctttccctcagtcttctccagcagtcccgtctcctccccaaactctccagcggccctgaccaccccaggaaagcggctttcactcagggagagcctgtggatgtggagtctgagggttttagactctcagacctccagtaaggccctagaaagttcccaccgggcctactaaacccgggaacggagtgtgtggtaggaatggtagttggcggccgctccccataccccaggccggggcccttcttgcgagtgccgcccccgtgagtccagggctagcgttgggtggcggtgatccacccgacgacccaagtgccagaagcggccaccagccggcgagccggttccgtgagctctccaacgtttcgggcgggcggggtctccgggcgtctggacccggggttggagaggaggggattgaagttgggggtgaaggggggtgcaggataggaggcgagcccgggacgtgcgggctccagcgccgaagctgccgggcgggctgcccacacccaggtgggcacagcgcctggcaggccgctgacctctgcccaaccctgcaccctcccctcggccgcgcacacttgcgccctgggccgcgaggggacccggcccccctcctccagggcgcgcgcggagcccgacggccccagcccagagaggcacccgcgccccccgcggcgaccgactggccggcggcggcggcggcgtggcggggctgccggccccagctccgcaatcgcggtagtcacgccgcggcacccccgcacccctcccgcctgcccctctccccaaaggtccggcgcgctaattacagcaaattgaaactaattaagcttctcttccctttcccatcaccctgggagcgtcggcgagacccagcccccgcgggcgggcttccaccaagcggtcacccggaggggcgcgggcagggcccgggggagggagaagctgcggtccccgccgcgaggagggaggcgtgcgccgaggtggttaaggattgcaaatctgtttgggtctcctcacgaaatctgagttgtttagatttttttaaatgtatacatttaccaatgcctggataagtgatgtaatgacatttgtcgagttaagatctgccatttggatacccctcgctgcctttccatcactactgctcccgcatgtttctctctctctccctccctctctctctctctcacacacacacgcacacacaacacaatacacacacacactccctcctccctgcgaacatgccgtggagcccgccccctcggaagggagcgcctgggcttctcgctctcgccattacctgtcatctcggactgcgcacttcacttcctggctacgtggcactttccaacagctcccttcgccttccgagccaagactcccgcttgcttcaaatttctgactccaccgtcaacaacgcccaccatccacccacccatcctggaacccaccccacctccgtggcccgggacccccagctcccgctgtgacacgacccgggagagcccaggtgcgcgtggaaagtaccgcggcggcgtccttaaccttcgtaggaaatccggttccctttgaggatcggattcaaaccaggggcctctgccaggaaaacgcgtgtgcagataatcccaggagatgcctggacgctggagcccacccttgactcccggggggtgggggtgggggcttctactgtcccctcagcgcctgtatggagcattcacacttcgttttgttaaacatataatttttttattttgagcgtgacacttctccactagatagcaaggaaaagtggtaacaattacacattacacaaaagtactgtaccattgcctttatcttgaaggtttcggaagcctctacagttaataagttaaataaagggcttgagtacataaatatttgtctaggaaccctaccgtatctacaacacagtaagaatctacgggaggacaaacttttaccataccacgctgagtgcaattgcgttataacatttcaaatatacaaagctctgttcttttttttttttttttaataacaatggtatgtacagaatcaataatcacagtttggtgacttcaacagtccatattctagcagagtattatttccctttggtttgatataaaaaccttggttggtgtatgataaagaagagaacaagaacaagacgcccctttcctttaagtgcactgttagctatcttacaggctcgcatttgcttcccgggccctggcttcacgctggggccctcgctggggagatcaacttcgagcgccaaaatgctatttaaaaaaaaaaaagaaagaaagaaagaaagaaaagaaaggctaagtggggtgtcaggaggaagaggttgggctttttaaattttttacttcaatatcaggcgtctgggggagaaaacctccccgatattttcaggaaagtaagaacaagagagagtggatgttggagttggagcgaggttggcagtagcaggggcaggggcaggggcgggtggacagccagccgaggaggtgccacgtcccggagcgccgagggctgccatgcccgcatccagactgctgtgaaggcggctgcgctctctcagtgccgtctcgggagtgtgctggtcctctgtttccatttggtcttgagtggtgctgagtgaggtgacctttcggggcgcgcgcggggcgcgggtgtggagggcagcctttagcacacctccttgcccgtgctggtgcccggcaggatgttgagctgcgtgagctgcgccgcgtgctccttggccttgagcctcagcgcggctatgctagaggcgcgtctgtctgcggccgccgtggccgggtcggccagggcgcccgatgccactgcgccctccacggcgggtgtgggctgtctcaggagcgcggccgcggtcgacgcgctggtcaggggggccattgtggaaaagagcctgcagggagagcaaacagcgcggtcatggcctcgggagctgtgcgcggcgcctcgggcagcgtctcccgccgcttgtcgccggggcagctgaggggcgcggtacccacgggacccggatgggccgcggcggggaagtgggcagagggcgcgggcggaagctggaccccgcagagagggctttcctggggcagggaaccgactggggggaaaagaccgagtccagatattccccgaggggccgggccgggccggggtccacaggccggcgtggagacctcaagccccacggcccagtggcgtggattcggtggtttcgcttaaacggacggtttattccaaggccaggggctgcaatgacactatctcccaggagagaatgcggaaggagaaaaggagaggagagcaaaagaagggaaggtggagggtgggaggggggaggaaaaaaaagacggagaaggtgggattccagctgcccggacgcacgccgcaggctctgagatctccctccggctccttggcccgggactttctgcgccctgaagaaacaggcctagctcgccggcctcccgggccacccgcgccgccgcggccgcccttccgcgcgggactcagctacccgcgtctggccagcgcctgcgggtgagagtgaagggcgaccgcctgttgatttcggctccacgggcgggtgtcacctgccagcagccccacatcctggcgcggcgaccccagctgtcttccccgcgcccctgtagcctctggcctcagggagcccccgacccacgaccctggcgcgcggcgcaaggcgatgcccaagcctgggacccacgccagcgccaccgcctccaagcggcgaccgaattactccacgtgacgcttccaccccatgcacacagcaccgggacattagctgtggccggagccgcccggggccaccggacaccacccccacgcccaccgccttggagcgcccgcgagctttcccgaccgcctccctgaggggtctggctccaggcccgcggggccaattccggatttccagggttagaaatgagcccacctgggctcaccgagcgccgcctccttctcccaagcccactgctcactcctcgcaccaccccagcccagaccctcttccagcctctccgaatctcgcaactcggtcctccagccacggttcgcctgggtttacaagtcacttgtcagagggaaaaagtggagggaggggagagacagaactttaagatttttctcagaaagaaatgataaagtgtgacccggaggtggcgtaacatgccctggttccattaggtaaactgagtcactaactctgcttcagtgcgctcgctgtttattttattggtttgttataagaaactaaatttactccgagtcttaattttctgtaagatgattttttgttaagcagctgcgcagttggatgaatctattatttctttgttctcccaaagagtgatcattgaagctgcatccagttttattttcactgcgctaacacaatacatccctcctttgtttctttgtctgtgtgattatacagactttttatttcctcattcgatgttcattaaagaaagggagttataagatgaactgtttcttttatttcgttgtcttgtactgccgtgtagatcggggcttgcacatatgggggtgtcgttggcagcgggtcacttgagtgacaaggaagatggagtctggggcagaagaaagaattctgtgcacccagagggcctggtggctccagggctcccatggggatcagggctgtgttcctcaggctgccaggttggggggcataaggaagaacttttgcaaaacttaaaaagtcgtccctgctctgtaccctacacctgtacatatttgctcgcttaccacctatggtgggacttgttgcagcctgcaaatggtacttttacagctttcattctcggttgtcacggttgtcgttactgccactgccttcccctttcccattaagttccaagtcaataccttcaagacccacatttttttttttgaggctcaattagagagtattttctttggctacagtctctgaggttgggtcaaagaaaaagatgtgtgtaaccctgtttgactcctgcctcctccctgcccccagcctctgtgtgtatgagagacagacagacagacagacttccgaggctgcgcgttacctgccgaatgccgggctgatgaaagctgggtgtcggaacactgccgctccgaggaaagtgctcaggcccagcggcgccccgctgggcggcaggctggccgagcccggaggcggaggtaggctcgggaaggcggcggcggcggcggcggcagcggcagtccaagcggagtcgagcgccgggtggtgcggagggaaggggctggcgtccaggtaggggctgagcgggtgggtggcggagagcggccccgggaagggcagcccaggggggtgggtctgcgcgcctgccttctcccgcttgcgccacttggcccgacggttctggaaccagacctgcaaggcagagagagcccagggtcggcgcggctcggcccggcgggcgcaccgggcccctacccgtcccttcccttggcgcgctgcggggcccccttcctttccaccgcggcccgcgcccacctgcccctctttggcctcaggttgttttcggacgcgtctggggccaaatgagcagtgaataggagccgcaacttcaagtcagcaggaaacaggacaagcaaaccctttctgccggcattccacctgggccagttttccaagtttaaggaaagtgattcagtgtgtttagagttggggaaaccaaagtttaaacgtctgtgctgacgcttgctaggatctttaggcaggtcacttaaacctctctgaacctcagttttcgaatctgtaaaatggggataataaaacttcactcataaggctgttatgagaactgggtaaaataaggcaagtgaaagcatgcattcaatggtgactctagggaatgggcagccaccaagagatgagggacatgcttgttttactgcatatcagctattttcacctatttcagatttacgcaagagctggcaaaattcttgctctgtatggaagaggaaagtggaaagatagttcatttattctttccagaaacatttattgaacaccaaagagcactatgctgggttctggggttcagagagggatgagagggagggaagaaaggctcgagttaattagcaagcatacatttcagggggtcaatcctctatgaaatgaaacagggatacacaacctgctcttggcaggggatccctgcaggacccagttctatgcaggaaggcactgactacatggatgaagcaggcagcaatacctgggcgcatagaaatcagagggcatgataggtgtagacttttcacatcttcagagctaacaagtcttttatttccttttggagatgtgttttaaatcggctatttaaataagatagttttaggcttggagggaggttttcagcctgaggtattttcctaattgctaatagaaagcggttttaatggagacctttacctgaaacatggcagctaccatcatctaaaaataaaccccaggagcatgaaattatttttatgtgacctgctcatcacacccacagctgggaagatatgctccttctcccctgaaggcattaatatttttagggctgggtttataactgcacacaagtctgaaaattaagaatgaactccagggctatacagagttatattaaaatataatgtaaattatcccagaggaatatattttaaaatgtgaaacacatccatatttttcaaatctacacactggggcttgttgttaccagcactagcatctaagcttggtttgacttctagacagccccccagggcaagaaaaatcaagaatccaaatcggtcaattacttccaagtcggccaaaagggggcccattcacaccattccacagccttcaaaataatctatttgtgaatttcagaaacacttcagtgtggaaacccagaggcttgaaaaagtaagactgtagatgggaccggactgggtgggcagcttttgtgtagccaaatctgtctagacaagaatatccgccactccttgatcgcagtgaaagaagaaggggaactgggggcagtggactcagaatgccctcaaagaacgtggaaacctttttacagacagatcgtctctcccggctcaactgcaattatcaagatgtccccctgcaattcctcattattgaattaatacctctgaggccccccaaaggtaaacgaaaggactctaataattcatattcacttaattacatcttctccagtgaatagggggagaggagaaagggagggggcgctctctttctttttaaaagttatttaactttcccacgacttgttcccctgagctgaaaatacggagttgctgtcacatctctgtttgacaatggagaaatgtgtcaacagaaaggaggggacaggcctcatcattagccctctaatgcaagaagctgttgtgtattaaatgagccatatggaatttattgtgctttatcagcgcttgattttgactgtaaagtgattcactcagctcctaactcggggacatctgttttctgttggccatcggggctgctcagtgttgatcgtctctttggttatgaggcctgggttcggaaatgcactctggtatggggctgcaaacacctttaatagcattgcactcactccctattagatcaatgtgggttcattgctataaaaaatgggaaatcaaatagcattagccagctccttgtgcggggcggaggggaaatcaaacagcattttgccttcaaatggccctgtttgttctagcactaagtgggcttttatgaagcccgattggagacttaatcgcagccaaatacctgcttggaactgagcggatttgtctaacaaccaaatccatgctccatcccattatttcaatcaggagaagtagatcggtggattgtttcctataggagctttggggctagggggtcccaaactgcagtctcagggactctaaagcccttgttctgatcctggactccttccttgggctcccaaacccagaaacctcccgcttccacctcccatgtcttaagttttaaatatctttgtgtgtgagagagtgcttgggtctacttttctgatcctgcttctcttggttttgtgaaggggatctcaccccccgcacccccccgccaccaacccatctctctctctcccactggcccccagccctcctccctccctcttccctctgttgtgcagctcacctggactcgggcctcggtcaagtccagcctcatggccagttcctccctataagaaagcaacacacagacaggaggtcactgcaggccccagcaatgccctctcagctatttcctcctctatggcaggcctactccaccagggtctcccctggctgcctgccccccacccccaaacatatgggcattaccattccatcaccccctggagtgccaactatttgactgaaaatgcaaaaacacgaagcacattaccagatataggatattatctattatatcatactacattcgtgtgtgacaaccaagggtggcttcaagtctacaaacctgggtacacaggttctctctcactgtcttaagccagagttagacaacacacacacacatacacacacacacactgcttataccctgttttgtcctaatattaagtgggataggaactcagcacttaactaagaaaatatttttctgtcctcttggtttccttctgccttctttttaaaaatttctcttccctccttcttccttcttctctttccagctctatgcctttccctccatctctctctcccccgccttcctccctccatcatccccttgggtcacactccccattaccctctgcaggtatgttaagcttgttaagagttcagtggggtaatttttcgattaaacaaaattctgcgcacctcctgactccaatgcccactacaaaccctgcccatctcaggggaagtcaatttaactgaaaccctaccccatcattgcagttattactgcgacaattaaggcaaataggaaaccattaagatgctgtaaaacggcttacaacctgtttaccgaaaatatgaccgcgccgagaataattggccctccggctcgctaatatgaaagagcggggccgccgaagcctgggacctggggttgccctgccggtaggcccccagtccacacctgaaacttcagcaccagaggtaaaccgtctccataagtgccctccgttgccgttgcccccagctacagtgggcatcagcaaatctaaagcggcactccaggctggctcagggccggagccaaggggctcaaacccctgggttggaaagaggtgggggtggggcggggaagaggagctgcccctcctcgtgcacttcggtcctcccccgcccctaagcccgccagaagctaagaaagggcggacgtggatgccaactgacaccagctcagtttcttctttggaaatacacacgtacgataaacgcaaaacgctggtcggccaattcgctatttgacagcacacataggttttcaaacttatttccttttttaaagataaggaaaggactgggtgacacaggggaagaccaagtgtagcccaagggatgaccaggtttaagtgcctttgcctggcattaagtctgctcttttctgtttctggttgggagagagttaggcaattgccaggccaactacattttggagtagctcggcctcccgagccctaagcagcgatttctcctctggttcaaaggggcgggcagcattccccttctaaaatgcacattgaaaagctgcgcacgtctccttcgaaggaactgcccgcgcttgacaagccccgcgctaggcagtcaccgatccctttctccccctcactgggggacgtttgccctaagactggctcctcgcctgagctgagaacttggccttggggtgggagagaaggatccctacccgggccggcgccccaggtggtgaataagctggggccgagggtccagtcatcacacaggcacatgtttcccagaaaaacaagtgggaggtggagcgtgaccaggtcgaacacccggcttggacactgatccaaagagaaaattcccccaactgctttgtctactccctgccaggcttccagcaatcattgtccacccggtaaacccgtttacattaaacgcacggtgggtttaatatgtgtgtcgggagaggacagagagtagaaggggagattctggctggggcccctcaggtgttcagacaccaaacactgcccagttctgacttcctttggttatttcaggagtcctgaaacgacagaactcggatctttttaaaggccttctccgctggcacgggctccagcttcactgcgaactgcgtaactgatacccaccaggcccctggggcaccaggcgggggtggcgagcgcacagcacagcgaccaaaaatagcccctgctttgctctgtctgcggacagcgcttcctgagcctcgccggggacctagccgggaccgcagctccggaggccttgtgtctgtgccctctgctgtgcgcgcgtctccaaggtggcgctttcgggcgctctttggagaggctgtttcttttcctctctctaactaaaacttgtaatttgaaaacattaaactgcaacgaccttgggaagaagataaaccattccagcctaaacttaaagcccgaaccggggtgggggtcgggggagtgggtagtttgggtgagcaagggtgggtgtgttgggagggcgctcttccacagagtccaggagccaagcgtccgccccgaggccggggcccctgccagcccgctgtccctccctggggcccgcgtgcgctctctgccgctgcgaccgcgaccaccctacgcgcatacctggtgaagacgtccgggtagtgcgtcttctggaaggcccgctccagttcctccagctggtagctggtgaacgtggtgcggtagcgcctctgtttgcgtttcagcagcccctcctccgagtcgctgcccgcagagaggcacacgctgtcctcgccgtccttgccctcagcgtcttccgggtgcagcagcagctcctccttgggtgacagctccccgccctctgtggccactgcagcggcagctgctgcggccacggcgccagtggcggccacaggacagcgccggggctccttgagcagcgcgcgggcgtcgtcctccagcagctcctcctcgtcgtcctccagcagttcctcttcctcgtcctcatcttcttcgtcctccagcagctcctcctcgtcgtcctcggtgccggtgccaccacccgcagccggggcgctgcccgggccgccggccacgccgaggcgctcctccgggtgcgtgacgccccccgggccgcccagctcgtccagcgcgggcggcggcggcacgaagggcgccccgttctcgcggtacgacttgctgcggctgatgctcacctgcggcgcctggctgatcttgagcgtgtcccaggccgcggcggccgcggccgcggctgccgcggcggcccctgcgccgtccggccgttccccgggccgcgcggttggcggtggcggcggaggggcctccccgcgtggacccgccgtggccgtggcggccgctgccgccgccgccgccgccgccgccgccgccgctgccgcaccctgaaggaggcggcccccgcccgggccgtacaggcgccgcagcttgggcggcaggtgcagctcggcctcgaacggggcgctgctgctcttaggggagcctgcgggcaagggagagctatcagccagccggccggccggggagtcccagccagggctgctgccggggcccgcccgcagttgctcccccagtgcctaggcccaggcgtgcggggaccgcgcaccaccagacttcgacgccttggcctctttctccacttttcttgctttttctttttctttctttctctccttctccctttctctgggttccttcttttttcccctttcctctcccttctttccgttccctctctcactctcccccttttatttcctatcttccttcccttatctattcctcttgcccctctctcccttccttttctctccttaccttttttctttttctttctccccctcccttcttttcctcacctctctttctccttctctccccctttctttctctttttgcaggctttctctcccctctctccttctttcttctttattcctttctctttcccctttcctactctctcatttttatttcccttcccacgtcggggcagaggaaaatccgaaaacattctacaactttaaaagaaaatcaccactatcctgaaaactttgcgcatgacctctgcccgctgctccaccatgagggcaagggttggcaagaggggtgcagccctgaaggcgaccgctgcggggcggggtgggggaaagcggccctgtggccccaagtgcaggccgcgccccaacagcccacagcgggagagggtgggggggcttcttgcacaaaaaggcaaagaaaaatcatcctggcaaaaatgttctgggaaaggtctggggcagagagggagtgggagtgcagcaggcgcaggccgctccttccttttgaggaagcgcctggcataggtgccactgcaggctaaaaaaagaaaagaaaaaagtcagttttatttaaatgcccccttctcaaccgtctgctcctgccatccaaattgcgctatggccggaccgctggtttttggattttaaaagaaaccaacagttctttcctttccctgcgacacctctgcagcaagctcgaggcgaaacttgaggataacaggttcggggtaaaaggacatttgttctggaatttttaatttcagaaaaaaataaaatattttaaacagctcgtctattttaaaaaataaaatagcagagaaaaaattagcatccagaagtcacacatttcatacattttaaatacattaaggagcatttggagaatcccaggaagatgttttctgcaaagcttgggtttaaaaggtcacaagtaatctgcaattaaaaaaataaaaccaaaacattgcatatacagaaatcttccaaagaggaaaggccaaggctcactcagcctggagaccccgattcaccagcttttgggcttcttgtcttcatcaagttggtgctacaagggtccaccggccatctactgtttctgacctgtcgccgctcttcagagcacacccaaggccaccaaaaggggcatttaaacaacctaacgatcaacaccgaaaagctaaaggctccctaagcgaaaacgggcctttttctggaagcagggagggagggagggagagacagccctggctagatgtttaacgctctttgaggcagcaggcctcagagttatgccctctccttccttcctctccaaattgacaattccaggccactggcccccgaacaccaaacatccaaatcagggcccaatgcccttagtaagtgcctgacgggagcatccttaccttgcacggccttttccgggtcggcgcggctggtcagcggagcaggcaagctctgcgcggctcccagcaaccgcattttgcacgggctcctccggcccaggatgctgtcgatgcagtaggaggagagcaaagttggagatttacttttgcactcgggcctctcggagcagccctcctcctggtactgattgctcatggctggggctttttcccagggcgcagagagcggatcgccggctgcctctcccggagggtgggatggatgggtgtgtgttgggggtggggttagatagcgggttataacggatattattgcgatctttgtgcctttctgcctcccttggttgccggctgccggctcccgccctgcccgcggcccgagctcgccctctccgcgctcaggacaagcggtaacaagtgtagtgagcagcgggcgctgagctctggagtctctctcctccacgtgctgagaggcgccctctgattggctctcgccagaggccgggctgcgtcggcctgtgggcgcggcgcaaagcccggactggattccagaggggcaggcgggggtgggggcagcgggcacgcaccagagccaattttccttttctttctttctttttttaagttaccaattttctaagtccgctatcctcttcctgcagctcctcctttgaccctttagtgttggccgaagttctagcttattgggatgccaggcctgtgaatgccatctgggtggcgtgcgccccttccaccaacccgaggacctcgctccctggaggcgaggcctcgaggctcacgttcagactcactcggcacttttcaaagccgatattgggctcccaggacaccgccttgacctccctggcgctcaattgccgtcctctctaggccggacgggcgtcggggggccagggtgaccgccccaagcaaacatctgccgtctgggagttcgcttttctcttgcggcccaaggcattgcgctgtctatcttcaccctgagcccgactgtgtctctcttgtttgtagcgtcccccaaccgctctcctctccgttttaaactctggaatgggaaaaagcctccttacagacaaagctctgccataggcgcgcggccttccctagagcatttactgggtgggaagggacaggcgagtatcagcagcgaggaggggcgactggggacgagtctgggggcctcctctttctccctggactctcttccctctttcccccacaaattcgtatctgttaggccttcaccctgaggctgttcaccttccaatcgcagctagggagcagaaccctcagggatccctgacctctccagggtggaaggaacccaaattcggctgcagccaaatctaagcgtctaaaattctgaattctcatgacctggctcccttgagcaaaggtgagagagtgaaccttagagagagcgcctttcttcccaaacagtttccagcgccgagaactaaaacccaactccaactgatgttgggtcgagcctgggccagcacggacgccttccctgcctgggtgcaggttcccagggatttccaggggccccaacgctggcagaattggggcgaaggtggtgggtgagagaggggccagggagggggaatccacgccgggttttcctctctcaactcccttcaatgtgtcaaagagaaaagcattttacaaaggattatacttgaatcacttacagtcagtatttaaaaatacaaggatgcataactgggatttttttttttcagccataaacatctgcataactcttggatgctggtgggtgggtagcagacagatcgggctgcctccgcaggaaacttcaagacaaaactggggggaggggatgaagggttgggaacaggcacattaataatgcgaatactaatactgatactactactactattaaagacaggacaaaaagaattcctctgtccctctctctctctctctctggcttttagcttaattctcatccgtttttttctgcacttggatgatagggcgggctgtggtggggagcggaggagaacccgagccatcgctgacatttgattttcctttaagccctctctgcgattcaaagtcacctgggatctctccttgcctttcccgcattcttccttttccatccccaccaagagttcggtgtttttacaccgtccggttcagctttaaactaacattctgcgcgctgatttcctcccacattccctcccccggccccgaaagcccattccaggcgcgcgggtctcatcgcagccaagaggagtaaagacacttcggtttcctcctagcctccagccgcggaccctcgcgggcgtccctgcggcttggtggttgggagagacggaggcacttttccctccccggcgggccccgcgttggaaatccacaagacccggctgccgggtggctcagtgacttcagagtcggctccgcacacgcagggagtgggctgaaaatgagtccaagaaagatcgtgttaaacaaaaacacaaatgcacaaatcatttctgagagcccaacggagtttcagctctctgggtggaagacttctttgcctccatcccccctcctcccccttgtgcagctgttcttcttttaaaagaagtcggactttctgctggggtgtattctaattttaatcatccactgtaaaaggggaggttaacaaagaatttctgattctgacttaatgatccctggaattagatctaattctattaatggaatataaagtgttttcgggggagacctgtgtgaaaacactagttttatttgttctgttattttatttatttttgttattttctaatcaatcttcccaagtgaggatgctattgggaaacacgtccattcacctcggggagaagggcctgacctagctcactctacacccagtggccctgagaccacctttgtcacaatccaatacccaacttcaaaaatctacaattaacttttgctatttctaagagattaaatttaaaaaattacagaaaacttttctaaggtgctgggtagagagacataagactgtgctgtggtctccacaatgcctaatcaggatatgggattatatatatatatatatatatataaaatatgttattctatatatcattttagaaacaaaattatgcgtctaatatctaggaagagggtaactgatgtgttgagtgggcagacttttaagaattgggctataggattacgtatgaaagaacttacagtttagcccaatttaattttactttgccaggaaaacgacacttcactttctttttgcctcacttttactcactaatcaaaagtaattgcattttagtgataatatcattcttgtttgtactttgttattcacaagtcctggctcctctaatctttggggtctgtagctgttggtttgcttttcctggtctgcttggaaaacaatggtttgcagtttatctgcttttaaaatcaatcactaaataaaaatgacaataatggctggaagtgaaggtcacatgtgtttagaactgttgtttatggtgaaaaatggggcttgttcctagaactggaaataataatttacctagaagaggagagtggaaggagaaacccctttcttttctgagagctaattctacattatagttttaaaattacatttgcaagaaatgtggaataagggggggtggcagttagatgtcattatccagaaaaaaaaaatgtttggaagagagttaacctcacatacttttcatttgagatgttttaatttattgtgcaatatacacatagataaatcaagctgtgatgggcttccagttgcaccggacggctcaggtccccttaaattacgatcagcctcttcaaaacatatatttaaacaatagaaataaacttcattggaatctagcgaccaatttggaagccactggaagagaagacaataagacctgattacacgcaaggattctctgtgatgtgatatcccttttgccaagtcattttgctgttttatttatttaatttcttttttttttttaaacaaactttcattcatttatggtcttccgcaacctgctaatttaacactggagcgcgttattgcagtgttaggaggagagaaagagagagagaaaacaacaatactgcaatgatccaaatgatacagtagaattatagcaattatagttctacttgtggaagaaaaccttgctgagatcaggcaaacaaactgaagccttgtgaggataacaagcgtcgggattgacagccggtgctgggaagagccggagggcacaaacagaaatatttgcttccccccacccccccttaactccaaccagtcaaggttaacctcctcaaacgctgctttcagagtcttatccacttcagggtatgcattttatgcacaaatcgaggtgtctcctcctggaagtctggtaataggaggaagtgtaacataatccgcttgcctagaacttgcccctcgccttcttggcctcctgcgtgctctccacttcctaccctgcctcagttctccccacggctgttgggatctctctgtggacggtgtttatttgttgatgtattttcaaagaaacagcccgtggaaaggtccaaagggactgatagaacttggatttcctgggaagactctgtcgcgtttgctaatccttccctcttcgccgtgtcctcctcctaagccgtgggttccacagttagggcttggctgggagaggtttgttgggaagcagcttttttggaagcctcccgaggaccacggccgagccctcaaggtatggacgcgtgagtgtgatggctatgttaggacaactccccttatttgcaaacttcctcactttctgttgcccgtcagcagccgggggagggggtgggggagcaagaactagagaggaaagagaccccctcaccgccaccaccatcagccatccgggcggcagccgaggctttttcaagctttgctccaagcataaagctggacgagatggtcgcagcctcctgtctgctctcagaagagggggtgtgtgtcccctcccacgggcgagaagcaggtggttgggctctgagctctcacggagttccttggcgggagttccccatctcctgccgcacccatccctccaggtttccagacctgagagagagggaaactttactgtgccctgtaatcaccaccatctgctttctcctctcctccgccggacggcgggaccccgcctgcggccagggtcgaggcgtccccggtgcagcgttgactcagtagctgctgctccgggcgaccctggacggggtggagggtggggacgggtgggcacagattggagctagagtaagatgcagcgggctacccaacgcgtgtgtcaattcccaggccgcgcggaccggagctgggctgtcggcgtccgcacccccagcctccccacctcagcccccttttcgggctcggctcagcgccacggccagagcgcgccccctagcgggggctccgagtgggccgggctctcctgccgcaacctctggggactgaagttggcagagcccagtgatccggcaggaatgaatgggggaaaaaaacaaaagccttggaaacatttccaagtgttcaataaaagacccatctgtacctttcttctccagcgcgttcgtggttaatgtccccccatgcgcgcgagaagggagataattgctgggtggattcttgtcggcgaacctcgggaaacgctggactgagaagtgaaataattgggggtggggccaaggcaagcgtgccgaggatgcgacaccagtcaggaagtctgaatctgcagtctctggggtgttcatggaggcctggcggcctgagcccttagattcctcagtgcctggtgttggtggtggtggtggaggatcgtccgaaggcagctactctgagatttctctgatttgacatcggcctctgtggtaccttcatatcactcatggtcccctcctatcttctgatttgagaataccccactctgtgattctaagttccctgagctcagattttggggctcccatcttctgaagctaggagtgtccactttttgactagatgatcccctacctcccgtctctgggatttctccatcttctgacttgatggacttctgggccaccaccctgctccatctccccccaggcatcctcctctcccactcctttcacttctcctgcaacatttgcctctggaaatcctcaaatcccagcttccactacttccactactcatacattacctactccctcttggtctggccagaaattgagaaaagagaaatgcagggttcttgtccaaccctctttgacttgttcaacctggaaataactgaattttcttgaagcccttacaacctctggtttaaaaaaaaaaagttaaagacgaagcttttacaaatgtaaaaaattcccagttcaaatcgatccataacttacttcttttgcaccgagtgtgtcaatctgaactcatcaatcagaaaaacagaaatcgtgcttctaaagacctgcaggattttaaagttataccaaggccaccaaaacacttactaggtagggcctagaaaggaagaatccaaaaatagtagcgacaacagctcccagagtcccttattttgcgatgtgtcttgctaattgggaagttcaacacgaggctttccctgcccatacaaggctggtatttcagagcgggaggagcagatggaaggggtcctgtgggaagggaggtgtgggtgtccctgtgtttaattaagagttgtattgtgtggaagggaggaggaaagatgccgggctgcacagccctctgttcccttcatcgcaaaataacctgcaagtgaaaaaaaaaaagaaagaaagaaagaaaaagaaaaaaaaaaaaaagcccgctactaagacggagccggctctggaatagataccattagaaccacagtgtttctggaataaagatatctaatttcctgccgcaaatcacttccccgatcagaaaacacaaatagctgaacagaagggggaaaaaatagaggactcctccaaacccggggcagtgctatcctcctcccaaccacccccactctgctcccgactttccagcccacccgggatcccttttgaggacacccagcatctttgagggaagggagacggctcccaggctgaggttgggacagcgacggtggcggagaactggggcactcacggcctaggggcctcgtggggccgctgaggccgggcctgttcggcaccgacggcgtcacctcctcttctaaccggtcaccccgggcagggccctcctcagggcaccgcttgcccgaggcggcctcggtttccctgtctggaaggaggtgcaggagcccgggggcaggggagctccgggcgccctgctggggccgcgctacttgggggcgttgcggcggcggccccgacgccccttgtcaaatcgcctccagggtctcggggacccggtgaacaaagccaagacccgacccccggtggccccaatggcgcgggtgaatgaggacgctggacttaggggcgcccgcgagagggcgcaggctgggagggcctgggaggagaggcgccgggctccgcgtggggctcgtgaccgaggggcccccaggacgcacagactcgatcgcgcctcgaaaatgaccgtggtggtagcaggtgcaggcggagagtggaggcagaaggagtgggaggaggagagcaaatacatctactcagatgctaatgcacagaaagtgagccttagctgttttttctttggagattaaatgaaatctcaaacggatttgtttttgagtaggaaattgtagatttctcacaatcgcatgaaattttgtgttgcacgcctctaatcaacatcacattctttgcccccactttaggctttgcaggtcttagtacagttctggtacccaggaacatctttcccgaaccagaaaattgcactgtggctgtgggagtgtagtaggtacttttatttgggcaaatggcacttgatgtttcatcctcatgaggtgggcgctgattgatcttttcccttatttaaccaggcctcattcttttccctcaattctcccattactgctgttggggccatttcattgttcattactcctacggtttaaggcttgcaagggactaaaaagaaattaaaagcaacgtattttgcttagagaatcccagaaaggctggaaagaaaggcgattgaaacccacggttcaagtgaagtttagacataggagtgatttttacatatttctttttcatggataatagggagttggcgttatc

SEQ ID NO: 8105 - DNA, 1282 bp, artificial
  synthetic oligonucleotide
gttaaacactacaagctagctgacagtaaaattataaatacaggtgttgtcacactacactataatcagaattttaatttgaattttcatttgtaaagcctttttttcagatgaaaatgggaatagaattagttttattgacagtaaaaagacattttgaaagcttcctaaatcattacctgtatttagcaggaggaaaaattgtatatgtccatgtaaaaagaagagttttattatcacatatttactcattatatttggtggtaaataaaacggggaagacatgtttgacaaatgattgacggaactcactaggtttttgcttcatcagaacaatagacagacataaatatatattttgcttttgttttgttctgctattactaatgcagacctgtagacaaaatctgtttctagcaaattaagtgcagcctattgggagtctgcatgcaatgctaaactttttatttggcaattttctcttttcacccagattcatcatctgtggcgctctttttaccccttttgcgtggtggttggagtgggttcccccttctcaggtcccttttttttttccctcaaggcatttagtgtcgtgtctgccagatttcagtgatgagcagcgaattgcttttaaagtgggcattatgccagttcagcagcacaatggaaaaccaatcttccaccattctacttttgatgctgttattgtagcattttagataactgctgccacaaaaaaaaagaaagaaaaaaagatgtgctcaattgctaccagttagtcaagttaaatccagagtagcattaaaattactctgaaaactctttgtcagaggtcatgtgccgtctgtggctgccacacataggatggatgttctgttcaggtgggggtttttccctttattattactgtgactgaccagctctctaaatagccctttactacctgtttacttattgtcttcacctccctgttgaaaaaatgtgtcaagcagaaatgttgaaaagtttctttaaagtgctggaaatagcaggagagtgagtcgttcagggtgctagagtttgtacaatgtgaaagcaaaaaaaaaagtcgggggagagcaagaacataattctctggtttctatagcaagattactgttttcttctttttatcttcacttttcaaccactgggttcactgttctactttttttttaatagcacaaatggaatttatcttctctccatctcaagtccctcccctccctccactggctttgcttgtgaatgaaagggactc

SEQ ID NO: 8106 - DNA, 959 bp, artificial
  synthetic oligonucleotide
atgattttttctttatttgacatttaggataaattcttatcaacaatacatacatacattgcataaatacaatatggtcatgatttatattgccaaattgctttcctaatgggctttcccaacttatactgtataccagtactttatgaacataccagttttaccatagcctttctaacatttggacactatcatttattttttaaaactaatttgatcagcataaaaagttccttgccctttttttggtatacctttgatgattagcaactttttttaaaatgtggaatgttagaattagctgtcattgaattatttttacgtcattcttgtctcaagacttgcatcagcaggtgcagagagagaacaaaagtgtatgtatttagtgtgactcatcaatccggttgtaggctttaggggaatcaccttgcttcatgaactgatgctgcctttgagactttttaaatatctaactcatcaagttaagttcaatgaaaatcaaattacttcttagaaaatcaaccagttttatgattgcattcttggtaagagaaggtaaaaggttagtctataatcttagatcgttaagctattagaccgatacatttcgaggatgatgttgatagtggtttagtatatcaggttatcttttaacatttattaatctttttagatttcaaagtgacttgtttttttcttcatatccttgtccttctcaaaactgcagcgttttagacatgtgtttctcaaggttatcagctactcttcccaaggagaagctttcatagattagctcctctggttccggtgctgctcaggacatgaccctatggagttactcagtttcagagcaggctggttggtgatactttccttagccattcctgacagggaccttgacagtgggactcagaacactcttatgtactcgattttgagttgctaataatgggcgagga

SEQ ID NO: 8107 - DNA, 3288 bp, artificial
  synthetic oligonucleotide
agtttttcataacctcaattctgtattcttcgttgattgtgaacctttgtggtagagactggggaggacagtaccagctccaaaacaaattgttccccaggggaccgaccatccatgtaggtaggcaaaacaagatggtaaaataagatggttaagagacagtgcaccgcagtgtgtgttcagcgttaggtggaataaggaagaaatccctgtggatcgggaaaatttcacaaaagacgaatggaactgatgatcaaggaatcgaccttttaggcagaggttctccagcctgtataatgataaggaggtgaaaacaggcaaaatatggtgagtacagtgagaaaaccaatctgattgggcagtaagtttgtgtaagagaatgatgagaaagggcaggggagtgggatgaggttgtaaggatttgaaagccaggccaatgaatttgttcttaattgtttgtggaaggtgtgtgattgggagatgggagtggagagccctttgcattggatataagagagaacggagtcagggaaaccagggaggaggctactgaaatagaacagtctgaggtctggctttgatgaggttggtggtaatgggactataaaggaaagaccagtggacaaacttggtgactgattggaaatgagaggggaagggcccactatgtatttgactcaagtatgcaaactactatgcattgttattttccttattgttttttataaacttgctcctctacatttttatttgattgcttctgttcatttattcagaagacttttaaaaatataactccaacttttattttagatttagggggcacacgtgcaggtttgttacatgggtatattgcatgacactgaggtttggggtacaaataatcctgtcacccaggtagtgagcatagtacccaagaggtagtttttcagcccttgcttccctccctgctttagtagtcccagaatctgttcccacctttatgttcatgtgtacccaatgtttagctcccacttataagtgagaacatgtggtatttggttttctgttcctgcattaatctgcttagcatgatggcctccagctgcatccgtgttgctgcaaagaacatgatctcattcttttttatggctgcatactatatattccatggtgtgtgtgtgtgtgtgtgtgtgtgtgtgtgtgtgtgtgtgtgtatcacattttctttatccagtccattgttgatgggcacctaggttgattccatgtctatcatgaatagtgctgcaatgaacatatgagtgcatgtgtcttttttgtagaacagtttatcttcctttgggtatatactcagtaatgcagttcctgggttgaatggtagctcttttttaagttctttgagaagtctccaaactgcttaccacagtggctgaactgatttacattcccaccaacagtgtataagcgttcccatttctctgcagccttgccagcatctgttattttttgtctttttaataatagccattctgactagtgtgagatggtatcctattgtggttttgatttgcatctctctgatgattagtgataagcattttttcgtatgcttgttggctgcttatatgtcttttgagaagtatctgttcatgtcctttgctcactttttaatggggttatttggttttcacatgttaagttgtttaagttccttatagattctggacattagacctttgtcagatgcatagtttgcaaatattttctcccattctgtgagttgtctgtttactctgttgatagtttcttcaaaagatatttttgaggacctcctatgctctacagtttcagatctagatgatttctgtgtgtatagccttctacaaatacaaatgtacacaaatgaataacagtttgtgtttaaggtgcaactactaggaacgcctcagttacaagtggaaattgatccctttttaacatgtgcagaagaagccattttagttgaggcctcaaaaatataatttagtaatcagaaccaatcaacatttgacacaatttcatacacaatgattttaaggaattagtgatgctgagattaaagcaacaagtcatagagcttggcatattttggtaaaggtttgttttgctattggacaggctgacttcacctcttttgaactttctatttataaatgtggctaagccaggcaactaaaaatttattgaccttattgctattggttatgataatttgtgtgcggcattacgtaataaaattacgtatttggatagcagacatccttaaagtgattctagaggtttttattaaaatccaaatctttttataggttgagtagttccaaggaactacacttttattaaaaatgttctcttctgtttacttgtcaatgtagccttgggctgtacaggctatatgttatttctgaaaatgaggaatgaaagtaagttaagttttgtctttgtgagtgatcaatcagagtgaacttatgcaatattattattttcatttgctttgtttttgtcatttttaagaaacaaaattcagtatgagatcttataagatttgcatcatcatggaatattttcaaatacctgttatatttatttatttttattaaaaaaaatttttttgagacaggatctcactctgtcaccctggctggagtgctgtgacataattacagctcactgcagccttgacttcctgggctccagccatcttcccatctcagcctcccgagtaactgtgaccgtaggtgcgtgccaccactcccagctaatttttgtatttttggtagagacagggttttgccatgttgccgacgctggtcttgaactcctgagctcaggcaatccacctgcctcggcctcccaaagtgctgggattacaggcataagtcaccatgcccagcctatatttattttttaacagcacaaatgttccttgaaggttagatttagctagccggttggcatttgttgggggaacaaggggttaaataaaatgtactttacaaaattgaattgaagcaaagcatatatttaatatgattagggcctatttcctacatagaagagttttgtttaaaatacaccatgaccaaaagcttaattatcaaaataaaacaagaagcataaagagttacaggcttctaatatttttttcagccccagttcccttcacacagttatcagcatgtttaatttccatgcataatagcactagttattgttgtcatttgtaaagggagattaacagatagtaagtacaaacaaacccaaata

SEQ ID NO: 8108 - DNA, 1755 bp, artificial
  synthetic oligonucleotide
gcacaaaaacccttttatagcctcacagtaattttttgtatacttctcctgacttatgtagggaacagatatggagcccagcttgtatcgttgcagtaacatcgattgtaaggcttcacctctgacctttacagtacaactgagcaacaaattgatcatggacattagacgtttcattaaaaagtactatgatgtaagtatccataatgatattcttacatacacaacttattgaggtttggtacttgtttattggttttcatgaaactaaaattttgaaaagacttttgggaaaaattcctagtgaaatactattaatacaaatatgataaagtatgtaattttggcatattagcatgacaaattatttgataatttctctcaggcattacatctctttcatttacgagcagtattttaaataatgaaatttttacttcttttagaaaaagccagaatataattaagaaatgttttagtttattgttacctaaataagactaattaaatgattgcttagatctttggataaaggaagaaaaaaatcactattggctattgtcagcaagtagagccataagatcgtgtgtagtgatcttagtggactgcccacacaaaactaatactttgtgtttatgtagcactctaaacgactccataccctagttttttgaggaaatcaaatatcttttaaatttaaatgcagtttttctggcattcaaaagagaatatctaatttttataaatttatagtaaaaatgccagaacagtgagtgatttgtcttcattggaaagaaggcttttattcagagtttttgtttttaacgcatttcacatgaattagtttttttctcttcaaaaattaaaaatttcacatttcccacgtgatttttcttagtgtttcagtatgtcatttgtcatctaaacaaattttctgttacttgaaagtttactgtaacttctttttaaaagctacattggcaacacatttcaaaaaaaaaaaaaagctcatgtcttagttaaggcctatgacttttctaaagattgttctgtactttttactcgtattagttaacatataatagcattttcttctttaaaatagaactcattatgtgaaaagtaactatcagatcattaagatgaagagtaaaaacatagagttccagtattatgattttggtgttgaatatatttatcagaaaagcaagtcagtttgcctaaagattattaaaaaataataattatgactacattttgggaaaatctgaaacattttagtgaataatcctgtgctgcccttactgaacagtggatgggaataaaagttggctgtggggtcacattcctcagtaggtgagatgtgcagcacatgaaaatttaggccaaatcaaaactattcagctcctcatttacaggcctcattgaacagagtatgatccttgcttgactcttgggaagaattctgagctttctctctgtgtttagtctatcaagatcttcaccatggaaatgttaatactagaagaaacttatctatttccttctttaagagggaatagtctgttttgactaagttgcaaatactctgaaaaatgatcttctgtatagctagaaatatgccctgactgaaagactgatttctaacctaattgtgtgtatgttgtggtggtggttatataagtatttttcaagctaaataacctacttttagggatccagatatttaacacaaggtttctagagcatttgctt

SEQ ID NO: 8109 - DNA, 1731 bp, artificial
  synthetic oligonucleotide
tagagctagagcttgggaagctaaacttgtgattacttactagtaaacaagagaaaggacctgttgtaggtgcaaaaatcttactgaaatgcctgagtatgcactggagaaagccctggactgcacaccaggggtgctcacccacttgtttactttttgtggctttgagcaagtcatccattctgcctttggtttttcacttgtcagaggggtgctagatgatgataattactgctcagtgggcttcagttacaaagcaccttaacatagagtagctatctactgttgtttctcagaacaacccaggggaagcattcgtgcaaggctccgagtacctagcaagtgtcaggcatgccacgtggtgctgctgttagggagacagtggtaaacttaagcattcaaggaccttgtcttcatggagtgttcagtccattaggtgagagctgttaatcaaatggtcaatgaataattatgtcattctgaaagaaaataagtgctaagaaaaggcacatgaatttctgagtcttgatagcaaaggcccttgacctggactgaaaagtcaaaattttcctgatcctttggtacttgagctgagatctagaaagtgtgggctggagttaactaggtaaagagttggaagaataagcattctagagtgagggctagcatgtgtagaggtcctgtggtggttggaagcattatgtggccagggcactgagaaggctgaggtagctgaagtatagaaaggaaggggagagtgataggaggcaaggctggaggggtaatcaaggtcacaccatatgggctttgcaggccacgttgaccaagaggcagatgttaatagttttttgggtttttttttttgaggcagagtctcgctctgtcgcccaggctggagtacagtggcatgatcttggctcactacaatctctgcctcccgggttcaagtgactttcctgcctcagcctcccaagtagctgggactacaggtgtgcgccaccactcttggctaatttttgtatttttagtagagttggggtttcaccatgttggccaggctggtctagaactcctaacctcaaatgatccacccacctcagcctcccgaagtgctgggattacaggcatgagccaccacgcccggccagatgttaataggttttatatgttgggggagattggctcacatttccattttgagaagatcactttgcctcagtgagttggaggggccagagtggatgaggggaaactgattagcaggctattattagaatagaattccaggcaagtgatggtggtagcttgactagtgtgatggcagtcagtggagggaggaggacccagatatgagagagatttaagagaaaaagtatcagtaaaactgggtggtatattggatgtggggcttaggatggggaaggtatcaaggtcaactcttggctgacttgtgtaggaagatggagtacctttcactgagatgaagagcactggaagatgaccaggtttggggcaggaggagggaaagatgaacagtttgatcgtagacatgttaattttgaggttgcagaatataaactggggagtcattggtttatagtcattgttaaatgaagccatggacatggatgagattactttgggagagaggagagagtggaaagagaagtgggtgtaggactcagtcttaaggaaccccagcatttaatgacttggtagaggaggacaggc

SEQ ID NO: 8110 - DNA, 677 bp, artificial
  synthetic oligonucleotide
agattgctgatagatgtggtttttaaaagggaagttaggaaattgatctatttattttaatgtgtctacttccttttctgtttgtttcttcagttttcgttgagtgagtatagggagtacatttggaatcaccttatctcggtaatgcctggcggtttagtctgagggaggccttagtttggggtgcatccctcattatgctgttattcatatgtacttctgacctggctgatgtggcccagctgttgtgcatagtgaactgctgacctttgaaggagaggagaatcactattcaatatggatagtgcatgtttttcctgttacctgatgtttttcagtaattgcttctatgatagtctgctttgtcttaaaaatgtttcatgattcctccaaggcagtgtttcagtttttttaaaacctattttgggtcctggatgctttggagaatctgatgaaagctatagacctctttcccaggaaaatgaacatatgtacacacacgtgaggatttgcatacaacccaataatgtggcttatttttagttagatgttacaatatgtcattcttattagaaggcagggttgaagaatatgccagttaatgacagatgtcttaattatagtagtttttctttttcagtaaatagctattgatctgttgtatctattctctttca

SEQ ID NO: 8111 - DNA, 2453 bp, artificial
  synthetic oligonucleotide
ggctctatcataaaacctaggtaatgcttttgttatttcttttctaatttctttatcagagttactgcattctatttaatcgtctcctttcttatattttcctctaatgaagaataaggcaggtagagaaactacaagttttcctggcagaagaacttccccttgaaatataattcaatcatatctgcaatattattatcaatttgttacttacagggatctaaaatatagactgctttaaagtctatttattcactcacgtatgccagctccccacttcatttcagcaactaggagaaggagcctgccctctgaaggagaatccaagtgtggagcttcaatcctaaacaggccccctgcaaatatttcatacactttccatagttagttaagcaactcagtagccacactctgttgatggctgtggtgtcagtgacccacatacaatttggagctatatgcctgggtgctgggagaaatgcagaatttatacaatttgaaatatgaagacactagcaaagctacaagatcaacagaaactactaaaaaccagagaaagaaatgctaatttcatgttttcacttgctgctcactctcttcatcaacaaacttttttattaagtagttagcatgtgccttagttattaaagtaagatcattagcaaaggaaagttaggctataaagtataaatctaaatttagaatataaccctacagtgatcaaagttagctaataagagagaaggcaatttgaaaattttagtagtgttttataaattggttgcaagcccctgtttaaacagagtcaaatttcagtagcccatgacaatgatgaacaacgtggaaaattttgtatcataagtaaatcaaagcaggtgcttcaacagttcaacttatgtacatctgtatcatacctatgcatgtgcatgatacacacacacacacacacacacacacacacacacacacacgaaaccagaactgccaaaaagatgggaagggaatgtatctcacttatgagtatgttatagaagaaagatcttccacttttccggtgtagagctctgggttcaaatcccagctctgcccccttcaaagcagtgtgacccttgggcaagtcacttaccctctctgaacctcagtttccttatttctacaatgggtgggaggtgagggtgtagagcacattgccagctttgcgtggttcttgtgagttaccacctggaataagctgtcacgagtgaaagtggaaagtaacttggccaggtgcagtgggtcacacctgtaatcccaatactttggaggccaaggtgggcggatcacctgagggcaggagttcgagaccagcctggccaacatggcaaaaccccgtctctaccaaaaatacaaaaaaatattagccaggcatggtgctgcccacctgtaatcccagctactcaggaggctgaggcaggagaatcgcttgaacctgggaggtggaggttgtggtgagccaagatcaggccactgcactctagcctggaggacatagtgagactccatcttaaaaaaacaagaaagtaacttgaactttcttctttcccttaattttctctgcccatctccctcaggcagaagcaatcaagaagcagaatagctaagaggtaaaaatggaaggaaaaatagtaggcaaaagagactgaaatgatgcacaaactggagctggatgccgcctttctctcctctgccctttacctctgtcaggaaggtatgtgatgcaaatttgaagattgtggttactttaaaaaatatatttttgggtaagcatgggcacaaatatatatacatatgtgtgtatatatgtatatatgtgtgtatatacatatatatatatacacacatatatatattggtccagtgctgtggcacaagcctgtaatcccagctacttgggaggctgaggcaggaggatcacttgagtccaggagttcaagtttgaggccagcctggaaaacagagtgagtctctctctctatttatgtgtatatatgtatatgtgcatatgataatcttgtaatatgcttttagtggtcattttcctttatgctaaaccataagttgtttagtgactcaaaggaatcccttagtaacaaacttattgggatggtttgtatctcatgagaacatagacactgcactgtgtatgtcattcagtaagtggctaaagtgctagggcacagttactattaaactgccctaagagaaaacatttttaaaaatagaagcataggggaaaaaagcccacagggctctaatataacttcctctgtatttgtgctttttaggaagttgttctaagcctcctttgaacccttattaactcttattaagaaataacagttttatgatgggttggccttctcatctgcgagccctaattttgcaggttcacagaaaatgctacatcacaaaat

SEQ ID NO: 8112 - DNA, 1289 bp, artificial
  synthetic oligonucleotide
taaccctcagcatcctgatgtcaggttcagcatgcatgaattaccgagtagaaaacaaaaacaccaagtcaaagattttggcgggagggaggagattatatgaaaatgaattctgctcaataggctagccccgtgtggccctgcacactattacacaggcgcacactaccagggctcactgctttattttctaatcactgtgttttcaagtctgccttcaagattgttgagtgctaaactgtctctttatccccaagcaaggtcagcttcccagcctcccatacaacccagttcatgctgggataaagaggaaggtaggaatgttaaaacaataatgctatggtctgaggccagcaacgggtaatcagatcctagcaaggtagaggctgttacctgggagattattggaagaaaataggcctagcttgcaatgacttagtttgtttctaccttccttgcttttttttccttttcattcttccccccagtgatctgatgggataattattttcctgcatttatttccctaacagtcactgagaagctttgtgtggggcaccagctaaagatgtaagagttttgggactacagcctgacccattgctggactttaaccccaagtagcaagcttagatggacaacattgattaagaaaggcctctatagttcaagcccatactgccatgcctcaaagaaggcccaatgtttcaaacttctgtagtatgaaatagataaattaggaggctactgttcacattaagaagagattcaacacaggtttcccgaaacaatgaatagaacattccatatatgatttggaatacattcaacctgtctgagaaagcatctgaagaataaaacagaagacagcagaagtggtttgtacaacatcaatgtaaaacttcaaagtgcttgtgaacatttgttattcatatttagccagtgtgtcttaccataagatcatgcaacctgtttttaccccaaatggataaaaccaacagggggtgaggaatggggtagcccagacttttgataggagcatgagctcaaacagaacatactgcagtagaccaagttccaaggcaatgaaagctagaatcacactctaaggatctatccaatccattgtcggggacagaatggaatccagagaggaaagtgatttgcttaagtgcacacaataattcaatggcaaaactgacactggaacaagactatgggctccagcaagtccagaccaagctttagcacatttgtcttgacagccccctgtcctttcaccgtgggct

SEQ ID NO: 8113 - DNA, 860 bp, artificial
  synthetic oligonucleotide
gaaagttgggtggcctgcatcgcctgacattttttcatttgctttcagcttattgcaatatactgcagttcacctgagcctagataaaggtatttgtggattatattatctagttttaactaaaccaatgcacataaatcagcaggtggcttaaaacatttcctgcaggccgtgcgcggtggctcacgcctataatcccagcactttgagaggctgaggcaggcggatcacgaggtcaggagttcaagaccagcctgaccaacatggtgaaaccccgtctctactaaaaatacaaaaattagccaggcatgatggtgcatgcctgtagtcccagctacttgggaggctgaggcaagagaatcgcttgtacctgggaggcagaggttgtactgagccaagatcacgccaccgcactccaggctggggacagagtgagactccatctcaaaaacaaacaaacaacaacaacaacaacaaaaacatttcctgcaatgaaataggaaagcaaagataatgcaaacacaagtgaacaacaagaaaatggcagagctgacccttctactccctgtaaaagttctgcagccaccacattatcaggtaccaaccacgacaacccaatctgatctgacaagaagatagctgaattgaaaattatctcacagaagaccattagaaatatctgctaccaataacattaaatatcaccttgagatattagctaatgatggtatgaagttattgtaattaacatattttaaaatgaagcatccagaacatgaagataaacctctatgatttttccatgtttaatgtttcaatgttgtgagtcatgtgatactcaatccagcatgtcacaaaat

SEQ ID NO: 8114 - DNA, 2195 bp, artificial
  synthetic oligonucleotide
accacttaccaatggttctcccagtgtgatccctggagcagtagcatcacctggaaacttgttagagatgtaacttcttgggccccaccccagttggactgaatcagaaactctaggagtggaacccagccatctgggttttaagaagccctctagtagattctaatgcaggctccagtgtgaaccactgccacttagtagtgaatgaccttgtgcagattcacaacttctctaaaccttcatttcctcatctgtgaaatactaaaactactaatcacatagagttgtgatagtgaaatgacatgatacatataaagatcttaatacatagtaagtacttaataagtatccattattattgttaagcaaactgttcttcattccatggattctcttaagtttggtttgtttgtttttttttttgtttgttttctgcaatggcaactagaaaccatagagttatgccatgttattttattttatattattattatttttttttttttgagacagagactcactctgtcacccaggctggagtgcaatggtgtgatctcggctcactgcaacctccaccttctggattcaaatgattctctcacctcagcctcccgagtagctgggattacaggtgcctgccaccacgcctggctaatttttgtatttttagtagagacgggatttcaccatgttggccaggctggtctggaactcctgacctcaagtgatttgcctgcctcagcctcccaaagtgctgggattacaggcatgagccaccgcgcccggccgagttatgccatgttaaatggcttaaagtttacctgttcaactagtcttatttttcaccccatcccaatcaactaaaacaacactcactcctacacagctgtctatttctgtcttcactattcctcttccacctgtctgcaatacctttgcatcttctgcccacacagtccaaatcttagttctcctaaaatgtctgttctgctccctcccggaagtcttgcatgatcactcaggccaaatgaatctgccattctctaagaatcagttatcatctgtgttgcaggttttaacccctaagcacctgcacacatgctactaatgttttttatttcacatctagttgtcttgtctcttgaaaaacagatggtaccttataattctttccaaatctcttccctatccatcctctggcataatgctaaagggatgaatgaatgaacaaacttctatagcacaacccactctttttaaggcacactagaaactttttttaaaaaatgcatacttttaagaatggcaataattatagtagcttaggtttgtatatgccttcatggttttaaaaatgctttggtacttttgatgaatctagttatcacagaaaccttgtgaggtaggtattgttatccctgttttaaggaaacagattcagatctttctagtgacttgcccaaggctgtagaactaacaagtgacaaagctggggctcaaactccctgtattctgatgcatctttttcttggctcctttggttggtctggtttatcactgctagtgtttacccttctttacccttgcactgcgttataatctctaagttcaactctctgcttgaaagcaagtgctgcacaaataatgatgggcctttctgatacttttttttttttgagatggagtcttgctctgttgcccaggctggagtgcagtggcgcaatctcggctcactgcaatctccacctcccgggttcaagcagtcctcccacctcagcctcccaaagtaagtagctggtactacaggcgtgcaccaccacacctggctaattttgtatttttagtagagatggggtttcaccatgttggccaggctggtctcaaactcctgacctcaaggtgatccacccacctcagcctcccaaagtgctgggatcacaggcatgagccaccacgcccggcccctttctgatactttaaaatgtcaagacagggcccatttaagacaaagaagtacagcctcacctggtgttcctaagcgggcctgagcaatggtcagtttttcatggggtgcttgacactggcagttggtttcatcagcaaatggggcaggtgcagtcagggtctagaagggagaaaaagaaagggaatacagtctgacaaactttcctttggcactaacttcctctgaagtt

SEQ ID NO: 8115 - DNA, 2541 bp, artificial
  synthetic oligonucleotide
attttaatcaaagatatcggcacctcacagcccaggcaaatacagttgctcagaatcactaacatcatctccagcaactgggctgccctctttgctttttaacagcttgttttgcttattttaaagattgtttttattattattattatataaaaatggcatcctgagggaatctaagtcactgttaatgttctttgtctactataaagacacatgcacatgtatgtttgttgcagcactattcacaatagcaaagacttggaaccaacccaaacgcccatcaatgatagactggataaagaaaatgtggcacatatacaccatggaatactatgcatacataaaaaaggatgagttcatgtcctttgcagggacgtggatgaagctggaaaccatcattctcagcaaactaacacaggaacagaaaaccaaacaccgcgtgttctcactcataagtgggagctgaacaatgagaacacatggacatagggaggggaacatcacacaccagggcctgtcagggggtggggggctaggggagggatagcattaggagaaatacctaatgtagatgacgggttgatgggtgcagcaaaccaccatggcacgtgtatacctatgtaacaaacctgcatgttctgcacatgtatgccagaactgaaatattgttttaacagttgctctattattaaactaacagcagtcctgtgggaacaatatggtagaactacaaaaggaagccaaagactttaggctttatttaagcagctgtaatttctttggacaatgaaaaatggccattaaggtttctaatgagcatctgtaaggccttaatcaaatgaaaattttaaaacgttagaataaaaaagtttctctgggtttagctttcattgcctcttccctcctccctttcctttcagcagaagataactcttgccttttacaaggggcagatctcccagaaacccttcaatcaagtctaaaaactctaaagagagagtttggggtaagaggagggaagcaaggaagcacctttataaaatgtgaagctcactacctgtgttctttggttaatttatgttacccctgtagatactggttttgtcatctgtaaaatggggataataatacatcatgggttattgtgtgggttaaatgagaaaataaatacaaagcgttaaggacactgcacaggcatggtggcaaatgcctgtaatcccagctactcaggaggctgaggcaggaggatcgcttgagcccaggagttcaagaccagtctggacaacatagtgagaccctgtctcaaaaaaaaaaaaacaagttaaatcaaacttaaaatattatacacagtgagaccccatctctacacaaaaaaaaaaaaaagagagagagagagggagaacactgcatagcacttagtaagtgctcaataaacagcagcactggtggtggtggtgtggcatggtggtcttcagagggtttgaggtggcatgcttacatttataaagctgacattcagttccttggctgtataccctctctggaggttacgtcgggcataaacatcatagtcacgaacaattctggtaatgatgtccgatgttgagatgccttctgttctctgcgttggaacgaacatccctgttcaagtagaaaagagcggatagaggaaaaattaagatcacctcagttgacccatctcctttaatggtccccctttacaggacaaagttggagctcctgggtatgccaatgaagactttacgtctggccccaagtgactcttccaccctcagttccgtggaattcctctctaccttaaatgctacatgttcatcatcccagacctgtttccaggacataccatgtacttgcctggcccctgctgtttatccatgctgagcctttcctttctgccctggataccccctccctgctcatattaactgcaaagctcttcctcatcctgcaaagtccagcttcaaggttatgcctctgggaagtcttttctgacgtcatcaggtagaatccacaacattcagaacctaacttatctttcattaacaaaaatattgggccagccatggtggctcatgcctataatcccagtactttcgaaggccgaggcaggcagaccatttgagtccaggagttcgagatcagcctgggcaacatggcaaaaccctgtctttacaaaaaatacaaaagttagctgggtgtggtggtgcacgcctgtggtcccagctacttcggagactaaagtgagaggatcacttgagtccaagatcaaggctgctgtgagcagtgactgcgccactgcactccagcctgaccttgtctcaaacaaacaaaaaaaattaaatatttgtctccatgtagaaaatgaacattttgaaagcactgatagtgccttaactgtctttgcatccccagcacccacctcagcccctgtgtctagcacatggaaggtgctcaataaatggaaattgagtgagaaagtaaatgaagactaacaactgagtcaatgaattagatcacagc

SEQ ID NO: 8116 - DNA, 2039 bp, artificial
  synthetic oligonucleotide
tgacaagataagaaaagtggatggaactctagagccttttatcttgatgctagaagtgtggaggctgaaggcatgaaaccagtcaccaatgcggctgtggaggccccaggggactggaagaccacctctcccgtgagagttcagtactttctcatggtcgttcagtgacagcatcacagctggtagaagcttggggcaatgcagcctgcctcatacattcagagacctttacaggcaaaggagaccttagaaataatttccttgaggccaaagaagtgaaaaggttaggccaaggtcacaaagtcagttagtagtggagcctacaatgcagggtcctgactgggttcaccatgtgagcttccctccacgtggtgctgttcctaactagctttcaagtcaaatgtggggcctttggcaactccaaggctttgccctgctctgcacggtgcacagtcacatccttctgaagggctggggccacagctgggcagagccagccggtgggccaggacagctgctgcaatgcctgtatttttccccattgagctagttcataaataggaacacacagcagcacacttaagaaacatgacaatgacacacgaaagtgcaattctgcatccctttatttataaacgagttgagaatggtgtggtccatttgagagcaagaatgggataggagcaggggggcagggggcgcgcagagttgggggaggctgattccagtagttcgcgttattcagcaccagagtaaatgcttgggcataaggtcgtgctttaacccagacaggtcttgtcttatatgtacagcatagtcttaagtatgtatgctctacttatggctttgtccctggacacatcgcagtgacacaacagaggaaaactagaaagaagtctagagaggagaagttgcaaatgcctcatgagctatttcttttttaaaaatctgatggccaagactagtgctgaacggatgcctaagaaacaggcacatctctgctagagacgggctcatctgcttcagctgagccagtgacaccgtctcgcatctctccctggggtatgactagatgctaaaataagtactgaagacggagagaaaataaatccgtgctcttcctgtccctccctcagggggtgaaataacagtatctagtagcctaagagcaaaactgaaatccctaagctgtgtctcttccactcagaccaggttagaagccaggccaatgtctcacgtcctgctcctcttgagcctggcatttctttgccttggtaaggtcctgacacacaggagcatgcttgccagaagcaagtcgttcagtgtgacttatggcacagcaatcccacccttgtttcttagctggtggaggggtgaccagttcattttagggtccccataagcagctaatatagaagtgctgaaatgaagcaaccagagaggcagggaccccatatcctgcatgggcatttgctaaccttggttgtgcgtaaaaggaacccttccctcttcacctgtcagggggtgagttaacacttgaaagggagcggaaaatcggctggacgccgtggctcgtgctcataatcccagcactttgggaggccgaggcgggagaatcacctgaggtcaggaatttgagaccagcctggccaacatggtgaaaccccgtctctactaaacatacaaaaattagctgggtgtcgtggcaggcacctgtaatcccagctacttgggaggctgaggcagaagaaccccttgaacctgggaggtggaggctgcagtgagccgagattgtgccattgcactccagcctgagcaacaagagcaaaactccatctcaaaaaaaaaaaaaaagaaagaaagaagaaagaacaaagaagaatgaaagaaagaaggaagaaagagaaagaaaaagaaagaaagaaaaagaggaaagaaaaagagaaagaagaaagaaaaagaaagagagagagagagaaagaaagagaaagaaagtaaaagaaagaaagaaagaaaagcggaaaatcactaccctcctg

SEQ ID NO: 8117 - DNA, 1015 bp, artificial
  synthetic oligonucleotide
tggcctttccgcctttctctgtgcctgctcctttacctgtttttgtctgtgtactggacgactcagtggcagcttgttgggcactctagtccttcacagatcatgataattttcagtgtaccattttggcttctgccctgcctgatcaccccaactgtcttgatcctaaattctcaaaagatgcatttaattaactcagcttatctttttttgcccacgatcttgattctgaattcccaaaagatgaatttaattaactcagcttatctttttttttctttccccctacgatcacaagttttaggattctgatcaatctggagattggatattctgctcccactcccacttgcccagtctgctgtggtttggagcgtgaggtgtgggggcctactcctttaaaaaatctccattggatcccacttgggatgggtttggggtaggaaggatgatgatagacatgccttattagaattgctttgagacttgaaagggttcctaaaaggcagcatatcaattccagaaggtggggtgcgggccagtgttgtctctgtgggttctaccatggtgcactgtggccagggccaaaaagtgcagaaggtgaatatagcccatcaaccttaccttcatcttcagatacttgcaaaatagatctcggattcaggtatggctctatgagcaagtgaatatgctgatagagggccgtgtcattggttttgacgagtctgtgaacctcatatcagatgatgcagaagcgattcattgtgaaacaaagccaagaaaacccctgggccagatcgtgctaaaggagatcatattctgccacaaaatgtctctaaccagaaatgatcaaggaagtgagacactattgagaacttgtttttttaggtgtcatttgttgggagtatagttctaaaatgcctgttcagattgtttccattatctgtatatattattaccagatgacagtaaatgctgtgggattgtttttattaaaaaataaaataaaaacaat

SEQ ID NO: 8118 - DNA, 2738 bp, artificial
  synthetic oligonucleotide
gattacttagctcttctggtaaagctcctggttaaataagttgttagtatgtcttttttaatgctttgatttaatttgaatggaaaagacatggtagtctacatacttctaccaagatgaagatgaccaagatgttcttgaaaatccaaaagtctagaagaccactggatgtctttttttttgagatggagtcttgctctgtcgcccaggctggagtgcagtggcacgatctcggctcactgcaagctccgcctcccaggttcatgccattctcctgccccagcctcctgagtagctggggctacaggggcccgccaccacgcccggctaatttttcgtacttttagtagagctggggtttcaccacgttagccaggatggtctcggtttcctgacctcgtgatccgcccgcctcggcctcccaaagtgctgggattacaggcgtgagccaccgcacctggccgaggtcttttactgtgtatgttacttttctttacattcagagtagagatgcaactattttattaagcaaagaattggctgcataaacgtccactgaaggcacaaaagctaaatagctacccaccaataatctcattcagtgagaaaactagtccaatcagagacccaaggagtggcttccagtcacatttgtacctttccttaaagaacattcttcctgtccttttagttacatatgtttatgtttacatattgccaaaaaaaaaaaaaaagccaaggtttggtggaaatggctaaagtaagctgtactttattcactcataataggaaataacaatttcatatactgagccctgagttcaagttcacttttttttttttttgagaggggggtctgggtatgttgcctaggcagatcttgaacttttgggctcacgtgatcctcccacctccgcctgcagggtcgttgggactataggtgcatgtcaccatgccaggctctcaagttcacttgagataaagaatacccaacactgtgtaagcatagactcctgtccaaaagtggtggtgaagcgtgaagggggctgtcctatggtggtggtgtagagaaggggtatgaaagaaagtgccagtgaccttacatttgatcctttccaatggtagtagtggggtgggggggtatgaaacagagtcagtgaccttgcaattatcctgtccactggcattggggaggtagggggtgttattgacccttgacctcacaatggatcccgtccaacggtggtggtggggggacatgaaatgcaatcagtcacttaatcttgtgcgggaaggaggggaaaggaaccacgaaaaagagaatcagcgaactaacaatccagtccaaaggtgttccaaaggtgttctcttgggagtcaggcagggaggtgggggtggggctgggccacgaaacagagtcagtctagttaggctgtaaaatctaagtgtcaggatgcagcgaacggcaagtcctcctcccggaaaaggcgcctgcggttgagaagggtcttgagcagcgcggaggatcggattccgggctcctggcctcttcccggtccgcgggcacctcggctacctttcggcagcggagaacccagccagaggcggagctgaaagcggctgcacttgctgggctgggctgagtcccatgagccagggaggggggtctctggcgccgcgcccggacaaaacacaaacgtcacagaggcagcggcggccaatcagtggagggcgcgcgcggccgcgtgcccctcgcgctcctcgcctcccctcgcgcgccgcgtacgtgcagcaaccgactccgcccagcgaggcggagcctagggaagccgcgggcggcccgccgctgtcctggagctgctgctgctgctgcggcggctgcaccggcggcgccgaggccgagatcgaggccggggtgcgcgcttcgcaaacgtgccctatccgtgcggcttggctgcgccagcccttgcggccacccgggcgtctaggcgggtctgtgcgccgcccgggcgaggatgcggctgttccggtggctgctgaagcagccggtgcccaagcagatcgagcgctactcgcgcttttcgccgtcgccgctctccatcaaacaattcctggacttcggtgagtacggggccaagggtccccatgggcccggggccgccgccattcgggctgccaccccggatctccgcagcttcggggtaaagtctgtgggaaccgcaggcggggctagggaatatccggggggctctcctggggctcggatttcggggcgcggaggggcagggcctggccccctcgcacccagcctgggacttacccggagacacagaaacggcgtctcattgcaggaccctcatcgcaggcgagactccccaaacctgcggtcgttagcttcaaatctgcttgacacaaacctcacagcccttaaaacttcagaacgagatgtgggtggctttttaatgtttttatttttagaattttttttttttggttgggtaagaactgtttagaaataccttgaggttgaataaattatgcaatggcattttgttccttttctgctctaaggtgttgctgtgtggctggagtggcaggactcgaactgttgtcttcatcaggttatgttaaatcagttagaggcctggcctgcagacgccttagatgcttgggaagagcggacgtctgggatcctagcatcagagcagggtctaatacaactctggctttagtgccag

SEQ ID NO: 8119 - DNA, 1498 bp, artificial
  synthetic oligonucleotide
gagtccttgcttgctgccatctctctcggttattctgcatcttgaaccatgaactcactttctccttcactttcttcctttcactctcctaatgttggagagattttatgtctccagggagtctgagttaatcaaaatctcattgcaactgcttctcatccaatgagtatgcagcggttcttcactgggaacatggccagtcctgtgagaagacaaaggacaataggatcttagttaggcaggtgaggcatgaataagtataagggaaggttacaggtgagtcttctacctaggagaagccagaaaggctattggaaaagccaacagttgccccagattgaaggtttaaataagcggaagagaaaatgtatctttacttttttattgactactgaaattcagcttatacccaattcagatggagttccttgaccgtgactatgaggtatatatgagtccagccttctccactctatgagacaacatagcataagaatgagatatttcttgagttatactgccaaataaaacttatccaagaccaaagtgactttctcactgaaaccagggcaacaacaggaatgctgagaagaaaaaaaaaatgcagtgaaagaacgaagccattttgagggaaaggaatacaagaaaaaaagggttatacaaggaattatactaggaaaaacagaatactgctctgactcatgcagtaaacttgctttgtaagctggtgaaaaaataattgatgtaattagagaggaatatcagagttctgaacttggttttgaataatgctttgaacacaaacatagcttttatgcgtaaatttggaggtagttcttttccccctctcttcattatttcctttgtccttcagctttggaaattactccctatagtaaaataaatgatttcctcttattttcctgtgaaagtacttgtcctaacccttctctcaggatctattgaataaattagtacttgaggaacaatagctttgggtgactacattggcatcaataaataatttagtattgtagtcagagctcttctcatagattcatggtctcctttttagagatcagctgaagtcaagccctctcactttacatctgaggaacagggtgttgaaagataaagcaattttcccaaacccatagagctagttagtggcagatctaggcctggaacttcaaggtcaggtgtctgcctacattatgctgccatgctcaaatgtatggaaacagcagcagcccccataattgaaagctggtggaccccaggagggtaatgttttcagtccttacaacaaacctataaaggaggcttcattattctaatatcccacttttcggatgagaaaaccaaagctcagagaggttagataactcacctaagatcacacagtcagtaaatagcagaactgcctaatcttgtgagatgaccaagtagggtgtaccagtatctaggactgacagaagacaggtgatgccctgcctag

SEQ ID NO: 8120 - DNA, 4951 bp, artificial
  synthetic oligonucleotide
tgatttttttttaaactctaaatcagagattctaaatgggatgcagtattgtctggggtggaggacattttagaaattggtggcatttttttttttggttttcacaatgattgggggagcctattgacatttaaagggtgggggagagtgagtctagtattggaaatagtcccatgttccaaatgaccttcacatttcctgctgaaccttcatgtaggtgaaaataagcacctaattttccaacaagttgaatactataccagttgaaggatgcttgcatttagttttgactagaactttccagtgttccatggtttcaccatgttggaaagtcacagcaacatgggcagaagcgcttttgtgatttgagttgccactaaagcacacttgtgtcagtccgcatcacgagctgtcactcacagattagtgtgagcatctgactactttttaatgtcttctagtgttgccatgcctgagggtttacattttaaggtgtatgttatttcattatacattactttgcttttacttctcctttctactaggacgttatgttggtcttttataattacgtgtaagagtatgtggtatcacttatgaatttcatctcaggttagtacaggggggctactatatatgggctttaaaatggatcattagggccgggcgcagcggctcacgcctgtaatcccaacactttgggaggcccaggcaggtggatcatctgaggtcaggaatttgagaccagcctggccaaggtgacgaaaccccatctctactaaaagtacaaaaaaattagccaggcatggtggtgtgtgcctgtaatcccagctactcaggagactgaggcaggagaattgcttgaacccgggaggcagaggttgcagtgagccgagatcacgccactacactgcagcctgggcgacttgtctcaaaaaaaaaaaaaaaaaaaaaaggatcattaggtgtgagaccactgtttcaaataactaatccttaagtatagtatgacattaccttttctgtttccaaggcacccaacatctctgcccaccatctgacatcagagcggtgttttcatattcccttggcttcaagactgtaaaaagattgttcaactctgccctagtccctaccatttgtggtctaaagtaacaattttatctattttcgtggtcatgatgcgtacagcttcatcatttgttcttcagaacatttggtgccctcttggaaaatcacataatcaaaaagtccagtgcattgaatatttaaggcggtttttaaattaagtgaacctaaatttccttaagtttagaattttcccctgaggaatttggaagtaagcattaacaaacacatcgatttagtcttatgccgtacacattggcaataaacaccctggtaagaaaataagcagttagtgttatgtgcacaatagcaaaaaataaatatatactttgggctggattaaaatatgaacctagagatcatgttgtcaacgcagtgaaagagaaaaaaatgcatcgccagttaataaacctgtgataaatatgcagggctgaactttggctggattgcaaagtagcttgtatttgttttcagcacttccatcttccttcttgggtgccctgttctacccccaggactccccataatcacaagcctagggccttcactcaacacagaattagcaaacattttaaagctacttctgtatgccaggcatcgtgataggcgctatcgaattctttctgatctgaaggcgtcttcctgtcagaaggaaaggggtctgataaacttttttctccctctgtaactctcgaatcttttgaaagtatttggttggcgcaaaagtaattgcaccaaccaaattactttcaaatacttttgcgccaacctaatagatggggtattttagagaccaggatagcggttatcttggacaagagggagttgctggaaagggcatgagggcttctggggtgctggtaatgttgtgtttcttgtttttctgtggtataaaaacacatgatataaaatttaccatcctaaccatttttaagtggacaattcagtagcgttaagtatattcacaatgttgtgaagcagatctccagaattttttatcttcaaaaactgaaactttacacccattagacaacaactcccctttgccccctcctccaactcctggcaaccacccttctaatttctgtctctatgaatttgactactctaggtacctcacataagtggaatcacacactattttcatctgtttgtgcctggcctctttcacttagcctaaacaagtttcctccatgtagtagcatgtgacaagatttcctttctaatgttgcatttctttctttttttttttcttgagatggagtctcgctctgtcgcccaggctggagtgcagtggcgcgatcttggctcactgcaacctctgcctcccggggttcaagcaattctcctgcctcagcctcctgagtaggtgagattacaggtgtgcaccaccacgcccagctaatttttgtagttttagtagagacggggtttcaccatgttgcccaggctgatcttgaactcctgacctcaagtgatccatccacctcggtctcccaaagtgctgagattacaggcgtgagctaccatgcctggcctctagtgttgtatttctcgatctgggtgctggctacccaggatgtctactttgggaaaattcatccagctgtgcatattttaattggacacatttctgtatgcatgttatacttttaaaagtgtttacttaaagtagatggagataaaatttttaaatcacttctagtaaggtatttgatatagtttggatgttgtcccctccaaagctcatgttgaaatataatccctagtattggaggtggggcctggtgggaggtgattggatcatgggggcagttccctcacggcttggtgcggtaatcacaatagtaagttcttgagagatctggtcatttaaaagtgtatgacacctcccccaactctccctcttgctctagctctcaccgtgggacttgcctgctccgctttgccttcctccacgagtaaaagctccctgaggcctccccagaagccaagcagatgctagcaccatgcttgtacacctgcagaaccgtgagctctcttttctttatagaatacccagtctcaggtatttctttatagcaacaccagaacggcctaacgcagtattagtaacttaccatgttaatgttttccagtggcgttttggaagtaccagttagagaaggcagtgcttaacatgcagcatttgctgagggaagaacttcaaaagacatggtctcagacaggccctcctcaaatctcacccgagctgtggctctgagcccctctctacagaagtctggtgctgctcatcacaatcccaaatcgcaaaaaaattataccctcaaataaaagcagaaggtgaagaaaaaactgtccttaaagaggagaacgaaattgagaagagagcctattaaaataaaattttaggagaaagaactgtattagtatgttttcacactgctactaaaaacatgccagagactgggaaatttataaagaaaaatatgtttaatggactcccagttccacatggctggggaggcctcacaatcatggcagaaggtgaaaggcatgtctcacatggcggcaggcaagagagataacttgtgcagggaaactcccccttataaaaccatcagatcttgggagacttattcactatcatgagaacagcatgggaaagacccgcccccaagattcaattaccttccactgggtccctcccacaacacgtgggaattgtgggagctacaattcaagatgagatttgggtggggacatggtcaaaccatatcaagaacaaaacaaagttaaaagaagggaatcatgtggggttgccagatctagcaaaaaacaaaaagcaaaaccatcaatcaatccaggatacctagtgaaatttgaattttacacaatcaacaaataatttttttagtataagtatgttccatatagtacatgaggcatacttgtagtaaaaaattttgttgtttgtctgaaattcaaatttcactggatgtcctgcatttcatctggtaaccctagatacaagggaaggaagaggaggatgaaatcataggcaatatcaaaagtgtcctttcaatacagagaaccaccccaaagcaagattctttcaaaagtacatagccttgaataacagtccctgccttaaaggagggaaagagctttccatgaggaatcagttgtattttgcaactgacaaaaaagttaggagacttttccttgaatgtcttggtaggggcccagagtttaaaccaaatcctgtcagattaactgttccctagagagctgggtggcagaagctgcctaggataatggtgtgtggggtgtaggaaggaaggacaaaggacttccgaaaggccttggaatgacttaccttgttgtcagttttcatccgaagaaatccttgatgtgtataaataagggttgccattaaaagaaccacatcagtactggtggggaaaacaaattactaaaaactccgcccttcccattcatcaaagcaaaagtgtccaagattcactgaaggtgaacgagggcagttgccctggcagagtcaggcttgccatacaatttctgattcccttttgatgccctgcagttaattctgagtcagtagaaggcatacttagaccagatcaatgaaaagtctgatgctcgtgacttaaagcaattttaattgcaagtatataatgaggagtaaataattaacaagatggttccaaattgatgttttgcaaggcctagtttaatggtttattttaaaatcagaagcatagttgcatatagttaaaggcaaatgtcctttgaacagtttgct

SEQ ID NO: 8121 - DNA, 825 bp, artificial
  synthetic oligonucleotide
gccctagttccaggtgatcaaacagagaggagaggccccagcgctgcccgttccaatgccttttgatacccagaagggtgtgctgtcccccaccctcaagccaccaaaggatgcagatgtgtgcagagctgttgtcccagccctttcacagctctgcagtttgatcttttattacaaaaccgcatggaaggggcaaggtggcattggatttgttattgcttcctctgctaagtgttttaatgccatgaactgcatgttacaaactctgcaatcattctttggacttggaaaattgcttaggacaaaatagttcatctcaagagaggatgtggggagaggagaggaggaggaaaagaggaggagacaaagtcctcttggaacacaaaccaccagtttcccttcaagagtgactaactgcatttgatctttgttccttgcccagggaacatgttcaacaagtataaaactagatcattttttgtttatagaaatgctttgaaggctccaggcccttctgctgtaatagcagcctaggccatgttttctactgtcctgaaccacatccactgagaacagataacaggtcaaaccagaagaagctgctcgagcactgaggccttccttctgctgttaaccaggcacagcctccaggaaggggggcacagagaagaagcctgtgttggcaacagcctgggcacaggcctgtgcatattggggcaagaaaaatgagcatgcatacaagagagtatggcagatagaaagttagctttaaggaattttgaccataaatgtaaatcaccaaaaccacttaaagaaaagtgtcaa

SEQ ID NO: 8122 - DNA, 1651 bp, artificial
  synthetic oligonucleotide
tattctattggtctataggtctgtctttatgttagtaccacactgttttgattactgtagctttgtaatgttctgaaattaggaagcgtgagtcatccatatttgttctttttcaaaattgttttggctattcagagttccttgagcttccatatgaattttagggtttttttttctatttctgcaaaaaaaattaccattgggattttgattttgatagggattgcattgaatctgtagatcaccgtgggtagtattggcatcttaacaatattaagttttccaatacatgaacatgggatgtctttccatttattcgtgtcttctttaatttctttcatcaatgttttgtagttttcagtgtataagtctttccttggttgcgtttattcccaaatattttatcgttttggtgttattgtaaatagaattgttttttaaatttccctttcagattgttcattgttagtatgagaaacacaaccaatttttgtgagttgattttgtatcctgcaaatttgctgaattcattatttctaataggttttttgtgtagaatcattggagttttagagtacagattttttttaaaggcaatcttttttttttgagacagagtctcgctctgtcaccaggctggagtgcagtggtgcgatcttggctcgctgcaacctctgcctctcaggttcaagcgattctcctgcctcagcctcccgagtagctgggaccacaggcatgcgccaccatgcccacctaatttttgtatttttagtagagacggggtttcactgtgttggccaggatggtctcgatctcctgacctcgtgatccacccgccttggcctcccaaagtgctgggattacaggtttgagccaccgcgcccagcctttaaaggctatcttaatgtaagaataaaatattaatgtatgactggaattaggagtctctagacagttcttgtgaagggaagttgaaacttcactagagagaaagctttttccaaattccagtaaccctgaaattcatggcaccatctattttcccctttcagataaaaaaaaagagtggattaattgtataacagttaccattgtccattatataatggagggaagtgggctgactttgttagttaagtctgttatactcatgcatgtgacatttttgttttcaatgacatttctattcccttacccttctagggagatttctgataaccataaatagttttcaccatgccagtgcaggatataaaacactgcctcagggcttctggagatttctgattacagtaagtggatcatacatggtgtttcagtgtcataattacaagagtaagagatggtggtactagttaaaggaaagggtacaactttgaggatcctcttataggtcagtgccaggcatttgctaatgaggctcttagactgtggaagaaacatccaaaatatcattgcaaagtaggaatttctgtttcaacagattccttgcctatgaacattcttcagcttggtgattgctgacattagtggaggtaaatgcccatgtagaagaaccaaaagcattctaattttctacaatttgaaagaggtacttttactttggaaaaaaattctgagatactgattcccaatcatttgggaattgtgg

SEQ ID NO: 8123 - DNA, 1554 bp, artificial
  synthetic oligonucleotide
aaagccccaggcagagttgcagatgcttgcaatagaaagctatcagcatgtacaaggctggtgagtgctgagcggatactggcaggactcctatagcgtctgccagagggagtggaaattgttcatttcacaaacaaggacgatttctcacacgaaattgcctgctgcctacagggcttatgttaggtggatctgcttgtctgcagtggtcctctgtcccttagctgcatgttctgatgccttcagtctggccagatttctgggaaaatcccagccaaaggattgtaagaggtccaggtcctctagttcatgaggttctgaagatgtgtgctgctggtggcccaggaattagcttctacccaccctggccttgcacattttctgttcactgcattgctagctattggagccacatctgatctccaaaaatccatgcctgccaccattgcaccaggccaagcccaagaggagaactgtaagacagtcagcatttgtagagttccttcttgaactgtccttcctatccatttctttctagtttcatcaccagccttgatcatttgtcactgtcccttttgtttaactgtcattacctcacagtgctgatgaagccatgaggagaactgatataccagtgctaatgatcatcaatgaggtgatggtggaggtgacaggaaacaggagaaaatgacaaggacaatttgacatagccaagaaagggatccccaggcatgtccacagagtttgggaaagaacacgtcaaaaaatttaccaaaaaaatatggtcatgagctcatggctggagagtccaaaaaccagagatgagcaagagaaaatgattgctgaagaattgttcataatatataaccacagaggaagctggagaggagaggaatggggtggatctaaagaagccgtcgaggcttcagctcttcaatagctttgattttgaagggatatgtatagaaacagaaaccagacatcagtaaagaatcaacacaaatcatgtcaaaagtttatcagattggaaatcaaaagatagaatggcccagattttcagaaagtctaatgtcagcaatacaaaaatcatttgtgctacatttagaccagaaataaaataaggagaaaataggtctgcttggggtgagtgaagtgatacaagcaaaagaccacgagaaagaaccgtacaattcctagtttgtttccccctttttcttattgtttattaaagagaatgctctttaaactggaaatggtgaaagactcttggttaaagaagagagagaggcagaaatagaaaagagtgtgagtgttttgaacaagttcaaataaggcaatctgtaggtggaaggggctgtcattgggggtagtgcattcagttttgtatgtcaagttttcaaagaatcactgtctcttataaaaaggggacagggtacctgggaaatgaggtctctgaaagtcatggcaagtgaaagctgtaagtgctaggtaggtatagtctggcaagggggagacatggaggaaggacatcaagctaacacaaaagatgcaaag

SEQ ID NO: 8124 - DNA, 6339 bp, artificial
  synthetic oligonucleotide
aagttgacattctccctgtctttgcttctgactgtggtgtgcccagattgtagactggccaggctcactgggtagatattttaaatcctcacttgtatattcacaaactgagcattggaaaaagaaaaagaaaataacttgctcaagtcacagagctagggagaggtggaaccaggatatgaatctaagatttctaacttcagttttggttctaagaatattccagggtttgtgaaagtgttctgaggtttatgatttttaaaaaataatagtggaatctgttttcatttcaactgtaaaagcctccaagtgttgactggctgtttggggcagtcaagatcctatgcctgttagtagcaggcctgttccagcatcatctgcttggttcttttgtcactcaggtgatggcctcatctgctatgggggttttgaccattctacagctttcaattatttttattcaattgtctaacttattctcgcagtggattattgggttcagaaaggaggcatcaaaaatactgattttaaagtagaatgagctactgaactgtacacttaaaatggttaagatggtaaaaaaaaaatagaatgagctgatgagggacataaaaattataattctgaattttgaccttacacctgtaaggaacattcatattatcatttcttactacatcaatatatctctagttcttcaaaataaaagttaaaaggataaaaaggaatatgcactatatggatagtggatatggattaaaagattttatatggataaaaagtttttatccaacttggcttttcctttattgagaataaaattatccatttccacagcatattacttctgaagaagtgcttgcaaatagctgccaaaaagtgcttgtgtctcctcttttagaaacaaaatacaaaaattataataataaaggaatgtattttttaaagtgcaaaagtcaagaattccaaataacaggccatggaagcagtctggatggattcaacacacagttaaatttcaatctacttattaatacacatttgatccccaaacatgatattaatatgtcattttgaatttgtagataaaccatgttcttgcttgtatactttaaaaaagtattcgctatgactttttttgaattgtttttatttttattgataaataatagatgtacatattttggggtacatgtgataacttgatatattcatataatgtgtaaaaatcaaatcagagtaattgggatatccatcacctcaaatatttatcgtctgtttattctaggacgaatttattttcgtctagctatttgaaatgtgcaatagattattgttaactatagtcactctactgatttatcaaactctaggtcttgtttcttctaagcgtatgtttgtacccattaattgatctctcttcatgccctctgatacggtttggctgtgtccccatccaaatctcatcttgaattgtaatcaccacagtcctcacatgtcgcaggagggacccagtgggaggtaattgaatcagggcagttcccccatgctgttctcgtgatagtgagtgagttctcaggagatctgatggttttataagcatctggcatttcccctgctggcactcattctctctcctgccaccctgtgaagaggtgccttcagccatgattgtaagtttcttgagggctcctgagccatgcggaactgtgagtcaattaaacctcttttctttatgtattacccagtctcgggtgtttcttcatagcagcgtgagaatggactaatacactccctcttcccagattctgacaaccaccaaacttctctctgccttcatgagattcacttttttagctcctacatatgagtaagaacatgtgatgtttgtctttctgtgtctggcttatttctctcaacataatgacctccagttccatttatgttgctgccaatgacattagcatttctcctgagagaaacaaatcctttatgtttgtatggggctttgcagataacaaagcatatccaagtccacgtgggatttttgggggtccagtgcttttatttatttatttatttttataacctcacacatttattggaagagacttttgaatgttctcaccacatacgattttatactcacaatcactctgggtggtaaggttttcattcttttttatggctgaataatattccatggtgtatgtacaccacattttatccattcatctgttgatgggcacttcggtttatcccatatcttggctattgtgagtagtgctgcaataaacatggaggtacaaatatctcttcaatatattgatttcctttcttttgggtgtatacacagtagtggaattgctggatcatatagcagctctattttttgtttcttgaggaacctacatagtcttctctgtagtgattgtactaatttacattcccactaacactgtacgagggctcccctttctccacgtctttgccagcatctgttattcccccccgcctttttaaataaaaatcattcttactgaggtgaaatgatatctcactgtggttttgatatgcatttatctgataattagtgatgttgagcttttttatatacatttgttagccatttgtatgtcttcttttgagaaatgcctattcagatcttttgcccattttaaatcagattattagattttttttcctatagagttatttcagctccttatatattctggttattaatcccttgtcagatgggtagtttgcaagtattttctcccatttcatggattatctcttcactttgtcgattgtttcttttgctgtgcagaagctttttaacttcatgtgatcccgtttgtccatttttgctttggttgcctgtgcttatggggtataactcaaatgtttgcccagtcaaatgtcctagagagtctcaccaaagttttcttgtagtagtttcatagtttggggtcttagatttcagtctttaatccatttttatttttatttttgtgtatggaaagagatagtgatctagtttcattcttctgcatgtggatatccagttttcctggcaccatttattgaagagagtgtcctctcactgatgtatgttcttggcaccttcgtaaaaagtgagttcagtgtagatgtataaatttgtttctgggttatctattctgttccattggtctatgtgtctgtttttgtgccagtaccctgatgtttttgttactatagctctgtagaataatttgaagtcaggtaatgtgtttcctctggttttgttctttttgcttaggatagctttggctattctgtgtcttttgtggttctgggtgcataaatatttatcattgttatagcctcttgctgaattgacccttttatcattatgtggtgattttatttttctctttttacagtctttgacttgtctattttatttgatgtaagtgtagctactcctgctcttttttggtttccacttacatagaatatcttttttcatccctttactttcagtctatgtgtgtctttataggtaaagtgagtttcttataggcagcatatagttctgtcttgtttctttatcccttcagccactctgtcttttaataggagaactgagtccatttacattcagtgttattattaagtaaggacttaccactgccatttttgttgcttgttttctggttgttttgtaactccttttttcctttcttactgtcttcctttgtggttaagtaattttctctggtagtgtgttttaattcattgctttttatttttagtgagtctattataggtttttgcattgtggttacaattaggcttacaaaaacatcttatggatataacaagttattttaaagagatgacaacttatcttagatcacaaagaaaataatagaaacacagaaaaaaatgaaaacaaaaaagcctctccacttcaactccatcccccctacattttgactttctgttgtctcaattacatatttttatattgtctatcttttaacagcttactgtagctattgtttttgatagatttatcttttaggctttatactacagttatgagtgaattgcacactacaattacagtactagagcattctgagtttgtctgcgtacctagttttaacagtgaattttataccttcaattttttcctttctgcacatagtgttcctttttttccggctttatctctccttcatatttgaaaactacggtattcttgaatggtaggtttcttttttcccccagcacattggaaatatcatcccgccccctctgaggctgtatgatttccattgagaagtctactgccagatgaattggagctcctttatatgttatttgtttattttctcttgctgcttttagaatcctctatttgtccttgacctttgggagttttattatgtgccctggggcagtcttatttgagttgaatctgtttggcattctatgaccttcctgtaactggatatttgtatctatctcaagttttggaaaatgttctgttatttatttccttaagtgagcttcctaccccttgctcttgctcagctcccttttgatcaccagtaattcttagatttggtcttttgaggtaattttctatattttgcaggtgatctttattccttttaattctgtttttttcctctgactgtattttcaaatattctgtctttgagattagtgattctttcctctgcttgatctagtctgctgttgggggcctctaatgaatttttctgttcagaaaatgtatttctcagttccaagatttctgtttggttttttaaattatttcaatcatctcttcattaattttctgtgataaatttctgaattgcttttcagtgttatcttggatatcactgagtttccctaaaattgctatttcgaattctttgtcagataactcacgtatcaccttcttattaggatcagccattggttccttgctttgtctgtttggataatgtttccctatttgctattgtctcttgtggatgtgtgtctatgtctttgcattgaaggattaattatttattctagtcttctctttctggcctgttttggattttattggttatgtttgcttagagattcttcataatttacctgctgaatttcttcttctttccactaggtcattgcctcatttttggcattagatggtgcttaaagctcaagtttgcctccactctagcaaaggataggagtgctgccagttaggaataggggaggtcccaaaggagataacctggcagtgtggaagagctggcttggggttcatgccactatacgtcctacaacacggtgctgctgaacggctactctgatttggcatctcctttggccaagttacagagcagagtttccagggctaggggtgatagtcctgattccctttttctggctgtcctcagggatatttttcccttcaggcactcccagtgcttcctgtgggttgaggcagggatagagctcctgccagggaaccaaaaatagtggagaaggtggttgtccacctcaatttcactttttccagtgtagaaactctgagtctagaaaaattttctgcaagcttggtgtcaggcagactgggagaagaggtgttgcagatatggaagtcccattctcttaccatcttctcagagatttttcacttttctgtggccccaggaactatctcatcctcatctttgtctcttgtatacttagttaaaaataaattaaacagcatgcatcacttgttaaatggagaaaggtcaaactttgtccttgtatatcctaaacattattgttatttgagacagtctcactctgttgcccaggctggagtgtagtggtgtgatctcagctcactgcaacctctgcctcccaggttccagcaattcttgtgcctcagcctcccgagtagctgggactacaggtgtgtgccaccacacttggctaatttttgtatttttagtagagaccgggtttcaccatgttggccaggctgatcttaaactcctgacctcaagtgagccacccacctcggcctcccaaagtgctgggattacaggtgtgagccactgtgcctggccttattataaatactattaaagaatacattaaactgcaaatgataatacaatctttaataatatactgatccaaattccttttccttaaaagttaaagttgcttgctgtcctataccatactacaacaacacaatgagttagcaattctgtgggggttaatgagattatagattttcatgaatgcagtttttaaggatagagaacagaagacagt

SEQ ID NO: 8125 - DNA, 2032 bp, artificial
  synthetic oligonucleotide
atgttgcttttgaaatttggagccaggaaaagctttgtctctcctgagaaggcatccttcctcctttctgataactgtagttgtgcaagttctgaggtttctctttgtgcctcagctgccgggaaactcaaaaccaaatttgtagctcaaatcgctgcgtttacatttatggttggcacttcagcattcctcacttcttattttttatttctactttactagttctttttatttgtcttttgtcttgggaaactggaaacagccccctccatgtgtcaacacatccatcaataaatagtagcttctattcatttatatatgctgcctctaatccttttaataacctagtcataatgtccattaggtatgattatccttacttgcaagtgaagaaacaggctcagatagtccttgcctgaggcaataaagctattaagtggcacaatttttcagctccctttctgtctgcttctgaagtctatgccttgtgcctgggtacatgtaactgatgcattgatgagtctcaactcagtggtggactatacaggtgaaaccattttatttttcccaaccactgctttcaaccatgcagcaccaagtcccttttcccatcctttaatgacaccttgggtggacctcatgacttgctgggctctcttgtttggtaaagctgacagtcccaattacaatttcaatatcgtattctctggtctggtgggtgggggaggacgagagaagggagagagaaatcttcctgcgaaaatggtccttttgcaggtgtgatgctctgatttgctgagtgaggtgaagggtctctgagcacggggctggttcttttttctgcggcgacggtgttgaacttcacttggattctgactcctctggggcctcttgaagagcggctctcttagtaagccctgctgtgctccttcctgtggagcctttccaaattcagaagctgtgggctcacgggatcaaggtggaagtgatgctcccatttgctttccgggcacaccgcccctcagtaccttttgaaccgctcacgttcagatgtctctagaccacaagggggcaccagactccaggttcacatacaacacatccctcaaagaatatgcgtcaagctcgcccacagtttccaaggctccagggtggtccagtgtgggcctgcgggtctgtgcagctccacacgagcccaggcagtaaaactggatgccaactttgccttcatgcagacctccgactctccaggagcgaccctcttagaggtctcccttctacatacaactcttggcttgggagagcaggggagtcccagcactcctttcctcaccccttcctactctgtcccaagaaaagaaaagctcccccctccaccccaggaacactcaacttctctccctccccttcccatcctcccgtagctacagaggctggaaaagagtggttgaagggaacggtcagagtccaaatagggccagttctgccatctcttagtactctctgagaacgtgtctgctggctggttgcagcccctcgttaggatgtgggagcacctgatgctttttgtttccacctttggcaactctgggacaacaggaaaagtcctatcatgcgtgagcgccacacacacacgcgcgcgcgcgcgcacacacacacacgcacgcacatacacaagcacacacacgcacgtgcacacaagcacgcacacacgcacgcgcgaacacacgcacgagcacacacacacacagtgcttcccagccttctcccatccttgcctatttaagatctctggctttgccctcccaatttccaatgggaaagagcagaaggaaaagcgatgaggcctatggctggtgagacaggttttggaaggactgttttgggtgagtctgataaactctaacgagtttattgtaagacttgagaaagtcagtgtgaagcgggaggcagcttgagaaactttagctctctacgcctgtcttcgctatggagcgcattctttgatatggaaaagtgatgcttctaagaa

SEQ ID NO: 8126 - DNA, 527 bp, artificial
  synthetic oligonucleotide
gggggccatgtgtcctccgggggacaaaattgttctctctagaactgccattttatagttcaacctcctagataaaaatatctatcatagatgtctggagatattttcagtcaccacaactgtgggggagagagtgatgtgactggtatctagtgggtagtagccagggatgtggttaaacctcccacaacacatagaacagcccctaacaacaaagaattatctggcccaaaatgccagtagtgctgacgttgagaaaccctgcgctagccaaaagtcttcagatagttttcaatctccacatcttaaaaataggcctttcgacatttgccaacattagaagaaaaatgcacaatgatattgaacaaaagtagacaggaaaaaaatagactcttttaacctgacagccaaggctcaatttattataattttcactttctaaagtatttcttttagacgctagctggatctgcaccaaatcacagcaggattttaagaataacatctggcatataaaaattatcata

SEQ ID NO: 8127 - DNA, 450 bp, artificial
  synthetic oligonucleotide
aaggacccatcttctctctggagcatcacagaatacccctgattgcctgggtatagattgaccagtaaacatggcaaggactctctcctaacaagcttttctaacaagtttacattgcttctcaattcctgaggatcctcaggctcttttccacattcttcaacataaatgtcataaagtttttcctgcagagtttttcccgccctaggtgagtatctccttctaggacgtctctgttgggcaatttcagtgatattctctgtgcgatccagagcctgttctaaatctcgatccattgtaacagaaaacagggcccctaagaggagagaaaacgcatgtgcgttggtgaagcagggtggaatcacggctgtcatattaatctacaggcccgcaagacgccgcaagtccacactgagttcaacacgggcacctgcccagaaacccgccccc

SEQ ID NO: 8128 - DNA, 2264 bp, artificial
  synthetic oligonucleotide
acctccggttctgcttggagggatctgaaactaagttccagcatttgcatctgttcagaaaaactggatgagggaaaaggcgtaactgaaatgcaggtgctctcaaaagacactgacagacacgaagcagaaacagcctgtcccgaacatgtcagagtaaactcccagatctcctggcgcgtccatccctgaaccacccagatgattccctgggtgactactgcagctgttcaagagcagaatgccctcacttgtgtggacctggatcccacagattaatatcctgcaggctcagcttgtctgctcttggccaaaaggaaggaccgagaaagtgaagaacagccctgctggcagctaggccgtgatgttcccaactgaagataaatagcaacatgggatataaataatgtccagagaaggccactctgtgaccatgtttggaactcaacagagacaaggccactcctcagccaggaaaatgattaacagttcccccatccactgcttctcctttaccaatgacaattccagccctgtctcaagcttctcagctcccaaatacaaattaagatacccaatgattgtattgcctctgcttcctgacaacagagttcagaacatgctcctgcatccctaaactcttagaatccctccacacgtgcctaaatcctgtaataaccaacccccacccccattcttcttactaaaatgcccccacagtccccctgtagcgagatcttactggctgcagcaagtaaatgaagctagttcggtttggactagagatgtgtccctggtggtcttcctgtggcacgcctcagccctgccagctaccagctgattcacatcagaagagatgctaagaggagccggggtggtggctcatgcctgtaatcccagcactttgggaggctgaggcgggcaaatcatatggggccaggagtttgagaccagcctggctaacatggcaaaacccctgtctctactaaaaatacaaaaattagctgcatgtggtggcgcatgccttaatcccagctactcaggagacaggagaatcacgaacccagaaggcagaggttgcagtgagctcagatcgcacccctgcactccagcctgggccacagagcaagactctctcaaaataaaaagaagagaagagatactaaggggaaaaaagtcactattttcaaatgtttcccatttcgtctttctttcctcctctttctccaacataattcagtgtcacacatctcttttaaaaatgtccctctactatttcttccaaatgaggctccagcttcccaacaagttgttggaccctgttctctgctttgtagcccgtcagagaacgaacaacgcccactcttccatctccaaaccccaaaacaacaacaaagcctcctacattatcaggcagagcaatttatctcactcaaacctcactctacccccacactcagcatctttacaaatctaaagcttcattcatcaattagaaatggaaactagcctaaatatccgataatagtgcatcaactaagtgggctatcttgcagctgtttaaaaaaaaggcaattaaggcaacctggaaaccaaaagtattgcttatgaaataattgtttatgaaaataaaagataatacaaaaaatggtgagcagtgtgattacaactaggtagctgctatgtgcagctcaggacctacaccgggtgcccaggagggttttttgtttttttgagatggagtctcactctgtcacccaggctgtggtgtagtagcgcaatctcggctcactgtaacctctgcctcctgggttcaagcaattctcctgtctcagcctcctgaatagctgggactacaggcaagcaccatcacactcggctaatttttgtatttttaggagagacagggtattcccatgttggccacgctggtctcgaactcctggcctcaagccatctgcccgccttgacctccaaaagtgctgggattacaggcatgagccacttcgcccagcctcaggagggatttatgatagatatagcttgaaggcatgaggaggcagcctaccagggctaaaggagagaggaatctgatggacaagaccagggtttgggactagggtgagagtgaacgaggcacttatgcaaaatttaacagagtgccagacaaactccctcagtaatcaagataaaaatattgtaatgcaatagtaaaaaaaaaaaaaaaaaaatcaaaattagggcaagaaaccatgatgaacaca

SEQ ID NO: 8129 - DNA, 3027 bp, artificial
  synthetic oligonucleotide
aaggagtctgcattttcattttgcactggcccccacaaattgtgtggccggccctgcagctggttgagccactcagcaacagcgcgttacaaagttacatggcaaagggtgtggatcccaggagggctggagaattgggccttccatgtaatttaccacaccatgtatttgataggctgggaagtttttattttgtgaggacaggaggataaaagatctttcaagtttcttctcaagggtgataaaaggatgacattggattcagtgagaatagttgaccacatgtacttctattttaaatttataaatgagatataatttggagccaattgctggtttatcaatcaacttcaaacactggaaagtcttagctggtcttgctctctgctgacatctttaagagggttgtttttgctaaagagcccataaattagtctgattagatagccccttgagctatagggaaggagagacagcagcgatgtcagagaaaatcagccagaaaaaatatttgacttcaatgtcccattgcattgatattcccttttcaaataaatctttttaaaaattttagatttaaggggtacacatataggcttcttatatgaatctattgcataaggtgaagttcgggcttccagtatacccatcacccaaatagtgaatattgtacccaacaggtaatttttcaacccttcccctccctgactttccccacttttggggtccccagtgtctattatttatatctttatgtccatgcatatctagtgtttagcttccacttataagtgagaacatgcagtatttgattttctgtttccgtgttatttcacttaggtaatggtctccagctccatacatgttgctgcgaaggacatttgactttattatttaaaaaaccaaataaaacttccttgctattattttttgtttcttgatctgatttctatcatttgtgttacaagtggactcatattggctggaagatacagactttgaaccaaggttgcttcctttcttcccaagtgtattagtcccttctcacactgctaataaagacatacccaagactgggtaatttataaagaaaaagaggtttaatggacttacagttccacatggctggggaggcctcacaatgaaggtgaaggaggagaaaggcacatcttacatggtggcaggctagaggacatgtgcaggggaactcccctttataaaaccatcagatctcgtgagacttattcactatcacgagaacagcatagattcaatgacctcccactggatccctcccacgacatgtggggattattacaattcaaggtgagctttgggtggcgacacagaaccatatcaccaaggtcatttagaaagtaaccagaagacccaaggctagcacccgtatctccatagcttctcttttgcttgcaaagagagttggactgcatttttaatagactattaagtcatttttgcaaatattatttgtgggcaacatatttgtattatttgggtctttttttcaccttaattactgagatataaatctccatctggccaaaaaaaaaaagtttagtttgcacaaaaacattgtcatggatagtttttaagactttgagaaagttcttcactggcaattctattaatcattagacaagaaattacagaaacaaacccactgtctgcttaattcagctcttcaaaagagtttcacttaggaatatgtgtttccatcccagaaatgattagcggatggttaaattacaagaggagggagaattaacattttgaatgaaagggtatataatgagagagtttgaagtggaagaaaattgctttcaaatagaatgggatttttgaacaagagaaaaactggtccagctatttatgtacattaccagtttcaatgattatactttgggctccttttcagctctggccagtctttcttaacctgctgaatgtttcagctttcagctttacttttccagagttttgctggagttatactgctaaaaatagaggcatattgtccacttagagctccctaagatatgtggtctactcagtggtatagcagcaggataaagctagtctctcttccctttctcattcttttttggatttgcttttcaaagtctattttggtgaaaaacacataacaaaaactaccatctgtcttagtccatttttatttatttatttttgagacagttttgttcttgttgcccaggctggagtgcaatggtgtgatcttggctcactgcaacctctgcctcccgggttcaagcaattctcctgccccagcctcttgagtagcagggattacaggtgtctgccaccacacctggctaatttttgtatttttagtagagatggagttttgccatgttggccaggctggtctcgaactcctgacctcaggtgctccgcccgccttggcttcccaaagtgctaggattacaggcttgattgagccactgtgcctggccaatagtccattttttgttataaaagaataccacccactgggtaatttataaaaaacagatttcctacagctctggaggctgggaaatacaaagttgaggggcctgcatctggaaaagccctccttgctgtgtcaccttgtggcagaagggcaagagagcacacaagagaggggtcaaactggcttttgtaacaacccattcccaagataacaaacccattcccatgataacgacattaatccatttatatggatagagctgtctcatggcctaatcacctcttaaccatcccacctcttaatacagtggcaatggcaattaaatttcaacatgagttttggaggggacattcaaaccatagcaccatcttagccatttttacatgtatagttcagtggtgttaagtatactcacattattttgcaaccaatctccagaacttttccatcttgcaaaacggaaactctataccgattcctccaccccatcccccagcccttaataatcacctttctcctttctatttctataa

SEQ ID NO: 8130 - DNA, 2465 bp, artificial
  synthetic oligonucleotide
atgagtatcatggcttacttttcgttgttgtagttaatgaagaattcctaattctttaaaatttataatactgtataattttgttttttaatacacattgttaggtaataattctgatggaattgaaaaccggaatggcactgcaagtgccctcttgcacatagatgagtctgctggcctcggcagactggctaaacaaaaaccaaagaaaaggagaagacctgattccaggcagtaccaaacaggtgagggcgcacgagttccatggcgcagcgtgctctgcgagctctcagaggaaactctagtatgtatccacaggggtgtcacaatggcattttagctgctagaccatatatagctttgtctattgaacttgaaaatataattttcagaattcagtgatattcatgaatgatttccttggataaaaagaaacaggacatggctgaaacatggatgagaaaaattgaaaacttggatgatttttatgtgtacatggaatgaaatccctcaaatatgttataagcattaactttttaaataaattaatacatttagagaatctatgtcagcataaagcaggcataatttacagagcagcaggataagtactttagttcatatgacattcctattcttgtatgatgatttgcgtattaaaaattttatgggtatatttaaactttgctgtaagttaacgtaagttatgttttttggaataaacagtggaaatttttgtcaccaaagtttatttttatgaataattttccaccagtttatttacttatttttttttgaggcagaatcttgctctcttgcccaggctggagtgcagtggcgtgatctcaactcacactgcaacctctgccccctgggtacaggtggttctcctgcctcaaccttccaagcggctaggattacagatgtgtgccactgtgccccactaattttcatatttttagtagaggcgggttttcagcatgttatgttggtcagggtggtctcgaattcctgagttcaggtgatctgcctgcctcggcttccgaaagtgctgggattacaggcgtgagccaccgtgcccagccaattttccaccaatttctaaattgctgtaggtttaatcactaattgataaaagttacatattcattaattttattaaactagagggagtgaaggcggtacagtcttcatgaaggaagtttccagaccattttctctatgactaggttgctatatctcttgtgttgaaaaacagtaaaaggaatgttaagcagcaaatagtccaatttaggagtccttggccaacagtggtcagaacccacactttatattcgcaaagaaactggaacagaacttggtttgagcactcatactcctttcttttccttttttagcaataattattggccctgatggacatcctttgactgtctatccttgcatgatttgtgggaagaagtttaagtcgagaggttttttgaaaaggcacatgaaaaaccatcccgaacaccttgccaagaagaaataccgctgtactgactgtgattacactaccaacaagaagataagtttacacaaccacctggagagccacaagctgaccagcaaggcagagaaggccattgaatgcgatgagtgtgggaagcatttctctcatgcaggggctttgtttactcacaaaatggtgcataaggaaaaaggagccaacaaaatgcacaagtgtaaattctgtgaatacgagacagctgaacaagggttattgaatcgccacctcttggcagtccacagcaagaactttcctcatatttgtgtggagtgtggtaagggttttcgtcacccgtcagagctcaaaaagcacatgagaatccatactggggagaagccgtaccaatgccagtactgcgaatataggtctgcagactcttctaacttgaaaacgcatgtcaaaactaagcatagtaaagagatgccattcaagtgtgacatttgtcttctgactttctcggataccaaagaggtgcagcaacatgctcttatccaccaagaaagcaaaacacaccagtgtttgcattgcgaccacaagagttcgaactcaagtgatttgaaacgacacataatttcagttcacacgaaagactacccccataagtgtgacatgtgtgataaaggctttcacaggccttcagaactcaagaaacacgtggctgcccacaagggcaaaaaaatgcaccagtgtagacattgtgactttaagattgcagatccatttgttctaagtcgccatattctctcagttcacacaaaggatcttccatttaggtgcaagagatgtagaaagggatttaggcaacagagtgagcttaaaaagcatatgaagacacacagtggcaggaaagtgtatcagtgtgagtactgtgagtatagcactacagatgcctcaggctttaaacggcacgttattt

SEQ ID NO: 8131 - DNA, 664 bp, artificial
  synthetic oligonucleotide
ttaattatggccaactgaattccaacagaagatgcaacttgctcacgctaagtataacctaagtatcaggtgtcagataaatggttaatttttgtagggcatgcttagttcaataaaactagggcctttctaggggaagataaatattttttaatgtttgggatacaaaaaaaaaaaaagaattaccacaactttattcaagaaggtctacattttctcataagccaataatttattgcttcttatttgaattcccatcagtctccgatgtggagtgaaaatcaacagcttcttttctgactaatctttctctggaaaaatgattgaaaggccttctatcgtttctggctcaaggacctataaacatgtcagagatttttagttaatttattaaaacactgtcaaaaccttgagtaaatgcttttaactatctgatgtacattaacagctctgaaggaacaaatacattttagcacgtaatcaaaattccttttactgctttgaaaccagctattttgtattcatagcattctcttttgaaatgttctgctctcgacctccctagataaaatttccttttattatgtttacttaagtgagaaaatgaaagtacttaggaatgtttttattttgccttacacagcctccttattcgagttcccca

SEQ ID NO: 8132 - DNA, 1129 bp, artificial
  synthetic oligonucleotide
tctcctcctgtcataatgagtgtaggagtttttttccttgtagttaaaaattgttgggcctggagcagtggctcatgcctgtaatcccagcactttgggaggccaaggtgggaggatcacttgaggccaggagtacgaacccagactggccaatatggtgaaaccccgtctcttactaaaagtataaaaattagccagccgtggtggcacgtgcctgtagtcccagctacttgggaggctgaggcaggagaattgcttgaacccgggaggcggaggttgcagggagccgaggtggcgccaatgcactgcagcctgggccacagagcaagactctgctcaaaaataaaaaaagaaaaaataaaattgttgccaaatgtgtgtacgtgtaggtagctgattctcctgaaatgtggtaaattccttcagtctgcagatactgatctttcttaagcttaggaaaattgtttccaaagctctttcatgattgcatctcttggccaggaacggtaactatctgtgtgttggtgccgcattctctgttctccgtatctgtcatctctctcataattttctctctcctccacctccgaatgtgggaattcctcagggcttggccttggtgaaagtattaattatgagagcagttgactccttgttccaccccaaccttccatccaagggccgtccaagggacagaggaggaatcttaagccacctcctgcctcgagcccagctccttcccacaggccaccaggggaaatgagtttctgcctcgtctgggtcccccattgtctttctagcagtggtgctggcaggtgtgggtgatataggacttggtgacacagactttctgcaaagccagtgggaaatgcaacagctctgcaggatcccagagacccctgctgtgtagcccagcagctccaaaggccgcactgagagcctgttggaaacgcagactctcgtgccttatcctggacccctgaatcagaacgagtatttccacaacatccgtgggtgattcgtgtgcacattaaagtttgcgaagctcagctccagggtgcaggctcagtttaacccttttttcataatccattttttgtctacccacaaagtcattctttacggtgaa

SEQ ID NO: 8133 - DNA, 2560 bp, artificial
  synthetic oligonucleotide
acggaataaggaaaaagttatttttctggtctcttaaaatacccttgaaaatgttatttctaacaaagggctcttgtaagacatctagaactctgagcttgtgacttgatctatgaatgtaaccttggccttaaaaaacctgaaattcttggccaggcgcggtggctcacgcctgtaatctcagcactttgggaggctgaggtgggcagatcacctgaggtcaggagtttgagaccagcctggccaacatagtgaaacctcgtctctactaataatacaaaaattagccaagcgtcgtggcacacccgtgtaatcccagctactctggagactgaggcaggagaattgcttgaacccgggaggcagaggttgcagtgagccaagatcatgccactccactccagcctgggcaacagagtgagactctgtctccgaaaagaaaagaaaagaagaaaagtctgtaattcttttggtttgtatcaattaataatctgttcccctagtgataatatttaaattgacctctccatgtcctaaaagctgtgaatacctatgagttttcttttcttttcttttcttttttgagacggagtctctctctgtcgcccaggctggagtgcagtggcgcgatctcaggtcactgcaacctccacctccctggttcaagcaattcccctgcctcagcctcccgagtagctggactacaggcgcacgccaccacacccggctgatttttttgtagttttagtagaggcagggtttcaccatgttggccagactggtctcgaactcctgacctcaggcaatccacccgcctcggcctcccaaactactgggattacaggggtgagccacctcccccggccaagttttctttaatagctaagtgaattgaaaatttttgtgcagacaaaaccctgtatgtaaatgtttatagcagttttatttattttatttatttatttttgagataaatacatttatttatttatttattttcagttttgctctgtcacccaggctggagtgcaatggcgttatcttggctcactgcaacctccgcctgccaggttcaagcaattctcctgcctcagcctcccaagtaactgggattacaggcgcacactgccacgtccagctaattttagtagagaaggggtttcaccatgttgcccaggctggtcttgaactcctgacctcaggtgatccacccgccgcagcctcccaaagtgctaggattacaggcatgagccactgtgcctggcctatagcagttttatttatttatttatttttgagacagaatctctctctgtcacccaggctggagtgcaatggtgtgatctcggctcactgcaatctctgcctcccaggttcaagcaattctcctgcctcggcctctcgagtagctgagactacaggtgcgtgctaccacacctggctaatttttgtatttttagtagagatgggatttcaccatgtttgctgtctgttctcaaactcctaacctcaagtgatccacccacctcagcctcccaaagtgctgggattataggtgtgagccaccgtgcctggccttatagcagttttattaatcaataactgggaacaaccaagatctccttcagcaagtgaatggataaacaaactgtggtatatgtgtacagtagaatactcgtcaatgaaaaaaaggaaagatctatcgactcactcaacaatacaggtgaatcttgtttttttgttttttgtttttttgggatggagtcttgctctgtcacccaggctggagtgcagtggcacgatctcagctcactgcaagctccgcctctcgggttcacgccattctcctgcctcagcctccctagtagctggcactacaggtgtccgccaccacacttggctaatttttttgtatttttagtggagacgggggtctcaccgtgttagccaggatggtctcgatctcctgacctcgtgatctgcccgcctcggcctcccaaagtgctgggattacaggtgtgagccacctcgcccagccaaatcttgttttcttttagtggcaaaatatatataacaaacatagatgaatcttttttttttttttttttgaaacagagtctcgccgggcggggtggcttatgcctgtaatcccagcacttcaggaggctgaggggcatggatcacgaggtcaggagtttgagaccagcctagccaatatggtgaaacccggtctctactaaaaatacaaaaattagccgggtgtggtggcacgcgcctgtattcccagctacttgggaggctgaggcaggagaattgcttgaacccgggaggcagaggttgcagtgagtcgagatcgcatcactgtactccagcctgggcgacagagtgagactccgtctagaaaaaaaaaaattacccagtctctgataagtctttatcagcagcgtgagaacagactaatacaaggctctggggggaaattcatttccttgccttttctagcttctggaggccatctgcatacattagttgatgaccccttcctcacatcacttcaacc

SEQ ID NO: 8134 - DNA, 2840 bp, artificial
  synthetic oligonucleotide
taattggctggtataaatatttagaatctaagattaaggcggggcgtggtggctcaggcctgtaatcccagcactttggaaggcagatcactttgaagtcaggagtttgagaccaacctggccaacaaggtgaaaccttgtctctagtaaaaataccaaaaaattagctgggcgtggtggcgtacacctgtaatcccagttacttggcaggctgaagcacgggaattgcttgaatccaggaggcagaggttgcagtgagctgagattgtaccactgcactccagcctgagcgagagagcacgactctgtctcaaaaaaaagaaaaaaaaaaaagaatgtaagattaaagtgattacctccagttttcaccatcacttaactaatgcatgcatttattgaaacataacttcctattttagctaaattgttgtaccaaaaatttatgtgatataaaacacgtattcatataaattttacttaagtattcaatgaacacacagataacctaaattctatttttttttttttgagacagtctggctctgttgtccaggctagagtgcaatgtctcaatctcagctcactgcaacctccccctcccagtttcaagcaattctgcctcagcctcccgagtagctgggattacaggtagtgccaccacgcccaggtaatttttctattttttaggagggtttttgccagctcaggattttggtcaggctggtctcgaactcctgatctcaagtgatcagcccaccttggcctcccaaagtgctgggattacagacgtgagccaccgcacccggcccagaaaacctaaattcttattcacctctccttacattttttttctggtttaaaatagctgtttataaaaaacaactccattaaaaagtggggaaaggacatgaacagacacttctcaaaagaaggcatacatgcggccaacaaacacggaaaaaagctcaatatcactgataattcgagaaatgcaaatcaaaaccacatgagataccacctcacactagtcagaatggtgattgttaaaaagtcaaaaaacaaaagatgctggcgaggttgtggagaaaaaggaacgctcttacactatttgtgggggtgtaaattagttcaaccattgtggaagacagagtggcaattcctcaaagccctagaggccgaaataccattagaccaagcaatctcattactgggtatatagcctctaaaatataaaccattctgttataaagatacatgcacacatatgctcactgcagcactattcacaatagcaaagacgtggaatcaacccaaatgctcatcaatgatagactggataaacaaaatgtggtacatacacaccatggaataccatgcagccataaaaaggaacaacatcatatcctttgcagggacatggatggagccgaaagccattattctcagcaaagtaacgcaggagcagaaaaccaaataccgcatgttaccacttataagtgggagctgagtggtgagaacacatggacacatgcgggggaacaacacacactgggggctgtctgacggctgggggtgggaggagagagagcatcaggaagaacagctaatggatgctgggcttaatacctaggtgatgggatgatctgcgcagcaaaccaccatggcacacagtttacctatgtaacaaacctgcatatcctgcgcatgcacccctgaacttaaaagtcggggggaaaaaaaagagaggtagcaattatcaccttaatgaattcctttcttcacttctcatattgcccctcattttccctaatttccctcatttttttcatttataatatatatatattttgagacggagtctcgctctgtcacccaggctggagtgcggttggcgcgatctcagctcacggcaagctccgccttccgggttcacgccattctcctgcctcagcctccggagtagctgggactacaggcgcccgccaccacgggcggctaatttttttttttttttgtatttttagtagagacggagtttcaccatattggccaggctggtctcgaattcctgacctcgtgatccacccgcctcagcctcccaaagtgctgggattacaggcgtgagccaccgcgcccggcctcataatatttatttcctaaataagctaacttgatgactacttacaagtattctaaagtgagcttggcttctcagtattcgtcattgtggctttcatattatcttttcacttctctttactatacttttgcataatagctgtctaacaagtttttatggaaataaatttattgcaaacaaaaaaggaaatagctgtttatgataaaatttgtatagaaatgcaaggagaaaaacaaatcactcaactgcttttcaacacgacgaaaagtgggttaaggtctcaaaattctttaaattttaaaataccgatttatcggtaatcgaggtttttttggatctgcttctttaagaaaaaaaaaaacaaaacacacacacacaaaccagcgaacttcagacgctcttacgacacctagctatattcactgggaacgcaatctaacgtcaccaaggcccacctcccgggccctagaaatcgctctctgggaacaagctggggactttgattttgctagccctgcccctctgagcccttcaccaaacttccgcgcgggggcgcccgccccacctcccgccggggctcagcacgcggccttctcccagccaagagccccgtcataggtgggcgccgaccccgagccgatctcgctttattaaattacagaaatcggtattcaaaaaaaaaaaaaaaaaagggcgggga

SEQ ID NO: 8135 - DNA, 2198 bp, artificial
  synthetic oligonucleotide
aatccccaataaagcaatgatttgtcaaaattttatcaagattagtgataaatccaatctataaaaccagccactttgaagtaggctcttccttttactatgtaaatcctgcccaacttctattattttgcctttttacaaaacacaaaagcatactctgaaagacaactggtattggactagaggattataaatttaataaaacatctaactactcaaaaccatttgttagctaaaaataacaatatacccaaaaatgcttctcttttcactttttgtggaccatttaagccaaaccatactatatttttgatatgccaagtaaaaatgatcaatactaatctgttacacatataaatcctggcaaaataaattcaattttcaaaccacaaatatttactatcctattctttccccaaattaatcagcaatgaagagtgcaagttaacatcctctaccactgataaactgtgactctaagcacctactacgtgttgtgattaaaaatgagaataaaattatataattacattaagtgctaaaaagttgaaatgttctatacatttctagatctattaaggattactgaaacatgaatgcattgataagctcttcaaaaccaattttcaaattagtagaagtattcaagcatcctgctccctagatatgaaaaacaggcattaaaattagggcatatatgtctgcaaagcattttctaaattaccacttaatcagattaacaaaggcaaacaaattcggaaaacagaaaagactaacaaatgtaaggtgttaaatatttggagtaagaaaaggggcctaaagcggcctagaacgatgaaaagcaaagcccctacggtaacgttacatttgaattaaagaataccgttatttaaataagcagttagcacttcgtaggaggaaggccaagcaacgtgactattacagatctatggattcacagcactgctttactattattccgtacttatttgcttatatttataatatagaaataaagaggcagcaacagttagccactacattaaccactctaccaaaggttacttaaaaaacggccttgcattcttacaacactctacagttaaggattattttcacatatatgacctcatatagtcctctcaaccctgcgatgttggtagtaccgactatatttcatagataagaaaccaaggctcggtacgcgattttttctcagagtcacccaagtcgaacccagaccttccgattcctagttttatgcctcgcattttgcatagttctatttcaggcataaattgaattgttaaagggaaggaacgggttaggcaaaaaataatcatggtacctgcagctgtgtgctgcaaaaaatggctgaattatgcttcttcctttttctttctcgctctctctggaaaaaaaaattacatttcaaacaatttaagtaaactcgaagacaaacgaggtcccggcgtctaccaaatgtttgactcgggtccgtgcagagagggccggcgaattcgtgcctagctcggggccgcgggcgaagcccgggctccgcaggccggcggccaggggcggctacgtacctcggggggtcctgtccagcctctagtggacggcagtctgcatcaggaagaaccgggccagcgggccgatgggtgggcggtcgggcgccgggacggcactcggcaggctcctcggacgtctacgagcagccgctcccggcacgagccgggtcgctccggcggggcacgagagtgctcgcctgcagccccctctggataagtcctgggaaagaagacagcgctgagtcgagaaaccagacagtcgggctccgcacgaggcggcgcggcgtcggggcccggaccgaccttgccaacgccgggggcctcgcagcacccgacggggctcggcgggagggccgactggggccgcgggcggggaaaagggctggggggcagcaggcagagacagaagcaccagccgaggaagcgtcgaggacggcgtctctgggcttctgccccgaagcgcgccgagcctcgggatcacccacgccgggggtggaggaaggcgggaaaggggcggggaaggggcggggcgtgcggggccacgagccgggggccgctccgggccgcgcgccccctgcgggccgcgggagccgcccggggcccgcccagggaggcggggctggccgg

SEQ ID NO: 8136 - DNA, 661 bp, artificial
  synthetic oligonucleotide
aatctctgggatactacagccatttttaagcactttctagaatatctcatgacttggaatcatatgttgcagctattttctagaacatgacctacaaaccacactagcctaaaagagcactaaggatgtggcagccaacatctacggctctgaatttccaccagtgacactgctgggacccaatctcccaagttctgtccttcccctggttaggtatttatatggaccccgagccctccagagaagcagcggacactacagtcaactgctgtcacttgctctacacctccttctttagggaggctgtcactgccagtgtcaccactctgtcaatgccttcccatttcatttactaaaaggaagagcccttgtgtgtgccaggtactgtgttaggtatggagatgagtgccatttgggaatccctctgtactctgggtttggctgagccctcagttgccaagaaggaaaaggtggcatctatgtacacactaaaaagacgccacttctccactctcatgaataaactatcactagatttactactttgtttcatcaatatgttgtccatgataccctttattcaacttcctgacagattaacccatttattcaatagttatcccagcccaaagtcatctcaaaaaaaaaaaaaaagaaaaaa

SEQ ID NO: 8137 - DNA, 1328 bp, artificial
  synthetic oligonucleotide
aaattctctgtaagttacagaaatccaattttggggggatatactgaattacatttaacagactggggaaaaaagtacattagggggtctatcatgagccagtttataaaataaaatatttggaataagcatgatggctgtatttaaagcagaatacttctatataatctacttccttaatagccaatgaaaaatgaactataaaatcctaaatacaaagctgaactaatgtgttttttctctttatcggatttaaaatagatttctttccctctgagaaagtgaaaagattttatgattatgtaagatactgtattttacatattaatacaatttctaaggggatcattgggatgctgaatcttaccttatgcatatttataatactgaagataccctgggttcaaaaatattaaaatgtcactgtactagagaatcaacatatgggtattttaatgaataatttaacaattttgctttaaaaatcttttatgtacaaaaaaagtcaagcataggctgggcgtggtggctcaagcctgtaatcccagcactttggggggccgaggtgggcagatcacttgaggtcaggagtttgagaccagcctggccaacatggcaaaaccccatctctactaaaaacacaaaaattagcagggcgtgatggcacacacctgtaattccagctactcgggaggctgaggcaggagaatcgcttgaacccggggggcggaggttgcagtgagccaagatcaccccactgcactccagcctaggagacagagcgagacttgactcaaaaaaaaaaaaaaaaaaaaaaaaagaagaagaaaaaaatatatatataggtcgggcgcggtggctcacgcctgtaatcccagcactttgggaggccaaggcgggtggatcacaaggtcaggagatcgagaccatcctggctaacacagtgaaaccccgtctctactaaaaatacaaaaacttagccgggcgtggtggcgggcgcctgtagtcccagctactcgggaggctgaggcaggagaatggcgtgaacccggcaggtggagcttgcagtgagctgagatcgcgccactgtactgcagcctgggcaacagagcgagactctgtctcaaaagaaaatgaataaataaataaataaataaagaaagtataatatgcattttgccaaatatacgtttacttcataaaatgttttcaataaaacaatcattgttttttaaaaatcaaagaccaaagaaagcagttgaaactatttaaatcttcacatcactgaaattcagaatgacaaatgtcaggccttatctgttaacatg

SEQ ID NO: 8138 - DNA, 1449 bp, artificial
  synthetic oligonucleotide
aaaacttaaaagccttaactcatagtacttccccttcttcctttcctgctccaaaccttttctccagtcatttccagactctctgatccttttcaatttctgcttatcatttgtttttttcttccaatttcttaagagtttcctcatttttttaaatgtatttatttattgattgagacggagtttcgctcttgctgcccaggctggagtgcagtggtgcagtctcggctcactgcaacctccgcctcctgggttcaagcggattctcctgcctcagcctcccgtgtagctgggattacaggcgcctgccaccaagcccagcaaatttatttgtatttttagtagagacggagtttcaccatgttggccaggctggtctcaaacgcctgacctcaggtgatctgcccaccttggcctcccaaagtgctgggattacaggcgtgagccactgcgcttggccacggttttctccttttaaatgtcaagaaagctgtccctgttccacgtcttcctttttaatttccaattgtcctatgcttgttttcatctttaatttaaaaagagaggcctggcgcggtggctcatgcctgtaatcccagcactttgggaggccgaggcagacggatcacgaggtcaggagatcgataccatcttggctaacacggtgaaaccccgtctctactaaaaatacaagaaattagccgggcgcggtggcgggcgcctgtaatcccagctactcgggaggctgacacaggagaatggcatgaacctgggaggcggagcttgcagtgagccgagatagcgccactgcagtcctgcctgggcgaaagagcgagactccgtctcaaaaaaaaaaaaaaaaagagagaatcagcaagtaagattgaacttttacactccaattttcaataggttcctgtctgtctaatacactccccaagatactatctttccttcctaaggccctaatagtagtcaacacctagattacaggcactcttcaggaatctgtgaacctggagtgaatgcgagtcaaaggtagaaaataagaacactctacatctatacataaaaggcagaaaactttagaggagaaaaacaccttgcgtgatttcgaaagaactgcacatgcgttaattacaatcttccaaagtccatggggttggggaggaagggttggcaaaaaggagtccgatgcagaaaaagacattaagttaactgagaaagtacacttaacccactgacctagtttctaacagaaaacctgctcatctctatgctttcactccaagaggtgagttcattgttaatttaagcaatttcaagttctagctgcatattatctggtatctgaaggagatttagaactttttcaaaaacaactcaagcttattagaaattctaatcaaatttcacatttgaaataaaggttactatcttttaaaaagt

SEQ ID NO: 8139 - DNA, 1654 bp, artificial
  synthetic oligonucleotide
ttttacccatattaccatgggaaacaagataccaaatttcatgtttggaaactgtaagtaaatgacaggactagttaatgaaaatataagtctcatatataaaataagattattattgatttttgaaatcaatgccaatggttttttcaaaagctacttatgtacctggtttcttaaacccaaatgcctccaattctggagtttgaagatcaggtttaatctcatagtatgtctaataactgcccaaaaaacccccaaaaaccaaagtcttcacatttccatgacttcacacttccattttatgttcaatggtggcagcagcaaaaaaacaaacaaacaaacaaaaaaacaaaaaacaccaaacaaagtgaaactagaaaatttatacatcagcagccatatagaaggcattgcaatattgcaccaatattctaagatctggcaagttttgccagtatagatctagtctgtatcagatatagactactcatgcgcaaatggcatcaatttcaatgatccactcccaggttattcttgcttaactttgtcaactatgttttttcctctgcatttaaagagttgaaaggtgcagctaatcctaaaacacttattataaatgcttttaaacagctattcttgatccattctgaactttgtggttactatccttcatgctaatagctttcagtaaataaaacaaaaactgagggcttacatccctagtgtcgctgggtattttgtacaaaataaacaagtagataaaaccagtaacattataattctatttcttacctctaagtcaaaactgaggtcaaattttctaagagtttctaccttccattcaataacaaatgcagcagccttactgaatgtaaaaaatgggagttgcacttacttttaaggggccttgatttaggagtctggtattacctaaatgctctttaaaagtgcttgcatgctgcagggccagaacttgtcatataccactccgattctcactaaaaacagggtaacgttaaacagactgcaaagaaaaacattttcaaaaagaaaagacatacatcgacaaagaacactaacatttacttttgaaaataaaatataaagtgttagttttcataaccatacatgtttcagaaatataaggagttcaaatattactgaatcagtatggactgaagataggctactttgatagcaaatgaggactccagttatttcaactttctaaaaatgttaatatgtgaaaagacgttacatctaaaattcaacaagtatggcgaactgtgtgtgcaagtaagtgcactagcttaaaaatatagaatcctaaccacgcataaaagggatgtgccttgtgtatttataggttgtatgcgagtatgaatatgctttcactaacacaatgcggataagagaaggcagcttagaaatagtgttttgaatataaaaagttaattttgtagaaaatttatatttttgcattttcagcaaaaagccatgcaaaaaggtcaagagttttaaacttttaaataataaaactaaaaagtataacagactgaaatacactgaaataaatcttcaaaaaggtttcagatagagacagagactgaaatcacatccagtgacacttatcgggtcttctcttagaagacac

SEQ ID NO: 8140 - DNA, 1063 bp, artificial
  synthetic oligonucleotide
tatttttgagaaacacacccccagaaatattctataatttaagtaatcttgaaataaatcacaacattcacattttcctgctaaaatcatagaaatcctccttcggaagataatttctctcatgtgttaaggtaattctcctaccctgctgtgacacatactgtgtgtaagtgggctgcctttatcctctcacctttaccacttccgagcacacagcttgacttctaacttaccagctcatggacttctttgtttagggcattctcctgttgctggagcccactgccactggtgcttatgcaagcaggccggaagtgccagggaatgaatgcccctctggttgctctcactcaatgcctgagagaagttgatgtataaatatctcagctctttctgccctgggtggaataaccgaggtgtatgtgtgtgttttgtactggttctcagaatgtccccagcaccagtaagttccaggaacccacagcggtaactgacttagtaatacatcctttattggctgccttgcctttcttacttccccggtaacttccccattctactgtggcggtttctttttggtttgttttggttttgcaccttctaaataattattgtacttagagtggaatgcttgcctcaggataggcttctggggaaaaccagaagaccctgtttctggttcattctttcctcaacatttgaattcatttgtcgtttcttgtttttatagtgcagtgaagacagagaatgtcaactttgttaggaaatggcttttcagctatttctgaacagactgccttctttgtacactgtgttaagaatagtcattttattccttttttaatcctccaacgtatagaaatctaccattgattttggctacctggagagaaaaaatggggtctctgttgtctttatagtcaaatcaaggttccagtcagtactgggtgatttcgagggtgtctttcagttttaaaattctatgagttttagcaccaattttacagaaactattccagaaaattgaagaggagggaatatttcccaacttgtattatgagaa

SEQ ID NO: 8141 - DNA, 772 bp, artificial
  synthetic oligonucleotide
tttaattttgcctctttttttatatggtttttatttctttttaatctgtaggttccctatccacctctttttttctcccccattacaatttgttaattaaactggatcattcattctgtaacatttcccatgatctagactttgctgattgaattccttggtgtagctaacacgtaactctgtcctctgtatttcctgtaaattggatctagagaatcattcttttcttcttcttccttttttttttttttttttgagacaagttctcactctgtcgcccaggctggagtgcagtggcatgatctcggctcactgcaacctccacctctcaggctcaagcaatcctcccacctcagcctcccgagtagctggaactacaggctgtgccaccatgcccggctgatgtttgtatttttcgtagaggcagggtttcaccatgttgcccaggctggtcttgaactcctgagctcaagcgatcgggccacctcagcctcccaaggtattgggattataggtgtgagccactgtgtctggccttaagagactaattctttattattaaaaacagtgacaacaacaaaaataccaattcagtaaatatatgttgaatatctactacatgcctgaataggataaaaatatgaagtaattattaaggacatttatcattttaggcaacttgacaggatcttctcgggggacaaattgttacggtttactctatgccattagcttggtcatcaactcaggagatagctcaaaaaatgtgtgg

SEQ ID NO: 8142 - DNA, 5407 bp, artificial
  synthetic oligonucleotide
ccactttttgtttctttgacggggaattccctcttttgattttccatttttgtaaaatgtcacatgggtttatcattgggagacaaaaatgcaacacaactatatacgttgctgtttgtgtgtgaaatgaataacagattcacagtgaccagtcactgattgactttggaaggtatgacatgatttgtcactaatcatgatgatcatctgtcatttatattgtgatctttgagctgaagagctagcaacaggaggccgggcgtggtggctcatgcctgtaatcccagcactttgggaggccaaggtgggtggatcacttgaggtcaggagttcgagaccagcctggccaacatgatgaaaccctgtctctactaaaaatacaaaaattagccgggcctggtggcacacgcctataatcccagctacttgggaggctgaggcaggagaatcgcttgaacccaggaggtggaggttgcagtgagccgagattgcgccgctgcactccagcctgggcgataaagcaagactccatctcaaaaaaaaaagtttgaaaaggccgggtgcagtggctcatgtctgtaatcctaacacttggtgaggcagaggccggaggattgcttgagcccaggagtttgagacctgcctgggcaacacagcgagaccccattctccagaaaaggaaaaaaaaaaagatgaaatggtgcaaaggtaggattgcctgtgtgtgtgtatgtgtgtgagtgtgtatgtgtatatgtgagtgtgaaggtgtgtgttgagagtgtgtatgtgcatctgtgtgtgtgtgtttgaaagcatgaatgtgactgtgtaatataccctaaaggccttcttgttattctgtttcctagcactgtagctcctcctgccctatccctggctcttaaatgcacgactataatgttaaagtgatgatatatatttgtatttttaattcctaatttgatatcattttaaattggaaaaaaagaaaagtgggatttctacaaatactccaaaggaaaatagtgaaaatctccacttcatactagagatgaactcatatttctaaaaaggtttgtgcaaaagtcctctcaacagcctgggcaacatagtgagaccctatctctacaaagattaaaaaattggccaggcgtgatggctcacgcctgtaatctcagcactttgggaggccgaggtaagtggattacctgaggtcaggagttcaagaccagcttggccaacatggtgaaaccccatctctactaaaaatacaaaaaaaattaaccaggcatggtggcatgcacctgtaatcccagctgaggcaggagaatcgcttgaacccaggaggcggaggttgcagtgagccgagatcgtgtcactgaactgcagcctgggcaacaggagtgaaactccgtcccccccaaaaaaaaaaaaaatagccagacgtggtggcatgtacctgtagtcccagctactcaggaggatcactggagcccaggaggttgaggccgctagccatgatcatgtcactgccctccagcctgggtgacaggatgagaccctgtctcaaaaaaaaaaaagtcctctcaacccaagcatgtcatgaacaagctctactaggtatgcagaacacatagctattatcattaatttttaggcccatctgagtttaacttatctgagttatatttgccataaaaatgttgatgcattaaataaatatttagtgagtatgatactgtgtgcatgataatgtgtagcatagctcctgccttccaataagggagctaagtcatacacagataactaaaacattgagtagtcagagagagatcccaataaaattcagagatgggatcaaagaatgccttttggatgaagtgacatttgagtggaaccatgagaaatgtgtctaaaaacattttagagcacccacaaccaatcaattttttttttgagacagagtcccactctgttgccccggctggagtgcagtggtgcagtcttggctcactgcaactgctgcctcttgggctcaggtgatcctcctgcctcagcctcccaagtagctgggactacaggtgtgcgccaccacgcccagctaatttttgtatttttttattattatactttaagttctagggtacatgtgcacaacgtgcaggtttgttacatatgtatacatgtgccgtgttggtgtgctgcacccattaactcgtcatttacattaggtatgtctcctaatgctatcaggtttcaccatgttggccaggctggtctcgaactcccgacctcaagtgacccacctgcctcaggctcccaaagtgctgggcttacaggtgtgagccaccgcacctggccaactaatcagtcttaattgttttttttctctttttcttttcttttctttttttttctctttgagatggagtcactctgtcacccaggctggagtgcagtggcgcgatcttggctcaccgcaacctccgcctcccgagttcaagcaattctcctgcctgagcctcccgagtagctggaaccacaggcacaagccaccacgcctggctaatttttgtatttttagtagagatgggttttcaccatgttggccaggctggtctacgaactcctgacctcaggtgatccacccgcatcagcctcccaaagttctgggattataggtatgagccaccgcacctggccaacttaatcgttcttgttttttccctacagtatcgcagttttttcgatgaggcccctgcattttctggcggcagaaataacagctggcgcaaattaaatcttgaaaatattcccaggacaatgctaatgtatgacatagttcattattcagagtctggagtgatctcaaaccgtctacgaaatgaaatgaagtttctgttacagagaccagtaacgcaagagatccataagcaccagctacggattgtttctgaaattaggtaaaacagattcttcactggggttacaatactaggggcatatctgaaaatgttcacattctgccagatagctcactaaagataagaggatatatggggaaaatagggttggggcagattgctcaaaacgtatgcaattttgtaaacagagcactaacaaaaaggacaattggtacttggggagttaacttgtaccaccagacaggcagctcagtgtagctggaggctgccacagaaaatataaaaaaatgaacaaccatagagtggagatgctggcaactctttcattagagcagttagtgggcatggagacagtgcacatggaagtgggaccccaggccagcgtagttgccttttttttttttgagacggagtctcactctgttgcccaggctggagtgcaatggcgcaatctaggctcactgcaacctctgcctcccgggttcaagcgattctcctgcctcagcctcctgagtagctgggattacaggtgcccaccaccatgcccggctaatttttgtatttttagtagagaatgagtttcaccatattggccaggctggtctcaaactcctgaccttgtgatccggccacctcagcctcccaaagtgctgggattacaagtgtgagccaccatgcccggccgcatggttgccttttaagtggacatgagaggcagtgcgatctgccgagaaccaggagccatccaaggctggagtgggggtaggggaggagtagggtggagggcagtgagggtgagttgggggtggggtgtgcctctctgggaagacagcacttgatgcaggtgctcatttttgttttcatgaatacagtcaaaagggctccccttgcccatgcagcacagaactgagggctttttccttttttgctgaaggttataattctattcttgctactctggctccccttgcctgagataaattgcatataaattagagtgacgtcattcccctttttaccaatagtatgtgagccagttcacattgtagaaatggatgttgtagcaaaatagatgtattatgatctgaaacaacatggacagaatataacaactccaattatattccttttctctttccattactaagcctcacttagcccatcttatttacaaattaagctgctttcttaaaagaagaaagagataataatatgtaagaggacctactggtaatctattttcacactcttataattgaaatgaaaaatactccctttgtacatgaagaagacactgatgacccactgtcaagcaaacatgctggggattttttttcaggagtagagatgagtgattctgacccaataacataatttaacccatatattttatgatcaaggctatacatttgccagacagatggcctggtttagggcacagtctgtcatgaaatagattttctctaactcatccatatgagcactgaatatagaatttaaccctattaccaccaaggtcaaataaatgatgtaattttctctgccaccatatataatcctgatctccctgctatttggatttatcctactgagtatccaagaataagtaatttaagagccaaataattagccaaattattaatcaattgaagagaaaaaatactttcataaagccatctttgaatgcagttgtagtttagcatctcccagaagcaaaccctgagacagagatttaggaggtgatcccaggaacaactgaagggagagggtaaaaaagtggaaggcagccaaaacagtgtgtgttagcaagcaagttaccactgtgggtaactggagcttaatctcccccgggaatgtcagagtcaatgtagaacatgcaactcagaattatcccacagggggcaggggaattacagtattgatacatcaacacccatcagtcattggttaagggttgcttaggaagggacatattaattctcgggcacttttgacctcccctgcacatgggcttgcttttcttttcttttttttcttttctttttttttttttttgagaccgagtttcactcttgtcacccaggctggagtacaatggcacaatctcggctccccacaacctccaccttcctggttcaagcgattctcctgcctcagccttcctgagtagctgggattacaggcatgtgccaccacgcctggctaattttgtatttttaatagagacagggtttctccatgctggtcaggctggtctcgaactccagacctcaggtgatccacccgccttggcctcccaaagtgctgggattacaggtgtaagccaccgtgctggcaggcttttcttttcaaagaaaattttcaaactgagtgatgcagatgctggcattgaaagttgagtctatgttccttataatggtaaggacaaggggattatggacatagcatctgatcccagcactgattaaaaacagcttgtt

SEQ ID NO: 8143 - DNA, 918 bp, artificial
  synthetic oligonucleotide
acaaaggaagaaagaaacttaactggaatcaaaagatgtttgaattttcttttcttttcttttcttttttttttttttttttttgagacagagtcttgctgtgtcccctaggctggagtacagtggcatgatctcggctcactgcaacctccgcctcctgggttcaagcgattctcctgcctcagcctcccgagcagctgacattacaggcacctgccaccacgcctggctaatttttgtatttttagtagagacggggtttcaccatgttggccaggctggtctcgaactcctgacctcaggtgatccacctgcatcggcctcccaaagtgctggaattacaggagtgagccaccacgcccgccctgaattttcttttgtgctatccttcccttcatataaacataccctttgtggccagaagtacagatctgtaatataaatatgtgttagaagagtcagcacatacttatggcgggggtgcagagtacttaagtctctactcacagtctatgtatagctcttagcacaggatacttatatgtggaagggtatggtataagtagggcccaacaggatttgagcttccatatattctgtgattcttctgtctctgacctctcaggtgctttccttgagcataaaatgttgacatttgggagagaaaagaaaacccctctatttgccactttttagctgctgagaatgaagtctgaagggagggaggcttaaacagtctgaaacatacatgtttccacttaccagcagtgtattaacacataaaagagaggtggtactagtgacacctttcattgcagttcctacggtaactcgttgaatcaccagataagttttctctgcattgactgcacgaatgatattacaggtttgttttgcttttcaaaataaaagaattaa

SEQ ID NO: 8144 - DNA, 6464 bp, artificial
  synthetic oligonucleotide
aaagctttccaaagtgcccaaatcagtgaacacgactcatgatatgtaactaactcatatctcatctagcttatatctccgtcatggacattgttggttgcatatccagtctctattctccctcttccttcctaaaagaactccattgtgttcatgaatgcattcctctcccctgtgattaagtgacgccaccctgggttgatcctgtttagtctaagccaatcagatcatggcattcctctgacaactgttacagggtcagacaactgacctaagttggtccaatcagactgaaggaccaagtgtgggagttttttctctctcctcctcctcttgctctagagaatgagaaagtgtgtatgttactagtagtcatcttgcaaccctaaaggaaaccaacctgactgtggaaacccaagaagagatgggtccttgatgacactggttttttttttttttttttttttgggacggagtctcgctgtctcccaggctggagttcagtggtgcgatctcagctcactgcaacctccgcctcccgggttcttgccattctcctgcctcagcctcccgagtagctgagactacaggcacccgccaacacacccggctaattttttgtatttttagtagagacagggtttcaccatgttagccaggatggtctcgatctcctgacctcgtgatccgcccgcctcggcctcccgaagtgctgggattacaggcgtgagccaccgtgcctggcctgacactgttgaccaactgaatcagagcctggaatccattcttcctctggactttgtgagagaattttccttactatttaagcagttgggttttcccagctgaaagcatcctaacatagccatttctccttgaaacttttctccctcgattttctaaacatcactcttttctgctcctacttctgcttctcaagtctggcctccccctttcctctgcctactcctacattttggtgtcctccaaggtttgttgtgatcttttctacccaaagtacatgttcacctgaaataatctcagttcagtcgggcgcggtgggtcacacctgtaatcccagcactttgggaggccaaggcgggcgaatcacgaggtcaggagttcgagaccagcctggccaacacatggtgaaactccgtctttattaaaaatacaaaaaaattagccaggcgtggtggcgggcgcctgtaatcctagctactcagaggctgaggcaggagaatcacttgaacccaggaggcggaggctgcagtgagccaagatcgcaccactgcactccagcccggacaacagggccagactctgtctgaaaaaaataataatgataacaataataataataataataatctcagctcactatgtctttcccttgacacatcaaaactgagcttccagcacttcccccaatggaataccactgatgttccccaccccttttacctgaagaactcctacctgtctcaaaactaaatttaagtgtcccgtctgtgaagccttctctgaagtccccaggggttccttacctttttttctgccgtggacctctttggccgtcagtgagtcctatagactccttctcaaaataatgcttctaattgcatacaaaaaagtcccaactatattgaaataatcttattttttaaactcaaatatctgatataagcagtatgtgcttctttactagcccactaaacaaaaagatctagcagtgagtcttataactaccatagttctgaagtagtaatgagcataagtgatattttgacatctgcaacaactgtaatgtaatatgaaaatgtctgtgacttgtgctggtactgtgacttctactggtaacaggtactgctaatactactgtgatttgttacagtaggaacttgtaaaatgaatggcccccagcgaagtgcaccaactcatatctatgaccttgtgtggttccccaccatatcaactctggacttggctacgtgacttgttttgacatcagcaaacatgatgctgtgtttgtgccttgggacttgccctcttggaagtcagtaaccaagtgaggaagtccaacctaggcacatggaggggcaccaagcccccagacatgggagtgaagccaactttcagtcaagtcaccagcagaactgcccagccaacccagattttgagaaacaattcttgttttaaggcactggtttgcagtgatttgttacccaacaatagataactgagacattacccatatgcgtaactaaaggaagtgctcaattccaattggagattgctaaaaatagttatgttttttccccatcaaagttcagggatcctctgaaatctatgtgcagatcctttgaggagctgagggccccaggttaggaacccctggttaagccaagtggatcctgctctcctttttactactttactacactgttggtacacatatagttaaactggccacagcatatctttccttgttgtaaccctgaaatggagctgagctcctagcacataacaggtgtttaacacacaaatttatcaaatgaatgttgattataggatctgtcttcctgactaaactgtgagctgcctgaaaacagagtaagagcaaatactaggccttttccaagtgctttacacataccaacttactccttataacaaccctatgaggtagatgttattaccccaacttcaccaaaggaagataggcacagtgacttgcccaaggtcacacagctagaaagtggcaatgccaggactagaaggcagaatgcatgttctgattttacagcctttattaacgtacccaaagcacattgcagagctcaataaaacttttaaatgaatagtacaattctgagatttcattagcactattttatgggtactatgcttcttgaagactcaattttgtagattaatttctggtagcctgtgattttttatgacaaaatacatataatttactttttaaaaagtagaataatggctttatgctaaagtgcagattttcgaaattaagtcttcatcgtaaaagtcgatttttttccaaaggacacgagttcacaaaacgcagggaagggggtccactggcccgtattaaataatgttccctgaggagtggagcaaagctccagcttccctcgtcacccagccatcccaccccagcctcccccataccctgcacagcttctcctaaaatgaccctcccccatccacacatcaggttctgaaacctgaccctgccaggcaactaaagccgcgaaccccacagtgccctgagctggcctcaccctacccacgatcccaagagggtactagccgaggggatgggtactttgggggaaggcactttaaattttcaaagtgtttaattcacgaaagcacaacccaaagggccgcccccacccacccgggggtctcccgcctccgcccggcagccgctcatccccagtagaccagtgaatgaaccgcggggccgggacgcagccggcccagtggcgggaaaagcctcggggtgagccaggcctggctgcagagaggccccaagagagcgcggggagggctcgggcggccgggagggggcggtgacagctgtgactcgactccacgctctcaccttgaacatgtcgctggcagcggaggctccggcagggtcaccccggcctcggccacgcccactatagagaggtgactacggaggcccggtagggccttgatttctccaaccgcaagcaggcagcggtgcgggtgacggccgtactgcaaactcggtgcggcgaaggtttagttcaatcacccggttctagaagccgcgtcgctgagccgcagcgcgtcgcgcccgggcagcgggtgaacgcaaaccccgccctccaggaggctccgcccctgcgccggcggttgctaggcggcaagaaagcgccggctctgtgtggacggtacgcggaggcgcgaggagggaggcgcctggcgttgccgcggcgctgggaaactgtctttgcagcggcgactgggcgcccagcggcgtgtactgggatttctgtgagcagaggctgccgagagggggcgcttggagggccaccggcggcttcgaaagcttcgcagccggaagccgccggttggcggcctggatttaccttacgaaaggttttaaccaaggacttgaggtttctcaggttttaaatttaaactaatatgctgtgtcctttaatcggaaaaggctctgaccttattttttcccgttaagaaacaagcggtaagcctcctctctggaaatcaaatgtttgtcccttaatacttgtagaagtaactgataatggcaataattatcttattaacaagagtaaacaagcactgatacagcactttgatatgcgcagccctgatctaagttctttattcacattcatctaatctttccaacaacggaagtaggtgggcatgattattattcccaatacatagatgaagaaactgaggcacgtagaagtaatttgtacaagaccacataggaagtgggaagctaggatccaaacccattagtctgcctttgaaacctgtgttctagccaaaacaattgttgcactgtctcataatgaggatgtatttcctatttcattctgtatttctgccctaatcctataaaaagtgtaagccccatccaggcgagcatctggaaaaatttagaatttgtacagtgacgtgccactgccctccagccaaagaccactaggggcacacctgtagttgaagaaattgggtttctcattgctgcaaggagaacgcacacgtaggaacacagtgacatatttcagtaaaagagttagatttattataggatttgggctttggttcggtgattttggggcgagttcaaggaagcaggagctttgctctggatcgggtgttgttaggaagcagtggtaacaccaaggcccagctgtgactgccagccttggtgttagttaagcccagcttagctcccagatgttaagggctgcttttctctttcttaagaggattgtatattccaaggcatccccaaggagaaatactgaatagactcagaaggctctctgcatcagcagtgtaacgtcacacatacataaaaatgtgaaacatattgataaattagggcagaagttcttaattcagggggtatgtgaacttgtatgggggaaaaaatgacaacttcattttcactaacctctaactgaactttgtttctttcaattatagtgtagataacaagccacagtagtattaacattgatgactttgtcatcaatggaaagcacagatattttcatgttacattgcagtcatgtcagggatcttgaaatatttatgctcgttactacaaaaatacagtagttattagagctcatttaatgcattaagaagacacatttactataattttgttttaaaaaatattttgatgatttcaatataattggagcaccttgtaatcctatgtattttatgttatgcgttttaaaaccaattcttagaagagatctgtccataggggtccatggcaccaaaagaaatgataaagagcccctggtttagtaacagagaccaagcagtgagtaagaatttgggagctgcatccaaattggagcattactgcatccaaactcgttgctttaaagaatagaaagttggaggtggaatcagaaatttagtgtataccctctcactttaccaaggagggaactgaaccactgagaggttaagtgacttgcccaaagtctcactgctatttggtgataaaactgggacaaaacgtttttagacaaacatgtaaaaactctccactgtgctaggcactgaggactctgtagttaacaagatgcctcctgccctcaatgagcttgttggtagacagctggagagtgaggagattgaattattgagttaaaaagttaactccaggtgtagtgtggaagatgaataagaggagaaaaagactggagacagaccagttagaaggctatggatagatttacttgtcttttccatataccatataatatttttagtacacaaagaatgtaaactgtaagcaactttaagagatccacaatgccttcctttttaaaggattcagaattagtacaacaatcatatggcacttgagtcttgtccaaacagtgtaatagtataaattatgacctcaaagggttaatttatgtactttcagattacttcattggagggaaaatgaatcgttcctcaaatgtaccacgtaaaggtattctgaaatcaggtacaagatccttacaaaaagttcgcagagtacatttcgcaaatgcacgaaatgcaagatcattactatcgtaagtacctgtgttttgccttgtgttatcttccacaactgtacagtttccaaacagtacttattcagataacttcaaatgcttcttgttttgtaaatcaaagtt

SEQ ID NO: 8145 - DNA, 1415 bp, artificial
  synthetic oligonucleotide
caatttttatgtaagtgtttacgttgcatctttttcctttgtttagagttccagcccacaagcctcccctggtagacaacaatgttttcataactgcaagcaacaaggtagttcctagcccctctgctctctagttaaggcgttacgcactgcccagggagagggaaattctctctgtagctgtggcaacagctgtcaccaggaagctagggcatctctgcaacccctcctcagatggcactgaagaacatctgtaagtcaggcacttttaacttggggccttgtatttcaacattttttgtgggtacgtagtaggtatatacatttatggggcacatgagatgtgttgacacaggcatgcaatgtgaaataagcacaatatggagaatgcggaatctatccgctcaagcatttatccttagtgttaaaaacaatccaattacactctttaagttattttaaaatgtacaattaaattattgttgactacagtcatcctgttgtgctatcaaataggttttattcattcttgctacttgctattttttttttttgcacccattagccatccccacctttcccccagacccccactacccttcccagcctctgtcaaccatctcagggccctttatcatgcctttttccaaaaacatgcagccaatacagactttcctctatggactctaaacagaaatgcgttcactccattttcagaacagttgtacctgacaccaggttgtgtatggctcgcaatagtgtcggagctgtgagatgctttcttcaagctggctccttgcctcctccacatacttcgattgaccctcaggaactgagtagagtgaaagctgcgcacattaaaacaaaacaaagatttaaaagatgtactgtctacaggatacatttatcaaatttgtaagtatttaatataatatttctagtaattcatgaattacagtgactctgtggtcgggtgtggtggttcacgcttgtaatcccagcactttgagaagccagggcaggcggatcacttaaggtcaggagttcgagaccagcctagccaacatggcgaaacccagtctctactaaaaatacaaaacttagccaggtgtcgcggtaggcgcctgtaatcccagctacttgggaggctgaggcgggagaatctcttgaacctgggaggtggaggtagcagtaagccaagattgtgccagtgcactcaagcctaggcaagagtgagactccatctcaaaaataataataataatacttcatgaattccagtgactctaagggttacaagcaacctgaactttatctcaaactatctctgcaccttatttccataatcaacgaggccaaggccaaaagggcagggctatgaggtgtcctactttctccccacccactgactacaa

SEQ ID NO: 8146 - DNA, 505 bp, artificial
  synthetic oligonucleotide
cttcccagaaaaatccacatagctctaaaattctgcatataattttaaggaatacacagatttcttggagctcattcatggaactccgattaaagagttcaatgttaatgaagtagctgattatgcctaatttaaaatcaacttacctaacccccattgaaccaaactttgcatcttgggcttagtttgggagtacgtttcctaaaaaggtaaaaagaaactgaatgaaactattcacaggatctgctgattagaaagttaacagaataaatatacttgtttttactgaataaattatcatgttattaacgctttttgaacaaagggatacactgtctgtctgggtctttttgtttgtttttcctattataatcttcccttcactgcaaattactcagcagaatggcttactactgccacaggaagcagattccaaacagagtggtttcaacaatccagccatttcactcttccattaaaatggaaaaaatagactaaaaatcaa

SEQ ID NO: 8147 - DNA, 2725 bp, artificial
  synthetic oligonucleotide
gcggcggcagcggcccgagccgcacggttggaggcggcggcgcgggctacgttggcagcacgggcggccgtctcattggcaagtgtttccggatccagctgcaatgcctccaccagggtctgggccagcacagggttttccagttcccagggctcattctgcaaggccagagagaggggttggggaaggcaggccactcgacgacatacttgtgttagcttccctgtgctggccagcctcttcccagcagtcagccctgaacaccccaagaccttcccaaatcttcttcttccgagcaggggagggaaggcttgggaagctgggcagtcctttcccacacaaccctcctggctcccccctcctccctcccccattcacaggggaaaggcccaggccagcaggtgtccaggaaggggcctcaccgataagatgcgaaggcctggacccaagcttccgaaggctctgaggatatggatgtcaaagctggtgagggtgccatagccaccaaacgcaccgaattcttcatagtcgttgccttcaaccatctcttcctccccgacttcgtcgctaccctcatccatgtcttcaacactgtagctttccgattgcacgctgaagcttccctcagccatgctgcgggtcccagggagatgagagctcagcctgagagggagggtgaagcagctgcagggggagggggcgggatccaatgggaggcgggatctcccgggaggtgaggggcgacaatcatcaggttactaggcaatattaggcagtagggggcggggggggggaggaggagcgggggggagacggtttggctttctgatggggtagacctggtcagggacagagcccaaggaaagggacagaggaggtcgcaggaggcgccgcactgaaagcggagtttaggatgggcaggctcgccatcccagcggctagatttgacgagggggtgttctggagggctggggtccgaagagtcccaaagggaatgcattggggaagagagaaacaaagggtttggatttacgggccagagaaggggaccgggatgaagggggagcagatgggagagctcagacaacagggacagtggcaagccgcaagctctgcgaaacagaaccccagggacctttggctaggtccgggcggggggcctaggtggggctcagactcgagcactagaggcggatggagtgggggcctcagacctaggtgaggctccaatcggagcgctgcagatctcaaacgcgaggactgggcactccaggaagggggcaagcggtcagctcggttcgagtaatctaggagtggttggggtgggggtggggcctcaggtccaagggagctcagctcggagcacacgggtctgctaaaggggtgaggatcctgggctccggtttcagtagggctcagatcggggcgcctgggtctgatggtgatgggggctcctatctagaccttgggtctaatggggttccggttctgagtgcttgggctttgttcagatccggaggcggagggagggcgcagcgtgtcgggttccactcgccctctcccggtcctgtctggggctggatccttaccttctcgggaactccaatggcgtccgtcctcagcaccaggaaccccgcagccgcgccctcgcctactgctgccagcacagcagcccggaccaccccgccccttttctccgtgcaccccccgcggctgggtagcctgcgcatgcgcggacccctccagcccgcccgctttcccaacaaaagccctttcctccaggtctccagtgcgcatgcgattccgcgggtgggtgggcggtggggtcgaaggtagggtgcggggggctcttcccgccagatccacttcacctctcctcctcctcctcctcctaccgcgggcgcgcacactcataccctgcagtgcagctcgacccacccaatcatctcttctcagtccccccacttttgcacaatgcttctctgtcctgccctgccctttcacccaaactcctccagcctggtctgggatacactatgccccgtttccccggcaagaccccttaggtcacaattagtgaggtctcacaattaataagctgggtctctaactgcaacaagtggaaatcctcaacctgcggggctacgaaatggacatggccagaggatggcacttcgctttgtgtgcttctccactagccaactctctggcccccagacatactgggaacatctgcttcctcagctaccctttatgcagcttgtatgtcacagagggatctgtgctggggcttttcttcctctcacagcagcgctgggaagtggatgtcagcatccccatttggcgtgtcaggaagctgaggcacagacacattgcatgaactagaccacagagccaggaaacagaaaatgcaaaatttgaacctgggtcttccggactccaaagtccacctcctgctcctgctggcctggggacagaggcaccgcctcctccgtctgagtgacaggcctcccccaccccaacatctgtcccaaagaagcaaggtttgtgctgtagaaggcctaagttcatgctccgcattcaggacacagggagacagagcctccccccgcctcgcccccagcctctgcggctctatgtgggtccatccaggtatgagaattgctccaccgggtccactctctactcagattgtcaggcctcttccttatcagcgatacaatca

SEQ ID NO: 8148 - DNA, 1903 bp, artificial
  synthetic oligonucleotide
aacccagtgatttggccaaacccagtaatctggcagaacccagtgatctggccaaaccccattgtctggcccggccctgttgtctggccgaatccactggcctggcagaatccacctggatggcagactccacctggatggcagaccccaccgggctggcagggtcctccagactggcaaggtcctcctgactggccgctaccacccgactggccactgccacctgattggccacttcccactgactggccactaccacctgactggatccccgctgattggccaattccacctgactggcagaacctgcgcccctcgcctaacctgcgcccttctcccaactcgcgtgcctcacagaacccaggtgctgcacagccccgagatgtggcccttcttcaggaaagagtaagagctgtaactccccagtcacttttcccctctcttgctcttttctttgtcatcctctcatctgtaattcaaccaagtttttttgtaaatattttataagtttaatgatttcctttttccctcccaggcaaataagttggtcaagtacttgatgcttaaggactacacaaaggtgcccatcaagcgctcaggtatgcatccagtgtcccctccccaagctctgcccttcccttcactccatgctctgtcagcattcttctgcttgtagctctgcccttcccttcactccatgctctgtcggcattcttctgcttgtatgacccttccccttctatcccctcctttccatggttggctctttccacccttgaggaccttgactgtgctacccccagcagggctggcaaagggactgctgctctgtggcccccgctcggctcagatggctccctcctctctcctacagaaatgctgagagatatcatccgtgaatacactgatgtttatccagaaatcattgaacgtgcatgctttgtcctagagaaggtgagaaggcagccctggggtacaggaataatggggaaagtcttgatttcaaagattcatggggttcctactgggagtttagggcaagtctcagggagatgagtgtctgcctatgggtagcttatgctagatgttgtaatttcatagtctgttttcttgcccctgtagaaatttgggattcaactgaaagaaattgacaaagaagaacacctgtatattctcatcagtacccccgagtccctggctggcatactgggaacgtaagatgggaaagaaggtggaacatggcctttctcagtggtgctttttttctaggagtttcacgtagatcagggtccagggttcagggtcacatagcaggtcatgggcagagctggggtataattctcccctagctgaggaatattggggaggctagatgggcaagctggttggggtctctcatgcaaatggctactgaaaatatattctttctatattcccttaggaccaaagacacacccaagctcggtctcctcttggtgattctgggtgtcatcttcatgaatggcaaccgtgccagtgagggtgagtggctggacctgcagctgggggttggccacagcctgatttccatgcttattttccgtcccttgtctccccttgcctcccattgcagctgtcctctgggaggcactacgcaagatgggactgcgtcctgggtatgattgggctctctcatctcttgcctgtttgtgccatcctttggcaacagtggatggtcccaggattgcattaacctgggggtctggagggtttggtttggggatgttcagagcccaaagatgtgacctgggtggatggggaaacagttctgaactctctgcctcttttctcatctctgacctctgttctggaaagctctttgggcatggtaatagcctctgattgtgggtttcctttttttacc

SEQ ID NO: 8149 - DNA, 1846 bp, artificial
  synthetic oligonucleotide
catccacttcccagggctgctgtgacaggaagacaagccccagcacaaatcctgctgtgatgtacaagctgtgcccttccctcctttcctcccccaacacacacaaaatgagtccatcaccggagctgcagaaagaaagggaagaaactaacgttctttctgcgtctgggagcttgtgggggcgggcagggggtgagggagaaatcatggagtcacgtggcagccacagacttactactactactttgttagctccaatagtgtatcctctcaggccattccgtttcctcagcagaggtctaacacttgttgcaattagagaccccaaacagagacctaagcatgctggacaagggggtggagatgcaagccggcctgacaggaggggccttgaataggggagggacggaatagagacgcattgcggaaaaggtagggggccggtgtgtggggcaaggggtgggaccaagaggcacagcgcatctgtgggggagggggcgtagaggaaggggaggtgctgttgtatagtgtcgacctggttggtggtggggtggtgtgttggcaaagggggcgggaccgccttccagcgcacatgcgcatcatggtctccaggacgaagcttttgttgggaaagcaggcgggactgactttggctcttcagtgtttgcgcatgcgcgtaacgtcctgaggcggtgggtggtatattaggcgaagaggcggggtcgcccaagctgccgcgctggcattttctcctggacaaggagagagtgcggctgctgagagccgagcccagcaatcccgatcctctgagtcgtgaagaagggaggcagcgagggggttggggttggggcctgaggcaaggtgagaattagcccccagactgggcatctgccccctggtgcgggcccccatttttttttatcccgatcccttcaccctggattctgaatccccttccaccccccaaaccccaattcaatgcccctcccgatccttcctgattcaaaacccctgtccgatccctcccatcgttcgaaatcctcagattccttgacctcgatctgtactgttagatgattcctcctgactcaaaacctccatgcaacttcccaaatgcgaatcccaacccaaccgcacccccgctccgaattcagaactcatctgcttcccgatccccatttgaagcttcgccctgtcagtagcttctcggggttcagaacctccatctggacgcccattcacttttaccgctccgatccgttcctcctcacattcaccttatccgcccgcacagtcagaccacagtcacccccctcccaattaggtccttcgtatttgccctctgtagtataacgccctgcccctctcccacagcccccaggctccgctcttgccagagggacaggagccatggctcagaaaatggactgtggtgcgggcctcctcggcttccaggtgagatctccactccccaccccaccatttccccagccgacagtcacccctccccgcgggcctctttggtctcccaaacgccgggatccggtttgaccctatttagtgactagactccgtgggcttttcgaattcccatcgtttatcgaagggggggaggggcgtctcttttcagccatcagtccctgctcagagagaggggagaccctgttagtagtcagggcaatctgcccagagaatgcggggtgggtaaggaaccatttttttttttttccagaatcctgacgcttgtagagcagtctgtcaccccctcccccagcctcctgcctccaccctccctctttctgcattccccactctgtgcgaccccccttattctcaactccgcgat

SEQ ID NO: 8150 - DNA, 592 bp, artificial
  synthetic oligonucleotide
gacatataggtaaaggaatggctgcaggaaagcttggcagggaagagttgaatgtattccttacgcagggaaatttgttacaggcacagtactgccacttatactactgaagagaaaggctgtgagtgaattaactgaggaaaggcaagctagatgcatattatatatgggaatcttctaggaaaaaaagcacagagatatgattcacatgaccataactcttgcaaaggttttagaatttgtgagacactggggaggttctcatggggaaaagtcttatgtatgtgattaatgtcaaaaagccctttgtcagtgttcaagggaggtacctcagagtactcatgataaagagaaaccctatgaatgctgtgaatgtagtgaatataaagaaatttttaatcatgatgccagtcttacttaccatctgaggactcacacctgagaattcattgatttgttatggccataagaatgtggaaaggcaggacatgattctctttcaacaccagaaatttcatagggtagaaaaactttcccaatgctggacaaattgcagtgggtgatgaagctttttgaatcatgcaaaagttta

SEQ ID NO: 8151 - DNA, 2494 bp, artificial
  synthetic oligonucleotide
taatttacaaacaaggtcgctgaggctttgactcaactgttaacactttctgagagtgagattcttttgattagggtcttaaggtctttgttcatctcagaagtcttaattggtttaattaggctgacacctacagccctgtctcattaccataaactgtagaggggttcaacatgacactgattgtttcttagagcaaagccagtgcagtgagtaggattccaggccccccggaatgaagcaggaaaacccgaggcctgtggatgcaggatgtactagggaggtgctggggagtagtgcagataaacccagaattcagttggttggtaaaacaagagtgatctgagtcctgtgcttgtctacgtgatccaccattgaatggcaggccagccattgtgcaggcatctgcatatgaagtgactggaagcttcactggaacaaggatctccttggaaattctctcccctcagacagccagggtgcttaacatgaaaagaagttgtaaccctatccttaaactatagaagccatcagcagaagttacaggcttatgggggcccactggaaagggaaaatcaaaaggcctgtggatttcaaattaatgagtgatcttaagttgcatttcctaagttcggctacagactcatatatttcatgagtccctccctacccattccttgcctctcccttcagttgctgggtttctgaatttctgtatagttaacccttatcttgcctcccatttgttcaatagaaatgatcacttttacttgaatcttttggtagaattgtataccatgtgttcctgtctaggtttaatcatcagattgtggtcaaattgctctgccagactgtgtgaacaaaaaagtgaatggaaattttcgttttaaaaaataatacttttggacttagcccgtggctaagaagaagtaaggaagccaagcgtacggatagcagcgaggggtcaatccacgcccggcgttgggtcgggggtggaggagtcggaagtggttggggtttgggggaggagatccgctcacacacaagaggagagtgttgagccgccatatctgctgctgccgccgcagttgcgaatgcagcatcggcgcttagctgcctccgcggtgcagctaaggttcgtgtcgctaccccttggcccttcgctcttgctgccttaaccccgccggcggagcccgctcttctggcctgttgagcccgctccctcactgccacacagcaagttccgagaccatggattcgggcagcagcagcagcgactcggcgcccgattgctgggaccaggtggacatggaatccccggggtcggccccgagcggggatggagtctcctctgcggtggccgaggcccagcgcgagcccctcagctcggctttcagccgtaagctcaacgtcaacgccaagcccttcgtgcctaacgtacacgccgcggagttcgtgccgtccttcctgcggggcccgactcagccgcccaccctcccggccggctccggcagcaacgatgaaacctgcaccggcgcgggataccctcaaggtaaaaggatgggacggggggcacctgtggaaccttcccgagaggaaccgttagtgtcgcttgaaggttccaattcagccgttaccatggaactttcagaacctgttgtagaaaatggagaggtggaaatggccctagaagaatcatgggagcacagtaaagaagtaagtgaagccgagcctgggggtggttcctcgggagattcagggcccccagaagaaagtggccaggaaatgatggaggaaaaagaggaaataagaaaatccaaatctgtgatcgtaccctcaggtgcacctaagaaagaacacgtaaatgtagtattcattggccatgtagacgctggcaagtcaaccatcggaggacagataatgtttttgactggaatggttgacaaaagaacactggagaaatatgaaagagaagctaaggaaaaaaacagagaaacctggtatttgtcctgggccttagatacaaatcaggaggaacgagacaagggtaaaacagtcgaagtgggtcgtgcctattttgaaacagaaaggaaacatttcacaattttagatgcccctggccacaagagttttgtcccaaatatgattggtggtgcttctcaagctgatttggctgtgctggtcatctctgccaggaaaggagagtttgaaactggatttgaaaaaggtggacagacaagagaacatgcgatgttggcaaaaacggcaggggtaaaacatttaatagtgcttattaataagatggatgatcccacagtaaattggagcatcgagagatatgaagaatgtaaagaaaaactggtgccctttttgaaaaaagtaggcttcagtccaaaaaaggacattcactttatgccctgctcaggactgaccggagcaaatattaaagagcagtcagatttctgcccttggtacactggattaccatttattc

SEQ ID NO: 8152 - DNA, 635 bp, artificial
  synthetic oligonucleotide
tttcatgtccaatattactctttctatattttctgttaagacaattgccattttttttatttttctagttttcagttacagcatctactcattggccattgagaggaaggagaatttgaaccaaggcttctccccagggacaccactggttacttccacagaatggggaaagtgaacttaccttagaatttgggagaggctttttcaaaacacctcgtgtgtgtgtgtgtgtgtgtgtgtgtgtgtgtgtgtgtgtgtgtgttcagcaaataaccaaaatcagcaagggaaagggaaaagaaaagaagaacctgctaaatgaacatgccatgtatcagaacaaacagaagggaacaaaagctctacttacatacagaagacacagcttacaacgctacactacagatcctgtaaaatactgaatattggccccccacacagttcagtcctgcactagactatgccagactgttttagagaaaatttatctaaattctagagagattctcttttcccacacttagcctttaaaaattgtatgatttctttctataaatcagtgttgataaaagcttcaggctttaagactcagacatcaaacaaaagggatttctgcaaagccccttgttttctac

SEQ ID NO: 8153 - DNA, 1868 bp, artificial
  synthetic oligonucleotide
tttttaattagtagaatcccgtaaatctcctaagtgtcttcttaatccgtatgtttccctttcatctttctttttttccttgcgattttgtttatgaaatgaggttgtttcacatgtagcatttgccacaatttaagttttgctaattgcatccctatggtaatgtttgctttcctctatcctctgtttctttaatttgctagttatgtctagagacttgatgagattgaaacatggcttttggcatgaatgtttcataggttatgttgtgttcatttagtaggtggcgcataatctgtggttttctctctttttgtggtattagcagctgctgcagataaatgcattaattcatgatgcttctgatatgatgagtcatctttgtagagttactaagcattagcaaaggaggaaatgctatgtaatagaaatattattcaatgccaaaatattttcttaaatagtcatagaactaacaagaaaaaatagatagcaaaaaaatgtgttggctgttctcactgtttatcttcctaacttcttttgatgatggaaggcagttttgtggaaattgccagccaggactttgacatgaaacagacccagggctaaattttggctctgtggtgttggataagtggccttgaataaattagttattaagcttcagttttctagcttttaactgattataacaatgcacacacatacctgacacactgttaaattttcttctcttcctgtttcttatgttaaggaaagatactctgtgttttggcatatgttggtgaatttgtaccatttttatcctctcagtccttccttttataagacaataattggagtagtttaatcttattcatgtgcagataaaagaggtttatgaagtttagggtgaagtaggcaagggaatctgtttactccctcttccctctactgaataattttccctctactgaataattttccctctaagaattgctgtgggtaataccaggagtggggacattgcccacatgcataagagcgtatctctccattcgatcagtttgtcaccatctttgctctgttttgaaagtcaggcttctctgtgactgtgaagcctgctgttccctgaaaatctgataatggagcagtggaggtttttttctttctgtgctctgtagatctcattgtttgcacttgtaatttcccagagttgaaaggaaagattgaactggaatattgtgtaaactatctgtcttacattagtgtagcattttgcaatttggggaacatcttcacaatttgtgtctcgttgttcagaacaaccctgtgaagtagttttggcaatgtctgtgttacatttcatgtaatttagccaactcccattccaactaggctttggctaaatctgacaattttatatatagcttaaaacaaagaatatacattcttttcacccctcccagtctacccatccagccttcatgattcattcctgtgtcaaggttagtcgctgttttccatttgaattggtttcttttatggtcagtttactttcttccctctcccctccctttcctgcacatccccatccttgctatgcctttctgtcctcttttataatggatatatctttttcctgccattatccctcagacattctcctcatggcacattttcttcaaatgctaacatttactgagtgtacattgaagttctgtgcatacaggaagaagttattttctgagcttagataatactatgtgtatatgtgattaaaatgaagattattttctaaagccttcaaattagaagtggatttctgtttcattacttccgttttaaaagtttttgccagagagttttgctaaatactctcttatttg

SEQ ID NO: 8154 - DNA, 3061 bp, artificial
  synthetic oligonucleotide
atgattaatatgcactatgtagtaagaatttctacaaatttataatgaaaaacatcaatagatacatgagcaaagggtaagaacaggcaaatcagagaaaaatccaaacagaaacaaggacagcaacaacaacaaacctctttgaactcagacaaaaggcaattaaactaacaagcaatacaatgcaatttttagcctttcatattttcaagcattaaagagtgctggagaggacgctggaacgggcgctttcattttggatagtaatcttgtaatatttctgaaacatatgcctacatagtatttctgggaatccaacctatataaataaaagcaccagtatgtattacagcagtgttattttgaaaaaaaataaaaaaaggaaataaaagacgatcaataacgaaatggttgaatgcctttttggtacatcaacaagtactgtgtattcagctgttagagtaagggagggagggggagagcaagagtgcaagagagtaagagtgagggccagagagagccagagagagcaagaaagactgaagctactgataagaagagatatcatctacatgtcaagtgagaaaagcatgtggcttgccatttttacagaaactactagaacatactttctgcatgaagatggggaaaataggtggaaggatgtacttcgcatcctcaacacttgttttctgggaagaaacaaggtaaggaaaggaaggggtaaggacggggtgtgggtttacaccattaatttttcttaatctatttttgcattgttccaatggttgcaaacactttttaattttctattagcacccaatttaactgttaagttacagaacaaggcaatatcaaaagtagcaaagtacacttgaggcaaaattgtgaaactagtcaaggtaagatttgttggcacaataaaatttatccactttcctgaatttctgacacctaaactcttctctgcgttcacaactacgagaacacaaaataattcacatctaacagatccacaacttctctaaagagcacaaagaatttaaggagttttcaccaaaccatagacataaatgtgaatatcatcatcaaacttaatgaagtaaacagatggcttcgccaccacttgatgtataaaaatgccagttctcttggacccgtcatctttggcatgctccacctgcttgcccacgagactgtcgaccacctctccaggctcctgttctgctgtagggaaatagtagttggaatctggaataatgcgtaagtcaccatctttgtagtcatcaagcagcgtgtacatatagagaacaggatctttctcgtaggtgatgtaaaaccaagtatccatcacaggagctcgcgccaggaccatacccttccattcatccttggtaccatgttcaccttcaaacacatgctccactgccttgccaatcagggaatctgccagtcgtgaatcgatacgaggagttggcactctctcaggaaggatctctagcgctaaaactctcttatcgcggtgcagttctagtccatacacactatctttgccatcatatttaatgatgtaaagagtgggcttcacggaaacctgctcgagcacagtacccttccactgctccactggctcgttgccttccttccagccgtgttgaatgcggcagcccacgatgttcctacgagtgaggaaagtgggcttgcgccgttgcttcctgtgggtgtgccttttcttcatcaggtatgcggacacgccatctacccccatcggaggcacggttggaggagacatagctcagggattaagagggcttggggaaagctgctgccctggtcgattaaactgacaaaaagtcaacactatgcaatatgatatatatattttttgcgatctcaaagacctggtctgtgctcccttctccaagtgcaaggctctcaccaaggttttggcagaaacgctcgaactctaaccgtgagcactgggacagcgtgtgcctctccacagtgctttcctctctcgccctagaagggttactgcagcagtggcggctgacgtagagatggcgggctcgcgagtgctgttcgtgccttgcgtccgccccaaccccgaccccaagtccccgaatcggccacttagctgttgtcgatgctggtgcggctgcggcacggcggcagaggagacgacggggacgaaaggcaaggagtaagagggatggctgcagcggcaaaggcgcaggcggcggcaagtctctggggagtccgcgcggcctgggcttcgcagcgctagctggcttggcttcactctggcgaccgggtctttgcggcgcagggaacccgccccctctgagcccgcctgagccttggccccgcccccagccatcccgccttccgctctgcgggcggcagccgggctggtcagcgcgcgtgcccgtgttcagtttgtattgacacacgcgccctctctttcatttcctcctccgcccctcgaccgtttccctcaaacgccagccagacaggccgactcccctcctcctcctttctggcggtctgctgcccgccagcctcctacacagtggctccatctgctttctgtcttccaggaattcctcacttaaaaaaaaaaaaaatgtaaaacacacgcacacccagaaagagtttgtgcatacaaattattttctttcagtttaagatatttaagatgagaataaaaaccctgtgtacaatttacagaccaccatcttaatccaaaatctgttttatattttctacctgatcatttctagtaattatttttattttttttttttttgtcagaatgtaaaggtcatgtactgacattgtggagatcttctaaaattcagtgaaataaaagacgaaactaccattaattttaccatccagactgcaccaaaatgttaacaatactgttttctctcctattaataaacctgtacttatattttataaaattgggagcatatttcatacttttataacttgtgtttttcatgtatatcatgaacattttccaagattgttaaatactctgaaaacatgattt

SEQ ID NO: 8155 - DNA, 3943 bp, artificial
  synthetic oligonucleotide
atattaaaaaccttctcaacatttgtaggtaggtttgcaaccatcaaagcaaaatccacattaatggaggattccaggaacctggaggcctaaagtgaaagtttaatcctgatctacattcagagcagaataggacaagacatacagcatataattcagacatgtcaggaaggcttctctgctgctcccaaataccttcctcatctgctactcagggtctgaaattccaacattacagttactttttttgcctttgcttgatgactaagtccctttgcctggaagtagtatcatttaagccatcatcagccactggcacttcagtgagaaagatcagaatcttttctaagagctagttttgcaaggtggtaagtgtcagaagtatgagggtactgaatgccaacagacaatacgcagatattagagagggaattttgttactaatttgattttttttaaaagcatttatttgaaatcattacagattcacatgcagttttaagaaataatagagatcctgtgtactctttacccagttttcccaatggtaacattttgcaaaacaatagtacaatagtacaatatcacagccaggatattgacattataacaggatacagtcaagatatagaacatttccatcatcacaaggatccctgttgttacacttttataatcacaatctcttctgggtatatatctaaaataaaggaaatcagtacgttgaagagatatttgcactcctatgtttatcacagcactattcacaataaccaagatatggaatcaaccaaagtatctgtcaatagatgaatggatgaagagaatgtagtatacatacacagtggaatattattcagccacaaaaagaatgaaatcctatcattttcagcaacatggatggaactggagctcataatgttaagtgaaataagccaggcacagaaagacaaatatcaaatgatctcactcaaatgtaggagctaaaaaagtggattccatggaggtagagagtacaatgatggttactagaggcttggaaggatggtgttagggaaatgaagagaggttggttaatggattcaaaaatacagtttgatagatggaataagttctagtgttcagtagcacagcagggtaacagtagttaacaataatttattgcatatttcaaaatacataaaacagaagacttgaaatgttcccaacacaaaaaaatgatacacgtttaaggtgatagatatcctaattaccctaatttgatcattacacattgtatgcatatcaaaatatcacatgtactcagtaaagatttacaattattacatatcaatacaaaataaatttaaaaatcaattgggcatatttgtgtacatttatttctgggttctgtggcattgatctgatatgtccacccttctgccaaaattacgctgtcttggttactgtaactatataatgagtgttgaaactgggtagattgattactcacattttattctttttcgagatcatttttgctattctagggcactcatttgattttgtgctggccccaaggcctctggagatggagtctgtgctcatagccatggggagctctatactgatctagttaattaggtttatgtaccaggaattagcataaaactttcaagaagttatatatcaatacttaaaatgaaagcagcgtgaaagacaaaggtcaagtgaaaaggcctttcttggagctagatctggtattctctactgttatttcagccaggttccccctctcccagagcagtagactgagttgataatgtcccagtgttacagatggtgttggaaagggacattagagtagttacctatctaatgacatccgcattggagacctcttaacaatgcccctcacttcctgtgatgggtcattgaaaagctcaaggaagccagctttcatggttatcttaaataatcccttcttgctcttcccatgtacatattgtaactactgaattcctacatttgagaaccacttccacatgtatggcactcttgagtctcaaaacatatcagttactacagccctggactaggagtcttgaagaccaaaaatagaaataagggaggagatttgtagtaatcctgggaggtttgaaactaaatgaagctgggcgcagtggctcacatctgtaatcccagaactttgggaggacgaggcgaggggatcacctgaggtcaggagttcaagatcagcctggccaacatggtgaaaccccgtctctactaaaaatacaaacattagtcgggtgtggtggcaggtgcctgtaatcccagctactcgggagggtgaggcaggagaatcgcttgaaaccaggaggcagaggttgcagtgagctaagatcacaccattgcactccagcctgcacgatgagagtgaaactccatctcagggaaaaaaaaaaaaaaaaagaaagaaagacagaaactaaatgaatttctttgaagactttagaattgctgttaaagaaagaaaactgttcaagtgaatcagtatttagacactgggagacaagaaaggccctaaaaggaatggcctggagatacatagggtggggaaggaccttgaccaaaatgcttggcatgagttagcagggctatcttctggttaaccaactcctggttgctttatagatattcctttgtttgaagtgttctcagtgaaaagacaattcagtctcagatatgcttgaggaacccaggcttggataaaggagtaccataaaggtcagtatggtggatgtgatggttaatagtgtcaacttgactggattgaaggatgcaaagtattgttgctgggtgtgtctgtgagggtgttgctagagattaacatttgagtcagtggactgggagaggcagacccatgctcaatctggatgggcaccatttaaacagctgccagcatggccagaataaaaagcaggcagaagaacctagaaacactagactggcttagcctccaagcctacacctttcttccatgctggatgcttcctgccctcaaacatcagactccaaattcttcagctttgagactcggactgacttccttgctcctcagcttgcagatggcctattgtgggacctggcgattgtgtgagttaatactccttaataaactcatataaactcatatatatatatatgtctcctattagttctgtccctctagagaacgctgaagaatacagtgggggaagtagaggaaatcagagtgagaaagttcaggagttgagagcgtccaggagacaagctgttaggacagtatcccttttgcagcctgaaaacttcagttggctgggctcttttctgctcacatttctgtctgaggaactggagcaaaatcttaccaagttctgttaatacaggtcatatccttactgacattaactccagattgctttctaacaccatctctcacatgttattatagcaatcaaaaggttaggagttaattccccaccttaaattaactcccaactttttggtggctaattaaggctggcctcattccctatataaggggaatcacattcgcatgatgaggaaaagagacaataagggcctcccaagagcaagaagtaataagcagttgaaggggaggcatgtctagtcagcggagctaggtgcactgcttaactggaaatcagatgttcacaggcattcagcctcaatcaaaagaagcttcaatggaaaaaaaatagtgctttacatggctgctggaaatttcaggagacttgaatctgatcattttggatggtgactcattcagaaccacaaagcccactgagaaagcagaaggaaaggcctggggaaagtaaggtctcattaagattgcccacacctggggacagtgaacatggctatcagtaatagaagcagctgtcagtaattgaggcaa

SEQ ID NO: 8156 - DNA, 1324 bp, artificial
  synthetic oligonucleotide
gtttatccctacttgttgaatggaaagtcttattgtagataacaaatggaaatcttcaaaacaaacatcaggtagttttaatggcctttgaacaattaggctataactgctcgtgttctgggaagccagtgtcaagaacacccaggtatatggagttggtagcctttatactccagactctaggctggctgtgtcttgggaagaaagcctatggttcttgtgaaaacaagaaagctcccttctgtgggaagctatgactgcttcgaggtttctcttgttttcaccatccctgttatatgcttcccctaccctgccagcttagctggtttgaatccccagccctggcttgacttctagtttcttcctaatcattggctcccactatctggcttagacatggctcattactccatcttggtcttccactgcccgttgagttctaagttaaacccattgtttatcttgtttcttcccctttattcctggcttctgactcactgttttatgttctggatcctggtctatctcttatagccactgctttctagagcctagtttcacaatttagttaaagtaatcccagccttggctaacagatgccaaaattaacagggcctagggggtgcagaactataaaataagccaggttcctatttgtttactgcctctatggctacttgttctgagtgtaaacaccttagtgggaagaacaggcacattagtgttggtgacatggctgatatgctgagaatttccatggccacctaaattaaccctcaaaaatcctacctcctgattttatgaaagtcctgagaagagttgggggagctaaaaagaagcattagtgtttggctgagtttcagattcataaaagttctctgtttgagggttagctccatactgaggtaagttattatccccattaactgactggctattggttctagagtggacattcagagcttatcaccaaacactgaggcagtctgaacctaagctcagtgtttttcccctcaatccactgtcaaagcaaatggataaagattcaatacaagatatggcacacacatacacacacagaggacagggggcttaaaactgtgtggttcatgttccagcccagaaaaatgtaacactatttactctggtgttttgtgactcagcactcctcttcagaggcattcactactgggtgaaggagaggacaaagggactagatgatggcaaaagagcaaagggtagcatggtgaatttgtaaagtcactctaagcattctggtttcttcttccatttttactttccttggtccccaattcttcccagt

SEQ ID NO: 8157 - DNA, 1396 bp, artificial
  synthetic oligonucleotide
ggcagggtagtaggccagagagtggggcatctagaaatggtgtattcgagcataccatttttttccccagtctaaaggatgggaaggaaagggggaactcagtagaattattttctaataatagaaccccccaccccactgccgaaaaaaagcttagaaatactgcttcaactttaggctcccgacttagcctcaatattatccaggaactaggtaaacactccttctagaggggctgacatactagcacagaacctctggaggcctgatactgggaaagaaagccaccaggttagggagcagtacagcgatttcctgctggagggatgggaagctgagagaggttcccaccctgatgcaggctaggaagatgtgctacagtccactttgaatatgtatgaagtccaataaagccataaaagagagccaatgccataagaagatggtcagaatgacttttaaatatacaatttactaaatgtggatgatacgaccaggagggctacccagtattatctggtccatccactccaccagccaggggcatctcaattctacatttttttttttcttttttgagacagagtctccctctgttgcccaggctgcagtatagtggcacgatctcggctcactgcaaactctgcctcctggcctcaagcgatacttgtgtctcagcctcccaagtagctggcattacaggcatgtgtgtgacaccatgcccagctaatttttatatttttagtagagatgattttttgctatgttggccaggctggtctcaaactcctgacctcaagcgatccaccgacctcagcctcccaaagtgctggaattacagatgttagccacggtgcccagcatcaattatattttaattacttgcaacatgtaactccaccaattagaaaaaaaattaaaataatactcctctatgctcaccaagctgactaaccttgagcaacacacgtagtctctctataactcagttgcctcatcattaacatggggataataacagtaccaacttcatttgggtgttgtgaggattatttaaattaaaacatataaagtgcctagaaggtacacatcacactataagctcaacataagtgatacttattttcttgactattactgtgtgccccagtttccatacctatcctgtctcctagtaatatagcaacccagtaagtgatgttttgttattaccccaaaaccagggtcaaagaaattggaagtaatttgcccaaaggggcagaacctaggtcagaagccctccaaagcctatgctcttatccaccaaaccacattagaatgatggcccccacccaatctcctcctactgtcaccaacccaggggaacaaccagatgccatggaagatttctaaggtg

SEQ ID NO: 8158 - DNA, 790 bp, artificial
  synthetic oligonucleotide
tatgaggcaatcaagaatgtatcatcctgttttgcagataagttaacagaagctcagaaagggcaaaaggacatgtattctcaatgagaaccaacagatagaggaagttccctcattcactcctgactccctcgatcccttacctgtggtcttgggcagtatactttaggagctcagccaactgtaagggatacttgcagatcttctgcactggagtcaaaaggaaaccatcgatagcaatgtcaatcatctgctgcaagaggcgacaggcctcaaagaagtgctggtagcggctgtccttcatcagtttggagagctccatgcaagcatccaggtggttgttacaatactcagagtatatccagaatccatcttgctgtgggaaaagaaaaaaaggaaaggaaaagtctaccaaggaccccaaaagaagtcttgaagtaatggaaagacagatcatattcttaggcagaaatattaaaatgataatgagtcaattattcttaaattgattcataatttaataataaatatcaaaacaaattattcagtaacaagacaaactgactgtaaatttcttatagaaaaatgagtacataggaatagtagggacattctgtaaaagaagggtaataagggaacactggccctaataagagtaaaacacagcatggaaataaaactctgggactggatcacaaaaagcaagagatcagtgactctacttctggcaatgacagactaagttgttgcaggcaaaccctgccactgagagtagctggaaaagctaaaa

SEQ ID NO: 8159 - DNA, 505 bp, artificial
  synthetic oligonucleotide
ggtagggcctatggcaggcagaaacccctgggcttggcattttaggctgactagctgactcatatttttatcctaggatactgtacaaatattactatcttatacaatgtgttatcattttctatgtgccaagatgtaaagactattgggatgtattgagataggcaatttgcagaagggaaaacccaaatggctaatacgtttgaaaacctcaggcttaaaatataccaaatggaaatgacttgaagctacagcatgcctaaggaagaatttcttgatagtgaatggtatgatcactaatacagagtgagtgaggaaagctaggccagcttctctggaggcatttgaagacagaaggtatttcataggtatcagatggctgagattatcttcctcaagagaaagcagacaagacagctttataaagcatcgttagctctgcttactcttgcctcagtttccttgattgtactttgagttctaaggttataagaggcaatatcac

SEQ ID NO: 8160 - DNA, 3737 bp, artificial
  synthetic oligonucleotide
ccctgctcactagacttcacggctagcaggactgggctccacacaagagcaggcagacatctattccactgccataccagcaaacagacattcatgaaactcatctaagcacggtgatagggatggggtgggggtggggaggtagtctgcctctctttaccatcctgctcactgtgttatttgttctttttccctcaactgttccagcttgtatgggccatcagtcttctcagcatttggggtaacagattccagaatagagaacacatggcctatcaggcaaagagactcaagcactctctcccaagcattgaatttctgaacaagtcctctagaagtcagcttttccatcagcctactttgctcaaggcaataatggctccataagaccaaaactaaaacaactttaagacaatagaaatagtctatagaatatacatcctgtctcatatatctaccctccaacatgctagccacagaataaccctaggttctcaaaataaatgcacaacacatacgaacacatatatatgaacacacacacacatacacacatgctgatctttgacttaagttaacatgttttgttcaggtcctgccagatgcatctgtcatggctcaggattcatctttgtgccttccacagaaggtaaggcatagggtgagctcttcaggatagataaaaaataaatttccagcaggacctttcacaacaccacctttcaaatacctcatgctttacgctttgctaagtgttttcacatctactacatcacttgatccttacggaatcaactgggcctcactattaccattcattcattcattcattcatttttattttttgggacggaatctctctctgttgcccaggttggagtgcagtggcgcagtcttggctcactgcaacctccacctcctgggttcaagcgattctggtgtctcggcctcccaagtagctgggactacaggcgcacgccaccatgcccagctaatttttgtatttttagtagagatgggggtttttccatgttggccagggtggtctcaaactcctgacctcaagtgatctgcccacctcagcctcccaaagtgctaggattacaggtgtgagcaactgcacctggccatttacctatattttaaagatgaggaaactgaggctcagaaaggtgacctagtccttcagccaataacacaagtaatacattatgaagctgggtcttctaactttgtgtgctcttacaattatcaaactgtactaccaatgtctactcattatctatactgaactccatctatgatatcataagccagttggctcctattcttaaagaaccctacaggagatgtacacagccacctttaatcataggtgcccctgatgctgaggacattcatttttatgttgaacttgctttcttccaattgtactaaaagtcaatttctccttgttttggcctcagtgaagaaaaagaaaagctggtcactggcttactaaagtaaatttttatagagaagtctcccctctcctggaaaagatgggtcccaagtgggcattgttagaactcagtaagcacatacagccccaacccagagcaccattaagacctgtagtttaaagctatatccatagctttttatcaagggtcaaagagtatctcagtatcaattaccaaccttctgctcaggacactatctgtggtgctctttgaggtctcccaggcccagatctggctgattccactgtctatacttttttactttgcagtcttcttttcaggaactccatgcctggcttttcccagaagcagatcgctgacttttgtcccccatttagtccagctgatatacctgggccctcaggtcacaaggctcagctataccctggacaaagccaatctaggacctagtggtcacaaaaacaactaaccaacttgcaagcctgttgtcagggcctacttagaatcaatgactgtcagaattggacagaattttaaagatcatcaccttcatgccctcattttatagatgaggtttaacaaaagtaacttgcctacagtcatcaaatggtcagccttctggactagtgttttttctaacataacaccacagagagggaatacaggtagaaaaaataatctgaatttaagaccttgttatactactagctaaaggtgtaatgataattatgatgatgttagctaataaagagcgctattatgtcaggcactattctaaacacgttatatacattaattcattcaagcctcacagcagccctttaaggaaaaactattactattcatatcttacagatgaggtagctgaagctcaaagaagttaaataatttgcagttcacacagccaataactactgaagccattattccagtagaggcacagtctggctctagagactctgctcttaacttataaactattctgcctctgggtcccagtttcttcacctataaaatggggataattctactctaccatctgctttgtagggtataaaacactgaactgagagctgacaggtatgtgcatggaggtgagaggaacgctaatccagaaggcgttaacagctgtgtggggcttctgtgttctctcctcacaaacacaagccggagcaaagggatgttcctccctcatcttctgagttgttttgaaaatgtaaactaaacttaacctggaaattggttccaaatcttccatttgtgtacagaattaacttttaacttgctacaatttttgttaaaatgcactttgctctgctcatccatcttccatccaacattcattcattgagctcctactgtgtgcagggatctgctcactgtgactcagctgcagtccttacctgaagaacaaagggtttccaggtaccaacaatgcatatctttccagcaggacgcaaaggtggttttatgggcacgcatacctaccttcgattctgggctttactactttagaaagtagcaatgacaataggaggtgaggaatagaagaggagtcagaaacacaaacttaaatgtaattgtcagcatgtaattatgacatctaggagtataatttcacaaaagccaaagagtttctaactatacaaccttgggtctcagttttttcatctgcaaaatgggggtaataatgtttgcctcacaggcagggttatagagagggtgaactcagatggtggatatacagtgcctggcatgtgctggcctagtacaagacttcagagaaaggaggttgattacacatgggtattgggctatagaaaggttttgtgtggcaatgaagatagcccttaaaggatgggtaggatggtaccagatacaggaggaaagggaggggcatttgaagcagagaaatgagattaagccaagtctcagagaagaagactgggaaatgtgatggtgaacaagtagtggagtttggagaggttagggttgggaaaggggagtggagggagtgatggctaaaaaggtgagtgaagtcatgtttgaaggaccttgaatctagtctgaggaaaagaaaaaggtcaaagttaatttttgggtgcaaacgtcaattaaagcataggacaaattaggaggaaatattggcttggctttgcaaaagaagtgatgacaaattttctctttaaggtgttaaatatggggggccagcaggacatgcaggtgggtgggaagctcaagagagattagggtatatatacagggttgggaatc

SEQ ID NO: 8161 - DNA, 366 bp, artificial
  synthetic oligonucleotide
agatttccaagtaactagttagcacacctagctcagtcctccctttcttacaggtaagaaaaatgaggctccaatgagaaaagcttcctaaggcatcaagttagttagcagcagagctgccaagattagaaaccaagcctatagtcttagaagaatggtagccaatagtttttggatcatgtacctctaatgttaaaaacaaaaatacaaacatttagctattcttgtcacaaaaaagtaattctgtgaaatgacagatatgcttcactacagtaaccattttactatctatctatattacaatatcatgttgtaaacctcaaatatacacaataaaatttattttacaaaaaacaaaacaagaaa

SEQ ID NO: 8162 - DNA, 1407 bp, artificial
  synthetic oligonucleotide
agtataagtgaagagtgttgatttgttctacacagctcattgggcaagaacctgcaatttctaaaacagtttttgatcatatcatgaaaacccagtaatccatcacaaatcctagccaaggatctaggggccaagaattgttttttaattgccatgtgcctaagtggtttatggcttgatggacttaagaaggtgctaaataaaaacacaattaattttggctttcttccaagttcctcttttaactttgcaggagatgaggagagacaaagttagtctgctcttcatagcagcgagtgtgtgactgcatgggaaatggagcttgggataaataaaagaaagcttatttaaaaacaacaacaacaacaaaaatcagaaaacaaaacagctttccaccaagcacccaagacatgggccgggtcacagggcctttcttcttccaagggagagaagtaaaaagagtcctccaaaaatgacagacagaaatgagggacagagacaatgggatttgttcaaggtcacacagcaactgacttcacatttgcacctcctttttactcatgtgtacatcttccattcaaccaaatctttatagagggcttactgagtgtcaggcctccactggggcagtcacccacagttctgcctgaactgaaaaataacaaactcctagttctgtgacactttgctttccatcacaccacacaggtttcccaaacaacccttgaaagaccacagtggcttgcacatcttgcaggtccaggaattcacatccttgcatggcaatgttctaattccagcactactacagatgtactacatttcctggggcaagtccttttcttctctggacctagttccccagcttccacaatgaggagattagaatcaggacagctccagcacctatttttctagaaaatatagctgtctgcagtgactttaagtggcactgtaacttccagagctgaagcccagaaggccaggctagaagcagctatgtgacaataagtctttgaacattctttttctcacctgtgaaatggagataatctctgccctacccacttcacagggccacagagaaaatcaagtgagacgatgtacaaaatccactgaaaagtgtaagactgttcaagaggagtagttaagaatcaagtgagtacccactagccccagttgctttcctcttaatccaagtagagtgtaagtcttcccatgcagttcagtctaaatttacaagacatgaacttcagctggttgcatgctccaaaggaaattaataaatccctcaactccctttgggtcctaagcacaaagcaatctcatcattttgcttttgttctaagccctcctgccatgcagggcttatcagagcccctcctagagatgcctagctcctcctct

SEQ ID NO: 8163 - DNA, 2096 bp, artificial
  synthetic oligonucleotide
tctttctcctagtctttgaaagttcagtcttatcctgtctctatttcctcattatcttttgacccctcaacccactgcatcctggctttaccctcattgtcctatagaaaactgaaacctcttgtgaataggaaaaaaaacaaccaacttgttactaaatctcatggccaactttcaatctttacctttcgtaacttttctcccatttgactccactgatgccttcctcaatcctgaaatgctccttttccttgggaacaccatccacatgacctgtatgtttatgctgtcttcacttcctgcatgggttcttcttcatccagtcattaatgccatgatttctgagttcttctgattgcagtccccttttcttctcattctgcatttgcactgaatgggctcatctacttccaaggcttgaactaccatctacattgcacattgatgcacctcctttctacaaaattacaccaccactgggaaacaaaacagacataggaccttgcttgcacgtaagcagagagctgctgatgactccaaggtagctctcctggaccccagaatgaaagttctactgctttctggatatctcctccttagtatctcacaagcatatcaaacttaaaaagtcccaaattgaagtcatctcctcccactcttgctggtttccttcttcccctgagtcctttgtctcctgggaatggcagtcacacactgagcttgccagaaaccaagaaaatatctacaagttttttctctccctcacctcactggtggccaacaagtcttttagttctgttgatcctcttcctccttaatctctctcatttgtccctttctctcttcctgctgtcactacttttaatcagttcctcatcatctctgatccatcacaattcattaccagttatcttatgctgctctccctccccaattaagcctctactcttctgcccaaattctttcctcaaaagcagttttgctcttgtcaatcttgggtagatactctggattggtttttaaggatccactccttctagcctgccttcctatattgctgaaaagctaaaaaccaaaaaaactacaacaacaataaactggcatttccaagattcctttgcagccagcgttctggatatgacatagtgatgccaatcatatgcacatgcacagtatttagaaggaggtggttggtgagccagaagtcatgtctctgttgcttctgttggaaagcacaatggtgaaagtgttggggtttttttgtgtgtgttaccgtaggttccagtgtctagccattggctttgtgcattctgagagccagagaatgggactttttttttttttttttgtcactgaggatctggtaggcatagtgatactctagccaacagatggttagagctgtggcagcttcctcattcctaaattgcagacaaggcagcatgctcctagagcccctgacgcctcatcttcctgcttgtcagagagagcagctaccctgacactgttcttggaggcatagcctaaagcttgcccctccagccctcccaccaattttgtaagcactttattttctatattaaaactccttctgctgaaaagaactacagtggtttatttttgcagctgaaacctgacttatataatgcctctgttcaaaggccttcaatagctcctcggcgcatttaaggcaaattctgtagtgtggcataaaatgtcctgccaatctgatgtccttcggcctctgtatcctcagctcttaccagtgccctctcattctctgttctctagctacatagaacctacagtagttctcataactcatgaggttctcttgcctcagggcctatataaactgctgctttatttttccagctccccatttcaaagctcagctgaggtgccaccacctccagaaggctttctctaatgttctcttcctcaacaatattctgaatgatagtcctctcccataggatcctacgtttagccctcttgaaacatttattaaactgtattgtatttttttcttgtttgtatcctttactggactgtgaagctaggagggcagagaccacgactgtcttgttcactgc

SEQ ID NO: 8164 - DNA, 860 bp, artificial
  synthetic oligonucleotide
tctcaaaccacacacagtgtgaccataataaacaagtattagggacatcgtctcattttaactttctaacaacgttggaaggtagtcaagatagggacaaatctatgtttgaaagatgtgaaaacaaaggcttaaagaggcccatggtgacagagctaataaagggaagaaaagaactagaacccaggttctgacttcaaacccatgaatcatactgtccactactgtgctgcaggaactcagatctaatgaccctcagattccctatgcccccaagcctataactacttgatcctttcagctgctaggtgaaaaggcaggtagggatagaaatgaaaagttaacatttactgtatgcctactatgtatcagttaaccaatctctggtatgtactattattatccagactttttagaaaagacgcagcaggctcaggggggttaaagtgatttcccatggtcacacagctggtaaatggcagagctgatattcaaacacagatctgtctaactccaaaacccacgcccttggcactacatcagatagagtataagctttacctcaatttagtaacatgacccaggctccaagatcaaccaccgacaagctctttccttgaaccccatcttagacatatctcttggaagggagaaggcgggcttggaagaaaaagccaagcttggcaggtagcagctgtggcttgaatttctgttgagtgacattaactaagtcaaccatctgctgctccccagcctgcaggtgtcactctgaaagggtttagcctttctaccaggtccagaattatgctatttcagttttaatcctatgtcaaactaagtgtcccttctcaccatcacca

SEQ ID NO: 8165 - DNA, 279 bp, artificial
  synthetic oligonucleotide
gaatgcctctgcctaaacaggcttctgagtcagcccagtctcaagtggtttgagtagagctcagccaatatgtgaggtgacatgtgtgtgggtactatttcagtgtgtctgtttttgggattatattttgttaggtttttcttaagtataagaacccctctacttcatttggaaagcaaatcttaaattttaatattggtatcaatagatattcatgaatatcaactatgtacctatccagcccaggcctggatagagcttataaagcactttcatgtc

SEQ ID NO: 8166 - DNA, 2556 bp, artificial
  synthetic oligonucleotide
ctgaggaatgccatgggtgatgcccacaggcttggcctgtggtagagggctggggctgaagcctccagaactggaagagcaactgggctcatcaacaggcagcagcacatctcgaggcctggccctcatgctctgggaggcctgtggctggaggttatagcaagggcccatgggcaggtgtaggtgtgagggacgagctagttgaggcccagattccccaggtgcccttgactctggcactgatagtgatattgacatggtcataggaggtatgcaacaggttgcctgcctatatggagactggctggaaggcctgtccaactggttggggcttatccaggcaggacctggccccactggaagaggacagggagcccaagcaggccaatcataggcccctgggggttcagtatagagggaaaggggactgtctcggctccattctccttcttcctcctcttcgtcctcctcatctgaatcttcctgctgggcctgcagctcatcagactcgaggtagccctggaccaagtgggaattggagagctccatctccagggtctctgcagtgtcgagagagcggcttctcctgttgagggccatagcagcaggtggaggtcgagggtgcaggccaggcagtcccaagtatcgagggaggctgctcacaccccagggcaggccttggtagaatcgactatggtagttgttgaaggcatgtttgtgatagtagcccagctcaaaggcttccaaggaggctgcaagatcttcatcattgtggaactcaggattctcttcacacttgccttccccatcccgttccacatcagcgatgtcaaaggtcaccatgggaggcagctcagggaggttttgagtgaaagatgagtcagagtcagagctgcaggacatgctggaaaagaggttcccattgctggtgaactctaccagggcctgtgagaaactcacagtggcattcccttccttctcaacctcctcttcctctggatcttcagggggtgaataagtagggtaggccctcctgggagatcctccaaaatttgcttcttgcatgtctggctcaaacatggcatcactctggaagagctgcatcaggcaggtactttgatctttcttggagcaggttccttcataacgcttctccagaggacggaagtccctccagtctggctcgctgcttgcagtggtggggaaagctgaggtaattccccggtgggaaatctgagaggtccctgatacccctgctgccaggcccatcactgatgggcctaagggcctcatctgatactctaagacgggcttctcctgccgggcctgggtctctcggacttgagtctctctacaacgaacctctcgggcctgggcttctcgggttctggcctccctgccatgagcttcccaagtgtgggcctccctggcataggcttccctgccataagcctctcgagtataggcctccctggcgtgggcctccctggcatgagcttctcgggcacgtgcctcctgggcctcaagctgctcccgccgaagctcccaatacaacaactgtttctggatggtcactagccgttcttcctctgtctccattgccccaggtggccgggaggacaaaaagggctcaaagtttaagaaggggtcaaacatctcagagcttcgaccatggaggtcataaaggcagtcatctccaggtggagagttctcaaggctgtcatctggctcatagaactcatatagggcatctccactgtagctgtctcggggtagacaatccctgcggacaagccccagggcctcacctgaatcatcctcaaatccaggtgtggtggagtcataataaccttcatcactattgggggcggattcttgctggtcactctgaggagtcaaaagttccccaggggctaggccaggataagacctaactgggtcaaggagcatgtagccgtggtggcctggggatgtggtgggatggtagcccaggttcatattgggccgtggatacatttgggcagtttcccacagatattctaagtcatcatcttcttcctcctccttaacctcctcttcttcctcctctaattccacctcttcttcctcttcttcctcctcgtcatcatcatctggcaaggccatctcctccccacctccttggtaggtcaccaggcaggaacttcgcttggtcccatctcggtttgctctctggcccccagaggccatgctgtctgtcatactgtccatgtcctgttctgctattatgtcaccacaacctgtcaatgaatcaaagcttttcagggatgtcacatccccaaacaagaggctcagtgggtcccccacagggccattgggtgggtttacctctcctgctactaccttctcccctgtttctgggctatggggctcctctaggctactggcttcaggggcaggcttgggttgcacatgtgctgaggcacaggcctccatgggtttttctggatctttacaggccattttctcagtagctggtggagaaggttctggtgttggagaaacttttggcccagg

SEQ ID NO: 8167 - DNA, 2076 bp, artificial
  synthetic oligonucleotide
gaagatttggacaggtgtaggctgagtgggtttgggtgtggggaagggagttacatagagcagatacattaggtgcctgctggcctgagacaaggcagagggcaggtccagccctgggctagagatgcccagctgcaagtagaggtttgtgttggggcctaatcaaggtgggaggaggtgactgtagtgtgatatctgtggtcctggctcctgtcataaaggtccagagctagccttcccccaagtgaggaatttactgggtctcgttgcccctcctcaaagtgcccaagctttgcctgggccctgcagcccacagggctctccacaccagaggttaatcaaaggtccaagagcttaccaagcccccagtggcttcctctgtcctattcctcaaaaaggcctagagagcccactgccagaggtgcaccatggtgcagtgactgtgcagtgggtggtgccgaatgaggggagccacactgggggagggggctctgctggaatcccggtggggcaggcagtccaacagtgcagtgccctctgccttgcccatgcccacgccgctgcagcaggcaggcagagccgcagaggaagatgtttgtgtgtggaacaaggctcgccttgaccccgcggcccttgccgaaagcagcctggccaaacggagaccagctctgcggggccagtccagctgccgcctaggcgcttgggctgtgacgcatgtagcgggcacagcccctcaccaccgggggagccaagcaaagtccagcgttcgggcggtcaccagtgtcagaagtgtctccagcagacaatgacaggggcctggcgggctgggtatgttaagtaactgcgaagttggagggtttggccacctcgctagctctcctgtacacagagatggtatgatacgttccgtactacaatgagggctccttcggcctctggcaaggaaatgccccccaaacaccgtgcctattgctatttttaaacgggaggctggagaggaaaacgcggccagtatcctccaagggaaaaggaggtgaggcgaggcgaggcgggagacaaagcggccttgcagctctaactcaaggactagcttgcgccgctgctctaacccaaggaccagcaagagcccggctgccagccagcctgcccgaccgcgggggcgggcgccagatgcgcccggaggcccaggaggaggggcgcggctagttggggccacaaggccaaggttctgaagggaagtgtgcgactgagctcagcccacaggcccaactgagctcctctggggagggggcagtctgtggatgtcccaatccacgccaaagccggtctccgtcgggcccaagccagcacgccagcttgagtccgcagaaaggagggagaggctggagatgcacaggggaggggaggggcggcagccaggcagccggagagaggggtgagcggtacccgcgttacacagctgttccagcaaatgtgctacaacaaagctgcagagctcctggcctacaaatgcatggcttggggtgctggctggcggcgcccttcccgggactgtgcggcagcacgtgcgggcccatccccgcccccccgaaagccgggaggcttggcccaggctagcctgccttcctacccgccctccccaacccccctccccccagccgtggtcgcttgtgcccaggggactcaaggccgctctgcctctccacccgacagtccgcaaagcgggttccaaaggagaggggcgagcgaccgggactccgacccgcctagtccttagtgccctcctccagtccgtaggagcagagcacgcgggaatgcacccgaccgcgggcaggcggaggctcctggctgtacgcaacgcttacccagcccggtcaggttcctagcccggttattgtccgctgagccgccctgggccgggctgcagcctcggctgccacggctgagagcgccgccaccgcagctgctgccgccgtcgccgcggctccagtcacctccagcactgactccccttccccaggctttgggtagctcccccataccccctcccccagtactccaaggccaccgggtggg

SEQ ID NO: 8168 - DNA, 982 bp, artificial
  synthetic oligonucleotide
tgaggggtgctgttttaaacaaggaagttggagaaggtgatattctagcaaagacctagaggaactgagagagcaaaccatgaggatatctggaggaaaagcattccaggtagagagaccagtaaatacaaagttcctgaggtggtgacatgctgaaatgttagaggagcatctaggcaagccagtgcacctggaacacagtgagtgaggaggaaagtggtaggagaggaggtcaaagaggacatagggaaacagacaatgtatagttttctgagtcattttaaagactttagattttgcaggattttgagctgaggagttacatgaccttagtaaaacatttagggagctatagcaacaaaggaagaagcagagaggccaggaaggaggcactgatagtgatccatatcagaatagaggcagtggaggtggtggaaactgattggactctggatgtatttggaagatagaactggctggacttggtgttgacaccttagatgaatgatgtgagggaaagagaagagtgaggaatagaagcccacaaggcccggagaaagagggattggcaatgtgaaaccagagcaaagagaactggctctcctggaagccaagtaaagtactgggattttataaaagacagagttaccaagagtgtatgtgtcagatgctgcccagaaatccagcaagatacaggcagaaaagatgccattggttgtggatctggcaagtcactggtgatatgggcaaggccagtttaggacagagctgtagatatacaccagactgccctggggtgtcaagagaatggtctgtgagaaaagggagaatgtatacagcttccttattctagaagtttgaccgcaaagatgtggtagctagagggggccctggtgttcaggtttgtttttacaagatggaaggatgtgagtttgtttatgtgctgagaggaaaagaaatcaatcaagtagaagatacagga

SEQ ID NO: 8169 - DNA, 1198 bp, artificial
  synthetic oligonucleotide
ccaagccatgctctccagctggctgtggcactggagtgaatcgtgcctccattagataaggacaaggaaatccagctagcctgttgtcttacctcactttgctgtagtttattaatcaaagagttactatgtgcctgttatgtgcacgtagctccttcctgatcctaaagatgtaggagttttaaacctttttttttgtgatattggttcctgtgacaaactagcaaagtctgtaaacacctttcagaatggtttttgctacataaaacacataaaattaaaggaaaccaattatattaaaatgtgactgtcaaaatatttttaaatgcatgatatagtaagagatgttctttagtaacacattaaataaaaaggtctagtaataatttctaagtggtaataaatgacatttcaagatctctgccacaactgtaatatgatatgaaatatctgtggtttcttctggtaaccaaattacatgaactggttatgctactgccatttgatacctgcattcatccttgaaggaaatagtacattttagttagaggttagggggaaaaaaggtaattgtctattcatccaagtttctggaccccttgaattctatctaaggccctcttggtgtctgtcaatccaggttaagtactcccacaggaaagtggttggtttccgtgcatcctagagcattccttcaggcattagcagaacgtttttaagcctcatcttccttctctcacccttacgagttctgcccttatgcccttaaacccactctaaggcacccacacacacagactagccaacaccacacagggacacaaagacaaatctccacacttcctgtagtgtataatcacaattgctctcaagaagcaggtctgtttagacccgaggtcctaggcagacatatcctcttgggacacacaaggcagggagctggcattatatccctcctccctcctcctggtgggttgccctaacgaccttccaagcgcctcccccaactcccaccacgtcccagacccagcggaaacagcctacaacgggaagtgggtgatcacaggtctgtgggcccgcagtggtcactcttctcaaaccggtcctaggctccaggtactcaccgggcttcagcctgaggccatgctgcccagggtcgctgccccccgcccctctgtgaaacattggggccctggtg

SEQ ID NO: 8170 - DNA, 63827 bp, artificial
  synthetic oligonucleotide
aaaaccccctaaatctgaggaaggaaatggacatccagatctaggaagccaaaatgaccaaaacacgatgaatctaaagaaatccacactaagacatatgataataaaattgtcaaaagtcaaagacagagagaattttgaaagcagtaagataaaaccaacttgtcatatgcaggaaaatccattaggaccatcagcagacatctcagcaaaaaaaaactttcaggacagaagagagtagagagtgggataatatattcaaagcactgaaggaaaactaaaactatgaaccaataatgatatatgtagcaaaactgttcttcaaaaacgaaagagagatcaagacattcccagacaaacaaaagctaagggagttcattaccaacagacctgccttacaggaaatctaaagggaagtcttctccttagattgaaagggaaatgaaaatgaaaatgaaagaatgctaaatagcaacacagtagcataaaaaagtataaaagttgttggtgaaggtaagtatataaactaataaagaatactatattactgtaatggttgtgggtaaatcacttttaattgtagtataaagtttaaaaaagtattagaataattataaagtatgctaatgaatatacaatataaataaatgtaaactttgacatgaataacatagagaagaagaaaatgtgtaatgtgtgcataattgaagttaagttgttacatgcttaagacagagtgttagactgttagacattttatgtaagccccattgtagttacaaaggaaatacctacagaagttaaaaaaaaaagaaagaagtgaaagaaatcaaagcatactaatataaaaactaaacaaacaaacaaacaaaaaaaacaaaacataaaggaagaaagcaagaaatgaaaagaagaacaacaaaatccctacaaggcaaacagaaaaaatgaacaaaatggcaacagtaaatcctcccctatcaataattacttgaaatatatacatggattaaactccccaataaaaatacacagaatgactgaatagtttaagaaaaacatcctattatatgctgtctataagagactcactttagatttaagggcacacataggctgaaagtggagggataaaaaaagatattccatgcaaattgtaacttaaaaaaagcaggtgtggcaatagtaatatcagacaaaatgaactgtaagtcaaaaaatgtcacggagacaatgaagaattttatataatgacgaaaggatcaatacatcaggaaaatataacaattataaatgtatatgcattcaacatcaaaatacctaaatatgtaaagcaaacactgatggaactgaagggagaaacagacagaaatacagtaatagattacttcgatactctactttcaattatggatagaacaatcagagaggaaaatcaaaaaacaaatagcagacttgaacaagtctgtggaccaaatggacctaacagatatacagaatattcaacccaataacagtacaatacacattcttttcaaaagcacatgtaacattctccaagatagatcacatgttaggtcataaaagagagcttatcaaatttaagaagattaaaatcataccaagtattttcttctgttcacaatggaatgaaactagaaatcaatagcataaaggaaacttgtaaagttaaaacatatggaaattaaaaaacttaaacactcttaaacaaccaatgggtcaaagaagaaatcaaaagggaaattggaaagtatcttgaaacaaacaaaaccacaacataccaaaacatgtaggatgcagcaaaggcagtattaagaaggaaatttattagcacagctattacagaaaatggtacagaggtttgacaaaaattaaaaatagaactaccatatgatccagcaatcccacttctgggtagaggaactgaaatcagtattttgaagaaatatctgcactctcatgttcattctggcattattcacaagagtcaagatatggactcaacctaagagtccatcaatagatgactgaataaagaaaatgtgatatatacatacataatggaatactattctaccttaaagaagaaataaatgctgtcatttgtgacaacgtagaaggaaccggaggacactatgtaagtgaaataagccagacacagaaagacaaaaactatatcttctcacttacacttggaatctaaaacaatcaaactcatggaaacagagagtaaaattgtggttatcagaggctgagataggagagaatggggagatgttggccaaagggtagaaagatacagctagataaaaggaatgactttttgaggtcttctgcccagcatggtgaccatggttgacaataatgtattgcatatttcaaaactgaagagaagagagtaaatttcaagtgtctcaccacaaaaatgatgtctaaatgaggtgatggatatgttaattagcttgatttaatcattccacattttattcatatatcaaaacatcacattgtacccctgaaatatatacaattatgactggccaattaaaaatgttaataaaaaagagaaatttatagtgataaattatagtgataatttatagtgatactaaaaaagaagaaagatctaaaatcaaaaacctaactttatatctcaggaactaggaaaagaacaaactagcccaaaggtagtggaggaaggaataataaaggttagagaagaaataaatgaaatagtgaatataaaatcaaagaaactaagaggtggggccaggtgcagtggctcacgtctataatcccagcaccttgggaggccaaggcaggagaactgtttgaggccaggagttcgagaccagcctggactacatagagaggcccccatcgctaaaaaaacatttagaaaatagcacatgcttgtagtcccagctacttgggagctaggtttggaggactgcttgagcctcgtccagtctgcagccaggccaacagagtgagtctctctcaaaaaaaaaaaaaaaaaaagaaagaaactaagaagtgtttattttttggaaaaaaatatttccaaaactgataaaactttagctagaccaagaaataaaaagagaagacttgaataaataaaatcagaaacagaaaaggagatattacaaccgatgcaacaaaaataaaaaagatcataaggacaacaatgtaccaataaattggataacccagaataaatggataaatccctagaaacacacaacctaccaagactaaatcacaaagaaaaactgaacagactaatattaagtagagaaattgaatcaggaatcaaaaatctcccagcaaagaaaagcccagggctagaggcttcactgaagaattctcccaaatatttaaagaattaatgctttttaaattgtgtctatttgattcttctctcttttcttctttattagtctggctagtggtctatctattttgttgatcttttgaaaaaaacagctcctggactcattaatttttttgaagggtttttcatgtctctatctccttcagttctgatctgatcttagtcacttctggtcttctgctagaatttgtttgctcttgcttctctagttctagatgttagggtgttgatctagttccagatctagattctagttctagatgttagggtgttgatctagttctagatctagattctagttctagacctagaacatctctagttctagatgttagggtgctgatcttagatctttcctgctttcccctgtgggcatttggtactataaatttccctctaaacgctgtgtctttgttctcattggtttcaaagaacttatttatctctgccttaatttcaataattacccagtagtcattcaggatcattaattacccagtagtcattcaggagcaggttgtgcagtttccatgtagttgtgcagttttgagtgagtttcttaatcctgagttctaaattgattgcactgtggtctgagacactgtttgttatgatttccattcttttgtatttgctgaggagtgttttacttccaattatgtgatcaattttagaataagtgcaatgtggtgctgagaagaatgtatattctgttgatttgggttggagagttctgtagatgtctattaggtaggcttggtctagagctgagttcaagtctcattgatctaatattgacagcggggtattaaagtctcctactattattctgtgggagtctaagtctctttgtaggtctctaagaacttgctttatgaatttaggtgttcctgtattgggtgcatatatatttaggatagttaactcttcttgttgcattgatccctttaccattatgtaatgcccttctttgtcttttttgacctttgttggtttaaagtctgttttaagactaggattgcaacccctgcttttttttgctttccatttgctgggtatatattcctccatccctttattttgagcctatgtgtgtctttgcatgtgagatgggtctcctgaatacagcacaccaatgggtcttgactctatccaatttgccagtctgtgtcttttaattggggcatttagcccatttacatttaaggttaatattgttatgtgtgaatttgatcctgtcattatgatgctagctggttattttgcctgtcagttgatgcgatttcttcatagtgctgatggtctttacaatttggtatgtttctgcagcagctggtaccagttgttgctttccatgtttagtgcttccttcaggagctcttgtaaggcaggcctggtggtgacaaaatctctcagcatttgcttgtctgtaaaggattttatttctccttcacttatgaagcttagtttggctggatatgagattctgggttgaaaattctttaagaatgttgaatattggcccccactctcttctggtttgtagggtttctgcagagagatctgctgttagtctgatgggcttccctttgtgggtaacccaacctttctctcccttaacattttttccttcctttcaaccttggtgaatctgatgattatgtgtcttggtgttgttcttgaggagtatctttgtggtgttctcttatttcctggatttgaatgtcggtctgtcttgctaggttggggaagttctcctggataatatcctgcagtgttttccaacttggttccattctcctcatcactttcaggtacaccaatcaaatgtaggtttggtcctttcacatagtcccatatttcttggaggctttgttcatttcttttcattcttttttctctaatcttgtcttcctgctatatttcattaagttgatcttcaatctctgatatcttttcttctgcttggtcaatttggctattgatacttgtgtatgcttcacaaagttctcgtgctgtgtttttcagctctatcaggtcatttatgttcttctctaaactggttattctagttagcaattcctctaactttttttcaaggttcttagcttccttgaattgagttagaaaatgctcctttagctcggaagagtttgttattacctaccttctgaagcctacttttgtcaattcatcaaactcattctccctctagttttattcccttgctggtaaggagttgtgatcctttggaggaaaagaggcgttctggcttatggaattctcagcctttttgcactggtttttcctcatttttgtggatttatctacctttggtctttgtagctggtgaggttcagatggggtttctgtgtggatgtcctttttgttgatgttgatgctatttattttgctggtttttttttttttttttttttttttttttttgagatggagtctcactttgtcctccaggctggagtgcaatggtgagatctcagctcactgcaacctccgcctcccaggttcaagtgattaccctgcctcagcctcctgaggagctgggactacaggtgggcgccaccatgctcaactaattttttgtattttagtagagacggggttacaccatgttcatcaggctggtctcgaactcctgaccttgtgatctgcccgcctcggccttccaaagtactgggattacaggcatgagccaccatgcccagccaatgttgatgctacttctttctgtttgttagttttccttctaaaagtcaggcccctctgttgcaggtgtgctggagtttgctggatgcccactccagaccctatttgcctggttatcaccagtggaggctgcagaatagcaaagattgctgcctgttccttcctctggaagcttcgtcccagaggggcacctgccagatgccagccagagctctcctgtatgaggtgtctgtcgactcctgctgggaggtatctcctagtcaggaggcatggggtcagggacccacctgaggaagcagtctgccccttagcagagctcaagcgctgtgctgggagatccactgctctcttcagagctggcaggcaggaacacttaagtctgatgaagctgtgcccaaagccaccccttccccctaacacttctcaaattatttcaagaaatcaaaaaggagggcatgcttccaaactcatttcgtgttagccagagttacccttataccaaagaaaattataggctaatattgctgatgttgaatatagatgcaaaaatcttcatgaaaatactaaacatcatactcaatgttgaaagactgaaagctttacctttaagattgtgaatgagacaagaaagcctgctttcactaaacttaagcatgcaggtaagaggcttataaacaataaactacaaaatattgttgaaagaatttaaagatgacacaaatgaatggaaagacatttcctgttcatgaattgaaagacttaatattgttacgatgtcaatactacccaaagtgatttacagatttaatgcagtttccatcaaaatcacaatggtgtttttttacagaaatggaaaaaatacatcctaaaattcatatggaattgcaagggaccctgaatagcaaaaacaatcttgaaaaataagacaaagttggaggtcacacacttcttgacttcaaaagatattattaagctacagtaatcagtacaatattgtactggcatgaatacacacatatggaccaatggaatagaatggagaacccagaaataaaccattgcatatacaatgaagtgatttttgataacagtgccaagataattcaatgcagaaaggacagtctttcaaacaaatgggtgctgggaaaactttatatccacatgcaaaagaatgaaactgaaatgaataaattcctggacacatacaccctcccaagactaaaccaggaagaagtcgagttattgaatagacaaataacaagttctgaaattgcagctgtaataaatagcctaccaactaaaaaaagcccaggaccagatgaattcacagccaaattctgctagaggtacaaagaggaaatggtaccattccttctgaaactattccaaacaattgaaaaggaacgacttctccttaactcactttatgaggccagcatcatcctgataccaaaacctggcagagacacaataaagaaagaaaacttcaggccaatatccctgatgaacattgatgcaaaaatcctcaataaaatactggcaaactgaatccagtagcacatcaaaaagattatccaccacaatcaagtcggcttcatctctgggaggcaaggctggttcaacatacagaaatcaataaacataattcatcacataaacagaaccaatgacaaaaaccacataattatctcaatagatgcagaaaaggccttcgataaaattcaatgtccttcatgttaaaaactctcaataatctaggtactgacagaacatatctcaaaataataggagttatttatgacaaacccacagccaatatcatactgaatgggcaaaagctggaagcattccctttgaatataggcacaagacaaggatgccctctctcactactcctgttcaacatagtactggaagttccagccagggcaatcagtcaagagaatgaaataaagggtattcaaataggaagagaggaagtcaaattgtctctgtttgctgacgacatgatcctatatccagaaaacattattgtctcagttcaaaagctccttaagctgataagcaacttcagcaaagtctcaggatacaaaatcaatgtgcaaaaatctcaagcattgctataccacccccaacagacaagcagagagtcaaatcatgaatgaacttcattcacaattgctacaaagagaatacaattcctaggaatacagctaacaagggatgtgaaggacctcttcaaggagaactataaaccactgctcaaggaaatgaaagaggacacaaacaaatggaaaaacattgcatcctcatggataggaagaatcagtatcacgaaaatggccatactgcccaaggtaatttagagattcaatgctcttcccatcaaagaactattgacattttacatagaattagaaataactacttaaaaattaatatgaaatcaaaaaacagctcatatatccaagaaaatcccaagcaaaaagaacacagctagaggtatcacactacttgacttcacactatactacaaggctatatagtaaccaaaacagcatggtattggtcccaaaacagacatatagacaaatgaaacagaatctagatctcagaaaaaacaccacacatctactaccatctgatcttcgacaaacctgacaacaacaagtaatggagaaaggattccttatttaataaaaggtgctgggaaaactggctagccatttgcagaaaactgaaactggaccccttccttataccttatacaaaaattaactcaagatggattaaatacttaaatacaaaacccaaaaccataaaaaccatagaagaaaatctaggcaataccattcagaaaataggcatgggcaaagattttatgatgaaattgccaaaagcagttgcaacaaaagctaaaattgacaaatgggatctaattaaaccaaagagcttccgaatagcaaaagaaactaccatcagagtgaacaacctacaaaatgggagaaaatttttgcaatctacccatctgacaaagttctaatatccagaatttacaaggaacttaaacaaatttacaaggaacttaaacaaatttacaaggaaaaaaacaaccccatcaaaaagagggcaaaggacatgaacagatacttctcaaaaaaaaaaaaaagatatttatgcggccaacaaacatatgaaagaaagctcaacttcactgatcattagagaaacacaaatcaaaaccacccaatactatctcatgccagtcagaatggcgattattaaaaagtcaagaaacaacagatgctggcaaggctggggagaaataggaacacttttacactgttgctgggaatgtaaatcagttcaaccactgtggaagacagggtggagattcctcaatgatctagagccagaaataccatttgacccagcaatgccattactgggtatatacccaaaagaatataaataattatattataaagatataagcacacatatgtttattgcagcagtattcacaatagctaagacttggaaccacatgtggacacagggaggggaacaacacacactgaggcctgtcagaaggggtgggggtagggagagcatcatgtggggcttaatacctagatgacaggttgataggtgcagcaaaccaccatggcacacgtttacctatgtaacaaacctgcacattctgtacatgtatcctggaacctaaaataaaataaaattagaaaaaaatagacaacaaaaagaataaagttggactcttactttacaccataaacaaaaattaactcaaagtgtataaaagacctaaaggtaagggtgaaaattgtaaaattattgacagtgaacacaggataaaacatcatgatactgaattcagcaatcttatatcacagatataagaccaaaagaataaaaatggataaattgggctacatcaaaattaaacttttgtgtatcaaaatacactatcagaagagtgaaaaggcaacctgcagaatgggagaaaatatttgcaaatcatatatctagtaaggagttaatatccagaaggggagagctccaagatggccaaataggaacagctccagtctacagctcccagcgtgagtgatgcagaagacgggtgatttctgtatttccaactgaggtactgggttcatctcactagggcttgttggacagtgggggcaggacagtgggtgcagcccaccgactgagctgaaacagggcgaggcatcgcctcacccaggaagcgcaaggggtcagggaattccctttcatagccaagcaaagctgtgacagatggcacctggaattttgggtcactcccaccctaatactgcgcttttccaatggtcacagcagacggcacaccaggagattatatccggcacctggctcagagggtcccacgcccaaaaagcctcgctcattgctagcacagcagtctgagatggaactgcaaggcagcagtgaggctaggggaggggtgcccgccattgctgaggattcagtaagtaaacaaagcagcctggaagctcgaaatgggtggagcgcactgcagctcaaggaggcctgcctgcatctgtacactccacctctgggggcagggtatagctgaacaaaaggcagcagaaacctctgcagatttaaatgtctctgtctgacagcttggaagacagtagtggttctcccagcacggagtttgagatctgagaatggacagactgcctactcaagtgggtccctgatcccagaatagcctagctgggagacaccccccagtaggggcagactgacacctcacacagctgggtacccctctgagatgaaacctccagaggaacgatcatacagcaacatttgctgttgagcaatattcgctgttctgcagcctctgctgctgatacccaggcaaacagggtctggagtggacctccagcaaactccaacagacttgcagctgattgtcctgactgttaaaaggaaaactaacaaacagaaaggacatccacaacaaaaccccatctgtatgtctccatcatcaaagaccaaaggtagataaaaccacaaagatggggaaaaaacagaagagaaaaactgaaaattctaaaaatcagagcgcctctccttctccaaaggaacgcagctcctcaacagcaatggaacaaagctggatggagaaggactttgacgagttgagagaagaaggcttcagatgatcaaactactaccagctaaaggaggaagttcgaacccatggcaaagaagttaaaaacactgaaaacagattagatgaatggctaactagaataaccaatgcagagaagtccttaaatgaccagatggagctgaaaaccatggcacaagaactatgtgacgtacgcacaagcttcagtagatgattcgatcaattggaagaaagggtatcaatgattgaagaccacatgaatgaaatgaagtgagaagagaagtttagagaaaaaagaataaaaagaaacgaataaagcctctaaaaaatatgggactatgtgaaaagaccaaatctatgtctgattggtgtacctgacagtgacagggagaatggaaccaagttggaaaacactctgcaggatattatccaggagaacttccccaatctagcaaggcaggccaacattcaaattctggaaatacagagaacacaacaaagatactcttcgagaagagcaattccaagacacataattgtcagattcatcaaagttgaaatgaaggaaaaaatgttaagggcagccagagagaaaggtcacattacccacaaagggaaccccatcacactaacagagaatctctcagcagaaactctacaagccagaagagagtgggggccaatattcaacattcttaaagaaaagaattttcaacccagaatttcatgtccagccaaactaagcttcataagtgaaggagaaataaaatcctttacagacaagcaaatgctgagagattttgtcaccaccaggcctgccctacaagagctcctgaaggaagcactaaacatggaaaggaacagccattaccagccactgcaaaaacaggctaaatcgtaaagaccatcgaagctaggaagaaactgaatcaactaatgagcaaaataaccagctaacatcataacgacaggatcaaattcacacatagcaatattaaccttaaatgtaaatgggctaaatgctccaattaagacacagactggcaaattggataaagagtcaagacccattagtgtgctgtattcaggaaacccatctcacgtgcagagacacacttaggctcaaaataaagggatggaggaagatctaccaagcaaatggaaaacaaaaaaaggcagggtttgcaatcctagtctctgataaaacagactttaaatcaacaaagatcaaaagagacaaagaaggccattacataatggtaaagggatcaattcaacaagaagagctaactatcctaaatatatatgcacccaatacagaagcacccagattcataaagcaagtccttagagacctataaagagacttagactcccacacaataataatgggagactttaacaccccactgtcaacactagacagatcaacgagacagaaagttcacaaggatatccaggaactgaattcagctctgcaccaagcagacctaatagacatctacagaacactccaccccaaatcaacagaatatacattcttctcagcaccacaccacacctattccaaaactgaccacatagttggaagtaaaacactcctcagcaaatgtaaaagaacagaaattataacaaattttgtctctcagaccacagtccaatcaaactagaactcaggattaagaaacttactcaaaactgctcaactacatggaaactgaacaacctgctcctgaatgactactgggtacataacgaaatgaaggcagaaatgaagatgttctttgaaaccaacgagaacaaagacacaacataccagaatctctgggacacattcaaagcagtgtgtagagggaaatttatagcactaaatgcccacaagagaaagcaggaaagatctaaaattgacaccctaacatcacaattaaaagaactagagaaacaagaacaaacacattcaaaagctagcagaaggcaagaaataactaagatcagagcagaaatgaaggacacagagacacaaaaaactcttcaaaaaatcaatgaatccaggaactgagtttttgaaaagatcaacaaaactgatagactgccagcaagactaataaagaataaaagagagaagaatcaaatagatgcaataaaaaatgataaaggggatgtcaccactgttcccacagaaatataaactaccatcagagaatactataaacaactctacgcaaataaactagaaaatctagaagaaatggataaattcctcgacacatacaccctcccaagagcaaaccaggaagatgttgaccaataacagactctgaaattgaggcaataattaatagcttaccaaacaaaaaagtccatgaccagaaggattcacagccaaattctaccagaggtacaaggaggagctggtaccattccttctgaaactactccaatcaacagaaaaagagggaatgctccctaactcatttcatgaggccagcatcatcctgatatcaaagcctggcagagacacaacaaaagaagataattttagaccaatatccctgatgaacattgatgcaaaaatcctcaataaaatactggcaaactgaatccagcagcacaccaaaaagcttatccaccatgatcaagtgggctttatccctgggatgcaaggctggttcaatgtacacaaatcaataaacgtaatctagcatataaacagaaccaaagacaaaaaccacatgattatctcaatagatgcagaaaaggcctttgacaaaattcaacagcccttcatgctaaaaactctcaataaattaggtattgatgggatatatctcaaaataataagagctatttatgacaaacccacagccaatatcatactgaatgggcaaaaactggaagcattccctttgaaaactggcaacagacagggatgccctctctcaccactcctattcaacatagtgttggaagttctggccagggcaatcaggcagaagaaagaaataaagggtattcaattaggaaaagaggaagtcaaattgtccctgtttgcagatgacatgattgtatatctagaaaaccccattgtctcagcccaaaatctccttaagctgataagcaacttcagcaaaatctcaggatacaaaaatcaatgtgcaaaaatcacaagcattcttatacaccaataacaaacaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggatacaaacaaatggaagaacattccatgctcatggataggaagactcaatatcatgaaaatggccatactgcctaaggtaatttatagattcaatgccatccccatcaagctaccaatgactttcttcacagaattggaaaaaactactttaaagttcatatggaaccaaaaaaagagcccgcattgccaagtcaatcctaagccaaaagaacaaagctggaggcatcacgctacctgacttcaaactgtactacaaggctacagtaaccaaaacagcatggtactgctaccaaaacagagatatagaccaatggaacagaacagagccctcagaaataataccacacatctacagctatctgatctttgacaaacctgacaaaaacaagcaatggggaaaggattccctacttaataaatggtgctgggaaaactggctagccatatgtagaaagctgaaactggatcccttccttacatcttatacaaaaattaattcaagatggattaaagacttacatgttagacctaaaaccataaaaaccctagaagaaaacctagacaatacctttcaggacataggcatgggcaaggacttgatgtctaaaacaccaaaagcaatgtcaacaaaagccaaaattgacaaatgggatctaattaaactaaagagctgctacacagcaaaaaaaaaaaaaaaaaaaaaaaaaaaaaaaaaaaaaaaaaaaaaaaaaactaccataagagtgaacaggaaacctacagaatgggagaaaatttttgcaatctactcctctgacaaacggctaacatccagaatctaaaagaactcacaaaaatttacaagaaaaaacgaacaaccccatcaaaaagtgggtaaaggatctgaacagacacttctcaaaagaagacatttatgcagccaacagctacatttatgagccatgaaacaatgctcatcaccactggccatcagagaaatgcaaatcaaaaccactatgagataccatctcacaccagttacaatggcgatcattaaaaagtcaggaaacaacacgtgctggagaggatgtggagaaataggaacacttttactctgttggtgggactgtaaactagttcaaccattgtggaagacagtgtggcgattcctcagggatctagaactagaaataccatttgacccagcaatcccattactgggtatatacccaaaggaatataaatcatgctgctataaagacacatgcaaacatatgtttattgcgtcactactcacaatagcaaagacttggaaccaacccaaatgtccaacaatgatagattggatttagaaaatgtggcacatatacaccatggaatactatgcagccataaaaaatgatgagttcatgtcctttgcagggacatggatgaagctggaaaccatcattctcagcaaactatcgcaaggacaaaaacccaaacaccgcatgttgtcactcataggtgggaaatgaacaatgagaacacttggacatagggtgaggaacatcacacaccggggcctgttgtagggtgggggcaggtgggagggatagcattaggagatatatctaatataaatgaagagttaatggttgcagctcaccaatatgccacatgtatacatatgtaacaaacctgcatgttgtgcacatgtaccctagaatttaaagtataataaaaaatatatatatataaatatccagaatatattaaaaacttctacaacaacaacaacaacaatgaaaaacaattataaagtgtgcaaaggactttgtcatttctccaaagaaattaaaatggacaagacacacattaaaaagatgttcaacaacactaatagagaaatgaaaatcaaaaccacaatgatatatcacctcacacccattagaatggctactatcccaataaaaggaacaaagaacaaagaataacaagttttggtgaggatgtggaaaaattggaaaccttgtccactgctgttgggaatataaaatgatgcagccattatttaaaacactatggtgcttcctcaacaacgtaaaaacagatttaacatataatccagaaattccacttccagatacgtatcaaaagaataggagcctgaacaacatagcaagaccctgtctctacaaaaataaaataattagctgggcgtggtggcacatgtatgtagtcctagctacttgggaggctgaagtgggaggatcacttgagcccaggaattagggattacaatatgctataactgtgccactgcattccagcctgggtgacagagtgagactccatcgcaaaaaaaaaaaaaaaaaaaaaaaaattaagttgggagcaaggactcaaaaatatacttttacaaaaatgttccattcagtattattcacaaaagccaaaatgaggaagcaacccaacgtccactgccagatgataaaaacaatatggtatatacaaccaattaaatattattcagccttaaagaggaaggaaattgtgacacatgctacaatatggatgacttttggggacactacgctaagtaaaataagccagatacaaaaggaaaaacattgtatgattcctcttatatgaggtacctggtcaagtcatgttcagagatagaaagtagattggtggttgtcaggggtaggtggaatgatttatttaatggttagggtttcagttgaaatgatttgtttaataggtagggtttcagatgaaaaagttctaaagattgacctaacactactgaattaaaacctaaaaatggaactaatctaaaacctaaaaaagtggactaacacctaaaaatggtcaagaaggtaatggaccttcttggaactaacctaaaacctaaaaaagtgaactaacacctaaaaatggtcaaaaaggtaaattttaagtgcattttactacacttaaaagtaaattactagcaggacaaagagcactaaactgggagtcgtgggacacaagaccaagcccctgatcaccttatgaaccagaggatcttgcacatgctgtttagttttttatcttatattttacttataacatttattaccatctctgaccagatgcacattaaacattttgtatatatatataaaaaaaagaaataatagcgttcccatggactctttacccagtttccccagtgggtaactgcagtacaatatcacaaccaggatactgaaactgatagtcaagataccaacaattccactaggcaaactcctgctctcctttagtagccacacccacctccccctcatacccaccacctcctcggagtgtggactctgtccttagcccttcataaccattaatctgttctctatttctttaattttgtcaagaaatttatgtaaatgaaaccatacagtacatagcattttgaaattggcatttttcacttaacatattctctgcaaggtgttgcatatatttagtttgttctttattgctgagcagtattccatggtacagatggaccacagtttgtttaaccctttacctgttgaaggacatctgggttgttttcagtttttgactatatgaataaaaatgctataagtattcatgtagaggttttcatataaacagaaagtttgatttttttctggcatatatggccaagagtacaatttgtacaattgttggggcatatggcatttgcatattcaattttttagaaaactgacaaactgtttttcaaagtggctccatactatttcatatttctattacataaatgagccaaaggtagcctctgcatatggaccttatgttgtttattttttcttagcaggctgggaactcattcactcaaaagcctgctagtaccaaactcaaatttttacacatccaattgttttaaatagccaaactaagcatatttttaaccctttagagcctgcctgtcttgcataccccacaaaactgcccccaacatctgctaaccaaagataagattaactccagagtaataaagaccccacatcactgctgcccttcagaaccctctgacccagcaacttcctgacatgctgcctagtcatctaaacacgtaagcccctctgatattcctctttcttgaagagaagtttccttgccttcctccccttctgcgtgctggcctctacactcatgctaacctgtcaaagtgttgcctgctgaacaccccacacacccctcaaaaagcttgttgtgtgctactgtggtcatatcttttccttctttccttgatcagtcctgaaatccctcaactcattacaagtggcaacaaggatggaattttggtgatgaccaggaaatcaatatgggacctaccaagtcaataggaggattaactgtcaaaacaaccctggacgaccttaagtgcttgggactcagaatttggaacacgttcgcataactttggcatggcattcttctgtactgaattacactctatattttctatggtctcccccatgcctcatgagcctggacaagtggtagtgccagtatttgagtaaatcctcgccatcagaactgacttttgagagagaggcaccaagctgcccagggaaggtcagcctgatcacctggatctcccactagaaaggcactaggtaggcacctgtgggcctgaatagaaaaagggaaagtacatacctctggaccacatgtgggttaccccagatcccataatgggctatagtaggagagttccccatgtccagactggtgatatgtgatgagaatactctgagatgagagaatatccttgtccttggacactgctatggcaggcaaacaagctgataaggcagatatgtcagtccgatgctggtctcctaagcacaattgggagacacttgcaagcagctagtagtcctctgctatcatgacaattatgctttagatactctcattctagtcctttgttggaagtatgttgagctctccatcttttggctgagccgactaaagcattatttcaagtgactaaatcaaggaaagttacattccaggacaccaaaggaagtggctatcctactcaagggatgctccaaaccataaagtaggtgcatgttggacctcgctgttggttgcttttcaccagggtttgcacagagaggaggtagaaactcaaactcctgcaggagatgagttggaagggaagatcctggggaagagaactggtgacctctaaagaagaaagcagcagcatggtgtcatcatgctagggactaggatcatttaccctctgctttgccagtaaccactggcaaagtcataaagacagaaaaacaaaagaagagggccacttctcttttggagcagaaaatgcatcatctttcttgcccttatgtccagtctctccgtaaggacctgacccaggaactgaatgaaaaaggggctgcctgactatatatacagaatgtatctggcagggagcaaactccacctaataggggaattaaacaattggctgccatagtacaagatggaaaaaaatggtgtcactgccaaagtatcccgcataataagcatggaaggtaggagtgaccctcaaaagaggctttgtgcctcagtccacatataccttgttgatgtggatttttacggcttggcttggtgggctttccatcctatactaggccttataaaggcctgggaagactgtcaatggaaaatgttaaccaaggtcaaagatctcctacatcagctggggatgctgaagtgggtttatcaggcaacagatgacctgcagcatgatgacttggcaagtccagaggaaacggaattcaatcccttgtctaacgacttatttctcaggagggcgcctgataagtgtaagtcctctttttgggcaataatggctaatgctaaaacaactgaagagttcatagcttcactggatttagtagaaatacatgaaagacaaactcaagtgttgcctgttaattctatgactataaccccttctagcctaaatcaaaattactatcaacagttatgctgcacccttctagaccaagcaaaccacgtagagccaggtccgtggtttagcttgaaccctgagtaaacaaaaggggttacattggaccctaagggacaaaggggcccaaattggatgttctctcatacattggtgaagcaagtattaacatttactagggttagattacaatctgcagcaggtattcaaagtcagcctcacttgggaagcctgctcctgatctcctccagtggcagggacccacacccacatagggatctggtggttgcagaaggtggctacttccagtagacaatcacccttttaccatattaactgtagtttggctctacaacattggctggctttgttggacatgggtgcccaaatctccctaatcctaagaatcactcatgctctaaaggaatcccctcactcctcaccctgtccaggaggatgattatgtaaaggagcaattacttacttaactattaaaattgatccagttctgctaaaagatgctttgattctggttgtacccctgagactatcccctttccttatttgaatggacttcttcaatcagctcgtaactccatagaacctaaggcttttatggtattggtgggcactacctggtgggaaccagttaactttcccctaccagggcaggtggtaaatacggcacagtacaagctaaggcaagaccctgaaggattataggctatcatagcttatttaaataacgtgtactgattcttaccatctcacctgtcaatcctctggtatagcctatgtgtaaagccactattaataaatggaagctaactatagagagttaaataagagcacctttttattggagcacttctactagatatcatcaccttaatggatgacattcaaaacaacatagataaatggcatggagttatagacttgcctaacatgctccaattgggaaatattttgtaggagagttaatcacaatttgccttcacttttgagggtgaagagtatattttttcccagccacctatgggatactcaaatagccctgtgatcgaacttgtgcagatatgacctagatgcctgccccattatttccaccagaaattcagctttggcattatattgataaaatcctccttactaaatcttaccaagattctgtctctgaggttatcacaactgtgagcaaacacttcaatgagaggggatggtatcttagtccacttaggctgctataacaaaataccataaattgggtggcttataaacaatagatatttattcctcacagtcatggaggctaggaagtgcaagatcgagatgacagcagatttggcatctggtgaaggtcctcttcctacttcatagatgactgtctttttgctgtgtcctcacatgacagaaggagaaaacaatgtctctggggtctcatttataagggaactaatcccattcatgagggctttgccttctcttaatgcctaggccttatctcctaataccatcacattgggagttaggatttcaacatatgaatttgggagaacataaatatcgcctatagcagatgggcaactgcccccacataaggtacaagacctctttattaaatcttggggttacctttggaactcagaagggtgaagtattctcagtctggtaagacaagctcctagtgctccaacctcccacactggtaaagaagatccaacatttgataggaatgtttatattctggctccaacacactcctcacctccaatatttgctactgagtcacctgtaagtctcacttttcagtgagaacctgagcaacgaggtactagataaactaaaggaagctattactttggctctcccgtaagtgcacctgaataaaacttaaaatgagatgtttctgacacacacacacacacacacacaaaattgtttcctagattctcttgaggtaaacctaaatgcaagaactaaaactgtaaaattctttttttctctcacaagatttacaagactaaaactgtaaaattcttagaagagaacatagggggaaatcttcatgacatggaatttggcaatgatttcctcaacatgacactaaaagcacaggcaacaaagaataaattgataaactgtactttatcaaaattttgtgcatcaaaagatactatcaagagaataaaaaggtaaccagagaatgggagaaaatatttgcagatcatatatatggtaagggattgatataaagaatatatagagaattcctaaaactcaaccacaaaaaacaacccaattcaaaaatgggcaatggacttgaatagatatttctccaaagaagatatacaaatggacaataagcacatgaaaatatgctcaatgccactagtcataaggaaaatgcaaatcgaaaccacgagatactacttcatacccactaggatggatactatccaaaaaataaaaggaaaaatgcaattattggtgaggatacagaaaaaatagagtccttgtgcattgctgatgggaatgtaaaatggcacagccactgtggaaaacaacttcgaagtcgtttaaaaagttaaatataaaattaccatatgatccaacaatccacttttaggttataccccaaagaactcgaagcaggaaatcaaacagacagttgaataccaatattcatagacaaattattagccaaagctaaaaggtagaagcaacccagatgtccatcaatggatgactaaacaaaatgtgctatatccatacaatagaatatttttcagcctcaaaaaggaatgaagttctgatacatgctgcaacatggatggaccctgaaaacactatgctaagtgacataagccagacacaaacacatacaaaaacaaatattctatgacttcacttacatgagctacctagaataggtaaattcataaagaccagaaagtagaatagagggctgccaggggctgctgggaggggaaaatggagagttattttgttatgctatggagtttctgtttgggatgatgaaagagttctggaaatggataatgatggtagatgcacaacttctgattgctgattacactgtacacttaaaatggttaaaatggtaaattttatgttatgtatattttacaaaaaccaaaacaagcaaaaaataccatggggccagaggacggactgttatataaatgaaccacagatagcctctgtatatggaccctatgctggttttttttttttttttttaattatactttaagttttagggtacatgtgcacattgtgcaggttagttacatatgtatacatgtgccatgctggtgcgctacacccactaactcgtcatctagcattaggtatatcttccaatgctatcccttccccctcccccgcccccaacacagtccccagagtgtgatattccccttcctgtgtccacgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcataatattccatggtgtatatgtgccacattttcttaatccagtctatcattgttggacatttggcttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatagtatctcatagtggttttgatttgcatttctctgatggctagtgatgatgagcattttttcatgtgttttttggcggcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccatgcctatgtcctgaatggtaatgcctaggttttcttctagggtttttatggttttaggtctaacgtttaaatctttactccatcttgaattgatttttgtataaggtgtaaggaaaggatccagtttcagctttctacatatgactagacagtttccccagcaccatttattaaatagggaatcctttccccattgcttgtttttctcaggtttgtcaaagatcagatagttgtaggtaggcggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcgtggaatgttcttccatttgtttgtatcctcttttatttccttgagcagtggtttctagttctccttgaagaggtccttcacatcccttgtaagttggattcctaggtattttattctctttgaagcaattgtgaatgggagttcactcatgatttggctctctgtctgttgttggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgtctaattgccctggccagaacttccaacactatgttgaataggagtggtgagagagggcatccctgtctgttgccagttttcaaagggaatgcttccagtttttgcccattcagtatgatattggctgtgggtttgtcatagatagctcttattattttgaaatatgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttatcgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcccccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcgaggaatgtatccatttcttctagattttctagtttatttgcgtagaggtgtttgtagtattctctgatggtagtttttatttctgtgggattggtggtgatatcccctttatcattttttattgtgtctatttgagtcttctctctttttttctttattagtcttgctagcagtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttcgtgctataaatttccctctacacactgctttgaatgcgtcccagagattctggtatgttgtgtctttgttctcgttggtttcaaagaacatctttacttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgtggactttctgtctcattgatctgtctaatgttgacagtggggtgttaaagtctcccattattaatgtgtgggagtctaagtctctttgtaggtcactcaggacttgcttcatgaatcttggtgctcctgtattgggtgcacatatatttaggatagttagctcttcttgttgaattgatccctttaccattatgtaatggccttgtctcttttgatctttgttggtttaaagtctgttttatcagacactagcattgcaaaccctgcctttttttgttttccatttgcttggtagagcttcctccatccttttattttgagcctatgtgtgtctctgcacatgagatgggtttcctgaatacagcacactgatgggtcttgactctttatccaatttgccagtctgtgtcttttaattggagaatttagtccatttacatttaaagttaatattgttatgtgtgaatttgatcctgtcattatgatgttagctggtgattttgctcgttagttgatgcagtttcttcctagtctcgatggtctttacattttggcatgattttgcagcagctggtaccggttgttcctttccatgtttagcgcttccttcaggagctcttgtagggcaggcctggtggtgacaaaatctctcagcatttgcttgtctgtaaagtattttatttctccttcacttatgaagcttagtttggctggatatgaaattctgggttgaaaattctttcctttaagaatgttgaatattggcctccactctcttgtggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttcttgaggagtatctttgtggcgttctctgtatttcctgaatctgaacgttggcctgccttgctagattggggaagttctcctggataatatcctgcagagtgtttgccaacttggttccattctcctcatcactttcaggtacaccaatcagacgtagatttggtcttttcacatagtcccatatttcttggaggctttgctcatttctttttattcttttttctctaaacttcccttctcacttcatttcattcatttcgtcttccattgctgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagtttttaacttctttgcctttggtttgaatgtcctcccgtagctcagagtaatttgatcatctgaagccttcttctctcagctcgtcaaagtcattctccatccagctttgttccattgctggtgaggaactgcgttcctttggaggaggagaggtgctctgcgttttagagtttccagtttttctgttctgttttttccccatctttgcggttttatctacttttggtctttgatgatggtgatgtacagatgggttttcggtgtggatgtcctttctgtttgttagttttccttctaacagacaggaccctctgttggaataccctgccgtgtgaggtgtcagtgtgcccctgctgggtggtgcctcccagttaggctgcttgggggtcaggggtcagggacccacttgaggaggtagtctgccggttctcagatctccagctgcgtgctgggagacccactgctctcttcaaagctgtcagacagggacatttaagtctgcagaggttactgctgtctttttgtttgtctgtgccctgcccccagaggtggagcctacagaggcaggcaggcctccttgagctgtggttggctccacccagttcgagctttctggctgctttgtttacctgagcaagcctgggcaatggcgggcgcccctcccccagcctcgctgctgccttgcagtttgatctcagactgctgtgctagcaatcagcgagattccgcgggcgtaggaccctccgagccaggtgtgggatatagtctcatggtgcgccgttttttaagccggtctgaaaagcgcaatattcgggttggagtgacccaattttccaggtgcgtctgtcacccctttctttgattcggaaagggaactccccgaccccttgcgcttcccaggtgaggcaatgcctcgccctgcttcggctcgcggacggtgcgcacacccactggcctgcgcccactgtctggcactccctagtgagatgaacccggtacctcagatggaaatgcagaaatcacccgtcttatgcgtcgctcacgctgggagctgtagaccggagctgttcctattcggccatcttggctcctcccctcggaccctatgctgtttacttcttcattacaggttaggaacccattagctgaaaagcttgatagtaccaatctgaaaatgttacacagccaattgttttaaatatagcccacatgagtatatttttaggcattagagcctgcctgctttacatacactgcaaaacttcacaaaatatctactacccatagacaagaaaaactgtagggcaataaagaccccaagctgctgctggtcttcagagttccctgacccacagactccctgctgtgctgcctagcaacatcatatattaatagacatgtcagctccgtctccttcatgagttccttagccctcctccccttatgggttgtgccctcaggcctataccagagagtctggatggcctcgtgctgtgaaggattttcccaggtgcaaatctgtcaaaggatcacttaaagtttgctgtgcgttaatgccatctcgtgattcttatcagatgtaaaatccttcaaagtcactataatccccaccaggaaggcaggaaaaattcagcttttcagtatctttgacagcactttgtattgtaaccatttttttttattttagccattctgataaatgtgtagtagtatctgattgagcatttgcatttaccaaattggctaatgatgttgaacatttatcttttttttcttttaagttttaatgtttatttctccaagacagcctagcttgtactctatttggataaatttcataagctagttttctgctgttactagttttaaactttatatttctgatgacaagacacactgcaaaaatactctagttcaacagagttatgttcacaaaacaatttttatccattctacagtgtttcagaattactagttgatttttaaacacaaagtagatatagaggctattggtggttaacgtgatatatttcttatagcaaactgtggttcacacaatacttgtgctcaaaggggaaggcacatgatttcctaaaatgagccaccttataaagagttcttactgtataaattacatcacatttactgtacataacctcaaaactgaggtattattcaatttacaaaaactactttatcagtctttatgaagcagtacatatgtgccaaattccattttagaagtttccacatcattttcatataaaacaaagtttgaaaacaagtaacatttaaatacagcatggtattctaacacaactgaaacttttttcttcttcttctctacaggacccaacaaaatctgaaaatgaactatgctgtaaatttacctcatgcaaagatctttatgttctctctgaaagtgaaaagcatggccttttaagcacattttactgttttatactattatggcaacttgtgtactgcagcacagtctgttttgagaaaaagttatgatttttttcatgcaaaaatctacacaaattagctttgataaggaaagacattcatagcatcaaacattcattcagtgcaaatgcacagggaaaccttcctgaaatgttttctgacttgagagtcaactaaaaagaaagccatactaggtaaataaaaacttacaggggcggggaggaaaaggggtaaggggaaatagaaaacataagttgcagagtaaacaaatgtctgctgctgatccagtatttgtttttatgtccagtgtacattaacactcaggatctcattttgatgatttactaggctatcagccacctgaaggcaaatcaagcttgcatgtgttcacatacagcaccactaccacactcctgtacatagtcactccaggactaggagtctaattcatgaatgagagccctagattttaaagatgatactgactgtccatcactgagccagacattcattcaacattttccatttggacactgcttcatagcaaggcctaggctcattttccttttacttatgtgggcatccaattctcttttacggttacaagccttgaagataatagtactacactttcccctcagtttatatagagtaagtcaatgttctttctcaggcactgaagatctgtgacctgtagccctttttactatgaacagcctaaataagcattcatgtaaagttttcattacattttgccactcattctcactcatacccattcaccatcttgaccacatttgggcattttctgtgattccaaatgaaatcttcacattttctttcccaatttaatgcagaagcagatcccatgagctaagcttgatggatcaaacatttatatatatatatatatatatatatatatatatatatatatatatatacacatacatatatatatacacatatacacacatatatgtataaacatatatatatgtatatacatatatatgtatatacatatatacgtatgtatgtatgtatataaattgtacctaacttccacaatactgttctaaaactggaactgttctattggtatactggcagataaattgaaaccaaatgttccaccttgaattgcctctggatcaaggctaagatcttcatcaatatcatttgaagagaactgagcaatcatctcataggctaatttgtagatgtctccatttttatgattttgaagttgttcaattttctccagtcctccacatttttctataagattggctatggattctgcctcatttttagccatttttaatatattaattcatccagtactacttgtacaacttgtgcatcttttacagtcagcttctgagtgccaatatcccccttatccaaaaggtttattattcttggtacaatattggcatctattactgcctgtatctgcagctgattacctgcagtgatgttacagagaaaccatactgcctctttattaattttctctttgggatgtgtcaggattgcccacaagtatgaaagagcatcataattcacaactacttctgtttgctcttcaattccagtagccatgttgctcacagcttgaggtgcagcagtctgaaccacccggcggctgagaagaggaaccaaatgaggaactattccagagtctactaccatctgtatttgttcattgccagcaccagtaaggtaagagagggcccagtctgtatctactaatatatttacaaatgtatgatgaattagaacacaaagagctgaaagcatttcctgtatggtttccattggtggtggtggctctttgtggtgacataaattggccataacccaggctgggcatggtggctcacacttggaatgctagcactttgggaggctgaggcaggaggattcttgagtccaggagttagagaccagcctaggcaacatggtgagaccctgtctctacaaacaatttaaacatttagctgggtgtggtggcacgcacttgtggttccagctactcgggaggctaaggcaggatgatttcttgagctccagaggttgagggtgcagttagctgtgtttgcgccactgcattccagcctgggtgagcccctatcacagaaaaaaaaaatgttttgaagtaaaataaaggtttcacaactccaagacttatgacataatctctacatcgggaggaccatcacttatgatagttctcaatgcccacactgcttgctcacaaacattctgatgaagtgaatggaggagcctcaggaaatgtggcacagcattggactgaactactgtttgagcttgttcagaggttctagatgcagtgtttgtcaaagcccatgcagcttctaactgtaaagcattgtcatctctttcaagacaatagactagaacaggtagtattccagattttatttttataaattggtagacttcgatcactggacaaagcttcctagcagcccgaactgcatttaattgaatttcttagttatcacttgaagcattttgaataatagctactagagaggtattttacactccataatcatcatttgtatcagtcttcacaggtatcttcattcagtacgttccttctctttaagagatgttcatctcttttattcttccttaattcaactacaacttcattttgctgtcttctcataatccccaagttgtggactttgttctcaaaattcttgagccattggctgtctagtttttcattgtccactatgaacgagctgatgactccttcccctacccaggccccacaggatctgccccaaccaccatgccacaccgacactcccaggaaccaggctgcctgtgctgctatgccggctgtgccactgcttccttcctcctcctcaactgcctcagctgaggccttctcctctccctgtacaactcccttcctcaaccccagcatgagagcagatcaggtggagacaactacgggagcggaatggcagcaacggtggcggaatgtaatgcatgctgagagtgagatggcctcaatctctgcacaccttttcatgtgcttattttccatctgttatattttcttcagtgaaatgtttatgtcttttgcctatttttaactaggcttgcttttactattacgtgttaagagttcttgatatattctagatactagtttgttactggatacgttatttgtagtattttctcccagtctgtagctctgtagcttctgtagaggaaaagtttttaattttattgaggtctaatatatcaacttttcctgttatgaatcatacttttagtatcaagtgacttacctgaaatttttctaagttttcttctaaaagatttatagtttgagcattttacatttaaatttatgatccattttgtataaagtatgaggtgtaggtgaaggttaattttgagcggagagggcaatggattgttcagcatcatttgttgaaaagactatccttcccccatttaattacttctgtaataatttaggcgtatctgtgcaggtcggcttttgggttctctattctcttctattgagtttcgtatctatccctctaccactgccgcacagacttgattaccatagccatataaatgtcttgaaattgagtataatggttcctcccaccttatacttctttgtcaaattgtcttagctattctacctccgctgactttacatacacattttagaataatgttgactacatctccaaaaaaaatctgcctgcgattttcataggaaatgtattgtaattgcataccaatttgggaagggctgacatttttactgtgttgattttgacaatccacgaacatgcaatgtgcctctccattcatttagatctttaatttctttatcagcattttctaattgtcagcagatcttatacatgttttgctacatttgcatttacgtatttatttgaatgattatgaatgatatattttttatttcaatgtctgtatgttcattgctagtatatgaagcacaagtgatttatgtatgttgatattgtgtcctatgattgcgttgaagtcacctatgttgatgggtgcagcacaccaacatggcacatgtatacatatgtaacaaacctgcacattgtgcacatgtgccctaaaacttaaagtataataataataataaaaataaaaagagaattagctaagaattcaaaaaaacttttgacgaagcataatacttttttttttattattattttttgagacagagtctcacgccattctcctgtctcagcctccagagcagctgggactacaggtgcctgccatcacggctggctattttttttttttttttttttttgtatttttagtagagacggggtttcactgtgttagccaggagggtctcgatctcctgacctcgtgatccactggactcggcctcccaaagtgctgggattacaggcatgagccactgtgcccagctgacagggcataatactttttatgatttattttttagttttttggctttcctatttataattcagaatatagtatcatctattatagttatacctatatttttctgacaatatttcctaattttttattttccaattttataaacaatattttcatttgattccagtctataaactatttctacataacgattaataataccatttctataaatgtcatgtgctgtatacgtggcatggcgtatacagatagttttgtgttttatgttttgttatataacctatattgagttaaattttgtggagtgtgtaagctctgtgtctagattcaatttttttcttttttaatatgtggatgttgagttgttctggcaccattggttaaaaagactttcctttctctgttgaattgtctttgttcctttgtcaaagctgagttgattatatttctgtgggtcaatttctgggctctccattctgttccattgatctatttgtacttgttgtttgtttgtttccaataacaccctgtcttaattattgtagctttgcagtaagtgttaaagtcaggtagtttcagttctccaactttgttattctgattcaatattgtgttggctattctgagtctttggtgtctctatataaactttacaatcagcctgtcagtattcacaaagtaacttactaagattttgattgagattttattggatctataaagttgggaagaactgacagattggcaatattgaatctttctatccatgagcatagaatatctcttcatttatttagttctttgatttcatcagatttttatagttttccttgtgttgatcttgcatatatttcgttagatttatagctaagtatgccattttttgtgtgctaatgtaaatggtattgtgtttttaatctgaaattccacttgttcattgctagtatgttggaaagcaattgatttgtgtatattatattaaacttgtaaatgcaaaaaaaaacagttgttctctggttttctagattcgttgggattttttctacataaacaatcatgtcatctgcaaatagagacagttttatttctccctttccaatctgtaggtctttcatttatttttcttgccttaattctatggctaggacttccaatactagttaagattttgaagtcacaaattatgaattaaattactgtcaaaccttggagataatgtaggttcagttccaggccactgcaataaagcaattgtcacagtaaagtgagtatcacaataaagccagtcacacaattttttggcatgtaattatgtttacaatatactgtagtctattaagtatgcaacaacattatatctaaaaactgtatatatcttaattaaaaatactttattactaaaaaatgccagcaatcgtttgagctttcagcaggtagtaatctttttgctggtgggaagtcttgcctcgacgttgatggctgctgactgctcagggtactggtggttgaaggttggagtggctgtggtaatgtcttaaaatatgacaacaatgaagtgtgccacatcgatgtactcatcctttcatgaaagattcctctgtagcatgtgatgctatttcaggcattttacccacagcagaacttccttcaaaactggagacgatcctctgaaaccgtgacactgctttttcaactaagtttatataatattataaatcctttgctatcatttcgacaatgttcacagcatctttactaggagtaaattccatcaaataaatcactttctttgctcatccataagaagcaactcctcatccattcaagttttatcatgagattgcagcaattcagtcacatcttcaggaaccacttctatttatatttctcttggtatttcaccatatctgccgttatatcctccactgaagtcttgaactcatcaaaatcatccatgagagttggcatcaactctttccaaacttctgttaatgttgatattctgacctcctcccataaatcatgaatattcttttttttagaaaaattatactttaagttttagggtacaagtgcacaatgtgcaggtttgacacataggtatacatgtgtcatgttggtttgctgcacccatcaactcgtcatttacataaggtatttctcctaatgctatccgtcccctagcccctcaccccccaacaggccccagtgtgtgatgttccttaccctgtgtccaagtgttctcattgttcaattcccacctatgagtgacaacatgcggtatttggttttctgtttttgtgatagtttgctgagaacgacggtttccagcttcatccatgtccctgcaaaggacataaactcatcctttattatggctgcatagtattccatggtgtatatgtgccacatttccttaatccagtctatcattgataaacatttgggctggttccaagtctttgctattgtgaatagtgccacaatatacatacgtgtgcatgtgtctttatagtagcatgatttataatcctttcggtatatacccagtaatgggattgctgggtcaaatggtatttctagttctagatccttgaggaatcaccacactgtcttccacaatggttgaactaatttacactcccaccaacagtgtaaaagcattcctatttctccacatcctccccagcatctgttgtatcctgactttttaatgttcgccattctaattggtgtgagatggtatctcactgtggttttgatttgcatttctctgatgaccagtgatgacgagcattttttcatgtctgttggctgcataaatgtcttcttttgagacgtgtctgttcacatgctttgcccactttttgatggggtttttttttcttgtaaatttgtttaaattatttgtagattctggatattagccctttgtcagatgggtagattgcaaaaattttctcccattctgtaggttgcctgttcactctgatgatagtttcttttgccatgcagaagccctttagtttaattagatcccatttgtctattttggcttttgttgccattgcttttggtgttttagtcatgaagtccttgcctatgcctatgtcctgaatagtactgcctaggttttcttctagggtttttatggttttagttctaacatttaagtctttaatccatctggaattaatttttgtataaggtgtaaggaagggatccagtttcagctttctacatatggctagccagttttcccagcaccatttattaaatagggaatcctttccccattgctttttttttttttttttggcaggtttgtcaaagatcagatggttctagatgtgtggtgttatttctgagggctcagttcggttccattggtttatatatctgctttggtaccagcacgatgctgttttggttactgtagccttgtagaatagtttgaagtcaggtagcgtgatgcctccagctttgttctttttgcttaggattgtcttggcaatgcaggctcttttttggttccatatgaactttaaagcagttttttccaattctgtgaaggaagtcattggtagtctgatggggatggcattgaatctataaattaccttgggcagtatggccattttcactatattgattcttcctacccatgagcatggaatgttattccatttgtttgttcctcttttatttcgttgagcagtggtttttagttgttcttgaagaggtccttcacatcccttgtaagctggattcctaggtattttattctctttgtagcaattttgaatgggaattcactcatgatttggctctctgtttgtttgttattggtgtataggaatccgtgtgatttctgcacattgattttgcatcctgagactttgctgaagttgcttatcagcttaaggagcattccctttgaaaaccagcacaagacacggatgccctctctcaccactcccattcaacatagtgttggaagttctggccagggcaatcaggcaagagaaagaaataaaggatattcaattaggaaaagaggaagtcaaattgtccctgtttgcacatgacatgattgtatatttagaaaaccccattgtctccgcccaaaatcatgaatattcttaatggcatctagaatagtgaattgttcccagaaatttatttacttggcccatgtacattggagcaattacaatctatggcagctatggccatacaaagtgtatttcctaaataataagacctgaaagtcaaagttactacttgatccatgggctgcagaatggatattatgttagcggccatgaaaacattcatctgcatgcagatctccataagagctcctagattacttggtgtactgttattgagcagtaatactctgaaagaaaccttttcttctgcacagtgcacctcaacagtgaccttaaaatatttagtaaaccatgctgtgagcagacatgctatcatctaggcttttttgttctatttatagagcacaggcagaatagatttattataattgttaagggccctaggatttttggaatgataaatgagcactggcttcatctgaatgtcaccagctgcattaaaccctaacaaaagttaggctgtcctttggaaatttgaagccagacactgacttcttctttctaattatgaaagtactaggtagcagcttcttccaatagaaagctgcttcatctatattgaaaaatctgtccttcagtgtggccatcttcaccaattatcttagctagatcttctagataacttgtgcagcttctacatcagtacttgttgcttcaccttgcacttttgtgttatggagatgactcctttccataaaactcatgaaccaagctcaggtagcttccaacttttctcctgcagcttcctcacttttctcagccttcaaagaattgaagacagttaggaacttttatcaacaataggactgttttgctttcttatcgtttgtgttttcactagagtagcacttttaatttccttcaagaacttttccttcacattcacaacttgggctgtttggtgcaagagccctagcttttgtcctttctcagcttttgacgtgtcttccttgctaagcttaatgatttcaagcttttgatttaaagtgagaaacatgtgactcttcgtttcacttgaacacttaaaggccattgcatggttattagttggcctaatttcaatattgttgtgtcttgaatccagaagactgaaaagatggagcaattatcttcatttctttccatattctgcattctagttctgtgatttcagccatcttagcctggttaagaacccttgttgaagaactagtactgtcatttggaggaaagaagacactctggcttttcaagctgtcatagttcttgcactcatttttatcagctgatgtttcttcaatctttgaagtcactgtcctttggatgtttttaaattttattctatttgaggaccttggggtttgattgtggcaaaaggtgggttcagttgactgggttcatttctggaagattttaggaggccaagcctcagctcaggactccggaactccatgtgctaactctggatgactgctatcaagcctctgctttgttctttggctccttgaaattatgaacctgctgtgctagaagggccgaggtgctcacagaccgctggtcactacactctaatgagtggtaacagctaaagtgtttcatagggtgatggtagtgggattcatctttgtttgcatgtgtcagcagtggtggcagtggcagcacagcggggtgcatgcttgtttgctgcagcagggtgctaggaggtgccagcatgcctgcctccatgcaggcattcacagtagtggcggtggaggctcaggagggcagaggcctgactggtgactgtgtgtgtggtcctgctagtggtgttagcatgggggtagggcactggtgggtgcaggactgtgtccaccctctgtgcatgtttatgcaggctcagggcaggggagggtctgctagtctctgtgcctagtttcacttgcaggggcggaactgcctggctttgtgcctgccaaggctccaactgcaatggcggtacagcagcggtggagggtagagagttgtagtgaactgctgctggcagcagtggcacagcatggttcagtgcatatatgtgctggccaggcagggaagaaggcaagattggccccacgtacacatgtgcggtcaaggcaatgtgggaagtggccctgggcccacaggaagctgtattgtgggtatcgagtgggtgggatggtacgtgacctcgggggccaccctgctatagctcatcagcagtcaggtgcagtccaccagctcagaagctatgatgcagacccccagggtaccaagactgcactgcaaaccaatgtggccaggctggggccctaagagaggccagaagaccaaggggtgcacagatcagactggcctgagtgatggacaagaccaccctgcagagttcaggcccactagttcccctaagactaaagtctactatgacagcaagtcgagttagggggatgggcatccctggctctgctccaatacagatgttcctgcaccaagccctctgtgctccacaactggctggcatgctgcccctaacacttctctaaacttctctccctgccaactcaagtgtccatcatggtctgggggtcttctcctgccaggattccagaggcccatggcaagagagggttgctccttgccagttcaactcacccattcccccattgttgttaggagccagtaacaagtcccaggcatggtggccccgtgcagggtccccagcttcctccaacttcagcccagcttctgtgtcttccctctgcctactctcagtgccttccctctgcccactctcagtgccttccctctgaagatcttctaggagtgcactagttgtcccagttcccttggtggcagctgttccacctggctgtgtcatcagccatcttgcccaaataaatttcttctgaagtctatttaatctgatactatgtgatatggcctctgctgcttccatttatgttttcataatgcttctctttccatccttttttttttactttcaacttgtctatttcattataattgaagtgcaattattgtagacagcatatattttttatccactctgctaatttttttcatttaattggtgtattaagatcatttacatttaagataattatatatgttagagcttaattccccatgttattgtttttgtttgttcaatctgtcatttctgttttcttgtcatgccttcctgtgggttacttttttacaatttcattttgattaatctaaagtgtttttgagtgtatctccttgtataggtctttcagtggtttctctaggcagtatattatatgtgtgcctatacatactctctctgtgtgtccgtgtatcatcgtgtagtggtgtcagcattttataagtttgaatgaagtctacaaatcctccttccttttacatcccttttccctcccctatttataatataattatcttaaacatttcctctctatacatttagaatcatatcagatagcgttataatttttgcttccactgtcatacatttgagacaattcaagaggagatgaaaagtctattgtatttatacatatttctattctttccattcttctttcttcttttctgatgttccaagattccttcttttatcattgccattctctttagagaacttccttaagtcttccttttaaggtaggtctgctggtgacaaacacgttttatttcatctgagaatatcatcatttctccttcattcctaaagaatatttttgggccagatgcagtggctcacacctgtaataccagtactttgggagcccaaggtgggcaaatcacttaagctcaggagttcaagaccagcctggagaatgtggcaaaaccccaactctgcagaaaatacaaaaattaggtgggcatgattggtgcatgcctgttgtcccagctactcaggaggctgaggcaggaggatcatttgagcctgggaggtcaaggctgcagtgagccatgattgcaccaatgcacaccagcctgggtgacagagcaaggcccagtctcaaaaaaagactattttcaccatttataagatttcgcattgatatattttttttggcacttaaaaatgtgcaacttccttctggcttccatgatttctgatgagaaatccactgtcatttaaactgtttttcccctataagtaaggtgtaatttctctcctgctgctttcaatagtttgttaggccaggtgcagtggctcacggctgtaatcatagcactttgggaggtcaaggaaggtggatcacttgaggtgaggagttcgagaccagcctggccaacatagcaaaatcccgtctctactaaaaagacaaaaagttagccaggcgtggtgatgtgtgcctgtagtcccagctactcgggaggctgaggtgggaggatcacttgaacttgggagacagaggttgcagtgagccgagatcatgccactgcactccagactggatgacagagcgagactgtgtctcaaaaaaaaaaaaaaaaaagaatattttagttttcacaaattttgctatgatgtattttcatgtaactttatttggggtttatcctgtttgatgttcactcagcttctcgaatctatacgtataagccttttgccatactggaatattatcagccattatttatttgagtgctttttgaggttttccatctttcctctttccttccaagtttccaattatacaagtgttagaactttcattattgtcccacagacccctgtgactctgtttatttatttttttcgtcagttttctcccagactgggtactttctatttttatatctcaagctcatgtattctttcctctttcccttccactctgctgttgagctgatccatttagttttcttcatttctatattattcatttgaataattttcatttggttctcctttatatcttgaatttctttgctgagacttttttcatttgtttcaatcaggtttgcaattgtttcttgaggcatcgtaatgatggcatccattgactgccttttttcagttgttagtttccttgttcttggtctgatggctgattttcaactaaaacctaaatatttaggtaattttgtgaagagactctggattgcatttagatctgctgttttagcaggcttactataaaactgttttggcaggggataataaagaaggaggagtgcctcctcattattgccaggtgggaatgtaagtcaaggttctccatttagtttccactgacacttgagttggggaggtgccccatagtactactgggtagaagtggggattcaggccccccactcagtctatgttaataacaccctagctgcattggataaaagtggctcattgcttttccccatgtgacctccaatgacaacacagggcatggacacattaatgctaggtgaaagtccagactctccactagccttcctctgatcatatccaagtggggaggggaagagttaccttattaccacttagtggaagtccagactttccatatggtctccactgacacctcaggaacagaagtgtcttttagggatttaaattccaactccccacttggctttttctgacaccaccctggcagggggccatttgggtattttgtgatagcttgatgaggccagaaatctagactcctgacatggccttttctggctaagtagagccatagtgttttctgtagtatttgacatagagcagttattttctcaagttttctgtgttactaggctcttttctggtcctttggctagaaagagatggcttctatttgtggcttttttttctgttcccgtgttatgtatgggttgccagcttcttcagctccaagtctgggttatatgaggcaaaaagaaaacccatgaaactcacaatcgtgttgttccttaggtcctgtggaccctagtcaatctgccttctactctgaatttttcatgatgggttaatatttgtttcataatgtccatgggctttagttttacttagtggggggagtaggaaaaatatgttgactccatcttcccctaaaactagtttgtttggtttggtttggttttttgtttttttttttttttttgagatggagtctccctctgtcgcccaggctggagtacagtggtgcaatcttggcttactgcaacctccacctccagggttcaagcaattctccagtctcagcctcccaagtagctggggttatttttgtatttttagtagagacgggatttcaccatactggtcaggctggtctcgaactcccaacctcaggtgatccacccgccttggccttccaaagtgctgggattacaggcattagccaccacgctcagcctaaatctggtttttatatcttaaggaaatgcagaatttctggcactacagttgtcaataagtacatgtaaactaccttcgcttcactgagaagttcccatttgaaatactcaaagctaaaaagaataattggtggcaatgaaaaatacctatcattggtgatatcaccaaaaatggtggagtagggaactccgtacctccatgaaagcaataactaagcaggaagaaactataagaataaacattttcaaattctagaatctaatttaaataaacttacaccaactacaaaaaccagggaaatgcttagttaaaaaaagagactactttgtcagatgagtagattgcaaaaattttctcccattctgtatgttgcctgttcactctgatggtagtttcttctgctgtgcagaaactctttagtttaattagatcccatttgtcaattttggcttttgtggacattgcacttggtgttttagatatgaagtccttgcccatgcctatgtcctgaatggtattgcctaggttttcttctagggtttttatggttttaggtctaacatttaagtctttaatccattttgaattaatttttgtataaggtgtaaggaagggatccagtttcagctttctacatatggctagccagttttcccagcaccatttattaaatagggaatcctttccccattgcttttttttgtcaggtttgtcaaaaatcagatagttgtagatatgtggcattatttctgagggctctgttctgttccattggtctatatctctgttttggtaccagtaccatgctgttttggttactgtagccttgtaatatagtttgaagtcaggtagcgtgatgcctccagctttgttcttttggcttgggattgactcggtgatgcgggctcttttttggttccatatgaactttaaagtagttttttccaattctgtgaagtaacttattggtagcttgatggggatggcattgaatctataaattaccttgggcagtatggccattttcacgatattgattcttgctatccatgagcatggaatgttcttccatttgtttgtatcctcttttatttcgttgagcagtggtttgtagttctccttgaagaggtccttcacatcccttgtaagttggattcctaggtattttattctctttgaagcaactgtgaatgagagttcattcatgatttggctctctgtttatctgctattggtgtacaagaatgcttgtgatttttgcacattgattttgtatcctgagacttaagagactactaaattttggtaagagagtgatacaacatgctgacttccctctctgccatcccctattccccagcttagtggcggccttggagatggtagtctacattactgatgtggctcgctgctgcaagggaagcaatatacatcttcatctcagaaaactatggttatatattttggcctgcctggtagctccctaaggtatgggctcaggaccttgactttattttgcccaccttggaactttctcagagctagagtggcctttttcataatatttgttgaaagcacttaaaggcaaatgtactagccacagccaactgaggcaagggataatagatggagcaagcagcagacagaataaaaagcctgggaaggaaaaggctggggaagcagatacatgagaaaaaaaatgctctggaaagctcctgcaaatatcagggaatgtaggaggtcagatacatgctgagggtcagacctattctcagaaaatatgtgaaaagaccctaagctttcacctgtggcttacttttaagctctacagaagcaggacatggctaaaatataagtggcccagctaagcattgaagataatacaccaacaaaaagccaatctgcaaagactaggagaactattgttatttttctggaatttaaggaaatctctgcgaaatcactatctgagaactaagctaactgacagagaattcactgactacatgtggcaaataacacaacctttacaaacataatttagaaaagctactaaactaacaattacaacccacaacaagtagcaacaaaaaatcctagagagaggtaaaaatctgatttctaccacattataatattgaaactacccagttttcaacaacaacaacaaaaaattatgaggcattcagaaaaaaaacaaaaacgtatgccccattcataggaaaaacaattaatagaaactgtttatgaggaaacccagatattagacttgctagtcaacaaatttaaatcaactgttttaaatatgctcaaacagctaaaggaaaccatagaaaaataactaagggaaacctggagaatagtatctcaccaaatagatagcatcaataaagagacagaaataataaaaacaaaacaaaacagaaattttggatatgaaaagtacaataattgaaatgaaaaactcactagaacagttaaacaacagatttcagcaggtaaaagaatgaattaatgaacttgaagataggtccattggggttaccctgtctgtgagacaaaaagaaagaaaaatgatgaaaagagcctcagggtcctgtagaagattagtaagcagaccaataagtgcacagagagagtcctaaaaggataggagtgatagaaaggagcggaaagaatattccaagacataatgacagagtatgtcacaaatttgatgaaagacattaatctacatatctacaaagctcaataaactccaagtaggaaagctttaaacttttccctgatgaatatagtattacctgtgggtttgtcatatgtggtctttattgtattgaggtacatactttccatacataattcgttaagtttttatcatgaagagatgttaaattttgtcaaatactttttcttcatctgttgaaatgatcatagggtttagtccttcattccactagcattctgtatcacatttattgatttgcatatgttgagccattcttgtatccttgggatgaattatgtttttaacgtgctgtcgaattctgtttgttagtatttttgtttttttttttttgaggcagggtcttgctctgtgacccaggtgggagtgcagtggtgcaaccatgcctcactgcaaccttgatctcctaggcttcagtcattctcctgcctcattttttgatttttttttgtagagacgaggtctcactatgttgcccagactggtctcaaactcctgggatcaagtgatcctccacgttagcctcccaaagtgatgggattacaggtgtgagccaccatgacaaggccctgtttgcttgtattttgttgaggatttttgcattcatgttcatcaggggtattggccagggatattccttttactgttatgtccttctctggtttttgtattagagtatgctgtttttatagaatgagtttggatgtattgtctcccttcaattttgttgactagtttgagaagaattggtatttgttctttaaatgtttggtagaattcagcagtgaggccattaagtcctgggcttttctttgattggagactttctattatggtttcaatttaattactcactgtacacctttccctcaccaaaacccaagctgcagctatacagtgccatcttgaaaacagagccacagctagcatgtatcctgctccaagagccagcaataactgcatcttttcattgctgaagctgcactgccattacaccaccttagtggtggtgcaccattccccagccaagctgttacagcactctatcctctgagaataagctgcctaggaagggctctgtcttgcacattcaggtgactgcagcaaccaaccctagcctctcagagcctaagtccactgctccagcacaaaggcaagtggtactctgtccctagaggaataggtaatcttgccaagtaaagaaactgagtactgcccagtgatgtgcacagtcagcacactcaccagccaggttcactgtccatgtgcaaccctgtgcgctcactagccaggcatgttgcttccaggtgcccctgccccaagttggtgatttggcccccgtgtgacaatggcataccagccagacatgttgcttccatggagccctgccccaaactggcagacttctgctgcctacatacttaccaaccaggcataccaattccagggggtacctgctcagagtgacaggtacactgaaagtgaagagatggaaaatgatattccatgcaaatggaaaccaagagagagcaggagtagctataatcataacagataaaataggctttaaggcaaaaactataaaaagagaaaagaagttcattatataatgaaaaggagtcatttccacaagatgatacgaaaaattttaatatgtatacacctaacaccagagtacccaagtaaatgaagcaattattatagatctaagggaatagactgcaataaaataatataaggagacttcagcatgccactctcagcaatggacagatcatccagacagaaaataaagaaacatcacatttaaaggacacactaaatcaaatggaccaagcaaacatttacagcatattcgaccaaacagctgcagaataaacagtcttctcaacagaacatgaaactttctctaggacagatcatatggtagcctgtagaacaagccttaacaaatttaagaaaaccaaaatcatttccagtatatttttttttaccacaatggtataaaactagaaatcagtaacaacaggaacttctgaaaattcacaaatacacatggaaattaaacaacatgctcttatatgaccaacaggtcaatgaagaaattaaaaggaagtctaaaaatttcttgagagaaatgaaaatggaaatacagcataccaaaatccttgggacacagctaatgcagttctaaaaggaaatcttatagcaataaatgtctacattgaaaaagaagaaagatcacaaataaaaacctaacaatgcaccaaaggaattaaacattttaaaacccaagtaaacctaaaactagtaaaaggaaagaaataataaagagtagaaataaatgaaagtgcccaggcacagtagcttatgcctataatcccagcacttttgggggggccaaagtgggaggatcacttgaagccaggagtttccaccagcctgggcaacaaagcaagacctcatctctacaaaaaattaagattagccaggtgtggttgcatgtaccagtagtcctagccacttgggaggctgaaacaggaggatcatgtgagctcaggagtttgaggctacaatgagctatgattgcattactgtactgcagcttggtaaacagagtgagatcatatctcaagaaagaaagaaaataaagaaaagagaagagaagaaagaggacggacttggtggctcacacttgtaatcccagcactttgggaggccaagagggaggactgcttgaggccaggagttcaagaccagcctgggcaacatagtgagacccccatctctacaaagaaattaaacaactagccagatgtggtggcatgcacctgtagtcccagatactcagggagctgaggcaggaggatcacctgagcacaggaggtcaaggctgcagtcaaccatgattgtggcattgcactgcagcctgggtgacagagcaggaccctgtctcaaaaaaagaaaaggaaagaaaagaaacccaaatcttataaaatggccctacccctatctcccttcgctgactctcttttcggactcagcccgcctgcacccaggtgaaataaacagccttgttgctcaccaaaaaaaaaaaaaaaaaaaaaaaagagaggtttaaaataaaatagatcaatgaaacaaagagttgtttttttgaaaagataaacaaaattgagatgcctttagctggcctaagaaaaaacagagaagattcaagtaaaattagataccaaaaaaagagacactacaactgatgctacagaaataaaaagcatcacaagacagtatcaggaacaattctatgccagaaaacccagataacctataaaaaatggataaattcctggtcatatacaaccttccaagattaaagaatgaagaaatagaaaatctgaacagaccaatagtgagtaatgaaatcaaagcagtaataaaaatctcgcatcaaagaaaagcccaggacttgatggcttcactgctgaattctaccaaacatttaaagaatgaatgccaattttcctcaaactagtcggcacaactgaagaggagacaatatttctaaactcattttataaggatagcattaccctgatagcaaagccaggcaaggacacaattaaaaaagaatatccctgatgaacacaaatgcaaaaatcatcaacaaaatactagcaaacagaattcaatagcacattaaaaagattattcactatgatcaagtggaactcatcccagggatgcaagaatggctcaacatatgccaatcaataaatgtgacacagaacactaatggaatgaaggacaaaaaccgtatgatcatttcaatagatgaagaaaaggcatttgacaaaattaaatatcccttcatgataaaaacaatacattatgtatagaaagtatgtacctcactacaaataaaagccacatatgacaaacccacagctaacaccatattgaacagggaaaagttggaagctcttccttaagatagggaacaagacaacaatgcctacttttaccacttctattctacttagtatttgaattcctagccacagcaattaggcaagagaaagaaatgaaagctatccaaattggaaaggaggaagttaaactatccctggttgcagatgacatgagtgtatacagttggccctcaaacaataccagtgttagaagtgtcagacccttgcacactggaaaatcaatatataagttcttacttaccaaaaacttaactaccagtagcccactgttgaccagaagcctgatcaataacataaatcattgattaacacctattttgtatattatatgtattatacactgtattcttataagttaagctaaagaaaaaattattattaagaaaatacatctactattaattaaggggacatggatcatcataaacatctacatctttatcatctttgtgttgagtaggcggaggaagaggaagaagaaaagttggtcttgctgactcagtggttgcagaggtggaagaaaatccacatataaatggactcacacatttcaaatctgtgttgtttaagggtccaccatatacagaaaacccaaaagactccaccaaaaaactgctagagctaataaacaaattcagtaaagttgcaagatacaaaaatcagcagtatttttatacatcaatagtaaactatctgaaaaagaaatcaagaaaacaatcccacttacaatagttacaaaaaacatatacttagggataagtttaaccaaggaggtgaaagatcttcacactgaaaactataaaacattgatggaggaaattgaagaggacacagataaacagaaggatagcccatcttcatggactggaagaattaatattgttaaagtgtctacactacccaaagtgatctacagattcaacgtaatctctaacaaaataccaatggcattcttcacagaaatagaaaaaagaatcctaaaatttgtaaggaaccacaaaagatcccgaatagctgaggcaaacttgtggggaaaaaaaaaagaagaaagaaagctgaagatatcactctatctgacttcaaaatgtactacaaagctatagcaaccaaaatagaatgatactgatctaaaaatagacacacagaccaatggaatagagagcccagaaaaaaaatgcatatacaggcaaaggtgtgaagaacaaacattggggaaaatacaatcttcagtaaatggtgctgaaaaaaaaatggatgcccatatgcagaagaatggaactaggtacatatctctcatcacatataaaaatcaactcaaaatggattaaaaacttaaatgaaagaccgaaagctatgaaactactggaagaaaacatagggaaaacacttcataatattggactaggcaacaattttttggctatgactctaaaagcacaggtaacaaaagcaaaagtagacaaatgagattacatcaaactaaaaagcttctgctgcacagtaaaggaaacaatcaacaaagtgaagagataacccacagaatggaagaaaatatttgcaaactacccttctaaaaaggattaataaccagaatatataagaaactcaactaaatagcaaagcaaacaatctgattttagaacgggcaaaagatctgaatagatacttttcaaaagaagatatacaaatggccaataggtatatgaaaaaaatgcaacatcaccaatcatcacgaaaatgcaaatcaaaaccacaatgagatatcatttcaccaagtttgaatggctattcacaaaaagacaaaacatatcaagtgctgacaaggatgtggaaaaaggggaacactcacatactatcagtggaaatgtaaattcgtacattcattatgaaaaacagtatggacttcctaaaaatataaaaagagaactgccctatgatctatctggcaatcccattactgggtatatatccaaagaaaatgaagtcattgtgtcgaacagatatgtgcactcccatgtttattgcagcactattcacaatagccaagatatgaagtcaacctaagtgtccatatggatgaattgagaaggagaatgtggtatacatacacgaggaaatactattttagcaataaaaaagaaagaaatgctgtcattcacagcaacacagatgaggttggagaacattatgttaagcgaaataagccagccacacaaaggcaaatacagcataatcactctatacctcatatgtagtacaattattgtgtcaattaaaatttaaaatgtaatagcaaaaaaatacaataaatactcaactgaaaacagaagagaacatcctaaacatgaaaaaggaaatttgtgaaaaacctacagctaacatcaatactcaatagtgaaagactgaaagctttccccctaaaatcaggaacaggacaccagtgcctcttttcactacttttactcaacactgtactggaagttctagccagagcaattaggcaaggaaataaaagacatccaaattgaaaatgaagaaatagaattctcttttcagagatgacatgatctaatatttacaaaatcctaaagaatccacaaaatgagctattagagctaataaatatattaatctctgttttgtattctttgtgagtgcctcagcctgcagaagctttggaaaaatatagcaaacattaccagcacactcctgatttgtctcatttttcttttctttgttggggaagggaaagacaagtagaagatacagaggaagagtaaatgaatcaaacaaacgttatcttgactggttgtattcctacaaatcaactataatttcttatttatttccctaagcaggtaacagcaaagccctgaaaaccaaaaggaattgggctcttgttttcagaagcagcaatgtatgggtgatatgaggacagagtatcctactccatagccaggcttgtacagatggtggcagctatccaaggagaagcaaggaagctgagaccctgggacctgctataagaaaggagggaaaaacttaagaacttactgaatgttgtagggcacagtactaggattgagtaccccatacatagtgaagcctttatagagagggttcctgaagtctggtttcctctgaaccaagaaaggccacacagaatgtgttttctcatagactctgttagaaaagaaaaacaagccaaaaaattaaaagcaggaagcaagtaatctcaatagtcctgttgaactgataagcagcaaattttactaataagtaacccagctcaagaaaggacgacaggatatgacagaagaaaaataagtggataaaaagtgttgatggagtaacaaattatctgggcttcaatttatccatctttaaaataaatgagaggttagaaagagttccatattggagaacaggagattctaagtccagtctctgtgtggaatagctgtgtgatcttaagaaaatcccgagtttttttctgggcctatttcctcaccgttaaatgtgacctctaagttatcttccaaatcaaggattttatgaactaatgacttttctggttttaaaaattctggaattgcttttacaagtctggtaagttaagtgataggttctatggggtgaatttctggctcttctatatttcattttacttaaagccagctacttctcccttcagaaggtttaagacagtgaaagacaattggaaatttatactagaaaatgtcatgagttatcccaggtgggcaactaaagattatggcatttatattacaaaattgattcttatactttagttcagaccatggggaggctgcttaaccagtaagcaagtcccttagttaacacctcaaaatacatgagatccactggttcccaaagagagttactgtataaccacccatgagaaggtcatttgcacacacaccatgtcaaaggaagctaaaggagaactgaagagtgatataagtggtaagacctaaaattgtggtcttgtaacttttgcaattgtcagagcatttcagtgaggccaaaggctttgtacatccatctttctcatttgctgttggtttataacagaaaaaaaaaaatattgcgttggtaaggtaactaatttgttgagtatttactatgtgttcaaacactattccagactctttacctaaaatacctccttaaattttcccaataaaaccttgtgagatattttagcccaaaattactaatgagaaaatgagactaaatattaatttgctcaaggtcacatagctagtaggtgagagagccaaagtttgaacccaagtctgcctgattctaaagcccatccttttctgttcatgaatgaatgacacttctgcttattttaagtaatcactattttaaaatatgttaaaatgttcaactgttatgttttttaaatggatattcagatttgtgtgaaaaataccacatatattgaccaattttaagagaaggaaaaagattatggaaaagattctgtgttttaacgcgtaggtaaacaaagacagaatgaatatcttaaaagaatttggggagaaagtgacaaaggtctagttgtaaagacagagagagagaaacatgcatggcatcaagagagaaactaccaagtaagtacaaatgttgaaacagaaagactcattattgttctctatgttgacaggaaaaccaaatcacagagaagtaacttcatcttgctatgctataaaggggcctgagggttgggctaactactaactcagccaacagctgtgaaataggagtgagttgtgaaacagctactatcctatttctttttctctgtctctaacataatgaaaatactgttcacaggagctctaccttgtcaattttgaaaagtacttatgtctcatatattgccaagctgttagtttaagtgaggggtgcaaactcaactgcctactagaactaggcagataacattagaaatgggctaagaataaactatagagaatggtaagaactgcagtcaacaagagtgagtttgcctcatccaaatggaacagctactattcagctctagctgtttattatcatgagaaaatagtctagtattgccagagctcctgatttttcagaatatttagaaaaaacatcctaaaataactggattttaatgtgaaatctactgatatttaaatgttagcaactaggcataagaatgacacaatggactttgggaactcagagggaaagggtaggaagcgggtgagggataaaagactacaaattgggttcagtgtatactgctcaggagatgggtgaaccaaagtctcacaaatcaccactaaagaactcattcatgtaaccaaataccacctgttcctcaaaaacctacggaaataaacaaaaatgtcggcaacgaattaggagttttaaaaaatactccacagattaaacaaaccacgcctgttgggttgggttcggcctatgagctgctagtttgtaatctctgatatgagtgagaaaggactgtagataatgactactcatacctgcacagcaattaattatttgcaaaggccttgtacatccattattttactggatcctcatgactgctctaaaaagtaggcattattatccctattttacagatgagatatcttagggttctgagagatctctgtgcaaacattgagtgctttatgcttcaaaagttctttttattattgttatctcctcccctttcttgactgctatgccaaattcagggtggtaggtacattctttttgcactgaccaccttctccctgttcagtgtcttctcacaaagtaaattcaccttagatcttcccgatccttctggcagttaccaaggaagtttccaaactggcaggagaaaacatggtcatgaatctccagcaggaagttttcattaaactcaaaggcacagggaaactgttccattaattgccagatacagtctaggaactgggtgaagataggggacacttctttagagtccccatcgaggtggccacacctgagagatgaaaataaaggtaaagaaagacactagttagcattaaggattacactgttgggaataggctgtaagagggtcatcttttgtctctgttggtagtggcaaggaaacacctcataccaaaatgccagccagaatctcaaagctagtcaatcccagcagacctcttagctgctggtgtccttcactgtcatccatactgtaaaccctttggtcatctagtctatttttttatacaccctctttccaatagaactttctgcaatgatggaaaatttctacagttgtgttgtccaatatagcagccactaactgttaagcacttgaaatgtggatactgtgactgaggaactgaatttttaattgtatttaattttaattaatttaatttaaatagctacatttagctctatgtgagcaacgaccacatctatattgtttactgcatagtgcctggcacaaaataggtattaaagaaacatttattaagtacatgaatgaaacctcatcccagaactgtttaatatttcctccccacaatgttttctttaccaaccctatcatcgactgaaacactattccactggaaatgaacacggcactctcagtttctacactgaatgttctctaccttctgatataattacaacctggctcacaacgataccacctttccttggggtcaaataaaaatggagaatgctgatcattccactttccacataccataattctaaaacaaagcagaggtgggtttagctttctccttgcacctactgctgcttctgctgcttccaagctactattcttttcatgcccttaagaacacttcctttatgggtcatgctatttagcttatttaccttctccttccacaatgctgtcttctagaatctctgtgtcacttccctacattctctgaataatctgatggtcttaagcttttgtgttgatgtagatgacttacactagctcaacagattccttaactaacgcaaatcaaattaccttcactgatctttacctctactccagccttttgaatccactggccacaggctggctagtagttcttactccatctttgaaatcttaatcacgatatcccactctgaacaccatatattatatttccaaaggctgctcatcttcttaactcctgcagacctcatctcaggacatctccacatgctagattcctgttggcttctcttttttcttatcaagcctaaattccatgatctgccctattaactactctctccccattttgttcagctttctggtctttcttgtaattattttccttctaaatccaaccacagatcagcctgaaaagctatgttctctgcttccacatcctgactgattaataatgctcaagaaaattataaaatcatacaaattcacaccattcaaattgagtctccacattcagctgtgttttaactgctctcaaataatctttgtgtaggtccttaacaacattttctcattacctttacagctcatacaaattttcaactaccttgtcaaacccctaatccatttcatatcttccttcactccagtgccactgaaaaatatcaaggccattaagtagaaaaaaaaatttctaacttctgcctctaatattcacatatagcaccttttctgcctgtctttccacctaatctccatggaaaaggtgttcttcattatagctcaagctaatctttcgtttggactggaactttcaccgatttgcccagaagtcttactctaccaaaaactcactgttttggcatatcttccaccttatcttctttaatgtttctttcttctcagcataagaaactgctcaaatatctcctgtcttgaaatacacttcctcagacccaaacccgaccccttctcttctacccccttgagagccaaggttcttggaaagagatttatatactcacattccacttcttcatccctcactcatgcctccattcacaaacatttggcttctgctttcaccactttgctcaaccagttatcactaaagatcattaaaacctgcatattgccaaagtcgattcttgggttattctgaggcatatgacactgctgactactcccttgagattctcctctcttatgtttcttctttcctatccttagatttattcttatctcactaatcactctttcacagtcaacttcatggacttcattcttcactagactttcaggtgtcagtattatccaaggctctgtcccaccccttggctcttcttcctctttatacaattttttgagttaccttatctgaatccatggtttaaactaccaattatatgcagataactcttaaacctctacaccacctctctatccaacccagaactagtgagctccagattactactgaatagtctccctactagatatcttctcctggatgccctatgccaaataagtcccaaactgaagccatcttccccaccaaacctgccctgtattatcctatatcctctatctcaataaacccagctacctcaggcagaaacctttgagttttattggactttttctcccatctcctggtgagttctacttcctgaatacccttgtatctatatcattgcttctgtctttttttcaggccctcatcaattctggtagcctactaattcagccccttgccaccaatttcaatcttctacatgctgtcagagggatatttgtaaaatatagatctgaacatcatgtcactgccttgttcaaagtcctccaatatagctttactatgtacacaaaacactcaaatctttcagcttaaaaaaaaaaaaaaaaaaaaaaaaacagggctctgaatgatcttctcctcactggctcggcttccctggcctcatttcctctattctccctacacaccctttgacccagccacactgaattgcttgcagctcctcaaacacgtaatcctgtttaatgcctttatggtttcaaacacatcagggctagaatgctttctccctttctaaataacatctactcatactttaaatctcagttaaaatgtcacctattacaggaagccttctttgccccagaatggataaacgtcctttgtttatgttttcctctgtcttaagcacttatcatactacaccgtcatcactgatttttcttttctttcaaagatgagataggaactatatctgattcagctctgtcttctcaatacctaacataatgactggtccaatgtttgtgggtgaaggaagaataaataaatggacccaaatggctagagagtggcaaccaaatgaaattaaattaatgcatatcaatgggggaaaataagacctgaattataatctccttggggtaaaactcaattttttttttttttgagatggagtttcagtcttgtcacccaggctggagtgcaatggcatggcctcagctcactgcaacctccgcctcccgggttcaagtgattctcctacctctgcctcccaaggagtcaggattataggcacccgccaccatgtctggctaatttctgtatttttagtagagaaggggtttcaccatattggccaggctggtctcgaactcctgacctcaggcgatttgcccgccttggcctcccaaagtgctaggatcacaggtatgagccactgcacccggccaaatctcaaattttatttgcctttggaatcagcttagtgtctgatataatatacagcacattgttaggcatttgacaaatatttatcgattgttctgataacacaggtaaagccttagtgaggcagtttggtttatagcagacaacagataaatataagcccttgtcctcatcccttaaaaaagaacaaatctgccccttttatcttacaaaaggttaaaaggtgcattgtcttgatattagtccctctgaatgacctcatcattcccttgttcttcctgttaaatttctattcatttccaaaaattcatcctcaaatgctgtgtactcctggaagcctaccctgacctcttcgtgcaatgttaagcacttttccttctgtagcctgtgatgccttgttcttccttgaaatatttaacaatttgatataattacttgtactccttgaaaacagggataatattctggttacttttgtcaccttagtgccctagcatagtatctagaatacttgtttcttgatgaaaagagatttatgccatgttcaacttcctcttccttcctttacatgtacatactgaggttttgatatacttcaccctaatgaactatcctcagccccttccttcaaaatgagtatatttttacctttgggaaaacttgtggcccatggatatccattccttctctatcaagatcttcattttatagaaaagaaagtgtttgcattaggaaaatcataaaatgaattaaccatacacacaagaatgtcaaaacactttgctgaaatagttgaactgatcataaaatagttaatttcctaaatgataaataagtaagtaacttagatttcattcataagcctatacagggtgccttcaaatttcagatgctctcagacatatccagagtcaaatttcctttggctttcacatgtgtgacaagccactgagccataactaaatgcaatcctgataagcacgatattaaattcacactttgaaaaacagaaatccaaaggc

SEQ ID NO: 8171 - DNA, 1135 bp, artificial
  synthetic oligonucleotide
gaatctgactatctgttagagatttttgtagaaaggattcaggcctcatgagtggatggactagatgggtgctttctaattccttttacatgacagaaaataatacttgtatgtatagcacaccggaggtaaacaacagggctgcttgtggcttgagtgactagtttccctaggtcctacacaaccattttgagggcaaaagggattcctctgcacacttataattcacactagtgtgccttggtacactgatttggaaacccaagatgagatgacttaaggcttttatatacttagattccctggagctatggttcccatggtgtcattccaagaacagcacagtcagcataacctgggcacttttagaatgcaaactctcagcctttccctaaaactactaagtcaaaaactgtgagagcaattcatgggaggaactgtggaagctcagcaattcatatttcaccaagctctacagaaaaaactgggtttaagtcttcatatttgcactttttggctgtaatctgtgggaaagtcactttgcctctctggaactcagttatataatccataaaattgggtgaataaactatctccaaagattaaatgatatatttataaagtgtgtagtgtagtgctcaacacataatagttattcagtaaatgttagttctagtcccatcaacaaaactgaactgaatttattttaaagaacatttatgaacatattcagtagcatgaaattgcacaaaatgatacagaaagcaaaaatcacctacaatttcatataattctcaatattatgtgtctataattccagtcttgtttctgtacccagttatacttagaataaatgaactgcctaaacaacttctaattgtgagtaatggctgtacactgccaattcttgattgtccatttggctaatcattggtggcaaattaaaatcccaaactggtttccctctgccacacagcatgtatctgtgtggccttcccctgccatcaattaatatttgcttgagaataaaaattccttttcatatcagcctaagggaaacaaaatgccaagaaatcagaaccagtattccagagcatgctagaaataggactcagattacctggaacattatttc

SEQ ID NO: 8172 - DNA, 2037 bp, artificial
  synthetic oligonucleotide
ccaatttttactaagcgcttactctgagccacagtaagttatgtatgttaagtgctttacattcacttttccatttaatcctcataactactctataggtattataattatccccattttactgataaggaaacagatttagacaggttaagaatcttagctcaggccgggcacggtggcttacgcctgtaatcccagctcttcgggaggcggaggcgggcggatcacttgaggtcaggagttcaagaccagcctggccaacatggtgaaaccccgtctctactaaaaatacaaaaattagccaggcatggtggcttgcacctgtagtcccagctacttgggaggctgaagcaggagaatttcttgaacccagaagtaagagattgcagttagctgagatggcgccactgcactccagcctgggcgacagagtaagactttgtcaaaaaaaaaaaaaaaaaaaaattcctagttcaaggaaacagagctacttggtggtggagcagaaattcaaacttggctgtaatttcaaagcccattctctaagccagaaggaagtgagattagattttcatttgatcactggtagaagtatgagaacaaattgcagaaagacaagtctaaaggcaaagaaaccagagagtatgctgttgcagtagtcaagaattgttaggccctattaagggaggtgacccttaaccacctgagttatgcagacgagtgacatagtcagagaagttatttagaaaattaccctggcagcccttgtgaaggatgaattggaggagccaagacaaatacgtaggcaaataaaataaaaacaaataaaagacaaataaaaggcagtgagacaagtagtgaggttgttgggactgtcactcttaaccgcagaggtgcctgtcgaggggctgggagacggtcgtatcccaagtcctcgggcctatcgaattgcagagcatcctggacctctcctcacccacgcttaccttcacgtcgctccttctaggccttaggaagtggggttttgagcactttctaggtcgtaggcctgctggtctgagctccgacagcggcgccagcggtggcagcagtcgccgacaggggtggggcgcatgcgcacagttgctaggcaacggcggccgggcgccgcggcgataaccgcgccggggctgtgtgtgtaggcagaggcgccagaggaggaggagcaggaggatgcagctgcgaccgcggccccaagagggagccgccgctgctctgtggccaggggggcccagggactggaatcaggcctgggggtcgcatcgctgaggggactggtaacggcggtccctccagaggctcaggcctagtaccccaggagggtccgggccgctgggcgagcgccttccccccatcgcctcccctcgtccctccacgtcgatggtggtgaagttggcggcgccacggagcgcaaggcaccaagctgtctcccttgcacccagctcctctctggccccggctgttggacacctgcgccgccgccttctctcgcccgccgagcccaccccctgcggcgggcgggggaggggctcccccctgcaggggctgcgtcgagcagggcgacgacggggaccataggagagtaggggtgagtagtggcaccgcactcgctcggttctagtgcgcctttccggcctccgtggccccaggaggcgagcgaatcgctgctttctcctgcagaagcttctgacgcctctcccacatctgctcgcggctctctattcccttcgaggtagttttccttctcatagccaccactttttggtctcaaccctggcgtccaggaatgcggggtgggtgcttaaggcctggctttgcttcttagatgccatagatgctgataattctacgtacagtcacgcagcctgattcctgattcgtggacagactctcccagtgccgtgctcgcccctttcccctcgctctggctctggctctcgctctctcaggaggctcagcctgaccgcgggcttctcaggagcccattccccgggctgc

SEQ ID NO: 8173 - DNA, 1944 bp, artificial
  synthetic oligonucleotide
cagggttgacttggccctctcctcagttgaggaagggagggaaggaggcaagaacttttcaaatgaagttttatgcagagccctagtagataaaccagattaaagcagagctgtttgggttgaggtaggggagggggccccacataacctgactcccaagacattgaaagtagctgccttaacaggacatcctttcaaggccttagagcttgggggcctggatccctcccacacccaacacctggttaaggggcccaaggccaggcttgggctataagactaggcccacgattgcaagattgctttagggagggtggctctgccctccttctccctggccctgctcataacactcttgcttcccctgcttcccgcaagtcaaggtccttccagctgggtgagggtgacagctgagagcaaagccatcaccctaccctcaggcagatccatggttacactactgcagctgaaagaacccttacggataatctagttccaccacctcccatcacccacaatcttacagacaagttaactgaggcccagagatgggaatggactttcccaaggccacatagccaagtcaggggtggagctgagacaagaagcaggggtgggcatgcccctccacagcaaaggaaacgtccctactacagtgggtgtgggagctgggctgaatcagcttccttcttgactgaacagctccagctgcccacacttcacccttgctatccatggtactcaataagccatccttacccagggccaggctggttgggaaggaggggtaagggcacctctctcagacatgtgaatcccactcccaactacagatctcctggcttccccagctgccacctctcttctccaagaggcctgctggcccatggccttggacagagtccatggcattgccttgggtctggcctgcttctggggcccctggattctatagccctttcccagaatgcccagatgaagaggggttcatctcccagggagtgggcaggcagcaaagggaaagacttagtttcaggggcccgcaggggttcctctctagtactcacaggattatctggtcagaatggcccagcattctggaatgtacaggccctttggatgggctcctttgtgttactagcatagcccctcagcaagggctgcttggttcctggctccctggtgacccaagggctcccacgcctgtgatccagaggcgagttttgagggagagcatgaagccccgtgcaggccttgctaccaaggtgcctggacagtgtggggaggcctactgattactctatgcaccattagacaaatcccttcccctttctgggcctcagttttctcctcagtaacgtgaaaaagctggatgagagcatctatttttgactttttaggagtggtggaccagttagagaatctgctgaaagctatggacccttctcctcccaaaatgtgtgtgtgtgcctgcacacacacacacacacacacacacacacacacgtccatccataagcacaaactgaatgcaatctgagagggatgccaagcccagctgtgtgtggctacttcactggctccccacactagggacagggagagctggcaagggcccagccagggactggggcttacacttcactcatttaggccctgactggggacagctacctcccccacccacctcaccttgtcttctctccctcccacaggtggcagagaaagggggtgagaaatcctgttgccatgggcactcactcagtcttgcatgttgagggttccagccgctgctctagcacaggctggtccaaaagatacatggtgtcataattctccagcatgagctctgctgggtcctcggtctgacctggcattcggcctaggggaaatgtgtcccatcgcacgtcttctgtggagcaaagggaagtggcaagactgggc

SEQ ID NO: 8174 - DNA, 218 bp, artificial
  synthetic oligonucleotide
tgaggtggcaggagagacggagtgggaaaagagttcacaaaaatggtttggggccagattctggatttacagagacttttcacctggtcagataaggtacagagcgtatgggacaggctcccaagatatggacagagttctagccctcccgtatggagagggcaagacccagtacttcatacgtatacaaggccaccaagggacagttaaggtgaaca

SEQ ID NO: 8175 - DNA, 1232 bp, artificial
  synthetic oligonucleotide
gccacaggcaagcaggattctctcttgttcctctgcccctccccttctccaatctctatcccctgccttggcatgagggcctctagagaaaagaaaataaaaatgagtgggcagaaacagctggatacagtcaggaacacatctggcctcccggactgtctcctggtccttgttttgcttctccccccatgccccttcctcctctgcaggcttctgataggaggactgtagcatagctgggggaagggtggggaattagagtggggctgggtgatgggggagaaagttgttctaaatattaactggtcttgtgagatgtcttcttggctggagcctgaccacctaacttactgtttttcctccaactgctgcctcctcctttccctctgctgcaggctggaactaagggcggcgggtggcggcgggaggaggaaggaggagaagcaaagttggccagggtcctgctggctgggggccaggactgcctccctaaacaagcaggcgggggcacatatagccctgggttgagttgttgcccttactcatctggccacagcaggaagaagaggcgcccggaaaaccttagctcttggctatctcttccctgagcacaccctggccctggggcctgagatctctccatgcaggggcagccatgagctccgggggcagcagcaaggctggccacaccacccatcagccacctccagccccgccgctcaaccagccatcagtcccttaactgccagtgttcgtggaccatgcaaaacaaccaagtgagtgaacaggggctggctgagggttgggagaggttcctggacaggaagtgccagcctgtgccctctttttttgccctcagggacaaacatgggaggtttaggcaaactcttctcagggggtaggggacactgaaatgttgatcagtgtaggtgttttgacccccaccccccaaccatttgcttttctgtgttcctcttgccctctctccctctctctctctctctcctctcccaactccccactctgttcttattcctttctattcccaggcaagggactcattaagcccaaagcaattttagggtgcccagtggagagactcacagaggctgctagtgccgatgctgctggtgctgctgctgaggagtgcccaggaccaggtgccaggggagttggagtcaataaccaccactgtcagatctactgacccccaagccagtttctccagtcag

SEQ ID NO: 8176 - DNA, 2587 bp, artificial
  synthetic oligonucleotide
aagaaaagactcacctcatttctcccctttcaaggcctctggctttgagagtgagaagatgactcactcattgcccacagttgccgctgagaacataattgctagctgggacatcaccacagcatccagccatcacatttgcagagtagtgtcttgttttgtcaaagctctttcctatttttctttttctttttttttttttatttcagcttcctcaagctccagggagccagatgaggcagataccattacctcttcttttataaagaagaaactcatttatggaggggtggggggaatgaggggggacctgaactggtgttggactgactgagactaaatccccagtcctctgatttccagctttctggagtgtctgcataaatacccagagtcccagaggagacagcagtgtccctcaaatgcctgatgacagctcctccctcatttattaatcactgagctggggccagatactgtactgggctttcattggagacaaaggtgacagaaaccctgcctttaagtgttcacaatctggatattgattaagtcaccactctgcccatttcaatcctcagctttctcttcttctactagaaaaataactccaacagtgctttattttattttatttatttcttatacatttatttgagacagagtctcattctgttccccaggctacagtgcagaacttggtcacagctcactgaagcctcaacctcctgggctcaagtgatcctctcactttagcctcttctgagtagctaggaccaccatgcttggcttttcttttctttctttctttttttttttttgagacagcatcccactatgttgcccagcctggtctcaaactccaggactccagtgatcctcccacctcggcctcccaaagcactgggattacagatgtgagccacctggcccagccttgttttattatttttgagacagggtctggccctatagtccaagctggagtccagtggtgtgatcacagttcactgcagcctcaacctcctgagctctggtgattctcccacctcgccctccctagtagctgggaccacaggcatgcaacaccatgcccagctaatttttaattttttttgtagagatggggttttgctatgtggcctagactggtcttaaactcctaggctcaagcgatcttcctacctcggcctcccaaagtgttgggattacaggtgtgagccaccatgcccagtccaatagtgctttttggctggagacattgaatcaattttataaccttttcagagattgattaggagtcagaacactaacattctagttccagttctgttacttcactgtgtaatagtgagctagtcctttcctatgcatgggcttcagttttcacatctgcaaaatgattttgtgggatggggtcagaagacagtaggaatatagtttctaagaacttctggctcagatcatttaggagatgaagacactttgtaatctgtgggcagtgttgtttctttgggtaaaaggctggagggtaggagcccgctgggcctgttatgagacctttcatcctgctgtcttcctccttaactttgtgaggtacccttcccaaggagcagggaacttgggctttctgaaaacctcagagggaccccatttctacctctccttaccagcaacactcaggaagcaccagaactattttggattggaagttatttagccagattctgaggttgaagttcatgaaacagagacagaatcagagaaggagaagagagaggcataaaggaagaggcaaagagacagagaaaagaaagaaagaggtggggtcggggggaagagggaaagactaaagaggaaaaaatggaggagagataaaaatagagagcaggaattagagacagacagaaacagacagagacaggaagaaaaagaaagaaacacagagagagaaacagaagagagaaagaaacagagaagggaagaggagagaggagagaaaaacaggggaaaagagacagaaacaaggaaagacagagagagagaaaaaatatgaatgaatatgataatatgatagtggacatacctagtcccaggcagccgcatgagagaagttgcataaaatcctacgtcttgaataggatctagaagtgaaagaacccttgaaaaaatcgaggccagagagcaattgagctttgttcatagtcacacagcaagctggtggaagtgccaggactcaaacccaagactaggatagagtagttcaaaacagactggcctgagagtctagaggtcttgaggtttgtcagtctgtctttgagggactgcgggcaatgtaataacacaggaagagtgccagcacattgtctgctgcagaagaggcactggcatcagggagttttgccctcttcccccatcagctttcctctgaggacgaagacatacaacatacatgcatgcctattaaggctgactagggtaagtttggttctattacacagcacttttgggagattagaggcagacttcatggaggaggtgacttgtgggtcagggcttgaaggatgaaaacaacaaccaaaatttt

SEQ ID NO: 8177 - DNA, 146 bp, artificial
  synthetic oligonucleotide
gcttagtatttctccttctttgccccagtctcttggactgtttctccttttgtcttatcctttctgtttgttgctctgcctcttgtcttttcttctctctcttacccatactccagtctctccttttgttttttgatgtctatggg

SEQ ID NO: 8178 - DNA, 1200 bp, artificial
  synthetic oligonucleotide
cggaaggctggtgcacttgcagttcagtgatgcagccagtctgagggttaatcaggacagagacctttgcccacagagccaggatgatttcatctctatggcaagcatcatcaatcaatcaggaggcctggagctggacaagtttttgggagatgagaagataatgcaagccacaatccttgcctttaggagcttttgttggagatccagaacccatgtcacaggaagagtaagacctctccagtttccaggtcagcttctaaagcttctaaacaagagaagctctcatttctcctgggtctcagatctggccctgagccatggtaggtacttgatccaggtctgctctcagcagagagacccaccagcaagcccctgtaattttttctccctccctaagaacttctcagcttctattttcagatgtcccccaaagcaacaggagcatgggatcattaatcttttgtattaacttgcttgattcttattgctcttgagtctggagacccagtggaaagaatcctagcctgggagtcaggagaactagtctttttcctgaccaactccattcacttcccttggccgtagttttctcacttgtaaaattgggacacgtagcctagatgatgttaaaggtgtaatattttaagattctgatttctgtttttactctttcattgaggatatgggagaggtggatttaggcggtgatgaaggaccatgctctaagattcagaggttctatgagttaaacatggggctctctctcttctcccaagcattctgatactcagaataaatggctggatgtctttggaaccagtcatatggcagtatatttaggactttgttggcctgcagaaagtagaaccagacctcttggcccccagtcccaaagtcttagagaagtggaggctggggagttgggagtggtgtgtgtgtgacagaaaactggagaatggcttctcatcttcccctgtggcattattttgccaacaccacattctctggagccactggagaggctcaggaacacatgatgtggctggtttgaaggggcacttcaaacctgggggatggccccgcattttccccactgagacatagccacatatgggctcacatcttcatgtaaatacatggctaggctgaatataaaccaatgcctttggtgtagtgtgaagtagggggaagtctctt

SEQ ID NO: 8179 - DNA, 997 bp, artificial
  synthetic oligonucleotide
tgatagcttgtgttttcaaaaggctgaattattgtatggatataccataatgtatttaattagtgctctggtgatggacatttatgttgtttcccttgattattatagtattgcagtgaatgtctttgtaaatgcctctttgtacacagtatagtgtttacctaaggcagactgggagcagagctgaaaagatctatgcctgtgtgtgtgtgtgtgtgtgtgtgtgtgtgtgtgtgtgtattgtgtttgttgttgtgagttgggagagagaaagtgatgacataggagaatctgttccattagtcttgtctcctaacaggataagttgaggcaatgtgaaggggaatgtgtgcccttagagaaactgaacataatacaagttgataggcctgcaaggctggaaatgagcagatccctctcttctctggcctagctgagcaacctgtcatgagctccaaggttatgcctagaagtgttctggactccttctgcatggaacaaaaactgtgatccctttatgggagcaactacagcccagcctggaatggaaaattaaaattaaaaaaagcagctgctgacaagacaaagcaggatgtgggagggaggccaaatgagcactgtgaacctactgcaggcactgcggggctgagggagacagagagcacgaggagggcaggaaagaccaagggagggctttgtgcaggaggtagggcccgggaagcccagagacaagagcaagcacacggtgctgctgcgtgcagtgagtagcccagctagagggcacggcctgtgctgaggagccgtgggaggaagagagggctgggaaggtaagtgtgtgcattggtgtgtgtgtgagggttcacctgccaattctgagcacacatgaaggctatgtttctgaagatcaccatgaagatcaccaaatgaccatgtggaggctggcctggacaggcagcctggaggcagggagacgagggaggagcctgttccaacagtt

SEQ ID NO: 8180 - DNA, 1695 bp, artificial
  synthetic oligonucleotide
ggctaggggctgtgaccagggtgggagaggagccgggtgggtctgggtggggagtggtagctaccctaggtccgcccgggcccagccgggccccccacgtggccgctgtggcctggctgcgccgggcctggccaggcggggctgggcggggcaaggccagcggtcggcggggaggcgggcgcgagggcggggagcggcgcggaagccgggccacataaaggagcgggcggcgcgacaggggcggctctttcctgggtggggtttgtgaagtcgtggcccgttagcaggaagcctaacagtcgccccgacgctagtgagggacccaatctgagtccccggccagccgaatccaagccgtgtgtactgcgtgctcagcactgcccgacagtcctagctaaacttcgccaactccgctgcctttgccgccaccatgcccaaaacggtgagtgccggaggtgggcgctgtcgaccccaatggctctggctgagcctcatagccctttgctgatggctgagggcttggccagccaccggcccgcctgggacgccgcgccctccgccatagccaagggtagggaggggaccggagtgggatcctggtctggtgcgccctcaggggttgagggggtgtccaggctggaagtttggacggggcgaggcctgcctctttctcaggttccagttccctgtgtctgagatgcaacagtcaggacggcttcgttggggcctggggtttccccttttccctgatgggccatgggcacagaggagaggattctggtccagaagacaacactttccccaacccaggaattggcacctttctggggcaaggctgccaatgtccaagaggggacatgggaacagagaagcagggagaaaggagggagccgctcggggcggatccggcacccccactcatctttcccacagcctcaccgggtggctccagctgttttccactaggaggtgaggagagagatgtgaggaaatcgtcatcgaggctgcacccgagagcaccaacacttatttaggcaccagtctgaggagaggcctaccccatctcctgggagagaggaccggtttctccctcctctccacctccaaatccctgcccctcctattgcttaatgcctctctatctcctcctatcccctccggactattttgtgtggtgtgggttttctcgtggggccacacctttctagagtggtggttgatttggggatgcgtctccaccccactggctgttacgagaggaacagaagcctcctgggagtggggataggggggccggatgcccaggagggagaggggaggaggggtgtgcctgactaatgagctctgcttgcttttgtgcaagtcatgccaaatggctgctgaggcccttcccttgctcagaaaggcctggtgaccaccctggcttgagtcccttaggccaaacagcttgttgagctggcctaggcaatgcagtgctcccaaacatgtctccccaggactgcttgagccttgtagaggtgagatagtgactagtagccttgaaaagggctgaaggtcccctgggatgagaggaggagagttgggggcccagccttttgggtttgtgatgagctttggttgccacgttactgtataccagcctcactgccaagtcgttcttgcctttccagaaccttgtccttcagaaacaccaag

SEQ ID NO: 8181 - DNA, 906 bp, artificial
  synthetic oligonucleotide
tgataattctctatatttgtaacaagtttcatagttgtaaaactcttttttattgttattactatgtcatttgatattcatcaactctctacagttggcaggttaggaattattatcttttttaaaattattttttaaaatagagacagggtttcactgtgttggccagcctagtcgcgaactcctgggctcaagagatccgcccacttcggcctctcaaagtgctgggattacaggtgtgagccaacacacccagccaggaattattatctttacttttacataagggaaaactggggctcatagactttaagtggctgcaaaaattactcagctaatgagtaatggagacaaggcttgattgggagacagaagactttggttttcgactatgcacggggtggagtgtgggaagggaaggcagtgttgtttcataaaggcctggacttaagctctggtcatggttaggtcagagttctgaagctagaaaggaagtttcagctttaaacatttggcccttcccccgttccagtggttgcccaacctcttttcagtctctcttctaaatattgtaagtcaagactaatgtttagagagagagcacttgggggctgtgtggggatggccacctgttatatttgtgtcctgcctacttggggcctggcctgactctggttttgcaactggcttcctgtgtaacccattcttggtagtgtcagaccactgccttcaaggctaattgtgctttccacctggttgagccaataacttattttgttttgccatgctcctggacatatgggagttgcttattagtaggtgagaattgtttgggggctgcttagacctagctaatgtagagtcttgtttgtaccttggtgggagcaagagcatcaatccaacttt

SEQ ID NO: 8182 - DNA, 608 bp, artificial
  synthetic oligonucleotide
tgcaagctctccaccccaagcagcatcttcacgggaacctggcagccttccatcttcgtatcctcaaactggctggccttgtccttagaagtctccatactgtcctgcagtttgcttctctgattgtgtctagggagtaggtaccccaccttctgctggtagagtcttgttttcctaaagagttgagtcttttgctggacaagtgtggagccactagtattccatttcaggctttaaaaaatggtctaatttgtgctcttgtttagccagttctcagtcctcagacatatatcctagtccttactttgctaatttatgaagttggaggagacttataagacgagcttaaaagaagagcttatgcctactatcagaatttggggatagttggatatagtcagataaaagtggtttgaagatttctgatcatcagtcggtattaaggtaatttcaggaagaaattcccaacagaaagtgattacagacatgggattcagtccccagtgaaagtaatgtattatttttcttaattaccaggggagttgccacccagctgtctaagattatgcaaattgatgatctttcagtgttttctccccaccctacag

SEQ ID NO: 8183 - DNA, 366 bp, artificial
  synthetic oligonucleotide
ccacctcacattgtaagaaggggccaggagctaaagaagataacatatgaaaaatgcaactacccccaggattttaagattcaaagaagtggaaatccttgggagtggtgcatccatacttgggaaagaaggaaatcccttcatctctgcattcatagtcccctgagacagaaagactttttctttcttaggcttccagttgatgtgggaagaatcatccaggtggacctggcaggatgacaggttgggtaatggaagccaggggagtactgtttaatcaagtattcactgttctccagctgggcttaccagtggagtgaagtaggagtggcatgtgtgggaaggggaaagaccaaaaaagcaaaa

SEQ ID NO: 8184 - DNA, 6808 bp, artificial
  synthetic oligonucleotide
aataagcttacctcactgacatggtaagaatcataattcactttcttcctagacagcaatgactagctctgccagattagcttccaatacagagcctgtgcatctcatcctgtaaatgaaaagcaaaggggtgggaaatcaacaagcactgctgccagcaggatgaaggtgaattgaaaaaatggtaatctagcagccaggagacaatctttgaaaaaataccacagacaatacatttcttagattatggcaggtccttgaccaagaaaacacaaaccatatagtattttccagttatagatatttcacttccagactataaagcttactgctattcagaagatttcagtatgtaattaacttgttatagtttagccagagtggaccacagtcgagtaaaataccagagttttcaaattgaagaggtccagaaaagaaggataaaggcaaaaccagattactctgttccctaggaatcctgaataggaagcactcttcaacctgggaaaactttcagcccacaagatgcctttttgcctatgtggtgccaggtaaagatgataaatcacttcactgtccctaatcagaaatgaaatgtgagatattgcaacaacgtaactggctagtccaaatgacctctagggtccttctatctatgagattctgtatatatgcaacctaggctttgaaatgactgtattcctcctagtgaacagcactcagtctgaatctcatcagtagatgagagccacaagacttggggagtgggacctacatcaattgtcagagtgtaaaaaatttgcatatttttaccttaccccatgatatagatcttgacttcattttatagtgccattcattattaaaaggaggtgctgtgaggaccatttatggtattattatcaactattatttaacctgatttaaagagctcaaaatgccagtaaattctaataggtcaggagcctttggtcttccctgtagctttctcagtctagtagaacttgaactcagctttgatggccaactaataatcatcccaaactagttgccttctgaggcaactcagtgccctgaagagtgacgattattttgctgcttaaagtagtacattttggcacaggttcgaggggctggtccacacttaagtttgacattaggctaaggaagctcacatggcccccttttgggtgtgtttgtttgtttgtttgtttgtttgtttctctctctctcttttgaacttgaaagatcatatttatttggagaaaacaaaaaacccacaacacaaaagatgggattttacatctcaaggcatctcccaggtaataagtctacagattacaaattattttcatagaagatatttttctacaaattttgcatgtattcaggagcaggccattaattaattcccatttcttttttaacagggaggcaaggtagaggagagggaaaaagttttggatacaactatttggaaggagagtagacatgaagatggcaaattctagcttttcattacctaaaatcaatgttttttttcttttaaaaaccttccaatcttcagtatatctttaaaagcccacttcttagctactagccaatccacaccaattatttaaattcacttggtagacacctttgtgtgctggctaaattatattcattatgcccactgctgaagcatgcataaaccaacacccctgcatggctgaacagggcctaatctaggactgatgggagaagggcttgtaaacaaagatcaagatgtcttttctctggtgatactgtctaccaagctgatccctacaaaaattcacataaaagcaggcaagtttagctactgtgttgcaagagaaaccaggaacttgttaaatagttctctccattaccatttattctctcaagggaagcttaaaaaaaaaaaaagaaaaagaaaaagaaagaacaacacattagtctgaccacctcataaatccaacaagcattggtgtggcatttcagtggagaagaaaacttgggggaaaaaaccccatcaaggttgtaagaaaggctcccaatttaactgtccctgtccctatttatccacctttattcaccacccaagaccatccattattctagagcactctgatctataaaaggggtcaaagcatcaggagcaggcagggtgtgagaaccaaaaggcaagaaactgatttgcttgagaaaagcagagattcttcctttcacagctctccatggctgagagagagaatgcccaagagatcatctctgtgacttagagactgctttttgggaggttaagagtcgcatgaagaacttaagatgatgacaagagcctaaatttttaaagtttcaaggtttcaacagaacgtagatatatttgaactttcaaaaagcagagtgtttagaaagggaaaaccaggacacacaaaacattgggaattactatgactcccaagtgcttctggctccaggaaataaccattcatgtgtttgctggaggtcacacaatttttccctattacctggtgcaaaatgactcatcacctcccaaaagcttcttttcaaaccacgattttcccatttattttggtcgaatgcagtcctattcgttatggcctatagactcactcccaactcctgggtggtaaaaaaaaaaaaaaaaaaaaaaaaaaaaatgagggaattccccctaggctggcctccaaagtcaggattaaataggaggagctgctggcagcctgctggagactaaaacaacttgaggctaaatctacctttccaagagtggaaaatttattcagataatgtttgagaattcatatatgccacaataggatagaaacgaaacagtagaaatctcacactttcccttatacctccctcctctactgcccaatcagactccaaatgttatatcactgtctttaccatttctgctaaattgaggcccctaggcactaatcacactggcaactgcatggtgacataatgcaccacaacttttccactaaaaatctctagtctctttctctctggctatattggtgattctccagttacttcagtactttaaaggctgcagcagcatgaataagaatttcctttaaaaaaaattaggtaagaaaggtctccaggagatggtgagttttattttgtcttgtctggatagaggtttgatttgctctcgaatgttccagggtggagagaaactaggagaaagcacaggatgttgaggtctctgtggcttaatcttctccctcattttcatcttcaccatcaatggagagagcagcatacttccttgcagaactgaacttggaagctggattttcctcaggtttctttggctcaggtgcagatctggagtctttatcctttttgtcatctttcctatctgactccttccagtggtctttgttccctccctctcctggaccatggctagagttcccagtttggccttttgggatattcatcccatctccttcattttcgtctttccttgctagtccttactcagatggttgagctggagctactttaccccaccaattgtaggggattgctgctctgtgtctgagctctgagattgagcaggagggttagaacttcacttcacccaaccattctcctttggtggaggggctggcattacctttagggactgatcaggtttgggaggtttagaagttggagagtgacagtcttcctccttattgagtgtttcattttctagtgacttctcactcactctccttcgtgcatttctgccggatgtggcggaggtcccagtctgcaatgactcacttcctgtcctcaactgttcccgttcctgagtttcttcactttgtcagcttgggtgtctctcccgaggccgtcgttctagttttggctcatccagctgaagctgcaacttctcgtgttccttctgtagctgttcttctacttctctttctctagcagctgtgtcaacgggctttgcccctccaaagacagaagcatctctactggactgggaggtactagcagtggaatcatctccttaggagcactccgaggctttagattcagtttgggtctttgggagggacctctatcatcacccatataatcatcccgagagtaatcatctctggagctccatgaccgatcatcctgtctgtcttattggtcttcatagccagtcccgcctcctctatagtcatcatccctgtggcacccactgccaaatgcccttctgccactgcctatccgggaatcatagcgtctatcatagtctctgctgccttggtcatcatagcgatcccggctgccacatcaatccatatcccagtgtgggccatcccaatacccatcctgatacccatcgtgataccggtctgaatcataactatctcgatacttgtctccaaagctatcatcacttcttagtcatcaaagctgtctgtggcaggacgagccctccagtctgtatctgttttgtcagaatcccgatttctatcatggccaaaagaacgatcctccctgtctttcccctgtgcttgatcagcaacgtccacttgaattttcctgttacctagagactcttcattgagactcatggaactgagcaggaaatctaggtcctcaatttcagcataatcaaaacctttcaacctctctggattgctgggtttacgtgacaaacgcactgcactgatatttaatcctcgaaagagttccttaattgactcttctgtcatatcataggataggttccctagaaaagcagtgtagggtggtgatttgggaagacggtcgatattgggttcccgagcagcccgtggagcagtgggaaggatggaacggtcaattggaggcaccctatacacttcatcatcattactgtgccaagttgttgaaacatctccttccaggtcatctgtttcatcagcccagggtactggtttggaaacataggtgcttcctccaccaatcctcccatcctcagccagaaagtatgttagggagagtcttctccttcttcttcttttttgctgaggccaccatgttgggagagggaaagagttttgggtgtgtttctcaggaagcttttctcactggggttgggcaataaatgagggtcagtagcagggaataacacaaatataaaatgataaagcatgtaaacagacaaatgtaagcactgctgatgaaggtgaaattcaggcagactcccttcctccacatggtactcaaggttttcatgggtagagatttgctgacaatagtgactttgtggctccaatttagtagtatttctgctgaagcacccacaacctcctagtttcgggaaatgaagactttttttttcttcctatagttttgtgccaagcaagaggtttcaccctacttacagagttaatttcagatataagatggggagggggggattttacactaccaatgcctggctttcatttttagaagatcgcaaaagaacaaataccaaatatattgtcaaagagtgcatctgtggtatatgagaaccaatgataatacgtgggagtgcaagtacagggaaaatgtttccttaattatgttttgttcccctcactataatattatattatactttggactaagaagaacccttcccttccctttttctcttcccttccctttttcccttccttcccttcccttctttccttcccttcttccctttccttcccttcttcccttcccttcccttcttcccttcccttcccttcccttcttcccttcccttcccttcttcccttcccttcccttcttcccttcccttcttcccttcccttcttcccttccctccccttcttttcccttcttcccttccctcccctccttcccttccattcttcccttcccttccctccttcccttccctccttcccctccctccttcccttccctccttccctcccctccttcccttccctccttcccttctctccttctctcccctcccctcccctccccttcccttcccttcccaatagggtctcactctgtcatccaggctggagtgcagtggcacaatcacagctcactgcagcctttacctccctgggctcaagcaatcctcccacctcagcctcctgggtagctgggactacacatgcacaccaccatgaccagctaatttttgtgtttttagtagagacagcattttgttatgctcaggctggtctcaaactcctgaactcaagcaatcctcctgccttggcctcccaaactgctgggataacaggcatgagctactgcacctggccacaagtaattttctaacctcagaagaatatgcctgaaaatatacagatttcttcagaaacacaaatcatacatcagacctaagacccggtataagatattgatcataatttagttttctcctaaaaaatgtctgattggttaaggtttcaaagtaaacattgaatcaatattcaaatgtacaatcagggatgtatgatagaattatgctacttctcagctagatttgaggttcactagctatatacttggatttccaaatcccaatcaccatcgtaaatagtgtttcttggtttatcagaaaggaaagtgaaagagtgtgcagaggtacccttcaaagtctctgcaagcttctgttgatatattcctgcctttcttccactctatccaaagtgatttccagattatgaaaaaaattacaaagtaagcattctctttaaaaacatgtggagaaccccctagtttaaagaagaaagagattttgtacctgttcattataacattacat

SEQ ID NO: 8185 - DNA, 578 bp, artificial
  synthetic oligonucleotide
attctagatgtcatgaagtctgagatcctcaaacttctttctggtgtctttaggaaagcttttctggtgcactgtttttcagatgtgcctattgctagcattctgcacctctgttcagttgatggatgtgatgaagacaacacatgtatgccactcttctgggccaacacccaggtagatggcgtttatgctgttggctttagcagccaatacctgtaaacatttaattcatgaacagaagtttaccattcatacctccttctccaataatatgtccttcccattgtcttgcttcttaaacacctcagctcccagatacaattgatttaatggcttagttctctttatagtacccaggctttaggatatccctgcttacatctgtaattaccattccctcaaacacattaactctcccaaaagattctagctcttcaggtttcctctttataccctcaaaatatatttcagaatattctgcctcctaaatgatcttccactggaagtcttctccagccatttccttctcagatttcctcttctaaaacttccacctccctgaccagacttaatgattc

SEQ ID NO: 8186 - DNA, 1534 bp, artificial
  synthetic oligonucleotide
cattgcactattttttaaagttttctgtatatttgaaaatttgaaaagtaagaaataatgaatgaataaggaaaggtaggttaaaaccatcctaaattatagccccttgttataagctatactagaaatatccttccatatgtttctttgaatgtttttataaacctttcttcagaatatatttttaagttggggaattgctatatcagaggctatgtacattaaaatttttggtacctacacccaaattactctctggaaagatttgcagtcctatcagtttagagttccattagcagtacctgaggaggactccttttcttacaacctcatcagcactggggaaatctttttaatcttgtcaaaatgacagtcttgtaggcaaacgacagcatcaacaaaactcactgttgttttgatttacatttgtttgattatttcatgttgaacattcagtatttattgcatatattattctacttgtgcatatgaaccttttaaagaaatagctttgtctacattttggtgtactttttttttttcaaattttgtctatattttttttcaagtgttattcccttttacatttacactctttataggtgagtgagtagggtaggtgccatctaaaccacttcttaccatcatgcattattacaatttgtaaaatctttgctaaattaatttgtaaaaaagttatctagctattttcaattgtacttctttgattactgatggcatgaaaatttgaaaaaggtctgtgcattgcttgaccatgtcttgtgtccattttagaaattacagccttagtgttttatatatatatgtatatatatacatacatacataacatatacacacccacatgtacataatacatattaaaagaaaaaaattaaataatcagagctgttcaaagatgacatggactataatggcaggtagtgagtcccccatcactggagagttttaagcagaagtagggatgtaagagcagattaatgtatgttttcaagtgagagatgttccaaataagtcttaaagtccatttttagtcccaaagtcctatgattttggaaaactgaaacatagggaagattaaattgctgcatttcatatagcaagtaatggaagaacgagaaaataaactcatctcttgactccttgaccagagttctcctcattattcaatattccatgttgctgctactgctgctccaaaatgcctttgtagttcataatctttatttcactgtttggagctgatgattctcattctagtcaatctaagtaatgagtcccatattttcactacaggctcatcttaccctggcttggttgccaagccctttgagaaagtaacataccgctggacagtcccccctcatgccggtcccactgctcaggatcctgcttgtctcacttggatgtacttctctgctgcagatcccataagagacacaaattctggcctggtgggcccgctgctggtgtgcagggctggtgccttgggtgcagatggcaagcaggtatt

SEQ ID NO: 8187 - DNA, 360 bp, artificial
  synthetic oligonucleotide
aacgaaaaaataattttgaaggaattgctgataggatttactgatgcaatagataacggtggtaagggaaatagaagaagtagatgtggaaagaaatgagtagaccctttctttcaacgtgtttataaactagtagaagggatcattttaaaagagaggggcacttagccctttaacatgtggtttagatataaagtgcattagaggtggagaagtgaagaatgtagaactctatttgggccaaaatagtcagggagggctttctggaaaagaaacatgaattgagtcttggataatgagtggactctcatagatacttgggggtggggtgggcaggtaagttccagaaagaggataaca

SEQ ID NO: 8188 - DNA, 406 bp, artificial
  synthetic oligonucleotide
gtaagctggatttgttaggaagtgctatgaatgttctatttgaaagagacctagatctccaatatggggagaaaaccaaggactctgggcccactgtacctgggtctgaatcccagctctaccactgccttggcatgtggtatgtcagcacgggcatgggacttaaaccactcagtgcctgagtttcctcatctgcaaagtggagattaaagtggcactagaatcataggtctattgtgaggattgaatgagctgacatatggaatgcatttgaaaccgtgcctggcactcaataagtactttataagtgtttattatatttttattatttgttccttgagggagaaattgaacacagaggctgagattataagggaaaaagcagggaggagacagggtgtgaagg

SEQ ID NO: 8189 - DNA, 4880 bp, artificial
  synthetic oligonucleotide
ttctcactcatcatatttgcctaccagggggttcctgaggactctgctgtacatcatcctcaatggggtacccggggttacagaagctttatttttctgcttttatgattgaaacattgtgaactgcgtacaagctcttaaagttttccccaagaaatgacccatattgctttactcacatgtccttggccatacacatcacatgatcattaataactacaacaggtacaagaaaatgcaattctacaatgtgacagaatgtggggagctgaaatatttgacaaatagtcataagcactacccacataagtactgttttataaaagttttacagataaaatgcatgaaagtatatattgggttgtgataaaaagttatttcttactctaggtcatggtaaaaaatgtttgaatgccaatggtatagatgagaggcaaacactctagctggctcttgtctcagctctggtactaactttggccatattccttccccccgacccccagtttctgggcatcagaagtcccaacactgaggaaattgaaataaatgctctctagagattcttagatctgacagcctaacttcaacaggaacaaggctcctgcctgataccagtcacagctctttctcaaagaaacaattctagttgtgaaagcatattaattgtatgctagttgtagcagaagctggctggttgttcacttaacctattctttatttctcctgggaacaccattagccaaaattctttaaccccactgcaatgaagtgggggcatgtgcatcatttctagccaatgaaatatggatactaatattgtttgccattcccaggcttgactcaaaaacatgtcctgtgtgatacttaaattttcttcatacattcattttccagtgcatgctgacacccctggaaaccttggaataaatatattaagaatgatagcggaagccagataaaatggaggagtaggcagcttcaagctcttatgcccctacagaaacatagaaaaacaagcaggaactgtcataatcaatgttgtcagaactctggaaaacattcaaaggcttacatcaaccatgtaaatgttaaatcaagaaaaaggtcacttgaaaataataggaaagttttctgctatttttacttgtacttgttacatccctcaccccagagcagtggcagtcctaaagtagtggaagtcttaaagtagcctcagcctgtattcctagtgtgagacctcagtacctgattccagagtgagctaagcaaaacttattgacaaattactgtgtatgtctgtcctaacctatttgagggctatttgaaggactgatacaaggtatttatgtatgttccactcgattgagaatgcagattggaaaagtgatgggcactgtttcaaaatgttgcaaggcaaactaacaaaccacaatacctagggcaatgattatggattaagacataaaacagactgtctgaatctgggagcaaaagctgggggaggttcctttagaaataagtacattcaaaagtatccacatggaggaatttagaaaggtgtgtgcatacaagacacatgctcagaaaatactagtggagacctaaagcttacatgtcaggctgatccctaagctaagtgcacatctggctaactgtttaagtagttccccagcacagagccaatctaaaaatgtgagagtaatgtgtgactattttttcttttggttgttgttgtcattttttaacttttagcattcaatgaaattgctgtccaaacattagctgaacatgagctaaattaacataggtttcaatggcgatacatgacaaaaaatagtctctacaaaaatagtttggaaaaacacctaaacaaatggagtgctagcctaggcaacacggcaaagccttgttgccaaaaatacaaaaattagttgggaatggtggcatgcacctgtggtcccagctactcaggtggctgagatgggaggatcgctagagcccgggaagtggaggctgaagtcagcaataaccatgacactacactccagttggggtgacagagcaatacccagtcccaaacaaaataataataataacaataatgataataataacaacaacagatggactactatagccttcaacaacacaaatctagaaaacaaacaaacaaaaccaaaaccaaaagtaaaacaggaagaggggaaatctgactaccagagttacttcattacaatacaaaactgcccagtttttaacaacaaaaaaataaatcacacagtgtaaaaagaaacaggcaagtgtggcccattcaaaggaacaagaaaaagaaagaattgagactattcttgaggaagcccagacattgcacttagtagacaaagactaaaagaactgtcttaaatttgctcaaagacacacatggacaaagaactaaaagaaatcaggaaacaaatgtataaacaaagtgagaatattggttaagaaaaattgtaaaatggaaccaaacatgaatactggagctaaaaagtaagataaatgaaatgaaaacttcactagagaatttgagtaggtaaaagaaagaatgagcaaacctgaatgtaggacaatttaaattatcaagtctgaggagaagaaagtaaacagaacataaggaacttgtggaacatcatgcaggtgaccaatatatgcattatgggattcacagaaaaaacagggagatgggggacgagaatgaatatttgaagaaataatggcttaaaacttctcaaatctgatgaaagacataaattaacccatccaagatgctcaagaaactccaagcagagtaaacataaagagacctatgctgagatacactatcaaaaaatgtttatagctgaaaacaaagagaaaatattgaaaatcaagagtgaaattacttgtcaagtaaaggtattctcgataagattcaaagcatatttctcatcacaaagtgcagagacttaaagtcagtgagatgacatataagtgcctaaacaaataaactgttaaccaagaactctatatacagaaaaaagttcttcaaaaataaaggaataattaaaacatccctagacaaacaacagctgattgatatcatttgacctgactacaagaagagagtccttcaggctgaaatgaacagacaatggagagtaacccaaagccatgcaaagagtaaatatctctggtaaaggtgactgcatgaaaaaatatgattccacttacatgaaatatctagaatagcaaaatttgtagagacagagagtagaggctatcaggcactttggggagggggaaattgggagttattgcttaaggcatacagagactgtatttggggtaataaaaagtcttagaaataaaggggtgacggttgcataacattgtgaatgtgattaatgctgctgaattatacacttacaatgtctaatacagcaaatttgagattacatattttaccacaatcttaaaaatcataatgcagtataccaaaaaccatgaattgtaaacctaaatgggtgaattgactggtatgtgaactgtattttaataaggctgcttaaaaaacacagagctcccataagcctggcttcctgaatggctgagaagaatcttcctactccccaacatggattggagtcacattcaggaataaacccttaacctcttatgtcaccaaactttagtatttgttacagcagttaatattacctgaactaacatttaagttatactttcccaggagttggaaaaagtgagcatcaggcaggctcgaaatactccttccattctgccccatgtttgcccactcaggctttactcaatgccttgcagcctcactcacaatgatcccatctaccaatgggatctgacatgggcagtagtcattttactcatgctctaagtttcttgaaaagttaaagggtttcttggaatctctgctaccttatgtgcaccactggaatggtgatagcttccatatctgcttaaaacagtgagctgggggtcaaattattaggaaatataatgtagtgatgaaaatccctgatccaaggtaatgaagacctatctttaactcccacttttactactgaccagcgatgtgaccttgggcaagtcattgggcctgaattttcttgtcaatccaattggaaataatgctatccaacttatagatttgttaagattacatgagctgaccaaatgaacaaaaggaatatcccaaagcaatggagaatagctggctttttaaataggttatgttggataaccgaatgacaatgtgaaaaatgataaaatttgatacattcctcacactatacaccaaaatagatcagaaatttatagataaaaattaaaaccaaaaagtaccaaaacaaaatataaataaattcctctttaatctgggagtggagaaattttctctaactgcaacacgaagtccagaagcagtaaaggaaagatagatataattacataaaaattttaaaaagtttcagggtaaaagattcataagcaaaattagaagacaaataatgaactagtaaaaagatgtacaccatatcacagactaaagatttatattccgataacacagaactagtataaattaacgacaaccaccttatgagaaactaaacatatattcacagaaaaagaaacacaaacagctcttatttagataaaggatgtctcttaaccagatacacaaacacacacacacacacacacacacacacacacacacacacacagatacatatatagctctgtgtgtgggttgtgtgtagtgcttgtcaccatgcctagaacatagtaatccttcaatgaacagatgaacattaggtattgtt

SEQ ID NO: 8190 - DNA, 570 bp, artificial
  synthetic oligonucleotide
agaatttatgcaatatgaacaacagggagaaaatgacaaaataaaatgaacaaagcctcaagaacctatgagactataacaaaatatagaaaaatcatattgtcagaatcttatgaaaagaaaattttttaaatgtttatctaaaaatattttcaaacaaattggaagaaaacttcacaaatttggtaaaagacctacaagttaaagaggatgaacagatcccaaacagaaaaaaatccaaagtaatgcacaccaatacacatcataataaaacttctgaaaactaaaaaaaatatattgaaaatagccaagaataaatggcattacctatagaaaaacacccattcaaatgatacgacagtgggtttctgtcagaagccatggaagccaagaaggaagtattacatttttcaagtactgaaataaaaaaactgtcaactgcaaatttatatccagtgaaagtatccccagaaatgaagggacataaaaacattctcaggcaaaggaaaactaacagaatgagttgctagtaggcctacccttaaataattctaaagagagttcataaaa

SEQ ID NO: 8191 - DNA, 1585 bp, artificial
  synthetic oligonucleotide
atggaagaaaaagaacagactgctctaggtggcctcagggagaatgactaggatatccaggtacaagctttaggaaaactaagttcagcttagcaaaaggaagaacttttaacagtccaaggctttccctgaagacagtgggctctctcaggaagcagtaaggaacctccctctagaagtgttcaagcagaaactggcaaggatgttttaatgtggaatccattagggtaaaggaaaattacaattcatgaaattctacttgtcaggcactgtgctagacccttggcaggaaatatatcttttaatcctcccaataacaccatgatgtgagtactgttatccctctttttcaggttagaaagctgaggctcaaagaatttgactacttctcattgggcttactactggcatggtgggtgggaggaacaattatttgttgcatctgtttggcattaaatgcagtagtacctcagactgtgtgtaaaacacacacacacacacacacacacacaccccacatacttctaaatgtcttgtggaaataccgatcctagttgggaatgtcaagtacataatatgcttaggatcacaaacagcagataaatagcagacccaggacttgaaaatagctgtgtctagctcagaaggtacatactctttctattgcgttatccacagaagtgagatgggaatgcacaaccttgtaaggtctaagccaacccgaaaagattctgattttctcattcttcctttttcaattccatataatgtatcaactacaaagttctgtagattcaacttttgtgatggcttgttaaattcatcacctcctttctattcccacagccacgacctcagttccagggccttgttccctctctgcccctagtttatccccctcttgtgttttcctattccaatccagctgactaaccttttaccagattactcttcctaaagcagaggatctgacgttttttttaagctcaaaaactttcaatggctttccattgtctgctaaatcaaatcaaaactctagcatccactgtcttttgcagtttaccaccaatctgccttggcaagtttaacttccaattttccgctaatcgtactctaaaatccagctcagctggtgttcttttcatatgccctgagcttccctgccttaaagcagttgttcctattttctctgcttaaactgtcttctctatctccacctgttgaaatcttatctgtgtgccacagtctatcttaaataataatagttaatatttattgagtgtttattttgggccagccactgtgctaagtgtgtgcaagtattttatatggattatctcatctaatcctcacaacagccccatgaggtgggtgctattattatccactttagcctgaagttaacagaaactcagaaagggagaagtaattttatttgtccatggtaacacaagttaaatggtgagcatgggatctgaactcaaatagtctagctctggagccctgaaaggcgttacaatttcaaaaaaagaataaaaaaaaacctttttctgatttcgtatggttcaacttgatacaatcctta

SEQ ID NO: 8192 - DNA, 1282 bp, artificial
  synthetic oligonucleotide
tttctcaagtctcagtttgcttgtctgcaagatagagatgagtaatattccacaaccaagttttgtcataggagttctgttaaaaatgcagaatatctggcacatggtaggcacttggcatagtttgttgatctgtacttcatttttaaaaagtattctaaactgtagtgtttagaaatcacactggtgatgtgagagtatcgatttctcagtttaacatggagaaatagaactggaactctgtgtgtatgtgagtgtatgtgtgtctgtgtgtgtgtgagagagagacaaatacagagtgagagagacagagagagagaaaaggggagtgaaagggagaagtgattcaaggagaaatagtgaggctgttttcctgtgtgtggctttatagtcagagaccttgcctagacgcatggaggaagaacctttgtgaaatacagcctataaaagtaattttaaaaaatgctaatccaggatgtagtttttccctaggtgggggttctgatgagttgtttgtgtgagaaaagtgtagttattgctacatttgtctcagtgtgacaaccggacatgaattacacaccacccaatgcgaaaagttacccttggaacacatgctgactaatcagaaacaattttgccagatgttattaattgcagaaaagctcccctttcctcctcaggaagttgactcaaccctttcagaactttctgtttgttttgatggctgacaaggagagtgaggcatggaactattttatatcctcccaaataatttctatcctagtaggatgggttgtctattgtgcttcttttgtgtcctagaaggcaggacctgaaccttatccaccgagctgggtgatccttaacaaacatcaaatcctgaagatagttctggctttttgtctacacttttcttctcccattatcccccctaccccttgctgtacccaactccactttatctcccagacgtgaataaaacagctacggagaagccgtgatatcactgagtataaaaggctaaccaatggccaaaggaaggctggactcttccattagctcacttttgataagtcacttcctttctctggacgtcagttttaccatttgtcaaatgggaataagacacttcccagttctcacagggtcgctgaggaaatatgcaaaacaagttgtgcaaactgaaagccttcagtatatgtaaggcataataaaaacaaccaatacttattgactcattaagtgcttactatgaactaggtactcttctaaactctttatt

SEQ ID NO: 8193 - DNA, 749 bp, artificial
  synthetic oligonucleotide
caccatatatcatcatagcccatattccgacaataccagaaaacttcagtttattccttccacctggaatgtgccccccatctcatactacatctactatgaatattggaaattatatttactaagtaagtatctcaggacaatctatgtactatatcatattatatccccataatattttattttattatctccattttacaaatttggaaacaaaagttcagataaattaagtaacttggacaagatcactcagccagtgaattctagagccagaaatcaaacaaaagactacaagatagagccccaaatcttttccctggcattcaagtttcttcataacctttttccagcctttgttgaaaggtaatgtgctatagaggttgagagcatgtgtttggatccaggaagtttggatccaaacttcctgggtttgaatcttgactctgctacttgctgtctgtgggatcttcagtaagttacttaacttctgtaggtctccgtttctgaactgtcaactgggaatgatgatgttcataatattaatctgtctcctagggttattgtgaggataatacatgttaaactcagtattgtttctgatatacagtaagtaatgaactaatattaactattggtattactttctataatcaccttctctcattccattactatatattctgtattctgcattgtcctgtttctgtgtattagtctatgtcgttgcctgcatctaatctgtatgt

SEQ ID NO: 8194 - DNA, 1370 bp, artificial
  synthetic oligonucleotide
cagtaatcttaacatttccatctttgaaggaattggaagggtgtgggtcaacaccacttccccagttctttctcagaaaaatatacaatcaagacactagttttcttattgcctatcttcaacactccccagatttagcaaagagtagggaattcctcaagaaatgagacatagacttggagaaatgggcagaattgatgtcaactctaataagacaacaaattggaacattttctcctttttattcgaaggctacattttaccttgatggcttttaaaataaatatcaatttgaaacatgaagaaagcttccttgtctgtggctgaatcactcttgaagttctgggaatcacctttgctcattgtctcccttgctttctgtttcaggtacctgggtctgctctctctcttctcattccttttcctgttattctctcaattcccagaaactcacttatggatgctgccattgttaggaatcacaatcactaataaatcattaaaatttggggtgcaacattatcagaaagtttatcttaactatagaagtggtgtgtgtgtgtgtgtgtgtgtgtgtgtgtgtgtgtctacccattgactgaagaatatttcttctaaaccactgattaaagttttagaatgagaaaattaaaacggcctcaacgaacctgtccttaacttggaaagaaatcaaagaaccaagctgttcctctgacacggatgaaagggcccatctcaaaaatatctgaacccactcataatttccaaataacatgagttcaaggcccaagccctgggggatgtcttctgtagagacagctggagagctacagggaaaatacaaaattcttgcccatttttatctaatcccacgcagatctaatctcatccttcatgaaacacatcttttaatcaaattctgtgtagagagggagaaaaagtacctcaggcataatttatgttttatttttagctcaattaaccaccagagccattaactggcctgtagcttcagggcttatctggaggaaacctcaaaagcttttgggcctcctcagtctgacagccctatctttagtcagtgctatagtagtttagaacttgaactttaagagtcacaccccagggtccccatttccattttattaaaacacaggcattagcaaagcttaatttcactatgataagacctgatttatttgaagctcagagccacagaagacctacttaattaaactagctattgtaagtcaagtccaactttttaatgctgcatggtagtttttaaaaataaatactttttagaagttacaatgatgtctttacttctcctttggaatattcctttggttatattttagtaaacttga

SEQ ID NO: 8195 - DNA, 5806 bp, artificial
  synthetic oligonucleotide
acatagggaggcccagggtctctactgacataaaggaaagatgttttccttataggtttacgtttacattttctctctctttccattcccacttgcatctccacctttacacagggcttatgggacctcctccacaaaagagcagttgcagtaacccacatcatcctctacgcctggctgtccatcaagaggcgaaaagcagccctatataggttctatccttggatagttccagttgtaaagtttaaaatatgcgaaggcaacttggaaaagcaagcggctgcatacaaagcaaacgtttacagagctctggacaaaattgagcgcctatgtgtacatggcaagtgtttttagtgtttgtgtgtttacctgcttgtctgggtgattttgcctttgagagtctggatgagaaatgcatggttaaaggcaattccagacaggaagaaaggcagagaagagggtagaaatgacctctgattcttggggctgagggttcctagagcaaatggcacaatgccacgaggcccgatctatccctatgacggaatctaaggtttcagcaagtatctgctggcttggtcatggcttgctcctcagtttgtaggagactctcccactctcccatctgcgcgctcttatcagtcctgaaaagaacccctggcagccaggagcaggtattcctatcgtccttttcctccctccctcgcctccaccctgttggttttttagattgggctttggaaccaaatttggtgagtgctggcctccaggaaatctggagccctggcgcctaaaccttggtttaggaaagcaggagctattcaggaagcaggggtcctccagggctagagctagcctctcctgccctcgcccacgctgcgccagcacttgtttctccaaagccactaggcaggcgttagcgcgcggtgaggggaggggagaaaaggaaaggggaggggagggaaaaggaggtgggaaggcaaggaggccggcccggtgggggcgggacccgactcgcaaactgttgcatttgctctccacctcccagcgccccctccgagatcccggggagccagcttgctgggagagcgggacggtccggagcaagcccagaggcagaggaggcgacagagggaaaaagggccgagctagccgctccagtgctgtacaggagccgaagggacgcaccacgccagccccagcccggctccagcgacagccaacgcctcttgcagcgcggcggcttcgaagccgccgcccggagctgccctttcctcttcggtgaagtttttaaaagctgctaaagactcggaggaagcaaggaaagtgcctggtaggactgacggctgcctttgtcctcctcctctccaccccgcctccccccaccctgccttccccccctcccccgtcttctctcccgcagctgcctcagtcggctactctcagccaacccccctcaccacccttctccccacccgcccccccgcccccgtcggcccagcgctgccagcccgagtttgcagagaggtaactccctttggctgcgagcgggcgagctagctgcacattgcaaagaaggctcttaggagccaggcgactggggagcggcttcagcactgcagccacgacccgcctggttaggctgcacgcggagagaaccctctgttttcccccactctctctccacctcctcctgccttccccaccccgagtgcggagccagagatcaaaagatgaaaaggcagtcaggtcttcagtagccaaaaaacaaaacaaacaaaaacaaaaaagccgaaataaaagaaaaagataataactcagttcttatttgcacctacttcagtggacactgaatttggaaggtggaggattttgtttttttcttttaagatctgggcatcttttgaatctacccttcaagtattaagagacagactgtgagcctagcagggcagatcttgtccaccgtgtgtcttcttctgcacgagactttgaggctgtcagagcgctttttgcgtggttgctcccgcaagtttccttctctggagcttcccgcaggtgggcagctagctgcagcgactaccgcatcatcacagcctgttgaactcttctgagcaagagaaggggaggcggggtaagggaagtaggtggaagattcagccaagctcaaggatggaagtgcagttagggctgggaagggtctaccctcggccgccgtccaagacctaccgaggagctttccagaatctgttccagagcgtgcgcgaagtgatccagaacccgggccccaggcacccagaggccgcgagcgcagcacctcccggcgccagtttgctgctgctgcagcagcagcagcagcagcagcagcagcagcagcagcagcagcagcagcagcagcagcagcagcagcaagagactagccccaggcagcagcagcagcagcagggtgaggatggttctccccaagcccatcgtagaggccccacaggctacctggtcctggatgaggaacagcaaccttcacagccgcagtcggccctggagtgccaccccgagagaggttgcgtcccagagcctggagccgccgtggccgccagcaaggggctgccgcagcagctgccagcacctccggacgaggatgactcagctgccccatccacgttgtccctgctgggccccactttccccggcttaagcagctgctccgctgaccttaaagacatcctgagcgaggccagcaccatgcaactccttcagcaacagcagcaggaagcagtatccgaaggcagcagcagcgggagagcgagggaggcctcgggggctcccacttcctccaaggacaattacttagggggcacttcgaccatttctgacaacgccaaggagttgtgtaaggcagtgtcggtgtccatgggcctgggtgtggaggcgttggagcatctgagtccaggggaacagcttcggggggattgcatgtacgccccacttttgggagttccacccgctgtgcgtcccactccttgtgccccattggccgaatgcaaaggttctctgctagacgacagcgcaggcaagagcactgaagatactgctgagtattcccctttcaagggaggttacaccaaagggctagaaggcgagagcctaggctgctctggcagcgctgcagcagggagctccgggacacttgaactgccgtctaccctgtctctctacaagtccggagcactggacgaggcagctgcgtaccagagtcgcgactactacaactttccactggctctggccggaccgccgccccctccgccgcctccccatccccacgctcgcatcaagctggagaacccgctggactacggcagcgcctgggcggctgcggcggcgcagtgccgctatggggacctggcgagcctgcatggcgcgggtgcagcgggacccggttctgggtcaccctcagccgccgcttcctcatcctggcacactctcttcacagccgaagaaggccagttgtatggaccgtgtggtggtggtgggggtggtggcggcggcggcggcggcggcggcggcggcggcggcggcggcggcggcggcgaggcgggagctgtagccccctacggctacactcggccccctcaggggctggcgggccaggaaagcgacttcaccgcacctgatgtgtggtaccctggcggcatggtgagcagagtgccctatcccagtcccacttgtgtcaaaagcgaaatgggcccctggatggatagctactccggaccttacggggacatgcggtaagtttttccttccagaaatgtcgcctttcggcccagggcagagtcactctgtgttctggggtatctagcggctcctacctgcgcgaacactcagattgcccctgggagagctcagcagggtaaacctagagctctcccgtggactcccggcctgccagaggtttaacctgagctctcctaatttctgctgcgtgccctgggtgctgattcctgccctcccagattcttcaactcccccaaccgccccaaattctcactacctcctggtactcgaggtcccaaacagaaatcctattgcacgggccaccttcagagataaagctcccaagccctccactcttcctttcctcctgtcctcaaagtctgagaacctcaacaggaatttgggcaatttctcctcttcaggtctgttaggatttcactttcagcctgcgcagattagagtcaaaaagaccggcccaatagcttctcagcgggtatcctccagagaggtaaagtgaaattctcggttagggaaagaaagtggtctctgggtgctgaggtctgctgtgtgaaagggtgaacttctttctcctgaagcaactggggacttgctccagggctggaggtcagtagagataatccaaaccgtcatgtttagagtaggcagaggggcaactttcttggtaaagacttcacaggatttgcactcacagtttctcaacgttggttgactatgttgaaagtagttgcttgggtcggttttctcttgtaaagtgtttattttctctgtggattataacagatccacagccccctacttcaggtttgcatcagatctataaagaggagaatattcttttaatgtacaatttaattaggcttgactctgacttacaaaactgttggaaaacatttttttgtaaagcatttcctgctatttcagtgtgctccaaaatctccactggggagggtggagtgaggttttttattatattcctttatttttaggacatgtttgcattttagaatatgtgcagttagctctaacaaattgagtaagaactcttaatgacctatgagccgtaatcttaccccaaagttttaattagcatatgagaaaagtggcaggcaattgcatcgtgcttattaaaaattattcctcaccgcagttgttgagcttcttggagaccatgctgaagattttctcccccagcaaattaagatattagtttatctgctgagggaggacagactgaattggggaattaactcctcaggtaggccaggtgctgatgtccctgtggacttttgtcttattctttgtttctatggctgttttcttttacctgtgacttctccgaaatttctttgttagccttaacatctttgtttggggacttaaatccagcaatttgccttctttcactgatgctttccttcttacaaggtagatagcacagtgttagtaaagaaagaaagaggagggtaggatttcatattatttcgtgggctgttgaagaaacagcttcttaccaggctttacattccattaggtttttaatgtttgacttacaagattttcagagggttcatttgatattgtcaaagtcttttccagttaatttagactcttcatttttgtaatgggtttatgctatgggacaaaaaaagtattcttcattttataagaacaaatttacttggtagggttaattttttttctagggctgtcactagacggtggagcccctcttctactgtaaacttttcttgggggaaaatgtctaaggtgcattttgacctgccatgatactaaacccagacactggaaccttccatcttctgcatgcctcccccacaacttacttacttaacagggaaaaaactgatggttccacatatttgctaaaaaatgtgtgccttcaaagacaaaaccaaaatttttagggaataactatagagagcaaaagttactcccatcaagtagacaacgagcttggtgattttatttcaggtcttaatgaaaaaagctt

SEQ ID NO: 8196 - DNA, 1295 bp, artificial
  synthetic oligonucleotide
caagtttttggtctgagtaactggaaaaatgagattgccatttactgaaatggtgaagactgtatgtagagcaggtgcatgggcagggtagaaatcaagagtttgatttttgacttataaagtttgaattatctgatgaacatcctgatggcttcttctcagttagttctcatgcagtgccttcagctttgctgttcttcaagaaaattaaaaaggaacttagagatcgcctaggctgtaggtaccctctcccctctttccttttactttatagaggtctatagaagggtagggacttatccaaggtgaaacagtgagctggcgacagaactagggcacaaacccagttctcttgaattctgaatcagtagattttctttttttagtgtgattctgaggactcatttgggcaagagtgagttttttgttattgttttttgtttgtttctttgcccaaacctaaaaccaggtaattaaactaaatagtgaataaaactgggaaactatacaaattggttgctctccccaatcacactgaaatattattatttttactgaaccacataccaaaatatttttcctgtaaaaacacagtaagtgaacttttaaaggcaattgagcttttaacaaagctagaatctacagaggacctggacagaaatggccttaaatcctaggaaattagagttcatggaacctgggagaccatcttgtccagctagctcattttatgggtgaggtgcctgaggcaccaagatggaaagggacctggctaagctcatacagcaagctagtgcctgagcctagtcagagcctgttttaagggttagtcgtatgttgttttcttgaaaaaagttacattggaaaagtgaaaattctttggtccatactgagaacaaagaattatacataatcatatataataataatgatagcacttcctgaatgtttgctgtgtaaactttggcaccttgcatgaattgattcatttaattctcatgtcaactttaggaagcaggcctagagaggttaaggaacatgtccaagggtcacacagctaggaagtagcagaacttgtgtgcactcccaggaagtctggcttctaaccacaaggttctaactactgtgcaataccaggagcttctcagattacccttcacctttaccaacccaaatgactggtgacgtaggtgacttcattatgctctgcccctattatagtccactgatcctcaccaaataggtgggtggcctagaggttaaagtagaggcagagtgatggaaaggggtggtta

SEQ ID NO: 8197 - DNA, 4141 bp, artificial
  synthetic oligonucleotide
gcatgattacaatttcagcttctccccattggcttatgggttaaagtccaaattatttaaatctggtgttcaagtccttttatgatctgcttatttttccagcctgaattcctggagttcccttacaaaactcttaaaacccagccaaaaggatctagtcactgtcactttaaaccatcctcactctcttgttttttgaacatgttatttttcttataatccctttgaccttgaaggctatcccaatttcaatactatccattcttctatgacagccccctacaaaatgaatattctcaacctcccaacccaaggagaagtgatctatatgacacaatatggttgaaagaatgttggcttcacttctttatctgtaaaccaggggctagaaatctctagtttataagattttgtggagaggggatcatatgtgattatggatgttaggcacaagtcaagagtgcataagaccttttggatttatcccttttttctttctccatcaatatggtacttagtcccttaaatcagaagtacttgtgttaatgtctgataacgtccttctaaatatacctctaaacatctgtctctctttagggcaaaggttggatatatctgcaaagattctctttggatataagatatccacagcacataacttaacagtggtgtacacagtaggtattccataagtatttctttatgaaatgattcagagtcaatagtagtaagtaactgccaaaaacaactgatggattgtaagttccattaacataaatacagtcagccctccatatccatggattccatatccacagatttaagcaactgcagatggaaaatatattttagagacacagtaaaaataacaattcgacagtaaaaaaatacaaataaaattatgtaaaacaactatttacataacattgtattagctattacaagtaatctagatataaatgaaatatatgggggatgtatataggttaaatacaaatatgacaccattttatatgttttagttaaggaacatgaatatttttggattttggtattcatgggagtgggggaatggaaccatgccccttcaaataccaagggactattatatgggacacagaataaaggagttgattgtcttgctctgttaaattctggtcagacacatttgcaatgtattgttcagccccagtattcatggagcatctccttttgtaaagcatggaggagctgtgagagagacatggagcagtgaacataactattgtttcaacgtacctgaaggattatcatggaataaagaagttagatgtttttctgtagtaccccaaagggcaaaagcaatgaggacagattacagttcagtaaacgaaagaggtttttttttttttttttttttttttttgagatgggagtcttcactcttgtcgcccaggctggagtgcaatggcgcaatcttggctcactgcaacctcgcctcccgggttcaagtgattctcctgccttagcctctggagtagctgggattacaggtgtataccaccactcctgggtaattttatttattatttatttatttctttatttattttagtagagacggagatttcatcatgttggccaagctggtctcaaactcctgactgcaggtgatccgcctgcctcggcctcccaaattgttgagattacaggcgtgaatcaatgtgcccagcctgaaagatattttcttagaatagcttctttcacccttcatcagaagttgtcaacatggaccatatgagttttgtttggtctatatggtgtatatgtgtgtgtgtgtgtgtgtgtgtgtgtgtgtgtgtgtgtatgtgtgtgtgtttattgaattacttgctaacattttacttcaaaattcagatttccaccatagggaatgaagatctggcaatacaggactttcattcctacatggtaatgaccagctgtaggtgaaaagcagctgatcctctggatgggccatgcactttgcagtttgcccaggcagcactgatccgctttattcatttaagttacctgcttgactcttctagtcattcgagtatgtcatccccatcagatcagagacctaagcaaatcttgggtcccttgcttactccaagggctttcactcctcgtataggaggagctaaagaaatgtacaagcagcaccacaataggatcagacctggctttcaattctagcacggccacataacatagttggatgacctcaggacagtaacataacccctctgagcctctagatcttcattatctgtagagcactcttcttatagagttattataagaatgaaataaaacaactaggataaagggcatggcacttagtaggtgctgaaatattagttcccttcttctaattcaccacaccatatctgtctatctattggctgaatcacataaatagtaaattcacattcactgaagacattcaagaagagtctggaccctttgggaaccatgtatagggcaaaggtttgaactcatagtagatgatttttacagtcactttttaacaatttaaaagcctatagatgactccaaaatgcccatttggatgatatgaggcatactttgtgtagttaaggattttaaatacataacagagaggctgaagggccttcgggaaagaagctggggtaagagtcaaagtgtagtatgttgaccgatgttcaggaataggctttggcatctgacagattttgttttaaatactggctctgggtcttactagcttccagttctgggctgcttcacctctcttgagtttcagtttcttcatttctaaaatgaagatactaatgcttcctttgttgggtttttgtgaatataagtgagataataaatgtaaatatctagcccagggcctggtgcatagtacaagcttcataaattgtacctattattattagtagtagtagtagtccagacaaacagagcttgggaaaacgctagactctggctgacatacatgggcttttccccaggccactgctgcctggcttccccttccacaaagctttgagtctccaaaatgctttggctggaatgtaagcgtgaggtcattgcagataacaggggagcatgatttgcttcggtaatgcaagttattaagttacttccctcagcccagctgaaatctcttattggttgatgtgtgcttcaaagtgtgagacagagctagtctgaggagagagggagagtgagaagattcctcttcttggccagaggtcatggtcttccacaaggaacagaatgactcaatgcaaattatgggacctctttgagtttggggcccctacatttaaactagtaactccgttgcacatattggcacccttcccccaacaaaattactgggcaggaattttcttgaatccttccgtggcctggaatgatctcccttctcatccttgtgatccacacagctggcaaatggcaggcagcagaacaaaaacaagcctcttagcatatagggagagaaagagtcacagcagtactgaatttgcttgggaacctaatgttaacaaaggaccttcctctcaacaccccaaacagattaaaacatttttttaacagcaagttgtgtctcggagcagctctttgcttgggtatatttaaagatctgctgagtcatttaagagcaggctggcatatcctaagaggcaaggactataccccagtctatgggggagtaagttgagaggtgaaatctgtttggctttctcccatggaaacaaacaaggtgatccacttccatctcccacgactctggagagcatctactaagccttcttattctatcaactttgaactcctcagtgtataatagagtaagggtgagagggaaggagcagtcgtaccagtgtcattattggtatgttcaggagttcaatttcttcctgattcagtcttggcgggatgtatttgtttgggaatttatccattttttctagatttttctagtttgtgtgcatagaggtgttcataataccttctgatagttatttttatttctgtggtgtcagtggtaataacccctgctgtctgaaattgtaatggccctgctattggtagctgagagtagcatggaagtgtcagg

SEQ ID NO: 8198 - DNA, 1384 bp, artificial
  synthetic oligonucleotide
taccctccatcagccaaagcctcttgcctcccttcaacgtaactcttctctagcgtcctcttaataatcttctgaaaaggttttacagcctttctgggtactgggacccagagtcttaatccaggctcttaagtgccttatttaactgtaatatggaaaatcaaagtcacagctaattcaggaaaaatgagtttgggatgtgaatttcctaggcaacttgtcatctcttttttacttccttagcttcataaacttacccacaatgttccctgaggactaagagtaatggagggtgatgaggaaaggctttcctcccttcctttccgagagtcctttagccaaatgccacacctcctcctgtttccctagtctccgtgcagagatggaagtgggagatagacatgggttcctttcagccctgagttcatgccagggttttctttccctctagctggactgaggtaggaggagaggttgaagtccaccaataagaccatgagtgaagaagactaaagtacttgaaagagcagcagacctacgcttaaaatactagggtttgtgtccagactttgtgggttactatctgtataattttgggcaagtcaacagttctgagtcagagttcccttatcagcagattggaagataaattctaattatatagatgaaacattaagtctagaagtaatttgtaaattcagaaagggcttatagatttaaagtgtagccgttttgattaccacaaactaaatcctatacttcagggataaaatcttctcctgttttttctaaaagcctgtgcatgtgtggtgtaaggggtgggttttcccttgtaccagcaacttagcaattgtagtaacggggctgagggcagtggcatgcttcttcattgagcaagtgtgaaaagagggttatgcattcaggggtcagcagatggcaggcagagtagcccctccaaatctccctcccataccacaaagccctcttatttattcaaacttaacattagaagctcatttcaagtaggcacgtctgtgtctgggcgtctattttccttctttgtatatagcaggcatttgtcaacttggtgaaaagcattactcttctttccatttctgaggactaattgtgcttcttcgctagacacgagttcaaaacagtgggttgaaagagggcaagtttatgccaaagaatcagaaatagtcataatttagagagaattctagaggtcagttccctttcgtatggactgggcaactgaaacccagacagggaagggaattagaccaagttcacaagcacaaacactttactggcacattcagattggaaatcgagggcttctgctcccaggtcagaactaaatgccctttctagctagggt

SEQ ID NO: 8199 - DNA, 455 bp, artificial
  synthetic oligonucleotide
tggttataattactcattttaaatagtgtatattagtaatgtacactatttgtatatttgttgactgcctcctatatgccaaccactatgctagaaattttgtaatattcttcacgatattcaagatattaacatatccgcattttataaatgaggaaactgctctcaaagaggttagtttacacagccagtaagccgctaagcctagattggatggaaggtatgtgagaaaaaagcagcatccataaggttttcattctcctaccctgtacgacagaggtaatagaaattattagttaaagaaataatagaattttacaagactctaggaagggagaatgtgaaggatacagttctcagttactggaatgagtgccagagtaccagtacatggcttgccttggggtttggactacctatcttaactcctttgctcctcccaatcttgatctcat

SEQ ID NO: 8200 - DNA, 2317 bp, artificial
  synthetic oligonucleotide
ttttcaccttgaaaagcttataaatgtatgaaatcacaatgagggtcgctgatatagtttggatgtgtgtccctgcccaaatttggttttgaattgtaatccccagtgttggagatggggcctggagggaggtgattggatcatgagggcagttttttcatgaatggctcagcaccatccccttggtgctgttgtggtgatagtaagttctcatgagatctggttgtatagcacctccccccttgctctcttgttcctgctttcaccatgtgacatgcctgctcccccttcaccttctgccataattttaagttgcctgaggcctcaccagaagccgaacagatgccggcaccatgctttctgcacagcttgcaaagccatgagccaattaaacctcttttttttttttttataaattacccagtctcaagtattctttatagcaaggcaagaatggacttacacagtctcttttgtatcagggagagggtcttcttggtgactccacttcttttctttgtttatgtatccttccagatgatgtatttatttcctttgtttttcaattgatatttactcttaaattaaactaattatttaaaaaagcattttaaagtctcattttagattattttgactatctgatttttaaaatggtttaaaaaatctatcttggcctccatatgcaatcaaataagaaacacattttaagcatattatttaccttgtggattctgccttcctcagtgtgttcagtctgtgtatattcatttctcccacactgtaagaagctagtcagatgtataattggattatcatgctacataatcttagcacactcattttaagcatacatagactagtgagcaccactcattacatgtcatttctctagagaaactagttgggccatggctgcaggactctcacttgaaaagacatgtgtggtgatgttttctcaggcagttaagcaataaagtgtaccctgatttgcactgaaaataaagattcctttaaagggagcagttctagttatctctctctttaggtaccatatgctgaacgtttttctatgcactaaaacagcaactaggttttatactctgccttacagcctacttcacacccatttcacagggagaggaacagagaggtaagtgatttgccccaaattacataactaggaagttatttgctcagtgtggaaacttgttcagaaggtcatttcattgaaatgtaggaagagtttctggcacttctcttgagcaggagtcaaaaacctttttttgcactagcccagatagtaaacattttaggctttgtgggccatatgatctctgtcaaaactcctctacttcgttgttgtagtgcaaaagcagctatacacaatcctgaaatgaatgggtgtggccgtgttccagtacaaccttacagaaaaggcaataggctggatttggctctgagactgtagtttgctgacctcagctcttgaactgagctctttaactgacctcagctcttgaactatggtacaagatcccatggtcctgtttggtacctccatttgccctccttttcactctctgggagcatagctaagttcaaaattgaattaggtacttgtagtaagagcatacttataatcctgggatcttcatgttgccagatattaacctcttgaagtttttcaccacaacctgggcacttttctgatttgctcacttctagccccacctttgggccccttcataagcaaacatgcaggttttccagagagctgtatgctactgaatgcagaaaatttggctcatactggcctatggactatctgctcactgccctgataactattttccaagggagtgggtgccctacctttcctacatgaagttttttgctagtcttgccctaaaaattctaggtatcccttgcttttaggataaatatgtttcactgggaccagctggaaaacgaaaaatagaattatccaactaccactttaaaattggacaaagacttttgttgttgttgttggagggggtggtaaacatcattttagcagaccaaatatacttttggtgaaaggcagcctgttgcaaagacacaacacttggacaagattttgaagccctggttgcctttactactgacttaactacagtatttgcggacttgagcaagttgcttcccttctgtgagcctcaggttattcatctttgaaatgagtataatacctgtgattataattacttatctggattctgcagagaattgaaggagataatgggtgtaaaagtactttagcgcccagcactgc

SEQ ID NO: 8201 - DNA, 5712 bp, artificial
  synthetic oligonucleotide
gagtcagggagaagcagagactgacctagtgaggccaggaggcactatctcaggtctctagtcaaaatgggttgcaattagtaaaagtccagattctgaatccccttcactatttatcttcctcttcctcctttacagttatttttgttcaaggtgcactttattaaactcatgcctaacaaacaaaactctaatgaatattttgtctttcattgattgtaaattcaattaattagattgcttgaaaaaattttaactgtattttcactttagtatggatgaaaatttcgatttctttaaaaaacattttttaataataacacaacataaagtctaccctcataacaaaatttaagggcacaacaccatattgttttttttttattttattattattatactttaagttttagggtacatgtgcacaacgtgcaggtttgttgcatatgtatacatgtgccatgttggtgtgctgcacccattaactcgtcatttagcattaggtatatctcctaatgctatccctcccccctccccccaccccacaacagtccccagtgtgtgatgttccccttcctgtgtccatgtgttctcaatgttcagttcccacctatgagtgagaacatgtggtgtttggttttttgtccttgccatagtttgctgaggatgatggtttccagcttcatccatgtccctacaaaggacatgaactcatccttttttatggctgcatagtattccacggtgtatatgtgccacattttcttaatccagtctatcattgttggacatttgggttggttccaagtctttgctattgtgaatagtgccgcaataaacatacgtgtgcatgacaacaccatattgttaactgtaggcacaatgttgtacagcagacgtctagaactttttcttcaggcttaactgaaactttatagccattgaacagcaacactccatttccgtttcttaaaggtcctttacaaaatgagctttctgcgtgtttccattttgtttatctgataacttttttttctttttttattatactttaagttctggggtacatgtgcagaatgtacaggtttgttacataggtacacacatgccagggtgtttggctgcacctatcaacctgtcatctacattagatatttctcctaatgctattccctcccttgcccctcacccctcactggccccagtgtgtgatgttccctagcctgtgtccaagtgttctcattgttcaactcccacttttgagtgagaacatgcagtgtttgattttcttttcttgtgttagtttgctgagaatgatggtttccagcttcatccatgtccctgcaaaggacatgaactcttccttttatatggctgcacaatattccatggtgtatatgtgccacaatttctttatccaatctatcattgatgggcatttcagttgttccaagtctttgctattgtgaatagtgccacagtagacataagtgtgcatgtgtctttatggtagaatgatttataatcctttgtttatatacccagtaatagaaatgcttggtcaaatggtatttctagttctagatccttgaggaattgccacactgtcttccacaatggttgaactaatttacactcccaccaacaatgtaaaagcgttcctatttcttcacatcctctccagcacctgttgtttcctgactttttaatgatcacgattctaactggcgtgagatggtatttcattgtggttttgatttgcatttctctaatgaccagtgatgatgagctttttttcatgtttgttgaccgcataaatgtcttcttttgagaagtgcctgttcatttccttcacccactttttgatggggttgtttgtctttttcttgtaaatttgtttaagttcattgcacattctggatattaattaacctttcgtcagatggatagactgcagaaattttctcccattctgtaggttgcttgttcactctgatgatcgtttcttttgctgtgcagaagctcttgagtttaattagatcacatttgtcaatcttggctcttgttgccattgcttttggtgttttagtcatgtagtctttgcccatgcctatgtcctgaatggtattgcctaggttttcttctagggttttcatggttttaggtcttacgtgactcatcttgatttaatttttgtgtaaggtgtaaggaaggggtccagtttcagttttctgcatatggctagctagttttcccaacaccatttattaaatagggaatcctttccccattgcttgtctttgtcaggtttgtcaaagattagatggttgtagatgtgtggtattatttctgagacctctgttctgttccattggtctatatatctgttttggtaccagtaccgtgctattttggttactgtagccttgtagtatagtttgaagtcaggtagcatgatgcctccagctttgtgcttttggcttagaattgccttggctatgcaggctctttattggttccatatgaaatttaaagtagtttttttataattctgcgaagaaagtcattggcagcttgatggggttagtattgaatctgtaaaacactttgggcagtttggccattttcatgataatgattcttcctatccatgagcatggaatggttttccatttatttttgtcttctcttatttccttgagcagtggtttgtaattctccttgaagaggtccttcacatcccttgtaagttggattcctacatattttattctgtttgtagcaattgtgaatgggagttcactcatgatttggctctctgtttgtctgttattggtgtataggaatgcttgtgattttcgcacactgattttgtatcctgagactttgctgaagttgcttgtcagcttaaggtgattttgggctgagagaatggggttttctgaatatacattcatgtcatctgcaaacagagacaatttgacttcctgttttcctatttgaatatcctttattgctttctctttcctgattgccctggccagaacttccaatactatgttgaataggggtggtgagagacggcatccttgtcttgttctggttttcaaagggagtgcttccagtttttgaccattcagtatgatattgggtgtgggtttgtcataaatagctcttattattttgagatatattccatcaatacctagtttattgagagtttgagcatgaagcagtgttgtattttgtcgaaggccttttctgcatctattgagataatcatatggttttgtcattggttctgttgatgtgatggattatgtttattgatttgtgtatgttgaaccagccttgcatcccaggggtgaagcggacttgatcgtggtggataagctttttgatgtgctgctggattgggtttgccagtatttttttattgaggatttttgcactgatgttcatcagggttattggcctgacgttttctttttttgttgtgtctctgccaggttttggtatcaggatgatgctggcccataaaatgagttagggaggattccttctttttctgttgtttggaatagtttcggaaggaatggtaccagctcctctttgtacatctggtagaattcatctgtgaatccttctggttctggactttttttggttggtaggctattaattacttcctcaatttcagaacttgttatagttctattcaggtatttgacttcctgctttaggcttgggagggtatatgcgttcaggaatttatctatttcttctagattttctattttatttgccccagaggtgtttatagtattctctgatggtaatttgtatttctgtgggatccgtggtgatatcccctttatcattttttattgcatctgtgattcttctctcttttcttctttagtagtctggctagtggtctatctacaaaatagactgtttatctgatatttattttgtaattatctaataataaccatcattatcatcatcagcattatcattatcatctcctttacccatacatacatttgtgtctttcaaataataatcccatctttgaagtgcatcctcatctttagcagtctgcactctgctttcttatatcatttattatcttattttataattatttatttccagtccttcttctctaacagatagtagtttcttagggccaaggaaatatctcgatcaccactatatccccagcacctaaccctgtgcctggtccatagggccagatgctaagagttgagttgaaccattgtacctaatcttaaccttcattagcacaacatggtttgtcagtggttaagaatctacactttggagtcagactcacccaggatggaatcctggcattgccacttattattaatagatgcgtgatcttgaacaagtttacttaattgttctgagcatcagtttcctcttctgcaatatagggatgatacacagctacctggtaggttgttgggaaaattaaatgggatgatatgtatgaaatggcctggcatatagagtgcctaaatacatgttcttctgattctatttggacagtttgtgttagtaacagaagtcaaaaaggtggagaaaggagaaaggtacttgtgaaaattttctatttcttctccatgtttcattcaggactgaggaagggggcacagtttttacccaaggaaatgacatttttagccaaaagaaatgatcttagcatttagctgaattatatattggaagtaagctccttccatgtggaacttatggccttgctagccttggtttgttggaagtgctcttgctggctttctagttagggtagggaaaggaaggcttgtggggaatgaagataggccatgatatcaagccactgggtttgcaaatcagtagaattttttattgctttctgttgtacttgggacttgaataaaggctgatatttgtgtcttgctggtaaagtgcttgtaaagtgagtgaaagttttctttgctcttgtcctgacatagctgttcacttggggttgaggggaggataacctttcatgttttttttttttcttcattctgatgactgtgctgaacattcaaaccaaaaggccattggtggaaagtaaaggtgagtggtgagaagacaatagggtaatggaaactgtgttggacttgtaatcaaattgtcctgcacttcccctctccaagtcttaacgtttttcatctgtacagtggatattaaaatgagaaaataagcttgtcttcacagagttttcgttaggtgttgacacaacaaacaggctcccattagggctcattttccttcattccttagtaaggaagaagtgcttataaaatatagcagttgtgctcttgtgaatgatagcatgggcagttgtcatctccctgaagcagatgtaacccagaatgtcacttgagttttgtttaatgcttaggcataagacataggaatgacaaaagctgacctttgggtagtgagaacaatgttccattttgttcaaacttgaattttttactataggagactgagaattaaccttccatgaaggttttaggattggctttctggcccttctccttcatatccacctgaaagagcttgggcgcagaagttcttgcagaaaggcagttagacaaggtgacttctgaagctccagtggccaagtattttgatggtagccta

SEQ ID NO: 8202 - DNA, 7164 bp, artificial
  synthetic oligonucleotide
tctgaagagaaaattcttatgtagaataggaaggcttagatacagcatgaaagctgcaggctttgaggagccagaggtcaaatgaaagcattgagtatttgtttagatgaaagaacagaaagggaaaaagaagcagaggaagggatagtagagagaaatgtataagttttatccatttaacttgtaattgtgtttggctatgggcacaatagaagcagtgagatcactttattttattttattctttatagacagggtcttgctatgttgcccaggctgcagtgtgcagctcttcacaagtgtgatcatagcgtactacaccctcaaactcctggactcaagcaatcctcccatctcagcctcctgagtagctgggactacaagtgcacaccaccacgcccagtgagatcacttgaaactagggagagatgtgtgagttctgggcaaccagtagttggctttacatagaactgtaggggtcaaggccaaaggggacgtcctgttccaagtcaccttctttggacattagaaaaccacgaggggtttggaaatcagaaaaccagcagaggcaggaaaactcagggcagcatgggagattcagtatatacaaaaaggttcacaccagtaatcaaacagaattttaactgctgatgtggagtagaggcagctttgtctgctgtgtgataaccaaacctttacgaatagtaggtgtatatggggaattggagggagataggtggctgtgtttagtaattggttgacttcactgagatggtttggggattgtggcttccagatgatcagattttcttttttaggtagagactccaacatcattacagaactataaattacatgtggaaaagaaaggcctcctatgttagaatagaaaataaaatgctgtggggttgagggacagaggtgctgtctaggaagtcagatagcgttttccagttctgtccctcagagttccttgtcctcattgagactcaatttctcttacttttttttttatactttaagttttagggtacatgtgcacaacatgcaggtttgttacatatgtatacatgtgccatgttggtgtgctgcacccattaactcatcatttaacattaggtatatctcctaatgctatccttcccctctcccctctccccaccacaggccctagtgtgtgatgttccccttcctgtgtccatgtgttctcattgttcaattctcacctgtgagtgagaacatgcggtgtttggttttttgtccttgtgatagtttgctgagaatgatggtttccagcttcatccatgtccctacaaaggacatgaactcttcattttttatggctgcgtagtattccatggtatatatgtgccacattttcttaatccagtttatcattgatggacatttgggttggttccaaggctttgctattgtgaatagtgccatgataaacatacgtgtgcatgtgtctttatagcagcatgatttataatccttagggtatatacccagtaatgggatggctgggtcaaatggtatttctagttctagatccctgaggaatcgccacactgacttccacaatggttcaactagtttacagtcccaccaacagtgtaaaagggttcctatttctccacgtcctctccagcacctgttgtttcctgactttttaatgatcaccattctaattggtgtgagatggtatctcgtggttttgatttgcatttctctgatggccagtgatgatgagcattttttcatgtgtctgttggctgtgtaaatgtcttctttgagacgtgtctgttcatatcctttgcccactttttgatagggttgtttgtttttttcttgtaaatttgtttgagttctttgtagattctggatattaccctttgtcagatgagtagattgcaaaagttttctcccattctgtaggttgcctgttcactctgatggtagtttcttttgctatgcagaagttctttagttgaattagatcccatttgtcaattttggcttttgttgccattgcttttggtgttttagacatgaagtccttgcccatgcctatgtcctgaatggtattgcgtaggttttcttctagggtttttatggttttaggtctaacatgtaagtctttaatccatcttgaattaattttagtataaggtgtaaggaagggatccagtttcagctgtctacatatggctagccagttttcccaacaccatttattaaatagggaatcctttccccatttcttgtttttgtcaggtttgtcaaagatcagatggttgtatatatgcggcattatttctcagggctctgttctgttccattggtctatatctctgttttggtaccagtaccatgctgttttggctactgtagccttgtagtatagtttgaagtcagatagcgtgatgcctccagctctgttcttttggcttagggttgacttggcgattcaggctcttttttggttccatatgaactttaaagtagttttttccatttctgtgaagaaagtcatgggtagcttgatgaggatggcattgaatctataaattaccttgggcagtatggccattttcacaatattgattcttcctacccatgagcatggaatgttcttccatttgtttgtatcttcttttatttcattgagcagtggtttgtagttctccttgaagaggtccttcaagtcccttgtaagttggattcctaggtattttattctcttagaagcaattgcaaatgggagttcactcatgatttggctctctgttttctgttattggtgcataagaatgcttgtgatttttgcacattgattttgtatcctgagactttgctgaagttgcttatcagcttaaggagattttgggttgagacgatggggttttctaggtatacaatcatgtcatctgcaaacagagacaatttgacttcctcttttcctaattgaatgccctttatttccttctcctgcctgattgccctggccagaacttccaacagtatgttgaataggagtggtgagagagggcatccctgtcttgtgccagttttcaaagggaatgcttccagtttttgcccattcagtatgatattggctgtgggtttgtcatagatagctcttattattttgagatacgtcccatcaataactaatttattgagagtttttagcatgaagcgctgttgaattttgttaaaggccttttctgcatctattgagataatcatgtggtttttgtcgttggttctgtttatatgctggattatgtttattgatttgcgtatattgaaccagccttgcatcccagggatgaagcccacttgatcatagtggatacgctttttgctggtattttattgaggatttttgcatcaatgtttatcagggatatcggtctaaaattctcttttttgttgtgtctctgcctggctttggtatcaggatgatgttggcctcctaaaatgagttagggaggattccctctttttctatttattggaatagtttcagaaggaagggtaccagctcctccttgtacctctggtaggattcagctgtgaatccatctggttctggactttttttgattggtaagctattagttatatcctcaatttcagagcctgttattggtctattcagagattcaacttcttcctggtttagtcttgggatggtgtatgtgtcgaggaatttatccatttcttctagattttctagtttatttgcatacaggtgtttatagtatgctctgatggtagtttgtacttctgtgggatcggtgattatatcccctttatcattttttattgcgtctatttgattcttctcccttttcttctttattagtcttgctagtggtctatcaattttgttgatcttttcaaaaaaccagttcctggattcattgattttttgaagggttttttacatctctatttccttcagttctgctctgatcttagttatttcttgccttctgctagcttttgaatgtgtttgcccttgcttctctagttcttttaattgtgatgttagggtttcaattttggatctttcctgctttctcttgtgggcatttagtgctataaatttccctctccacactgctttgaatgtgtcccagagattctggtatgttgtgtctttgttctcattggtttcaaagaacatctttatttctgccttcatttcattatgtacctagtagtcattaaggagtaggttgttcagtttccatgtagttgagcggttttgagtgagtttcttaatcctgagttctagtttgattgcactgtagtctgagagacagtttgttataatttctgttcttttacatttgctgaggagtgctttacttccaactatgtggtcaattttggaataggtgtggtgtggtgctgaaaagaatgtatattctgttgatttggggtggagagttctgtagatgtctgttaggtctgcttgacagtggagtgttaaagtctcccattattattgtgtgggagtctaagtctctttgtaggtctctaaggacttgctttatgaatctgggtgctcctgtattggttgcatatatatttaggatagttagctcttcttgttgaattgatccctttaccattatgtaatggccttctttgtctcttttgatctttgttggtttaaagtctgttttatctgagactaggattgcaatccctgcctttttgtgttttccgtttgcttgataaatcttcttccatccctttattttgagcctatgtgtgtctctgcatgttagacgggtttcctgaatacagcacactgatgggtcttgtctctttatccaatttgccagtctgtgtcttttaattggagcatttagcccatttacatttaaggttaatattgttatgtgtgaatttgatcctgtcattatgatgttagctggttattttgctcgttagttgatgcagtttcttcctagcctcgacggtctttacaatttggtatgtttttgcagtggctggtaccggttgttcctttccatgtttagtgcttccttcaggagctcctgcagtgcaggcctggtggtgacaaaatttctcagcatttgcttgtctgtaaaggattttatttctccttcacctatgaaggttagtttggctggatatgaaattctggttttaaaattcttttctttaagaatgttgaatattggcccccactctcttctggcttgtagagtttctgctgagagatcagctcttaatctgatgggcttccctttgtggggaacctgacctgtttctctggctgcctttaacattttttccttcatttcaactttggtgaatctgacaattatgtgtcttggagttgctcttctcaaggagtatctttgtggtgttctctgtatttcctgaatttgaatattggcctgccttgctagattggggaagttgtcctggataatatcctacagagtgttttccaacttggttccattctccccatcactttcaggtacaccaatcagacatagatttggtcttttcacatagtcccatatttcttggaggctttgttcatttctttttattctttttcctctgaacttctcgcttcatttcattcatttgatcttcaatcactgataccctttcttccagttgatctaatcggctactgaggcttgtgcatttgtcacgtagttctcgtgctgtgtttttcagctccatcaggtcctttaaggacttctctgcattggttattctagttagccatttgtctaattttttttcaaggtttttaacttctttgccatgcgttcgaacttcctcctttagctcagagtagtttgattgtctgaagccttcttctctcaactcgtcaaagtcattctccatccagctttgttccattgctggtgaggagctgcattcctttggaggaagaaaggcactctgatttttagagtttccggtttttctgctctgttttttccccatctttgtggttttatctccctttggtctttgaagatggtgatgtacagatgagcgtttggtgtggatgtcctttctgtttgttagttttccttctgtcaggaccctcagctgcaggtctgttggagtttgctgcaggtccactccagaccctgtttgcctggttatcagcagcagaggctgcagaacagtggatattggtgaacagaaaatgttgctggttgatcattcctctggaagttttgtctcagaggaatacccggatgtgtgaggtgtcagtctgcccctacttgggggtgcctcccagttaggctactcggggttcagggaaccacttgaggaggcagtctgtccgttctcagatctccagctgcatactgggagaaccactactctcttcaaagctgtcagacagggacatttaagtctgcagaggtttctgctgccttttgttcggctatgccctgcccccagaggtggagtctacagaggcaggcaggcctccttgagctgtggtgggctccacccagttcgagcttcccagctgctttgtttacctactcaagcttcagcaatggcgggcacccctcccccagcctcgctgctgccttgcagtttggtctcagactgctatactagcaatgagcgaggctctgtgggcgtaggaccctctgagccaggcacaggatataatctcctggtgtgccgtttgtgaagaccattgaaaaagtgcagtattatggtgggagtgacccgattttccaggtgccatctgtcacccctttctttgactaggaaagggaattctctgatcccttgtgcttcctgggtgaggcgatgtctcgccctgctttggctcatgctcggtgcgctgcacccactgtcctgcacccaccatttgacactcccctgtgagatgaacccggtacctcagttggaaatgcagaaatcacccatcttctgtgttgctcacgctgggagctgtagactggagctgttcctattcggccatcttcacaaaaatcttactttggtttctagtgttaccacccactgttctttctcatctcaaccctgagtataagtacagatcacattccttgggttcttagaaaataatagaaatgaactctcattcatcaaaat

SEQ ID NO: 8203 - DNA, 3586 bp, artificial
  synthetic oligonucleotide
cttgagccctgatgaatatgatcttatcagatactgttaacaactgacacagcaataaaactccaaggtatagattcttagcttcatcatctttcacaggtcaaaaatatctgtattttttttctccagactactaaacattcattacatctagaaatcataaactgagaattcttaggaatcccctggaatctactgacttcagaaatagacagtttctgcccaggacaatgaaaaaagattaattttctgattcttcaacatttttcctttccctctactactaatccgtcttattcttccacttttgtatcctttaaaatactaatgggatctcccttatcatcatcctattacctccaaccactatgatctcctaccacttaagagaaagcaaaacccacttacatatttttcacaggctatagctactgctctgaatctaatactttgctggacttgtcattctttattttactctctagacaaaaatttaatggctgttcttttaaatatttcaaaagacaaattgcccttaacaaactcctcctgctacttatgttttcctcacatcattaatcccaaatttaatcttgtaaaaattaaagcttgacctcacatggacaaaatgctgaggtcattacaatcctataagcaagacctagtttgtcagaaataggtgcaaatgctgagatttttaaaaatttaatttattatacttaaagttctgggatacatgtgcaggatgtgtaggtttgttacatacgtatacaggtgccatggtggtttgctgcacccatcaacacatcatctacattaggtatttcccctaatgttatccctcttctagcccctgacaggccctggtgtgtgatgttcccctccctgtgtccatgtgttctcattgttcaactctcacctttgagtgagaacatgtggtgtttggttttctgttcttgtgttagtttgctgagaatgatggtttccagcttcatccacgtccctgcaaaagacataaattcatcctttttatggctgcatagtattccatggtttatatgtgccacattttcttcatccagtttatcactgatgggcatttgaaatggttccaaatctttgctattgtgaagagtgccacagtaaacatacatgtgcatgtgtctttatagtagaatggttataatcctttgggagtatacacccagtaatgagattgctgggtcaaatgttatttctggttctagatttttgaggaattgctacactgtctccacaatggttgaactaatttaccctctcatcaacagtgtaaaagcgttcctatttctccacatcctcttcatcatctgttttttcctgactttttaattatcgccattctaactggcttgagatggtatctcattgtggttttgatttgcatttctctaatgacaagtgatgatgagctttttttcatatgtttgttggctgcataaatgttcattaggagaagtgaactttttgagaggtgtctctttgagaggtgacactttttgagaagtgtctgttcacatcctttgcccactttttgatggggttgtttgttttttttcttgtaaatttgttcaagttccttgtagattctggatattaaccctttgtcagatggatagattgcaaaaattctctcccattctgtacgttgcctgttcactctgaagatagtttcttttgctatacagaagctctttcatttaattagatcccatttgtcaattttggctttcgttgccattgcttttggtattttagtcatgaagtctttgaccatgcatatgtcctgaatgatattgcctacgtttccttctagggtttttatggttaggtttttatgtttcagtctttaatccatcttgagttaatttttgtataaggtataaggaaggggtccagtttcagttttctgcatattctagccagttttcccaatgccatttattaaatagggtatcctttccccattgcttgtttttgtcaggtttgctgatgatcacatggtagtagatgtgtggcattatttctgaggtctctgttctgttctattggtctatatatctgttttggtaccaagaccatgctgttttggttactgtagccttgtagtatagtttgaagtcaggcagtgtgatgtatccagctttgttctttttgcttaggattgtcttggctatatgggctcttttatggttccatatgaaatttaagatagttttttctaattatgtgaagaaagtaaatggtaacttgatggaaatagcattgaatctataaattactttgggcagtatggacatttccatgatattgattcttcctattcatgagcataaaatgtttttccatttgtttgtgtcctctcttatttccttgaacactggtttgtagttctccttgaagaggtccttcacgtcccttgcacgttttattcgtaggtattttattctctttgcagcaattgtgaagaggaattcactcacgatttggctctctgtttgtctattattggtgtataggaatgcttgtgattttttcacattgattttgtatcctgagactttgctgaagttgcttatcagcttaaggagttttggggctgagatgatggggttttctaaatacacaatcatgtcatctgcaaacagacaatttgacttcctctcttcctatttaaataccctttatttctttctcttgactgattgccctggccagaatttccaatactattttaaataggagtgttgagagagggcatccttgtcttgtgctggttttcaaagggaatgcttccagcttttgcccattcactatgatattgcctgtgggtttgtcacaaatagctcgtattattttgagatatgttccattgatacctagtttattgagggtttttagcatgaagggtgatgaattttattgaaggccttttttgcatctattgagataatcacatggtttttgtcattggttctgtttatgtgatggattatgtttattgatttgcatatgttgaatcagccttggattccagggatgaagccgaattgatcgtggtggataagctttttgatgtgctgctggatttggcttgccagtattttattgaggcttttcatatcaaagtttatcagggatattggcctgaaattttcttttcttttcttttcttttttttttttttttgttatgtctctgccaggttttggtatcaggatgatgctggtctgataaaatgagttagggaagagtccctcttattctattgtttggaatagcttaagaaggaatggtatcagctcctctttgtacctttggtagaattcggctgtgattccttctggtcctggactatattttgttggtaggctattaattactgcctcaatttcagactttgttattggtgtattcagggattcgacttcttcctggtttagacttgggagggtgtaacacagactgagattattctggctctgactcagtttgttctcttcagacaaataagcttttttttttttttaacaaaaactgcttgatt

SEQ ID NO: 8204 - DNA, 1120 bp, artificial
  synthetic oligonucleotide
gtcgttctctctacctggaatatcccccctctccctacatctacaaaatgtctatctatccttggagatgcacataacgttacatctccttcagggagaccagagcccactgtgctcatcttaactaaaaccactggcaagcagagtaagttgcaattttccgtttacttatctgcctctcctactaaatgataaacaacttccaagtgtgtgtgcctgccacacagcaggtactaatgaattatttgtaaaggaattgagctccctagtgctgtttcaaacagtcctggaggcagccaagtaaaaggcaagaatctcttttggtcagtttggctgtaggaacagcccaactgactacccgaaacactcactctccacacctaccaaggctaaggcccagaagagaatggcaggttcttaacactgagtgggtaattgaggaggacagaatccttagacaaatcttaatgtgaagtctgttaagccctagacaaagctgagtaccattcagatggaaatgaacagcaaccattcatagcttttgatattgctgggctggtgatgtgttccttttaacagtttcaatacccctgcaattaatctttattctttagtgacggaagtttttttcagatattaaaatggaaaagtatctccatgctaacaccaagtgaccctaaaaggctaaaccacaagggcacttgtgtatctccttttgtgaactttgaaaggaactgatctttgttcagtgtcccagcagctcacagaatcatcacaactccaaaaagcagagtattttagctttgaagcctaggtttaccaagagcaaagcacttggcaaggtcatatggcaaggcagagattcaagcccatatttgttgctccccaagtcttatagttatcccattgcatcccactgcctgcttgtctaacttttctggagaaatcaaaactcatatgtgagctcttctaagctaaagccaccttctgattctctgagggagttacttggcatcccatttaggatactcttccttcttggccttcttatgagatttggaagttcacctattctttggggaaattgctttgcatttagtgtctctctttttattatata

SEQ ID NO: 8205 - DNA, 5629 bp, artificial
  synthetic oligonucleotide
gtaatttcattgtcatatcatcatgtaatatttttgaagacattttaaatagaaaataaactcaacaatgaacataatttaacttaagtgactataatatgagcagctattacaagttcatgcatatggaggccatgataattacatcaaaactgctgcctgataagtgtaattttaagaaaccattgattttcagatgtgtacagaattcagattacaatttgagaaaaagtgttattagaactgatgaaatttggtttatgtgcttgttagttttcatgtatactctaacatgtataacgtattagttataattgtagtattctaattgtgaatacacgcatactctaggggtgattaatgagtatttaaagactcaggtaaaagtcagaggggctcctgtaagtttcagctaacattatctccaaccaacaccaaaggctttgttaatgagcataacataaggtaaaaatgaattatcattgcctagatgtattaaagacatatggactagctgaaaatattgtacagacactctcagccctgcattgacagggtagaaaaatatagcaatggttaatcttaacatcagtaaggtgaatcaaccaatcttatgcatcttcagatgtgatgcagcatatggtgtatacaacatcacatgtgatttgttccagccaacaaatagttaactggaatccatctagcctttagatataacctctactttacaaaacatacaagaagtagagtaattagctgaaatatatgacaaagaagaaagcagacaaaactaggaagtaacattctacaggacaattggtcttctcttgttggtaaaacagtatcataaaaaaaggcactgggcaggggccatgctaatcttctctgtatcgttccaattttagtatatgtactgccaaaacactcctcagcaaatgcaaaataacagaaatcataacaaacagtctctcagaccacagtgcaatcaaattagaactcaggattaacaaactcactcaaaaccacacaactacatggaaagtgaacagcctgctcctgggtgactactgggtaaataacaaaattaaggcagaaataaataagtcctttgaaaccaatgagaacaaagacacaaaattccagaatctctgggacacagctaaagcagtattcgcagggaaatttatagcattaaatgtccacaggagaaagcgggaaagatacaaaatcgaaacactaacatcacaattaaaagaactacagaagcaagagcaaacaaactgaaaagctagcagaacacaagaaataactaagatcagagcagaactgaaaaagatagagacacaaaaaatgcattaaaaaaaatcaatgaatccaggagctggtttttgaaaagattaactaaacagatagactgctagccagactaataaagaagaaaagagagaaaaatcaaatagacacaataaaaaatgataaaggggatatcaccactgataccacagaaatataaactaccatcagagaatactataaatacctctacacaaataaactagaaaatctagaagaaatggataaattcctagacacctacaccctcccaagactaaaccaggaagaagttgtatccctgaatagaccaataacaagttctgaaattgaggcagaaattgatagcctacccaccaaaaaaaccccaggaccagacggattcacagccaagttctaccagaggtacaaagaggagctgctaccattccttccaaaactattccaaacaatagaaaaagagggaatcctccctaactcattttgtgaggccagaatcatcctgataccaaaacctggcagaagacacaacaacaacaaaaactttcaggccaatatccctgatgaacattgatgcggaaatcctcaataaaatactggcaaaccgaatcctgcagtgcatcaaaaagcttatccaccacgatcaagttggcttcatccctgggatgcaagggtggttcaacatatgcaaatcaataaatgtaatccatcacataaacagaaccaatgacaaaaaccacataattatctcaatagatgcagaaagggcctttgataaatttgaaaatcacttcatgctaaaaactctcaataaactaagtattgatggaacatatctcaaaataataagagatatttatgacaaatcaacaggcaatatgatagtgaatgggcaaaagctggaagcattccctttaaaaaccgccacaagacaagcatgccctctctcaccactcctattcaacatagtattggaagttctgtccagggaaatcgggaaagagaaacagaaacagaaccaatgacaaaaaccacaggattatctcaatagatgcagaaaaggcttttgataaaattcaacaccctccatgctaaaacctctcaataaactaggtgttgatggaacgtatctcaaaatagtaagagctatttatgacaaacccacagccaatattatattgaatgggcaaaagctggaagcattccctttgaaaataggcacaagacaaggatgccctctctcaccactcctattcaacatagtattggaagttctggccagggcaatcaggcaagagaaagaaataaagggtattcaaacaggaagagaggaagtcaaattgtctctgtttgcatatgacatgattgtatatttagaaaaccccatggtctcagcccaaaatctccttaagctgataagcaaattcagcaaagtctcagaaaacaaaatcaatgtgcaaaaatcacaagcattcctatacaccaataacagaaagccaaatcatgagtgaactctcattcacgactgctacaaagagaataaaatacctaggaatacaacatgcaagggacgtgaagggcctcttcaaggagaactacaaactgccactcaaggaaataagagaagacacaaacaaatggaaaaacattccatgctcatggattggaagaatcaatatcatgaaaatggccttactgcccaaagtaatttgtagattcaatgctatccccatcaagctaccattgactttcttcacataattagaaacaactactttaaatttcatatggaaccaaaaaagagcccatatagccaagacaatcctaagcaaaaataacaaagctggaggcatcatgctacctgacatcaaactataccacaaggctacaataaccaaaacagcattgtcctggtaccaaaacagatatatagaccaatggaatagaacagaggcctcagaaataacaccacacatctacaaccatctgatctttgacaaacctgccaaaaacaagcaatagggaaaggattccctatgtaataaatggtgttgggaaaactggtttgccatatgcagaaaactgaaactggaccccttccttagaccttatagttaacacaaggtggattaaagacttaaatgtaagacgtaaaaccataaaaaccctagataaaaacataggcaataccattcaggacataggcatgcgcaatgacttcatgactaaaacagcaaaagcaatggcaacaaaagtcaaaattgacaaaggggatctaattaaactaaagagattctgcacagcaaaagaaactatcatcagagtggacaggcaacctacagaatgggagaaaatttttgcaatctatccatatgataaagggctaatatccagaatctacaaggaacttaaatttacaagaaaaaaacaaacaaccccatcaaaaagtgggcgagggaaatgaacagacacttttcaaaagaacacatttatgaggccaagaaacatatgaaagaaagctcatcatcattagtcattagagaaatgcaaatcaaaactgcaatgagataccatctcacgccagttagaatggcagtcattaaaaagtcaggaaacaacagatgctggagaggatgtggagaaatatgaatgcttttactctgtcggtgggagcataaattaattcaaccattgtggaagacagtgtggtgattcctcaaggatctagaacctgaaataccatttgacctggtaatctcattactgagtatatacccaaaggattatacatcattctactataaagacacatgtacacgtatgtttattgcagcactattcacaatagcaaagatttggaaccaacacaaatgcccatcagtgataaactggataaagaaaatgtggcacatatacaccatggaatactacgcagccataaaaaaggatgagatcatgtcctttgcagggacatggatgaagctggaaaccatcattctcagaaaactaacataggaacagaaaaccaaacaccacatgttttcactcataagtgggagttgaacagtgagaacacatggacacagggaggggaacatcacacactggggcctgtcggggggtggggggctaggggatggacagcattaggagaaatacctaatgtagatgatgggttgatgggtgcagcaaaccaccatggcacgggtatacctatgtaacaaacctgcacgttctgcacatgtatcccagaacttaaagtataataataataataatagaaacaagcactgtgctagattaaaaacacaataaggacataaataaaatgtgttcctatattgaataccagattggacaaacacctataaaaggccacttttgggtcaaatgggaaaaagttaatatggtctggaaaagtcaaaattgttaaaatggaaaaagtagactaaagaacagcataatctcattttggtaaaaaaaaatgcaaacaggtatgtgtatacaaaaatgcatgcacacacacacacaacgagagagagaaaaagagggagagagagagagaagagagagagagagagagagatccgaaaaaacctgaactatattaacagtaatgattattgaatgttgggaatagaaagcttttcctttttttttttttttttgctttttaaaaattttctaatttatacaatgcacagtattgcttctcaaataagagaagtattattacaaaagtaaaaagaacctagtaagctaataacccatacccttcagaatggtagcccaggcctaaggttacataggggtactagatggtaggattttattgtctgactccaatcttatctgcctccagtgaacctttcatccaagatgttgtcaggcagggcatctgaaaggacagagagctgggacttcatttgagtttgcagaacaggttgttcaagtcttttttcgtctgcctgctgataaatagctataagaatggcagaattaggcctggagcttgcttccattgtaatattccactggtagtaagattgccagggaggtggccttagagttctcctacttctgactaatagaagctacagatactaaccaaaaagaactggataactgagaacctcaaattggctaaggtcagtttggttctgcctgttattagcctagaaaacaggctgtcagtggaaacacagtacaaaggcatagatgtactcatcatatagatgatgaaagcagcagttgacaggcaagataattatgtgcattttaaaaacacttgaatttt

SEQ ID NO: 8206 - DNA, 2202 bp, artificial
  synthetic oligonucleotide
cttaacaaaaagtgccatttcttgagagcctctcatgtgacatgcattttacctgtgttcatcctaatccacacaactggccttcattgtagggattgtgcagatgaccaaacagactcagagaggtttgcctgagattatacagcaaataagttggagagcttcaattcaaaaccaggctcatctgacagcaaagcctgtgtccaccccactctaccttgctgctacctttcaactgagacaatccacatgcatgatgactctaagaggatatgtacatgggtcaaggcaaaatagccttcctcacagagcattcagcttccaaggaagcacttaagggctggggctgaaagagctgagaggcagtttctgtgtagtccaaccacatgggccagtcctctaataggaactttttctgaaaatccagcagttacttacttgaccaagtgtcttatcagaagttccagcatctctcggttcttttctggtagcttatataccagggagtgaatagctcctaggcggtaatccaggttgtcagactctgggatagaacagtaagagataaatggtttggctttctgggcaactggattgagcaaaattctcacatatatatgcacaaacacacacacatgcacacatgcacacacacacacacacacacacacacagagagagattcggagaaagacacccagagacacacacagagagagagataatcaatgagatgaaaagagacagagagataaataggcactgaaatacaataaaaattagagacccagaaacaaagacaaagacataaagaaagaaaaaaggcagaaaaagagaaaaaaaacacacacaaagaaacaggtctaaaaagatgtagaaaatagaagatagaaaagagaaggatgagaagagaagactgtctcagagggagtcagaactctgagcacagcaggttgttcctgaagtctcacagataaacttccagctggaaacctattcccatccaccttccttgtggtactgagaagtgtgctgctgcctctggattcctgttaaaatcactgagagagcccagaagtaaagaacaaagctcccttgtttcaacaaagacgcattatgatgttaagtcccctgaatctttttcctctacaccacacaggatatgatgcagaataagggtcacattgaggtggagaggggcactcatacagtggcctcagccaaaactttcaatgcttctttaatcgccaacttttgggagtgattctctatgccttatttcctatgtactgacgccctctccctcagttttctcatctagaaaatgtgatgctggcactaacagattaaggacaatggttcacaacacagtcgaaaagcatttgaacaggcaaaatgctgaaggaagttgaaacggcaactgtcgtgtaaccatttttctgtcccctggtaatgtgagccaatgttcttgttctgatggaagaggcaatgaatacatatataaataaagcctttatattcacacaaccctcaagttaaccaattttctcaagcccacttaagtaacactaattatgaaaaataatagaactcttgagttagacagcaagcaagaatactttcatttggcagttgtgcataatttgtgtatgtgttttaggtttctgtgccctcaatcacttcccctcaaacaattttctaggcttattgcagtaaacattaagaaactaggacaacacagttaattagtaacataaatacttactggcagcagagaccagctctttgtgaagtctataggtcatgacaggttcagaaagattcctgaaatgaatgaaaattgtcagttgctttgggaagaaagcagctgggtattggattcttagttctggggacagcaaggctgaagttcctgagccctacagcttagtgggattatatacatttttctcttcacctgaagcttcgtcagggaatccaagttgctagtaattcaacaaaagacctgcaaaagcatgggctgagccctctagcaaggtctccaactagctcccagaagtaaaaagaggcacaaaccagtcctgcaaaattccagaggggacccatgctgaatgctaccatgaatcccttacgatttgatagatccttagaatttccgaagtgcttttgcaattgtcctcccaataatcctgtgaggtggag

SEQ ID NO: 8207 - DNA, 848 bp, artificial
  synthetic oligonucleotide
cagcagcttctgaacctgaatattgctgcccacagtgcggtacaacccttctgtcttgatccctagtggaggaaaaaatcaggttaatttcacttgtatagctagagttgtcatctccccttggtacactagggtcaattcagataggaaggggtcacactacatactccaagttctccagccttccctgtaacaggggaatagtcctacagcatctctccaaattatccatcctttcatttggagtgtaccaaaccctcattaatctgaagagaagaaaacaaactctatagtaaatagaagcatatgcttagtttgggcggcagcagaaagctgagaatggtgctgccatcttagaaagaagttcattcaattgaaaaaggaggaaggatcaaccctcaagttgcttctaagcagtgatataaatcacgagagggctggagtaaggcagctgtgaaacaaaaggccatttcctgcaccaagaaagactaaaaaaacatttcaaagaacaaagagacttgattcacataccacacttgcccacagtctaaatatcctcagaaggaaaccagggagtatcggcaaccaggaagaatgctgattccacatctccctgagtttggctctgccccatcaattttcataccagtatgtactgtggcagaaattgaactcttgatcatttaggatagaaccatcatgacactgcttaaggagtgccaggtactgtttgagaatactttataaacttataagctctttaaaagcaggaatccaaattatccaaatatgcttgcataccactagtttagaattttctgaaattttctagcttgcatctactacac

SEQ ID NO: 8208 - DNA, 1432 bp, artificial
  synthetic oligonucleotide
aaagccatctgcatcctttgattcttgaaaacctaaagggagagcaaacttgggagagggaattgaaagataaatgccttgctgagcttcccagcatctgcctacagaaatgtcacaagcatgaaagagttcagcagcaggtttctggaaggtgacagaaggaagacagtgctggaatattttctggatggcagtcttcagaataccaagtctctcctgctaccttccagtttactataagtgcaatctgggatctagttacccctctaaattctccaggatactgaggacacatagaaagaaaaacctagaatgcattttccctcctagccagtttttcacttgaatacagcaaagaaataagactgtatctgaacactgctggatcttaggagttttgtatcccatcattcagatcggctagcacattgtggtttacaagatgacttccatctgttttttctaagcaaccctgtgagataggtagaaagaaattattaaagcccttttactgaggagaagaaaactgaatctcagagaggtgaaatgatttgcccagagtcacatagccatttaatggcagaactagtacctatatccaagcttttggaattccaacaccaggaagctgatattatttaatatgccactaagaaaccagaatgtttttcaattatttccaactgtttctattggtcgcttgatgataatcagtaaccctttcaagggattgcttgtcctcctgcataaccgtgttctaaatggaacggtacatcttgtgatacaggatggcaatgccatctccgctaccagctgtaccctcaaagagaataagctgagttggtggtataagggtgaggcagaaaaatcattctgaataaatgtttaataagtgcttatttataactatggcaattatttttcatattaacacatattaattaattaacacatattgattttataacctgaaaaatggcttcattctttctgaagaaaagctcatgggcatagctacatagtctaacactagagcagggagctgagagatctgcattctaagcccggttttggtgtcttctctgagggtggtctcagaaaagtccctcaacctttctggaactccagttgccttacctgctaagagatgtggaaacaattccttacagctctaaaactgagactaaacaatccattaccatttaattgtctgagacccactgataccactagagggcactcatacactggcatatgctggggaggtttccccagtgtcaggtaacttacaggttctttcccatccatggcttccatccatagccttctgttagcttctgaaagggcctgcagagtgatggttcctggcctgagggggaaaaaaatggtaagtataaagcagaaaattcaactgagagaatggagtcttgtg

SEQ ID NO: 8209 - DNA, 1054 bp, artificial
  synthetic oligonucleotide
atagcacctatcacaaccagtgaactcacaaagccagctagcagcagtgctgggtataccaggctaagtccaatcaggagatagaaaaccttacaaataattgacatataagaaaactctatatggtactctaagtttaaggaaaagtactcaaataaggagaaattttaatggggttcagacctcacttgaaaagcagtaatttggtggggcgtggtagctcacgcctgtaattctaacactttgggaggccaagccaggagggctgcttgagctcaggcattcgagaccagtctgggcaacatggcgaaaccctatctctacagaaattacaaaaaaaaaaaaaaaattagccaggcatggtggtatgtgcctgtagtcccagcaacttgagaggctgaggtgagaggatcacctgagcccagggaggttgaggctgaagtgagccatgattctgccactgcacctcagtatgggtgacagagtgagacccaccctgtctcacaaaaaaagaaaaggagtaatttaacactccggatagcagaatgtttgctgatttggcccggtggttcatagttactatgtaagcaggaggcaactcaccagattacaaaaaagcaggccaacagtgaccagcggagaaggtataaagagaaggtgggaaaactgagttgcaggtgagctcaacggggccagccttgtttggtgagaaccccctagggtgcaagctcaatgtatgagggccctgcagagagggtaatagctgcatgataactcttcagccagcaagtgggccatgtggggtagggggtctacagaaggaagctgagggacagcatggtcatgaaggcttcaaggagattgaggcaccatgtgtctgggtgggtggctgggtcagagttccatcaagctgtcctccccaccctgccccaaccccgcctcagctggaaacttcaagagatcccccttcctcctgcaacgtcctccagctccctctactgagaaagtttaagagtgtgctcactataaaggaaagatgcttaaagaaaatctg

SEQ ID NO: 8210 - DNA, 888 bp, artificial
  synthetic oligonucleotide
gatgcccttcctcacttctccccatcataattccttccccaatttatattcatttatggagatgaccagacacaggcaatttccatgcttgagtgctgtgaactttcttactgttattctaaagcttactttggactcttcttttacaaaggataaaatgcaatataagacccactaaattatccagactggggtagaggggtccttttgctacaaagccaggaaatggaaaagttataatcaagcaatgaattcctggcatggggtgaaaggcactcattaagcctaaccatctcagcattcctggaattaagtgggaaatagggagcaaacactcaatatacgattgaaaagttgttgggacaaaagggcacaacataattaaagacagaagaaaatgagtcagtcatgtggcaaagtatcagcaggaagggtgagaaaaacaacatctcaaaagatgaatactacttcaatatgtgagggctttgttattgggtaaataaaagagatggagaaacaactagggctaaagagaagtacagctgagctttctagtgctatctgaatgaaatgggggcaaatgcctttgaaaacaacataggcagcagtccacaaaccctgtgggcagagaagaacatttagtagactgtgtattagcaagggggccatctaagagggtccagggaaaccacacatattggtctcttcttagtacatttaaaagcaaatattttaaactaagaaaattcccaaatcatatttccacaagcagaatcctgtgagtaactaaagataactaaaaaccatgcttacataatcagtattttccccttataaaacacgtccatgtttactatgttatttggagcactttaaacaaccataaga

SEQ ID NO: 8211 - DNA, 1715 bp, artificial
  synthetic oligonucleotide
tttgtagaatattaaagcataataagatcaaataatcaagaaaatgataataccttataattatttctcatattaacttatttgtaagattccattctactttcacaatttccattgctcaatttcttcatttcagcaaccatgactgttttaatatacactcaaaggagctacaccacaaggcataaattagtctttttttcttcctaaaatataatattgtaaaaagttagtactaaaacaaaatatacaggcagacctttcaatattattgacttaacatcctagaccatagtgatgaagactcagcaaaacagatgctgaaatcgaaaaagttagagtacattatttcaaagaataaggttcctattcacagatactcattttaaatccactatttatacaaactcagtatatacatagtttaataaaagagcattaaaatgatattagccattgataatgtctctggacaaggcattgttgagcagtgtttgagaagttatgataaggccaggctcagtggctcacacctatgatccctgcactttaggaggccgaggctggcagattacttgaggtcaggagtttgagaccagcctggccaacatggtgataccccatctctactaaaaatacaaaaattagctgggcgtggttgcagacacctgtaatcccagctactcgggagaccgagaccgagttcaagaattgcttgaacccaggaggcagagattgcagtgagccgagatcacaccaccactgcactccagcctgggcgacagagtaagactccatctcaaaaaaaaaaaaaaaaaaaaaaaagtcgggcgcggtggctcatgcctgtaatcccagcactttgggaggccaaggtgggtagatcacctgcggtcaggagtttgagaccagcctggccaacatggtgaaaccccgactctactaaaaaaaaaaatagctgggcgtggtggcacacacctgtagtcccagctacttgggaggctgagacaggagaatcacttgaacccaggaggcggaggttgcagtgagccaaggtcacgccactgcactccagcatgggtgatagcgagagactccgtctcaaaaaaaaaaaaaaaactaaaagaaacgtcatgatgagatagaaagaacactgagtttgtagttcaaattctggccatacctcccactacctctgtgatcataaggctctgctcatccctaattatttcctatctgcagtcaaatattctttctgattttatgagtacatatatcttaggtaaatattctggggcctggaatggacatccagatcctgtcttcataaacccaactgttgggcccaggaaggtgcctataactcagtggcatcagactggagactctgagtgactaggctagtttcccctacatattagtcagcctgtatttatttaagctctgcagaattccttcatttgtactcaagagttttacattttacatgactgtgactagagaagctttctcttgaaatgcagagacaaaggaaaatctttctagttgtgtcagaaaacttaataactgcatctagaatctgcaagaaaacgaattcattttaagaaagtaggaaaggaaattgcataggacagaggcagggataaaatacagaagtacataaaacattgcatctgtccattgtggaagattaatgtctgctgtggaacgtagac

SEQ ID NO: 8212 - DNA, 1405 bp, artificial
  synthetic oligonucleotide
ggctttctgatcagtccccactttactgtcattggaatatgggtaaggctgtgtgactatgagaaatatgcactcatattccttttctcttctctttgtgaagtatattcttgaattttcaagtcataagccatatccaaacaccaattaagttattaattactacaatttaagtttgtttatggcacaagcactgtcataagtatgtttttttaaaatatatacttaaacagtagagactaacatttattaagagtatattactttcaaatatgttatttcatgtataccttctataaccaaggttggtattactgtctccatttataattgaggaaactgaaactttaagaagttcatagcttgttcaaatgccacccagatagtaaatagggaattcaaacccagatctgtgtgcctcccaagccaatggtcattctggcaactaaatgccattgtgctaagccttcccattaccattacttgctgatgagctcaatttcctagacagagaatatgctgaaacctaagctcagtaacctaacttcaaccaagactatgtctttaaccactttagtcccaaatgttctttaggtgcataagaataaaaaaagaagaagacttaattaaagccctgcagtccaaaagttagcatttccccttccaaactagtttctactgctctcaaaaggacagagttaaagatggaagacatctacaaggcaacaatctaattccattctttctctagccacgtctgtcttggctgatttaggtggctaggaagcagaggagttgactccatgacctctcaagactctttctaatattgtaattctgattctctttgccctacttacacatgggaacctgtgattattctctatagctagattttggaggccagattgctccattttgaaaaggtaccatgaataacatgagatagaaacttataactgccatattttttaaatctgtattaaatcatactaaaataatcatcctgaaataacaagatcataccaatcaatcagaaggaattaagagtcagggaagcagagagttgctcctgttcataacatttcttctctttagacctcagtgaaatattatctgaccagctggagaaagcttgactgggcaatgtgccctgtggtgacttctgtggctcctgtcctgtagccttcactacttggtgtattacatcattattaactataaagggaactgctgtctggcccctttaataaagaacttcccaactgtgtcaaagagagaaaaaggtccctgttagcttatgacaaataacatatcaaaaaccatgggtttctctgccaacggagcttcagactgcttatatattacccaattgtataatacactttagggcttaatataccag

SEQ ID NO: 8213 - DNA, 533 bp, artificial
  synthetic oligonucleotide
atcacacactgaatttcctcttcatactcttctcacaattgtaattaattatttaagagggtaatttgatatttaacatatgttccaaaagggcagagtctatagtattcttattcaccactgtatccccagtttccaggacagtacctgacacatagtaggtgcttagtaaaaccttcttgaattaaactgaattgcctttacattgcccaaggtttagcacttgatacaagcctggtaaaggatcatgagggccttccactccactagaaaataaaatcagctcaagatttccagggtactcccatggaaaagtgtgtaactttccagatcctcataggcttttaggaaatttctgtagtaactgattagagaaacagatgccagattaaacaaaaggttttggctatgcttaaaaaaaataaggctataaaaatgaggctgaaaggtaaagttccttcatcactctagagtctgattggaaaacttttcttaacaggcaagtcaagctaaaatcttccctaccccagcct

SEQ ID NO: 8214 - DNA, 1763 bp, artificial
  synthetic oligonucleotide
ctttgattacgtctttgatgaatttgttggtcctctccagttcctgctcataacacttgagcctctcgcggaaatcggggctgtccaggtagcagtcgctgaactccagcgggggatgacccatggttctgatggccgggagtagggggaaaggggaaagacacaaagaccgagagcatcaatggcacagtagaggaagtagaggggacggactgagcgcgcgacccgcttaaggaagctcatagcctccgtccctttggaggacaggtacctgtttcagtgagactcctgaggagcgctggctggtccggacagagaacaggcgccccggcgatggcttcagggccagggagagctaactatcgcagtcggatcccggcagggtgctgcctagcaagcagcatgtcccttaggcatcgccttcccagataagcagcaaaaaccgcagcccgacttgcctccggagacgggccggatccttcctgagcaattgcaaacgtgacacttgggcccgcccaaggtgtaggcgaggttagagctggagctgggaacagcctctctacaggctcctcgctccggagcgagcggaagacttccttggccgaactccgcgggcaacccggattgcactgtcccctcccctttcttaaagccaacgcctgcgccccgccccagcgaagcccgaggaccaaaccggagcgctctggctccttcctcaactgttttccttgtaccttagagtttcctgaccagggcccgctggctgctaagacttcttcctggtgcaagggagccggccggccggccgtccttttaggcgccggaagggttaagccagggcggcaatgaaacgtagcctcgctccatagacactgcagcgggaagaggagggcgagagcgcgacgcacaatagccgcggtagcccagcgcttccctacggaaactggggagcagtcagcgccctaggactccagctggaaagcgtggcggcctgggagatgtagtctttccgtttgcactccccaagactcctccctgcagtctccccaccaccccgcctgggaggctgctctcccagaacggcattcccagcctgccgcaggctcctgcgcagggaccggccccaaggggcaggtgcgcggcgctggactctgcgggggaagtttccgaaactagagcaagaacccgcaagactagattgcaggaagccatctctcaattcccatgattcggctgggttgtgtattcttttgccttcccctctttccagcctccttcggacctaccaacttcttttcctctttcttttcccatgtctcctgctctaagtgctctaattcccttgggccttcgacctgaagggttgattcctactctagggtctccgtgaagctcagtgccccctgccaaagaaagggaggccataattcagagttaatattttcctgaataggacctcagagcatggcttttgtggcagacgccgataatgcatatgattttccatgtgtaagtggaaagtctaagaataggatgttataaattgtcttgcagcttaccttaaaggcagctgtcttgagactaagggtaggtagaggctcgaaaaactaaaaaatagtttgtgcgtgggcaaagagatccctttaattctgcagaagtgtttacattagattgccctgtgaagaaagccagaacggaagggggttgtaaatagaataatagtggctgacccacctgaattagggtcctgttgctgctgtgac

SEQ ID NO: 8215 - DNA, 2317 bp, artificial
  synthetic oligonucleotide
acctatcaccaaggctaccttgaaataagtggccaagagggccaatagatgaggttagaaggggtagaagcgaggggcttgtggctagggagaaatagctaattttggaggttggcaaggaaatagcagacgttatcaatggcctcagggaagtgggacgggaggtagtgatctggtaatcatggggtgggaggatgaggtgagaagctcaggctggggttgggacatttgtacatgatattcccttgcaattgcaaaaagatttcatgtctactggcttaaattttaatatcacttccaccagtatttgtgcaagtactaaaattgtgcttggtctgaaggggaattatcgtaaacaaaacaaaacaacaaacaccaaaaaaaaaaaaaaaaaacacctccattcgtttggaattttgtccctccacattccacattcttcctccttaaatttactacttggattgcctatccaaaaatataaaacacttttatttcacagccatcccctgccttgttggttaaatgcttaacaccaccaaagggcacccaggtatcctggatgctgatgctgtcaacaatggctgccctgtctgactacattttagcctggggccaacgtaaactgggaccagaaataccttgaaagcccaaaaggatgagataaggaaaacaggttgggacatgaagattatcttttaagttattgtcacaatagttactctcttttagaccctgaacattttcagtacttgctccaaatggtttagcaacttttgaagtgggattaacaagtttggccaatgaagcttcttccctgcccaccgccagaggtgctggagaaaagtaatcctggagggtcggcgtggaggcagtagagaggtttataaaagtcaaggaagtgggaagaggcttgcgagcagcaggagaggcgcagagtcagaggggcaggggcggcggcggagggagcaggaggttggggcttgagcccgtcattccggcgcacgaaaacttgaagtcgctcggtagccggggaagggaaggaagagaggcaggctctttcctagaggtgccgtgatcgagggtctggcactccaagccaactcctgagaacgggaaatgggcgggagtcggtggggtggagagggcagccgtggtcgcgagagcgaaggagcggtctgagaatccggcttgagtgttaaaggctaagcgtgtctagctggacccgtggccccgaagaagcgagacaaggcgacgcggagctgtccctgacaccccgaggaccgagggacagcgaagggccggggccgccggccattgccaggcgccattaggtgacgcggccgtcacgcgatgacgcgctgaccggcagtggcctccacgtcgcaggttccgcaaagacctgtgggagcgacccgggagaaggagggccaagatggcggaagcggaggagtctccaggagacccggggacagcatcgcccaggcccctggtgagcttgggatctgcgacaaaagggaccgagggtgaggcagagtgccccctaaagaagtcgggggacgggctcgtggcctgagagccggagctccttccgcccggcaggcccttcttgtacccgatgccagaaccagtcccaacactgcacctgttctttgcgctaaccgctttgccccctgccctcgtggttccttccaggtctttttgtgaaactccgatctttcctttcccatcctcccaggtctcgtcatcgtcccctacattgtgttaaatggcgaactttaggtgatttcttaagttatcttttcttctgctgtcccctcattttatcaaaacctgtcaccagcctttgttgaaggaataatgagagattgcttcccgtgggacattaacgttttgttgcttataactttagtattgacttgttcagtgaccccagtaggccaggtttaacccctgtcgcagctccttgccattctcttcaccatacttgttctcctttcttattttttacttttttaaaaatcgagacaaggtctcactctgtcacccaggctggagggcagtggcgcggtctctgctcactgcaacctctgcctcccaggctcacgtgatcctcccacctcagcctccctagtagctaggaccacaggtgcgtgtcaccacaccaggctaatttttagtatttttttgtagagacggggttttaccatgttgcccaggctggtctcgaattcctgggctcaagctatcctcctgcctcggccttccaaagtgttgggattacaggcgtgagccactgtgcccggccatcttcact

SEQ ID NO: 8216 - DNA, 4540 bp, artificial
  synthetic oligonucleotide
cttttattctctaaggtaatgattggaaatggaaatcaagacttgtgcctttcacaagtccctgccttcctgtggaatgctagaaactttattttctttccaccaagcttagctctttccctctgttatagtggaatgcattaattgaaagattggcatatgctcagaaaccaggaaaaaaatgatgaaatacaaacaccaagttctgtccaagtttacttttctgattcttcactattactcctgtaatggttaattttaggtgtcaacttgactggattatggaacacctagaaacctagtaaagcattatttttggatgtttctggaggagatcagggtatgagtctgagtggactaggtggggaagatccactctcaatatgagcgggcaccagccagtctgctggaggcctgcagagagcaaaaacagaaaaggcaaatgtgttgatttacccgctggagctagcatacagtcttcctcttctgtccttggacatcagaattccaggttctccagcctttgaactctagacttacaccagtgcttcctccacaacaccagggttctcaggcccttcaacctcagactgagagttacacctcagcttcccttgttctaaggccttcagatttggactgagccatgcacgttaccagcattctagggtctccagcttgcagaccttgcagacagcctgttgtgggacttctcagcctccataatttcatgagccaattctcctgataaatcccttcatatatatatatatatatatatatatatatatatatatatatggagagagagagagagagagcttaaatgagcataaaataaacaggtagagattgaaataaaaggagatgagagaggtacttttctagtgcaatgagatgtattattctcatctgaaatcacttatgatttttattggaacaaggcacccagcaaattgcctggcagagagtagatgtcaaataaatatttgtcgaatggatgaatggatatcattgaatgaaaagtagaatgtaaatagataaataaatcatttttaacaaaataaatgaggaagaattcttctaatattttcctgcctaccatgtccctgtctcaatgtggaaaagtgactgatttggccctgccatgggaaccctgcctgaactgtggtgtaagtaaataccatttatagtcacctctcttagactcttgaagctattaggaacccaagtggttagctaagccaatctttttctagtatgcatctagtgacaggaaactcactacctcattggcatccatgctatgattcttggatgctctaaaaatatctgactgctgcatcaattacaggtctagtgctaggacgcaagcctctctatcatccagactcaggtactctccagtgtatcacagctgccgcccttagaatatatagctgtattttattcaaaggcggtgggaaaataactttcctaggaagcaggaaacctggatccaactctgagctctgccactgccttgctgtgtgaatttgggtattctccttccttatttgggcctcagtttcctttttttgcacaatgaggggggtttcaaacaggatgctctgcaagactcttccagctcagatgttccaggactctctaatgaggtctaattaagatcttctaatgcagtggttctcaaattgtggtccaagaatccctggaatgcctgggcaacatagtgagacccccatctctaaatatatttatatataatagaatatattctatatactatatagtatatagaatatattctattatatatagtatatagaatatattttattatatatagtatatagaatatattttattgtatatagtatatagaatatattttattgtatatagtatatagaatatattttattgtatatagtatatagaatatattttattgtatatagtatatagaatatatattaaattattaaattacatacagtatatattatatatatatatatatatatatatatatatatatatatatatatattagtcaagtgtagtggcgtgcacctgtagtcccagttacttaacaggctgaggcaaaagagttcgaggctacaataagctatgatcgtgccactgcactccagcttgggtgacagattgagaccctgtctcaaaagaaaaaaagaaagaaagaaagaaaagaatccctgaaggtccctgagaatctttccaaaggtcaaggtcaaggaggtcttttcaaactaacatatctgcaggaggcagaattttctttacatacttcaatacacaacagaagcagctagcttctgaatccagccaaacatcaaagagaataacaacaaatgtaaaatctccccactcttctcggtaaatttatttttgttttgtaaaatattgttatacttcataaaatattaaaaatatattctagaatatattatttatattaacatgtttaatctttaagcatgactttgacaacgaacgaatcaatcaagcaatattccttaaatgtttccatcttaatttctaatatagttaacatggatagatgtaacccacgtaaataaaaactccatcaaatcattcataacttttaatggtgtaccgcggtcccgtttagtaggtctgacttcctttctcattccatatagttttctctctggtcccccaatggtcacagatgtgctctgctcaatatctggcacaggaatggacacagtgtctctgggagggaggccattcttccttcctcatgggcctcagccataatgggcctgtcttctccttcacctgggttccttggcaaagaccagtgacttgggccttaaacaagacaccctcttgtgggcagtgccagttcccaggtggagaaatcaagcagctgatcaggcgaggcttgatgtgctagcctccctgcttgcctgtgcacagttgcccagcccctctgggttccagctacgctgaatgatacactctccatatccgccacccaaagaaagcagatttcattactgctatgccagttgtgtcaggccttgagtgtgaggcaagggagaacctgcctgattcagatcccccatggggtatatggggaagagggatatgaggagggaggacttgtgttaactgagagaacccacttcacatcaggtcctgcatgttccttcttccttttttttttttttgtttcttttttctttttttttttagacatttgagacggagtttcgctcttgtcgtccaggctgtagtgcaatggcgtgatctcggctcactgcaacctccgcctcctgggttcaagcgattctcctgcctcagcctcctgagtagctgggattacaggcatccaccaccatgcccagctaattttttgtatttttagtagagacagggtttcaccatattaatcaggctggtctcgaactcctgacctcaggtgatctgcccatctcggcctcccaaagtgctgggattataggcgtgagccaccgcgccgggcctgttccttctttcttaatgacaaacctgggaggtgagtagagatctttatccttattctcctattatagccatggaaaccaaaggtcccagaggtaatgtgacttgtctaaggtggttatgcaaccaaaaaagtagctgggcttggatctaaagtcatatctaataatgtcaaatcaatgctccttctgctttaccagaagcagggagagccaggagcgttcaggacaagacgagagaggaagggagctaacatttattgaacatttactatgtgccaagcatatgttatctcattaactcctaacagcagtccccttatgtaagcagtgactctcagtttacagatgaggaaacaggcttagggaagggaagtggcttttgtaagggtacactgttaggaggtagcagaaccaggattcaaatctaagtctgtctggctccaaagcctctgcttcttcaataataccaaatgagatttatttttatttgttaattgtttatttatgatgagacaccatttcttaacccacatattcatatttcatagttcaggaacacaggtctgtgaccaacttctatgtaattcaacccaaagaaattctttatattccaaaatcactttgtactctgaaatgtaccaaccttcctcatctcctcaaaatcttttatggaatcataatttctgtaaaaatctgcacatgccttcttccttggtttggtcagagcaaacatagagagctgcaaccctcagggaagcaacaaatgctccaataatatgaaacccatgtgtctgaggtttcatcaaagcactggaagccatggtagttattatccttgataggtatgtcaacctcaacaccaatatccttcctggctgatggagaatgagccacaaataacatatattgagaacgtactttatgccagacactatactacatgctttaattcattctgtttaaacctcccaaaggaagtaggtactattattattccccattttacg

SEQ ID NO: 8217 - DNA, 2644 bp, artificial
  synthetic oligonucleotide
tagtttctgggctgaggaacatggttagttcacagatagttgccagggtaaaagtgtggatcattttggggtgccaaagaaacatatagccctggaaggaaaccagctctgcctacaatctggagcttctacaggtacacatgtacatgtgtcacatgtgtagtgtgcaaacacacacatagtctatttaccaaaattttagtttcatggaataacaaggccttcaccatacaaaaacataccattgtctcccctgaggttatgggtaagcagaacctcttcctagaagatgcttccaagagcatctgcctagaatggcttgtttttttccaaaaagatctggaggcaaaattttcatattaaaacaagcatataattgttgtggaatagcataaaaaattcacatgaattacctgggcatgatggctcacacctgtaatcccagcactttgggaggccaaggcgggtggatcacctgaagtcaggagttcgagaccagcctgaccaacatggtgaaaccccgtctctactaaaaatacaaaaattagctaagtgtggtggtgggtgcctgtaatcccagctactcgggaggctgaggcgggagaatcgcttgaacacagaggcggaggttgcagtgagccgagatcgcaccattgccctgcagcctgggcgacaagagcaaaactccgtctcaaaaaaaaaaaaaaaaaaaaattcacatgaattcataagataaaagtggagacttgaaaaaaaattctcacttgtggttggctgtgtgagattctcctccagctcctcgggcctctgtggggaataaattctttctgttcattggaggtactttggggatgcaaaagtctgagagccacaaagtaaaacagtaggctccttgagggtagaaacgtctcatttttctctgtatcctcacatctgaaacagagccagccacagagtgcttgggaactatttgctccattcatgcatccatccatccatccattcatctatctatccatccttaccaagaaacaagcaaaaaaggtagccttagagtggtggaaagaatacagtttctggaaaattcataaacctctgggtctgaattctgactctgtcacttattagcctcagttttcatcacgtctctaagcctcagttttctcaggtttttttttttgttgttgttgttgttgttttgagatggagtcttgctctgttgcccaggctggagtgcagtggtgcaatcttggctccctgcaacctccacctcctgggtttagttgattctcccaccttagcctcccaagtagctgggattacaggcacgcaccaccatgcccggctaatttttgtattttttttttttttttgagatggagtttcgctcttgttgcccaggctggagtgcaatgatgagatctcggctcactgcaacctccgcctcccgggttcaagcgattctcctgcctcagcctccccgagtagctaggattacacacatgcaccaccatgcctggctaatttttgtatttttagttgagacggggtttcaccatgttggccaggctgatctcgaactcttgacctcaggtgatccgcctgcctcggcctcccaaagcgctgggattacaggcgtgaggcactgctcccagcctaatttttgtatttttagtagagacagcgttttgccatgttggccaggctggtctcgaactcctgacctcaggtgatccacccgtctcagcttcccaaagtgcttggattgcagggatgagccaccatgccttgccctagttttctcagttttaaaataagaatccaaatacccaactcctgagttgatgtgggaccttaagtgtgataatgggagtgggagtgctctataagatcccagacaatacagaaattatagttatttcatgactatcaaattaccaccatgactagcccagacagtagtggggtggggggaggggaagatgttttctccagccagaagtctgatttgagaataagaaagcaggagctgagacctcaggaatgagcccccgggcctctgggatggagagggcagatgttgaatcctagctccagctccacctccactccaggaaggcagtacgcaggccagaggggaacttggggtggagtgatggaaggatcagatgtgcctcatacacttcaggtctccaaagaccagatgtgctttccttctcacgtctgccaataagcccctttgaggcccggtttgcagcaagggtcattcatcactggggctgaaatacaaccaggcatagtgtgttgacttggctgctaacagactctgcctccttgggtaagtcctttttcctctctgggccccaatttccctatcattaaaatgaaaggattggatcgggttgtccctcaggtcctttgagctcctacacgctgtatttaagacttttttgggccttgattttctaaaaatgtgaacaatgtgatttgccaaaaatataattggtctgatcatctgatagttggacactgaatcatggatgggtgaaaaagttcaaagcaattgtggggcaggagacgggcctggctggggccctcttctgtttttaagtctgctggttcctgtggctccttctgtacgtgt

SEQ ID NO: 8218 - DNA, 3995 bp, artificial
  synthetic oligonucleotide
gatgcttacaattgttaaagcccagcctcaggaaggaggtcatatcccttcccacccaccagaaggattttgcttctgggagtaacttctggtgtgcaggcctcatccatagacccacagggacttggcgcaccttgaacaaattgctagaggatacgaggggcagtcctgccatcaagaggaaaagagggatacatgggacacacagtggtggtagtgtcactttatcattgctcctctgactctcatcagggccagcagggaaggaatgtgggagaatttcagtttggcctagtgaactgaaagctagacaggagaggggcacttggggctgggttaggtctggctctgtctttccctgggtgaccttgataaagttgctgccctcagagacagatatttttgctctcatctgtatcagatactctaacaagcaagttagatggatgcagttcctgccttctaggaatggtgtggagaaaataaccagtgtacaggtattgaccctgccatggatttgctgagtaaatcatttgaggccaggagtgtgagaccagcctgggcaacatagcaagacttcagctctacaaaaaatgtaaaaattagctgagcatggtggcacacacctgttatcctagctactcaggaagttgaggcaggagattttcttgaccacaggagttccaggctgggtagctttaagtgagtcatgcttaaagtctgctcagtttctgtctttgtaaatgtgagggatagcagttgaactgcatgaggtcctggatactctcagacctgactaataggagtcctcaattcaacaatgaaatcaaggttgtgaacttgtgttggacccttgtgatgaaaggccagagagaaatcaaagccgaaggctcttgtttcttactgaatttgaatggactttctggtggtgcttactatcagaactcctggaagccctcccctgccacgattaatgttcgtgccccaaattttccatgcatttctctgcggaggtagagttcagacttggggtaggggacagaagcctggggtattggggaagttgcagagccactggggcctgagcaacgtagggatggcagcttcctgctcaaattcctaattatctggttttcccctaccaattggagatttcactgaagttgtgtcttctggacatcccataaattatccgagcaagtcactgaaccctcccgggcacatagcatatgtgtttaaatcccccaaacagtgccggactcattcagaactcaataaatattagcctgtgtgcctggccaagtcactgcttgagcctcagtctttgggcttgcacctcctccctggcagcggtgtgaccggagggaaaggcagcggcgagggccttggaggacctgcaggcagtgccccgcccacccagatttgggtgactttctggcgagtccggtgggccagactgcgcccccattggccgaggggaggtgggcggggcgtccctacagccctactcgccgacgctccctccccacttgagctgagtggactcgggttgacaacggctaagcagccgcggcagctgctcttctggctggcaccgtcacccctgcccgaccccaggccccgcgtgtgtcccggacggagcagtccctcctgggctcgcctcctgcccgctcgctctgtgtcagcgcccgaacccaaaggggtggacgcggcctccaggtaggagtctgggcgacggcagggggagatccagacaaacgggggcgcctggggctccctctccccgctttgcctctctggcgcgctccggctcggcccttctcctagcggttccgccgggcggcgtacgcaagagacagggaggaagcgagccgagccacccccgcccctgggattggggggtcagaatcgccgaaattgggggacccccgagcgcgccagccgcgcgtcttccagcgaagcctcgcgagtggggcggtggaaggcagctgtccgcctgttaccgccgggcccgtgggtctcgcagccgtcgctctggggctttggaggggcgttgcagctggccgggggcggcagagcttcaggctctgttgccgggtcgcgccagatctcctgccctctcctttctctgctttcgagggcatttccaggaagcccccgtccggctgtatgggttttcccgtcggccactgcctcattgctttctctcctgagaaatgcccaggacttcttggtattaagatagctgcggggaccaagcgaaaacgtttggacacgtctcatcttcataggcctcattttcccataaagtccaaaatgggtttggattagaggaaaggcttttagtggaagtttttggaatttccaaattaggtagtgtggggttctctccacgttcctcctgacacttgtgaaagttgcgcgctgaattacgactcaggaaactggggttcagccagtccatgtgaccttaggcgagtcatactactgtgtgggccatagtgttttcagccacacctcaggtggcagcttgatttcagtatctaaagggcccggtctctttcaccctgacatttgtttacttggtacctggggtcaggctcctaactggcaggtaaaaggttgtctctgagacgctcggggtggcagcagctatgcacacggagagctttgtggtgattatgcagctaagccagctggaaaactagagtgtgcgtggaggggtgggcgacagcagccagaccaaggtagggagaggtgggagttttcttccagagcctggggccccagaggttgggggcctcagagattgggctggcttggagcctatgcttacccccaagtcccagggcctggcttctctcccagtcagagcctaagcggggaggaggggttaatgaatcacacccagggctattttcaaaccctgactcctcctgtgcgacctgctccctccccactctagggtttgccgcccccccgccccccacacctgtattattgccctctgagttttcctctcattttcatcctcctggaatgaaagggggacaaatcttgtctgcggatgcgatgggaaggtgggcagcccaaaggcatggagaagaaggctgcaggtgatttctgggtggctttcgcagtgggaagagtgtgatgggaagggtggtgttttgctgtaagggcataggggtcggtagtgaaactctttcactctaaaggtacagctgccatctagctggacattctgggctggttttcattttagggacgtggccttttgttaatgtgttggactttggattttggatttctgctccctagacctctatatttagtgctaggaaacaccacactggacactgcctctcctgtttttggagaattatgctaaacctctctgtgcatctacagctcccctcccccacctagagaggagaagctgcctacagatgatatctggaggtgtttagagcaagaagggctgaactgaaggtgtgcaaagcaaaggggctgtgtgcgctgtgtgcttgcttgagacagggcttgcagtgagtcatgtggggaggatggcagagccttccttattcaaacacaatacctcctgagttccagcagagaagcaaagaaagtggcaccaagaagactcgaatgttgtccctctctgtcctcttaaagttttaaaattccattattgggactacagattggagagggagcagaagacccctgtgtctaggtttagaggatagcaacagggacacaaaggcaagaaggtcccaaaggaaggaggggatggagtctccaattgggaagctgtcacagctgcagctgctttgctgctaggagactcctggagctccttatttgagccatggaaagttcaggttcaacagatggcaggtttatcacgtgcaggctgtgccctcacctcttttctggctagaagaaagggttgcctctgccttgaaaagaagagaaggaccttttgccttagg

SEQ ID NO: 8219 - DNA, 2907 bp, artificial
  synthetic oligonucleotide
aatgctctcagtagctataagatgtggatgctggctgggtgtggtggctcacacctgtaatcctagcactttgggaggctgagacagggagacaggaggatcactggaggccaggagatggatatcagcctgggcaatatagtaagaccctgtctctacaaaaaataaaaagaaaattaaccaggtgtggtgtggtggatgctattgtagtcctagctactcaggaggctgagatgggaggatcacacaaacccaggagtttgagcctgcagtgagctgtgatagcgccactgcactccagcttggttgacagagtgaaaccctgtctcaaaaagaaaaaaaaaacccataaacatgaaaaataaaataaaaatagaaaaaagatgtggatgccatggctcctattttaccaagaaggaaacagaaacctggagaggttatacaactcgcccaaagtcaaagagctagtgactgacagcatcaggatttgaaccctgggttgtgactccactagaccagaaggagcaggaaaacagcctggggggctggggttggttcctttgagtctgagctccttgcttggctggcatgagggcaggtggcataatgcaatggcaaagagcactgaacatggagtgaaaagatcagggttatagtctcagctgtgacactttaccctgtatgaccttggaaaagtctcttgggcctcagtaggccttatactgtaacttttaaaaaataccaatgtggagagtcctaccgcagatcaattaagccagccttctggggaaggggccctgggcactggtattttttaaaataacacttcctagctgattcttatgtgcatccaggggtgagaatcactgagcaatgtgatttagaccaagacttttcaaactttaatgtgtttgcccaagggtcttcttaaatatagtggttctgggtgtggggcttgggattctgcatttctaacaagctcccaggtgatgttgatgctgctagtctgggactacactttgagtagcaaggggctacagggctctaggtagtcatgaaagaacttggcattgacctgagtgagatggtccccttctgccaacccccagctagggccaatgcctagcatcaggggagggaggtgcctctcctaccctctccattagccatgagtaactgagggctgcagtgggattttaagggtgtgttcctggcatgcaggcctaccctagagatttgctccctttcctggggtggccatacttgtgaccctttaggggccactgtctgctcctgcgcctgcctctctggaagtcctaacctggtccattttctggcacctcccttttgtcctaataacaggaaagcagagctggctgccaggatgcgtgctaagatggggaaagggtctcatcccaggggcatgacaggaacagggacagggaagtggctgtggcagccagctcagctgtcctagcagcagaaccatgttcctcacaggctccctgggcagctccctttggactggtcttacatcacctagactaccactggcctggagcacaggatcctttttcaggcttgcattgccccctgccagacaggtggaggtactgctagcagggctctgtcagacactttccagggacccctcagaggtcctggcgattcctagatctctatcttaggttaggaagttgcagtaacataaaacatacatgtatgcatgcacacacacacacacacacacacacacggagagaaagagacgagagagagagagagacagagagacagagagagaaagagaggcagatgcatgcacagactgaggtgcctgtgggtatatacaggtgcatggtcccacagtgatcctcatgagtcatggacatgagcagatttggctacagctacatgtagagacagatgctgtggtgggcactgacctgttgcattcactcacagaaatgcagagatgttcatccttgcccttacccccatttgcccccaaaacctgcaggggctccaggggctgcagagccctctcttctttccctcaaatcctcatcagtgtgtgacccttgaggagcccattactttttctgactgacttctgacttcccccactcttccctccactgtctactcacctagcatctctgaaatactgttttgtccttcatcttatctgtcccagccactaggatttcatcctgggtttccttgtgagtgagcactgggaagagagagctcttcctgtcttggaaaaacctcaccagcctccttagagtcctctggtcaggggggccaggcgagactgtggccacaggtgctgaggaaatggaggatgtgttgggggcaggactccatggcaggatcagctctgctgaagccagctgacttccccaaccaacccggtgatgccaggtcccatggtcccagccccattcatcttggcatcacctgggtgggaagcaaataaccgcccaggcaggtgcagggctttgctgctggtatttggcctaccctgactaggagcgcctcctctgtggctttagtccagctgcacatctctgctggtgctggcaggggtgctcagctctgtgccagaactcccagagcagaggcgacaggctgacctagccatggccccccaagaccccgacaggccagtactgtgtcttcatgacactcagcactgcactatgacacaaataggccaagagggctggggcagtactgggaagctccctgaggagggaggactataatgagcatgggggtgctgctgtcagactcagctgggattccaaccctggcactgctgctttgtccactgtgagaccataggctgagcctgtttgtttgtctgtaaaatggggatagcaaagccatcaccagttattg

SEQ ID NO: 8220 - DNA, 1481 bp, artificial
  synthetic oligonucleotide
taaagtgagggaggatgctagaggagatggtctctggtccccagctttgcccattcagggtttcttggagcagcccctccacagtagtcttgggatgggcaggggtcttcactgcttattggcactagatgggcctgagctctgtgccaccctccccaagaacttcttggcccctaagaagctgagtccaagctttttccaccctggggcctcagcagcagcactagaaagtgttcccagctccctgcattttttctttggggagaaaaaaggggaccacaataacaccttttctaaggtttagccaaacctgctcctctgggcttctccacccctctcaccgccccccaccaggaagctccgttggcatagcttccagaactcccatcgtcccagcctcaactcagagtcgctggagatcaaccggcagtttgcaggccagatcaacctcctgcacaagggctcactgctgcggcttaccgcgttcatggagaagtacactgtgccccacaagcagggctgggtctggtgagtggctcctgggccatggagggtggggaactgctgactcaggtccacgtccccaggcagggtcagcccaggaggtgggtgcaggcaggcagggcccacaggccaggggagcggtgagatatgccaggaggctggaggggcttggtgaggctgggtatggggcagaggacctgaggtcctccagctgtatcttctccatcccaatctctgtgctgcaactagtgagattgtcctaaaatgcagctgtggttgtcactctccagataaacacttttctctggctccccattgtccagattccctcccaccatgactccttcctgttctggtcccgctccatccttctggctctttagcctaccgctcctaagcaaccccaccttacagaccagtgggaccagtcatccttccgtgaacgtgctatgatctttttcctgcctctttgcctttgtttgtgctgtgctctctgcctggaatgcattttccccatttctcctctgggacaatgccttcctatccctcaagagcctgctgagttaccacgtcctctccgaagccttccctaactcactaggtacagttcccctccctcaatgggtcttcccctaagttcttggcctcctactggccacatgagttgttactgcctattgacacagttatctccttggccagactgagagctctctgtgttcctctgtgactccctggggctgggcccaaaacaggtgctcaatgagtgttgactctggggcagtggtgtgtgccttacccccctcaccccacctgatcctctgagactgcaggcagagtctccaaactgtgttccccctatctgatcacttgtcattctcccaaacaggtcaatgcccaagttcatgaggaggaacaagaccccagattaccggggacagcacgtatttggggtgccacccctcatccacgtgcag

SEQ ID NO: 8221 - DNA, 1134 bp, artificial
  synthetic oligonucleotide
ctccatggctttggaaaaggaaagtgtcctacccaagctcacagtgctagcaagtggggggataagactgaggacctcttgactccaagcctagtgctctctacacttcaaaaagagggcagatcctctccctgccccagggaggcttagcatatgccatggaatttagggctgaaagggggtttgttcacagaccatttagggtagtggctcccaactctgcctatgcattggaatcacctggaaaactttaaaaataccgatgtctgggtcccacccccagagactctgatgtcattggtctgggctgtggtctgggctgtggcctgggcttctagggatttcaaagctccacaggtaattctaatatgcagctagggttgtggacatttgatccagcatttcccaaacattgctgatgatatggatcccctgagatacttgttaaacatacctgcttctgggttccatttcagaagctccagggacaggcctgggatgctgtgcatttcacagcaccctcagagatgtttgagaatcaaagggctttcctaatctgcatcttctgtcagtttcacaatagccttgggagggaacagggaacagcgtaccagctccagttgacaactgaggctctagaagcttagcaatttgttcacagatgcacagtgaatactgtagccagagtcagaacttgactgtaacacatcacaagaggggcatctccacgcaccctgaatccttatggagttcagcctggggcgcttcaggacaaagtttgattttttccctaactcttgccttgcttcagtctctagtccagccaagtttctcccagagaaacactggtcttcaaggaaatcctggttctctaatacctcaccaaattcccccttcttcaggacatacaaatggcttatttctccacacagcagtgaactctttctttcctcttttctcttcctccctccttctttcctttctttcttctccttccctccttctcttccctccttctttttttcttcccacccctccaggccatctaagtagactggaaatagagaagtagaggtttggggtgagagaggcccagtctggtgaaaatgatgctcagtttcaggaagcctgaat

SEQ ID NO: 8222 - DNA, 505 bp, artificial
  synthetic oligonucleotide
ggctctgggcagagcagtcaagaggatctccccagtgctgctgctggggtgggagagacgcagccctgagaggttgcaggagagcacagactctaaggtcagagaggaaggctcccagattctgccccccgactgccaatgaccagtaagctacctctggggtccatttagtgtctcctccaatggttgggctcaaaaaaaccccaaacctccttctgtctccaggcagatgagcttctgtcatttgtctttcacaactctgtcaagaagttcttcgtgatgtcttacgcagattgttcatgttatcaattgaacattttgaagtattgctcagcactggatctgccttcacccatactccagtgcgaactaagtctagctcttcttgggaggctctgcttcctgaagggagatggtatttcaggctgctaggtaaacacagaactaaaagtgaatatctctatggagctccctcgatggcactgagaatggctttaaagtaaga

SEQ ID NO: 8223 - DNA, 809 bp, artificial
  synthetic oligonucleotide
agctccccaagcagacaaatatgcacaaacctttataaagacgtttcaaagcaatttataaaggaatagtacatcctgctctggagaaatggggttgaccttggatatagggctcagaatggaagctatccaagactgatggcacatccttgagctagatattcatctctctgttcttatccacatacctctattcatattttgtacataatttataattttatatttcctctagcagataatcccagagctctagcctggccctaggctgtggcagccataaccataaaatgctgagacagaaagcgaagaagaaatcaagtagagaaaagcaaatgcctatgcacgatctgatttctttcagatcctggatatgtgggttggtatttatttgcatgtctggaatctgttctaactagccacctctgctcactaacttcttctgtgtacttctctttttctccaaaaagcctcacacaacctgggcacttgaaataagtacatatgataaatgacctggtttctctaataacaaatatatatatatatatatatatatagagagagagagagagagagagagagagagagagagagagacagacagacagaaacatttaacagtttgtgtagtgctttcacataaattatcttatctgatcaccaaccccagagtcctaccaaagagttcttaatatgtctatttgacagatgaggaaactgatattctgagaggtaacatgagagggagatggtaagtggagcacacactggagagggatgcaggagtcctaggtacaagtcctggc

SEQ ID NO: 8224 - DNA, 6293 bp, artificial
  synthetic oligonucleotide
agcaggtctggacataaagagtcttcttctcatttcctctgccaccctgcccaccgggattaggtgctggcacactcaggaactgcttgtcttcccatgtttcccaagactggccgcatagcctcatctccccatcccccacctggccttgggctctcctcctgtggggcaccgggcatgctggctgtggggaggaagaatcaaggctggctctagggttggcagtggtggtcttagatgagaagaactctgggctatggccaggaatatagatgaactttccaggcctggcaacctcttgaaggacagtgagggaagagtcctggccagccccaggctgctgctgtccatgcacgacccagccttaaccaggaatgaaccaaagaagcaaagaagcaaggattggctgggaatttgagccagtatggtacaggggaatggccacaggctttggagacagatgtcccaggagtcaaatcctgctttcaccactgatcagcttggtgatctcagatgagtcacttctctctgagccttactttcccctgtaggtaaaatggggatactgaaactcatttcaaaaggttatgaaaggaaaagcatctaacttggttcttgacaatagtaggcactcagtaagcagcaggctgctttctgtattcaggttttgatgtcctagcatgcactccagggatcccagtctcccagctagactactggtgtgtccctacaccctattcatctcatctctccttccttacaccccaatgcagggtccagctgagagctcagagaccccaaacagctccttctttccctacctacccagagccacttcaccctcaagggctgcccctggaagtgggaagggcccagattttccctattttctcctctatttgggagaaaataaaaagacaaaatctgggctattcccacctctacagccacaaagatcatcagaggatccactgagaaacgcagtagctcagtcacctattaagcgagatgatggacatgaaactgtgtgaatggtggagcactttgggaatgttgctcatctaattatctccataaagaaaaagtggggagaccttgtattcttggcagtccctaagcctaccccaaactcagatatccttctagttctttcccttcctccccatacagggtgacggtttttgccaaggctacgcctgtcccaggtcttgtgctatggcaagctccgggtttatcccaggcgcccgcagtgctatggaagtccagcagggggagacattagcacgtgggtacgtcctctggggtccgaccagcgagagtgggtcggacctggaaggtctgagctatgggatcgagccaagttataagcaaagaggcaaggcggggcgggaagaatgggccagggctgggagacaaagacccagatggcgaggccgggacaggctggagtccggcttctccggtccaggatgcccgcttttgctttttcaaaagtctcatgccctgtgctttttcctctttgccctcgaggtgtctttctttatcgacgtgccctctcatccccgcttgcctatcccgggaccttgcccgcgccttcggacaggacaagactaaatcttggctccagaggtcccacaaggctcccccagaaagctgagattccgaaggcctggtccccaggggcgatgaacacgccttctctccccaccacaccccaccctgctccccgccccacctctaaccccaatcaagtactggaccctcaccagtttccccctcccactgttctcacttttatgttcctgactccgggtccaagtgcaagcagacagtgcattttgagggcgagaggaggaaagcccactaaagccttacgtgggactggacgaggagcagacaggctgtccttgacacggaggtgggcacagagcaggacttcaggggtcctgtgtgtaaaaagaaaatggaaatactttcctggggtacttgggacagggtcagtgggctggggtgttgaccagacgcgtggagaggagagcaggccggcagctcttgagagtgccaacttcccacgggttgagctctctgggaacaggactgagagggacccaaccctaaccgcacgagccgcacactcagattggtgccatcgggcgcgcggcgtccttaagagctccctgaaaccccgcccccttcctgctctgggggcgtggtatggggcaaggaccccgccactgagcttgctattggctaagagagcagggttggccttgcgttcgcctgagcaagggagtagacagcacagcggcagcggagggagtctatgcgagctggacagcagtgggaggtttgtgaggctcgcactggccgcagaccctcgggctcgatcgcccgggagccaggactcggcgacgcgaggctgccgggctacccggccgaggcttcgggggcgcaaactaatgggactggctcgctcggcagcatctccccgctcttctaagtacactgagcagggcccgcgctgaagtagaagctgtccgggggcgcgtagcccggagtcccagtgtggcccggaggaacggagcccgtgccagggcggcccagtcgggagcccggggaccgagcttgtgctgtggggaaacccccacttcttccaagggacagcgatcccgggacggtcgaggcgtcggggcggtcaccgagacctctgcgggaagaccccgtcggggagagggcgcgcagccccgaagcgtctcgggaagtcgagcggaatcgggcgggatcacccgggggcgcagagcccccgtcgcgcctcgtgcggcagcggagagcccaggagaacgagccctcgggggccgaagcccatgcccgggttgggggcggctgcccagtgagtcctcctggccggccgggcggagaagagcgacaccgaagccggcgggaggggagcacttcaaggccggcggctgcggaggatgggcgcctgagcggctccgagcgcagcgcggcagaggaaggcgaggcgagctttggtgaggaggcgccaagggatcccgaagtgcagtctgcccccgggaagatggctcggcctgggcagcgttggctcggcaagtggcttgtggcgatggtcgtgtgggcgctgtgccggctcgccacaccgctggccaagaacctggagcccgtatcctggagctccctcaaccccaagtgagtaacttatctcctctggacgctggggtgggaggcactccttcagggtgaggccgcacgccccggagtgcatgtggggaggtcttcggaggaggagcggcgcctcattttgtctccggctttttcgagtgttttcctgcgggcgggcggatggagcagggtgcggcggggtggggtaggggcacttggctgggttgtgaccccccgggcttcccaccccctgcctctgcacgtcttggatgaagtcgaggtggtcgcacaggcggagctggggagtccgggcgcccgagagcgcaccggagaactgagtggaggcgagaacgcagctccctccggggcccctgggaacgtggtgattttcgccgagagccgctccaggagcgagcttgactcgggcgagggacgaggccagaacacgggttcctcgtttgcgtagctgtggagggaacacagagcgggacccggcgcttggggtgggtggcagcgccaacatccccactcgggcttctcccattttcatttctctttcttccctgttttcctccctggctttttgctttgctgtctctttttgccccccgcccctcctttctccctgccggagcggtagaaaggcgggcgctgctcccaggctcacaaaggcagcgggtggagaggggcggagtgggagagtggtcgttgggtagtgggggttcgaaccagtgcccgtcaggggtccaatggagccggtaacagagcttcaagggcccgccagggcggagagtggcggccgagctgttgagggaggtgggtggagaaggagcgattcctgcccaggcaggtccccttggcccccgagtctgtcccccagattgggaagctgtgcttagttttccccaaggggttggggcggggagtgggcagctatataaaggacatcctttcttttctttcttctccttcctctgcacaactaccccaccaccaccacacacacaacccctccaaacaacacgcacacctttcagggcggtggctcagtggtttctgggcttttagtgggaagtcgctggggctgttgtagtgacctctggaccttctcttttggcatccaggactcaggttggaaccaagggtcaaaattgcccttcctctcaattttctggaggtcccagcaatgtgcgaacaaccccacttagcaggaaactggggagctttgacctgctccatccgtgatcactgattcctgtatctcaaatttcttcctgtccactcttgctgccccacgccgcctcccccccagccccgccctgccccgggtaacttcccaggctcctgcctaccttggcctcttgggtcccagggacgtttgatctctcagccctggagtaggagaaggcagctttagttttcttctcctcgattaaggtagagtcctattactggttggtgggatggctaaaccagggttggggtggagggctctccctgggtacaaggaaagggattggcaagaatttctttcctacccagaagccaaacggggtacaacactctcctaacagcaggggctcaaaatgctctgggagctctgggctgcttgagcccaggggggaacgttgtgaagtgctcagtggttgtgaagtgctcagtggttgtgaagtgctcagttaccctggtaagggtggaggctggaaatgttctgtcttgagccaggagagttgaaatccgcctggggtagcccatcataggggctcatgggagtgacctaattgctctctcgggtctctaaccagagatagcatgcagctccacagctggaaaggagccctcctgcagagttgggggtgctggaagaaacacgatctgtctgtgcttccccctttttgtgctcagagactttagtgctctggactggcttacaggttttggggggtggtatcctctctgacccccctcctcatctacctcaagctgagggcaggcattgtggggtgaggatggggggtggctgaagactctctagaaactgtccgaattccattctgtaattgggtagatcctgggaaggatcagagactgatcctggtgcaccctccttccatccaggctcaggggtctggaatgcagccactgtctacatgtgttggctcggggtggtgggggcaaatggacaggaaggaggcactgccctcagctctccttgagctttgggggctgcttctgccaccgcgcccaaccctcaggctgccacagcctttcaaataaacagtccctctctgtctccctccctctctgcctcctgcccgagttctcctctcaggcccgtgtcagttcgccctctcataccctccgcgagcagcgctcacttcccctctccagctaggctcgcctgctctgccttgctctcacactccctctcactcttagtcactctctgcctctttttctcaagtccttttgtttctcgcacatgcccgtgctctccctctcaggctcattttctctcttccttcccctcttcctctcctggcttttggtctctctcctcagccctgtcagaagctggcaacccccctcccaaaaaagaaaatctcccagtgcctataaaccctgcttaattgcttccttcttgggaaaaaaaaaatcaaaataaaagaagtggtggggctgggggtccgcttccaggttccaaggtgcgtgcggcccggccccagccctgactgagaggggaagcgggaatggctggcccaagactcccaagcctctttcccaaattggtgctggggccttctgggatgctagtccctgagtggcaggagcttctgcctccttggcccctcctgtcagatttgccccatgagcgcaaggtggggggatgggtttggtcctgctagagttttttttaggaacctctgtgtgtgcgtgtgtgtgtgtgtgtgtgtgtgtgtgtgtctgagttggggggctgttatctaaatggtcctaggcgacccctcccgcagcctcttcccctgggaacttggggcagccggcaggcctcacacttgagtcctcagccaagtccagctgctgcagttcagtctctcagtcccgtcctgacc

SEQ ID NO: 8225 - DNA, 1698 bp, artificial
  synthetic oligonucleotide
tcactcgagtatgggttatttacttttctgacccaaactggacagtaaagtccttgacgatggagccatatcttctcttcctgtttcccctccaaaatatgagagtgagctcataggtacttagtgttagtatctgacctcctgcctcttgggagactgcttctaagaggcagtcaaacatgttgaacgcctattgtgtgctaggtgttctccatgtgctgccttgtctccccaccacaatattggaaggtaggggctcttgccacccccactttacaagagaagaaactgaagctcagaacaggcagctcatccaaggtcacagagttagtaagggcctagctttggaatctgattctaaagtctgtgttctttctcctacatggttctgccttgctctcagcaccagcccatccagtctcagaaatggccaatggagcaccattttctttctgtgtgcttaggcaaggacagagtcctatggataggtggtcctgggctgctgaccctccctgctgtcccccagtgcctggccttctggattagaatatgaacctggctcaaaaggcatttgtccatctcctctcaggagctggagtaggagcaacatagaggtgacaggttaggatacagatgaggccctatcttctatgatctgttgtctctggttgagccccttctcttctcctctgttctttttaagaatgagatgaatcaagtttaggaattcaggctcttgcattttgagggtgggatgaattgccagtaggacaataggcagtgggagtgagcagagctgcacctggccagagactgtggccatcatccctttgctccaggcgatgcctgttcctatctttccatcatgaccaagattagtaaggatgggggagaagacatgggtcccagacagattgagctcccccagcctttggctgggagctgcggggagtggtgactaagacatgtgtgggcttgctgtgtgtgtgtgtatgtgtgtgtgtgtgtgtgtgtgtgtgtgtgtgtgtgtgtgtgcgcgcgcgcgcgcgcacgtgtgtatgggtataggagaggtagtagcagcggtcatgaaggaatctttgttgggggtgggggtatataagactgccacctccaggtagcatgggcctgacaccttggtacccagcccattggccacgtcagccccctgcggaaatgccacattaggacaaagggctcccccagccaggcagtgctccaccctgccgagcagtcagagcctggcagccttgcccatgggccaccccttccacactctcctggtagtgtggttctctctccccacccccagcctgaggatggaggaagggcagaaggcttgctcttgccatctccacccagtaggcccagcccggctcttgtccgcttccctggttctggaatggcctggggccacccccaaccctgaggctgaccatcttcttccttctgggcaggttcctgagtgggaagggcttggtgatctatccgaaaattggagacaagctggacatcatctgcccccgagcagaagcagggcggccctatgagtactacaagctgtacctggtgcggcctgagcaggcagctgcctgtagcacagttctcgaccccaacgtgttggtcacctgcaataggccagagcaggaaatacgctttaccatcaagttccaggag

SEQ ID NO: 8226 - DNA, 1573 bp, artificial
  synthetic oligonucleotide
cagcctttgaactcagataatctgactccggatttgacctcttaaccaatctgtcatttttgccaccctaggaacagtctctgactccccagtacctagaggacaaagtgtaaattccttaagctgccattcaaggcccttccacccctcctccttgcattacaatgcaccctgagaactgaatgtctccagaccaccaagggtacttacctgcttacaagccactgctcaggcagttccttccacttggaatgacccctccccatccccctaaaaccctcacatatacacacaaaccccacctctcccagtgtttattttgagccaatttccaaagctaatgggtttagaggaagcacttgaagatgtggagtttgtgtgtgcctgtttgggggttttggtaggcagggtttagagggtcacttcaggtgtgaccaccctcatggagccagaggtgccctgggccagtagtccttaaccatttggccacctagaaccatccttttgaatgattcctccccattcctcttctccccctgccctcacaccaaggctctgatggatcttgtctaccaaacactctgtattggaaaaatataaagcacggttagcaggaaaggacggtctcttgggaaattggataccacatttgagaggtgtatggattttgccttcttccccaaccctgcttcttctgaacttgagtttttgaatgactccatgcgatttctgggcaaaccggatgcctgggctgggccccctgcaagtgagaatagaaagatcggtatttttctctccactgttgatatggttttattgtcatgctctaggactgactgcaagagacaattgatcctactgcccaattgttgtcagaaagcacgacttaaggtcaactacccgaaaactcaaatcatcagcattggcaggcggccccccagcattcaattggtttctctccaacaatttaatacagcaggtcaaatcactcagttacctgggggtgcaatttgcgactaatccatcttggagggttccccgggaagctatattgcctaaattagatgttctaggggtgttttattgaaagtttttaaatggccacagtggcaattggtaacgcctgctttgaaagtgttccagacagaaatggttgtgggcctggctcgaaggtggagaactttgcacattggaggggattgaaaactgttgcagggtggggagcgggggcagggggcagatgattgccctcatcagtggatacccctccgggcccctctgtgagaatcacccctaggccttcttgatccctcccctctgcctggctctctggctgagcctgggactctgccctacatccataactcacgactgcgacagcccaggatctcactccagataactcagccttgaagctcctgtcaccctagccttaccaatagctaagttggcagagatcatatttatggtggactgcctgaagggcagactgcccaccctatctcttggagtcttatattctcctttgcttaaagcagctcatcagagggctgagtacagagaccactgtact

SEQ ID NO: 8227 - DNA, 1628 bp, artificial
  synthetic oligonucleotide
ttatctgacatgcagtgcctctcttagatccttctgccctgtcttctgtgccagtccagggcaccccctgcccacagcagcctctcaggaaaaaaaggggatagagagatggccgtccttggcttcctgctcacccccacccccgctcatcctctccctcctgtcagcagcacctgcagaacaagttccctgttctttaggtgagttcacttggcaaggaaggagaagggtgccccaggaatgtggaggggctctaggagtccagtggtcattttctaggagatactcagtggtggatcgatggcagcagaagcttcagatgtagagtcacctttccatttcatctgctgaatatgggggcccccctggggttgtcccaagggacatgaccccagtcccagtataaggtgaaaggtggcacctcaggctgactcctgcccaggcctgttttccactctggtcacctgcctgcatcagggtccctggcagggaagtgaggagattgttctgtctagcctgccagaggggctgtggcgtgacaggatgggacagcaagagggggaatatctggatcccccaaacataaggtgtagacacagccaatagaccataaaagtaggcttcagaccagagcatgttggcaaacatctggtccagtgattctcaacctggggtttgtgcaatttgggggaggggaggcctactgatatattcccagaggccacaagttctctgagaattgagcttttttatggtcttattttgatgctaaacacaatttttgttacacttatgaaaacagctatgattcacaattgcaagctattttcatagcctggattcagttctgagggagcttctcaagttggggaacatgcagacctgtggtggggagttagaggtgttcattgataccttctcagagggtggttctgctgaaatttttttccttaaaagggaaagtctgtgtattccatcccaacattcagaaggactaatgtatccccgccccttcatgttccactcatggacacggaggcccagagaaggccagatacttgctcaaggtcttccagcaagccagagcagagctgagactggaaggctgggctccttcagcctggcccagggctcttgttggcacactctgcaggggcaaggctcaggccaggccaggagcagtaggggtgtcagaggtgtgtgtctcagatgtttccattacaaatttgtcagttctctttctattcattgggaccgcatggactcatttggatcttttaaagagatccaagttccagtgcggtagctcacacctataatcccagcactttgcaagcctgaagtgggaggattgcttgagaccgggagtttgagaccagcctatgttcccaaaacatagcaagaccctgtctctgtaaaaaatttaaaaagtaaaaagaaaagaaaaaaactaaagtgatcaattcagccagagggtgaataggaaagtaggaatcaaaagcttcatgtcatggtgactaccgtgtctgtgttctgtaacagatacataaacaggtaacgttaagtccctgatttcccccagctcctagactgtcagggaatggtgagcagttgtgaaaataataata

SEQ ID NO: 8228 - DNA, 3536 bp, artificial
  synthetic oligonucleotide
ctaggcagaagccttctggagtgaagagtagtgtgagggttgcacattctgtgccgggatgtgcatgtgggtgggattgtggctttgctgcaggatgtcaggggtcgtggactgagggaagtgcgggtcagctacggtgggggcagatgcagaccctgtgcagtgtgctgggggctgagggaggggctgtgtgtgtgctcacattttgagctcgccagtcccccgaggcagtcccatgcccaggccctgctttgggacttgccctgctgccctttggagttgtccctgtcagaaggctgggctctacaggagtctacagccaaaccataagaatcagcctctgaccggccaggggagaaggtgaaaccaatacccagtgagtgcagacaaggaggaatgaattggggtgtgaattaagggcatgtgtgaggggagggtggcatgaggtgcgtcttaactgctagggattctaccaagtaggagcaaaggtgggaaatgtgtgtgtgtgtgtgtgtgtgtgtgtgtggtcctcctcctccttgaaagaggggaatctgggaaacgagatatgcaaagaggcttgaaggcctataggttttttcctctgagcacttgggaaccaccaacttattttgcaggtgggagagacatgtttggatgaaacttgtaacaaaagttgctcagcttgcaacatgaagaaggtggagtggaaggggccaggccaggtgtcagggagaccagccggcaggctgcagggccctggcctgagaccaagcagtagcccaggctggggtgtggctgtggggaaagagagaaagccctggaattcaaagacaccgtggagttaaaattgcaggagccagaggagggaaggagcctgtgaccctgtttgctggctctgggcctggctgcctggctagtgggttttgaagccaggggctcaggagaaaagtctgaattggagacagatttttaaaaatttgacacataactttttactgctttttcttattacaaaacaatgcatgcttattaaagaaaagatggaaaatatagacatgcaaaaagaagacagaaataattttcaatattcttgccagagataataaatgttaacactttggtgtatttcctccttgtagtctttcttcactgaacatatttactattttggttttataaacaggtctttaatgtatgttgcaatcatttactgacgttaaatttaatctacaagttctttttgttataaagtattcaatgctatgggtaaactagaatttatttactcaatcttctattgtcattgttaaaatttccctattataattactgttgtaatgagtatctttctggccagtgagatggagatttggaagttgcccgccctatctctgttgaccccctgtgtgttggaaactctgccagggaaaggcagtgggatcttggacaagcgcctttctccctctggggcctcagtctccccacctgtgcaatagaggagattggacttggtgctggtgggctttctatggcaatgtaggccctgtccccactgagttatttctttgctttcattctcttcagtgcccttctctggccctcacctccttccttccctgggctccctgtctcccttttttcatttcctcgcttctgcccacctctcctgtacctcctctagtcctcctctccttggctctcctagtgggtcagacagccagtgggccctggctctttcccagttggcccgctgatctgacccctctgttgaacactagccctgcctggcaggggtcgggcattccagcagagacctacccagatgccagagccccaggacagctctagttgccccagcggctacagtggcactgggctttcctggcactggatgtcaggcaactgggcaggcagacaagatactcatgaaataaaaactgaggctaggggaaagggcagggaaggttgggtatttcttgggttcatcctgaaggggtgatatttcccaagagggggtggctccatgcagtagagagccattggatcagaggttctggttaatggccaggatatctggacagcttccaggggtctggagaccaattctttaaaatgaattgtgaactagtgtgggtgtgtgttgccatagccttcttctttcattaagacattcaaggactcatgagttcagaaaaagattaagaaggaggtcatcttgtccctaggctggatctacctcccagtcccaccctgacacacacacacacatacacacagagagacactggggattgacctcagtgatgtgacatcactgggagggtgacattagtgtcatgtaggaagtgctcaccatgcattgcttttaaggatcaccatccttctagctgccactcagtggtttctgcccctctcaaagttctctttgatgagcagaagttgcttggccaggatgccaggaggccaggctgggggcatctgtgtgagaagtagcaaaggccagagcatctgctgcctagagcccctgaaagtgcctgaggactccagtgtgtggagcaatccagagctggattggagaggattagataattgacctcataattgacctaattagtgagtggctgtgtggagagcccttggggacactgggcccgcaggtggcacaaaggccaggcagaaattcatagaggctgtgagagccgaagcctgggcatttgccagcaaggggcgggggcagggagaccataacagggaaagggataggacttaagggcaccaagcagagaggggcaggggtggcaggggtcactaaagagagagggaggaggcaggagaggcctttcagagcagagagatagcatctgggggcctgggaagggaagggtcaagatctggggacatcaaggggagaaggctagggaccaggggaattggtaaggggaggggacaaggcttggggacactgaggtaggccagggtcacaggagggccagaaaagaccctgagggcagagaaccagggcctaggggggctgaagaggaaaagagggttattgagggaacagggcagcagctgaagggaggagaagggcagagcctgggtgttttctggagccatgggccagtgacggagccaaagaatctggccccagtgcccacatatgggcagtgtgtgtgtgcatgcatgcacgcacatggtcagtctaaacctactggggctatgaggaacctaacagcatcttggtgggaggagaggtggcatggtaccatcggggatggagactggaactcttgtatcccaaagtttgttgaatgcttgctcccgtgtcccagagaacttggcccctggggcttcttcccctggctgcattcttttgccgtatgttcattgtgtgtctataagatgccagaaaatgttttaggagctgggatccatcagtgattagattccacagggatcctgggggagctacagtctagtgaggggagacaacaaatcaaccagtcatgcagtgtgtttgagcatggtgagtg

SEQ ID NO: 8229 - DNA, 3706 bp, artificial
  synthetic oligonucleotide
gggttaagagtttaaagatgaggaatctgagagctcgcatgaagaatggaaggtttacgccaagatctgctggtgtccaagtctaatgccttttcatagaacttctgctgcccagggtgtagtgttctagaaataataagaatgcttactacatgccaggcactattttaactgctttaccaatattaggtcatttaatcccacaacaaccccattttacagatgaggacgttgagtcacatagaggataacttacccactcaagctctcaccgatacttaagtgggagagttgggattccaacccaggcagagtgacactagaggtcttgcctacaaaccagagttattttgctgtccctttagaagccaagcacaggtcagggaatgagaacaaaagagggagtttgctggccttgataggtttattgaggtggtttatgtttgatttccccaatttgcagctcagctgtttaactggaatctcctctctagctgtttaactggatactcccaggcagtatcagctcggggctgcagactcctctcctattcagtccagtgcttctctcactccactctctagtctccttagagtcccctgtggcaatcacctgcagctcaggcttatcctctgggcttcccagccagcatccagttggccagcccaggggccccaatcagccaagaaggcaagaaataggaatcatactggtcctggagtccccaggggcaaagcttaggtaggatcctgatggatgcctcctcttggatatgttccatgcatccttctcctcagcggtcagatttcccacccctttctccgttggactcctacctgcccaggagtcagcaggttcccagcctggcacagatagttggctgctagcttcctgtgctgacaggtggaaagataggcagctggacagctaggcaagccgctgggtcagctggccttcatcagggtgcctcagggccacagcgctccttccagtcataatgagatgctcccagctgacagctctacagcaactgatggtttactaagactcagtgcattctcccagtgaatccccacaaccatcctgtgagggaggctttcttacactcatttttcaggtgaggaaactgaagcagttcagagaggcaaagcaaccagacagaacatacacagacctgcttacacagtcctatgccaatctggtactctgtaaatgccaccaaaaccccaacctcaattccgtttgggagatattagggccaatttcttggcagaaatggagtggctggtagagctgagaaatctccaggcaaaggtggtggaaggccaactatgctttatgctggtcagatatggggatccaggaagccctactctcttgtgtctctcctgtatctggctctgatgggaagggaatgaaccagttgctgtggccatgctcccatagatcaaccttacctccctgatggcctccttccctcactcctggtccagacacctgcagtgactgctccaagcacagagggctctcaggaactgccacatgccctgtccttctctcccaggtctggtcttaccctgtgagtgccctggctattctatcagaaacaaagccacaaacttctatcttttcaccaaaactatcctccctttaactccagattacaaacagaacgtcgagtccacttttaacaactttcttcaatggatgccctgctttttgcctttgtccagcttggcttctgtcctatgtccaatgccccctctttcacagaaagtcatgctaatgactcgaagcctccttctcctttctcagctccactgccctccagaatattggctggccttctccagttgccatagccccaggccctcaggcctttccctccaccccattgtcttcctcactcgcttcggcaccctcatacatgtcccctgagactgatacccagtcatcctacaacctccatgacctacatatcctctctactggagctgcccactggcttgagcgcatcttgggccttgtcattacttgggatggctccagcaccatgatttccaatccccagtccccctacccccagccttcagatgactggctccctcattcttctcaaacctggtcttggtcccggtccttggcactgggctattaagcaacggcttgtttaaaaaagaatggtcttcccaccctcaagcattccagtccttcttccccacccacaacctcattttcccagcccctagctatctctaggccttccccacctccctgcttcatatattcttaaccctgccaccaattgtgaccttcatgactcgaagtcattcaagctttgcacaccttctgctggtcctgccttctgttgtcccaggcttggccagttagctcctggcaattataagcttgccagcctcagtgtgaggtccttgccaatgttccacaatccttgaactcatcccatgggggctggcattcccatcttctacttttcttacattccagccccacaactacgctctcctaatgcttggcttccaattttgctaagattaaggctgtccatcttggaatctctctgtatgtgtgctctcttccttcctccctccttctttccctccctctctgtctccctccttctccccctctcccttttgtctcctaggaagacttatctatcctcctctccataactaacctctaactccatcaattatcccctttctcttgtatctccatctctgcccctcctttcagtgctatttcctcctcagcctacaaggattttcagctctcccccatccttcaaagaaaccctcccttaaccctgcctccctcttaagctatttgccttctctcttccattccattttcagtcaaactgcttggaaaagggttgtctgctctcactgtctctgcttcctcacctcccactctctcctcagtcgactgcaatatgtcctctccccctcttgcctgaaattgctctcttaaaggtcactgatgacttctttgtcaccagcataagtggctttttcccatcctcacatctgaccctgccaactctcccttcctgcttgccattctctccttccttggcttcggagtcactgagtgtcctcttccttctcttgcctatctcaccgcaccttgtggctctttactctcctctcttgccatacaagtgtcggtttggctctagcttctgtcttttgacgtcttctccctctacactccttcaattatcccctcattactgctttcttcagagtaatagacagtaatgtccactctccagctttcagtcattgtcatgatgtcccattctttattgttagctatgatcattcttcagttccagacccaggtcccagggacatgtccattttatgtcatacagggactttgaattcaatgcatcaagctgaactcatcatctttccccccaaactggtcccttcccatactgtttagtttcataagtggttccactagctaataaggccaggaaattgggagtcatcactgctcttttccttcccctcttcccctacatctactccatcaccaagtctcaacatgtctattttctcaatatctccccaatttgttcccttctctccagtcccactttctttgattcatttattcattcattcattcaacagttattgaattctttgtaacagtcactgggccaga

SEQ ID NO: 8230 - DNA, 2688 bp, artificial
  synthetic oligonucleotide
tttctctttctctctctctttctttctctttctctctctcttttttttcttttttctttttttttttggcccgggaagaggggaaatgataaaagtaatgcacactctccatagaagatttgaaaaccacagaagagtattactaagaaaataaaacctataatcccactaaccagggaaaatcactgttaactttttggtatctacatacacacacacacttctcctttttatacatgagatcacactggctatctttttttttttttaaattgtgctaaaacaatttatcacataaaaacacataacatgagcacgttggctcaggcctgtaatcccagcactttgggaggccaaggcgggtggatcatgaggtcaggagttcgagaccagcctggccaagatggtgaaaccccatctctactaaaaatacaaaaattagccaggcgtggtggtgcacgcctgtagtcccagctacttgggaggccgaggcaggacaatcgcttgaacccgggaggcggaggttgcagtgagccaagattgtgccattgcactccagtctgggcgacaagagcaaaactccgtctaaaaaaaagaaaaaaaaaacaccacacacataacatgagatctatcctctgaacagaattttaagtgtacagtacagtattgttaactatgagcactgtgttgtgcagcagatctctagaacttttccatcttgcatgactgaaactttatacccactgaacagtaactccccattgccccctccccccagtccctggtaaccaccattcattctactttctgcttctatgagtttgactattttagatacctcatatacatggaattgtgcagtatttgtcctgtgactagcttatttcacttaccatagtgtcctcctcgtttatccatgttgtgtcatatgacaggattttcttctttttaaaggctgaataatattccattatatataaatatatatataggcctgagcaagttccttcccctctctctggcttcagtttcttacatgtactatgggggatggtaccagatgttgcctttcagctctgattttcttgaggtctctgtgaatagaggtagaaggaaggtgggtgctatggactgagtgtctgtgcctgccccccacccccgccgccctaccaccaattcctatgctgaaaccctaatccccaatgtgatcaatgtgatggtatttggaggtgggcccttgggaggcgatatatatatatatatatttatttatatatatatatttatatatatgtgtatatatataaatgtgttatatatatatatcacattttctttatccattcatccattgatgggcacttaggttgatttcatatcttggctattgtacataatgcagtgaatgtgggggtgcagatctctctttgaggtattgctttcatttcctttcagtatatacccacaagtgggattgctggattttctagattatatggtagttctacttgtaatttttttagtagcttccatactgtttttcaaagtggctgtactaatttacattcccgccaaccatgtacgtaagtgttcccttttctccacatctttgccaacacttgttatctctcggttattttttttataatagtcattctaatggatgtggggtgatatctcattgtggttgtgatttgcattcccctgatgatgagtgacattgaacaccattgtatgtacctggtggccatttgcatgtcttattctatccattctgttttgtatcttgagtttcccacatatcagtgagctgtaagcatttctccatatcattaaatattatttgcactgccccttccttcatcctaaaggcagggacctgaactgggagagcctcaaagtcctgccaggcttctgtcggtgcctggtgcatcagcagttctgccggcctggcatgggtagagatggaaacaaatccagaagagtcactggagtagtaataggagtctaaacttaggttgtggtagacaatcctagtttcaaatccagattttgccacttccaggctaccaggctctgagccaatcaatttccctagccagtcagtttccctctgaaccctggcttccccatctgtaaaatagggatagtagaatctatttcatggtccttttgtgtggcctcactaagctaatggatgtcaggacttgacccacaaggagtcccctgtgaagatcatctattattattgtgagaatgtcaggaggcccgagtaagttccttttcctctctctggcttcaatttcttcatgtgtactatgggggattgtaccggatgttgcttttcagctctgattttcttgaggtctctgtgaatagaggtagaaggaaggtgggtgctatggactgaatgtcaatgcctgcccctccacccccgccgccctaccaccaattcctacgttgaaaccctaatccccagtgtgatggtatttggaggtgggcctttgggaggtgattaggtcctaagggtagagccctcatggtgggattagtgcccttataaaacatacaagacagcttacttctttactctctgctctttgccgtgggagcacacaatgagacaaccctcaccagacaccgaatctgtgagcaccatgatcttgtacttctcagcttctagaactg

SEQ ID NO: 8231 - DNA, 5169 bp, artificial
  synthetic oligonucleotide
ataaccaactcatttttttttttcctattgtgtctaaagaattgtgagggggagttttcttgtttaagatcaaactgcgagtagagctcagaagattgggaaacacaggctgcactaggaagcctgaagaggctcagagtctgcaggagtgggagctgaggtgactggcccctccctcctagctgcctttgaggttcctgtcccagctccatgaaaagaggtctcatggggtgatgggaaagggcttggtgcagcctcttcctagctgtgtgaccttgaatggagctagtcctggagccctggtcatttgcctcctggttcaggggtctgtcacaatctctcatggcagtgttagtttcacctgttagtcaattattcagctgagtgctgtgtgcctatcccagaactaggcactactgggggtggggatggcactgccaggaatgtgactcatgtggccagaccctacccctcagaggctcccagcccattagcccttcctagcctaacctcctcctcagtaaacaacctgggctggggctgggggctgggggtcctgccaacccaactgaattaggtaattaaaatctctcctctccccctgacagatgacctctaaggtccgttccagccctatgattctatgattccagctgggggtatccaattaacccttgtcatgcttgcctgggcttcgtgggctgtgaggtgggagggttggagacgcagaggtctggggaaggcccattctcagcacataccaggatgctccacctccttcttcccctcttctcccctccccacctccctgccatgccagggtggtggtcctggagttacagttgccagagtaaggacagggctactggtggatttggctctggggtactgcctctctccagccagggctaaaggacaagtgacagaccagctgtggctttgcatagtatctgcctggctctttgtcaaggcccaggcagaatatatttcccaaggaaggccttgaaggactgaggcactgctagatgggagctttgtaagcaagacagggtgggagcaggatcactggtcagtcaacaggccatcaagaaaccctgggtcctggaccatgtgttcccactcacccaattctagtgcacagcagcctccttctgggggtacattctgtccattcttcaggggcatgaaatttgggtgagggttgaattccaactcaggatggtggtggagttatatagacgtggtgattgtcagagctgatgtgtgccttagagactgccataaacaggcaccttatgggccacttaagaccctcaaagtgttttctttggctcacacagtgcctacattaataagaaatgagctgccatcacttaaaattcagagtttgatgtaaaaattcagatttataacttctaaaaaaatctgaatttctagtaataccaagctcacattctcgcagggcaaccgacagctggagctgagcgacagctgtctcctgagccagggcacatgctctttgcttcttcatgatccccacctgcctgagtttgcccttcatgtggcaaatggggaaactgaggcccagagagaaaggcgggcacttgcccaaggtcactcagcccaggtcggggacagagccaatatttgaacccaggcctcctgcctgctggccaaccccagaccctttccccatcctcctcctccccagacctctgccacggggccacaaggctcctctgtcagaaccagccccctgcgttcccaaggcctgacagcctctgtggccagcctttgtccagccaccttcctgtgtagccccttcagccgcccgggccccagccctggcccaggcccccttcgggtgagagcagaggcgctgcggggcctctgcagcccggccccatctcccgcagctcggaacaagaatctcattaagtgcagggggcggctgccgccgggcctggggcgccctgaccacagagctggcttccttctgcaaacagcccaggccaggccgggctagaccgggctcgggctgggcgggccttgtgtgtgcgcacggagcgggcaccgcagccgcccctcggctcctcctgctgcctcgggcctcctccccagcccggccctctgccggccccatccctgcttgggtctccctaccgctcctcctgcccccccacccctttatttctctctcccttccactcctttcctctctcggcccggctctgtttctgcggcattctgtcttggttttgtcatcatctcaagtgcagccccgttcttctccgtggtctagtttcccatctcagcctcccaggccggcctcctcccctctgtctccgtcttgctgtcttgctgctccagaggggtgccctcgtaggctctgtcactctccatctccgagctccactctctgtgtctcctcgccagtctctcggctttctgtgtcccttgggtctccctcactcgggctctctggcctgctctgagtctgggtttctgaggctgccccaaggcacttctgcggaggtttgctgtgctggataaacatggccccagcagcaggacgtgaggaattctgctgacggcgctttcctcaggggctgaggaggggcagtgtgagcctgcgggcaggggcctcagggagagggcagtgtcttctccatgcctgtgtccctgccttctgaccctctcagtcagctcaggggtgtctccccagctggaaaaaaagaacaggccccaaggggctgctcacctggcctcgcccgctccccaacaatctcccctgacacacacacacacacacacacacacacacacacacacacacgcagccgcagccgccgcagccgcagccgcagccgcagcagcagcagcagcagcagcacacacttccctctggtatctgcagcccagaaccaactaaatggaattcagtcctgtgtttctcctggcctggcctgcctagacctcaagggcagggtctctgggaagggaaacaacccagaagaccttgaagcaaagcattggaggcaaggacccgttagagatcattgcagccgtctctctgctctcagatagctccctgccctttgccatcattccatacttacaagccttaccccctgaggaaaagcttatcccctaccccctatttggaggctttatcccactgtcggttggaaggttctttatttaaaccgaaatccttgtcctgaggttcagatacacagaacttgggcgtgcctgggatgcgcacggtgtgcggcacatgtgcggtggtgtgagtgaggccgtgtgcctacacagagtggagaaggggtggtttatgtgtgggtgtgtgatgggggcatcaggtgagacgaaggtacagggagcttagaggacagatgatggctccagtggcagagaggccgaggggcagaaggcctggtatagtgggggaaactgtggatgtaagtgtgaggaaggggacgaagaaggaggagccaaatgatgcaagtccgggaggcttcctgaagaagagtctgggccagatttgtgggaagagcctttcagactgaggaacatcaggggctatggaggtgtgtggagatgtgagagggtcgccaatggtaggtagtggaaactgcttccaggacaaacattcctctgacacctactcctagtgtgaacaactcatcccagtttgctcaggactgtcccagttgtagcaccgaaagtcctgcatcctgagaaaagcctcagtcccagataaacccggacagttggttaccctacctacctactgacctccctacccaccctacctaccaggcagtgtgcaccagatggtttcaacctcacaataacccatagtggggcggggagggggggcagctatggtgtattagccctattttacagatgagaaaagggaagccaagaaaatgtaaataacttgttttaatgtcacacagtgagtttgaacccaaggtctgttgtttcactgcactgcattggttttgttgttgttttttgttatactagtccctgaaaccttcagggacaaacttagtaaccatcccccctcccgctcccctcccccacacacattccaaccccaaccgtttcaaagtcctgacatgaggcagtgtcatttggacctactgcccaagttccactgggctgcgaatgggagtgagggtgggctaggggaaggggggcttcatctcttttagcccaaggcctaccagggcttcactatggactgccacctgttgatcttttggcttctccctcagctgggggcaggaccagctgctggggggtgagggtgggaggcggaagctggaggaagtgctgacttggggggtgtctctagggccttgctgggttcctgggctccaggtggtgggtctggggagggctggctcaacatctgagagcaggctgggggttgggccccaggagtcccacactgctggtcagcgcctccggtgtgctggggtgtgaggaagcggccacagagcaaacaaacagagcctgtgaggataggaagcaattacggaccacccggcctaggctgctgaggagctgcgagtgggggggtaggctgagtcaagaataggccgccatctaggtgtggcctggggcaaggccaggaagtagaatgagtaggctctgggctggtggtggagttctggggaggtgataaccaagtgaccccctaccttggagaaaatctctcccattcagaaattaccttggtgggcagaggatccagaggcctagtccagaggccttggtcttaggtctagctgcagaacttctgagtctcatctggagcctgtcccttctgctctctcagcctcagtttttccatctgtataatgaagtgcttggaatgaatgatctccaacagtccctccaggtttaatagtccataatgccataaagctgctgagacataaggatttatttttatttatttatttgtcttgctctgttgcccaggctggtgtgtcgtggcatatcatagcttggcgtgatcataactcaccgtggtctcaaacttgctcaagcgatcctactgcttcagccttcagagtagctgggactacaggtggtcgccaccatgcccagataggatttcttagcttacaaggatttattgagtatcag

SEQ ID NO: 8232 - DNA, 2086 bp, artificial
  synthetic oligonucleotide
ggtttgttctggctgagacagtctgaggagtggcaggatccaagatggggagtgaggaatcctgggtctagtcctctgagtactactaacgctttgtgtgacctttagcctgttcctgcccctctctgggcctcatctgtagcatgaagaggctggatttgaatcccagagtcatggaatctcagagttggaagtacccttaaaggccatcgagtcctggcccccaactggtgcttgaatcccctgtacagctccctgcacacatgcactctgcttgcatacctccagtgatgggaagctcccttcctccaataacatcctgttttatctcaggatagctgtctgttagaaatttcatctgaaattggtcttcctgtggctttcttcaaggctgctacctaactcttctcctctgttctgtgccacacatctcccctgctctgtgacagcccttcagaggtctgaattcagagttcagccttctccaggccaaagagcccttttagctccaactgtcctcacagagactggtctgtgatcctttcgtgtgtggggcccataattggacaaattccaccaggtggggtcttggaaaggctgcagagggccagaacatcaccttgctccttccagacacaatagttcttgcagttggacctagggtcccatttggcttattacctatatacaggatttccactagcctgtgagctcagtgaaggcgaggcttttctgattcctttctgttaccccagtgcctattccagggccttgctaagggttggcatcacaacttgtgtgttgaggtagctgagggccaaaggcctgtgggtgtgcatgtgcatatgtgcacgtgtgaatgcaccctgaatgcagtctgaattggaagagtctgctgggccatggagggatccagattctccatagacatcaggtagcttcccccattcccccttgcctgctacatttggcacagtgtggggcctggtggcactggcgttcatcagggcccaagacccggagaggctggtatctttgtatatgcaaactcccatgactcctgggagccctgtgtgtccctcacagctctgtgtgcaagtcaccaatgttgtttatggcccttcgtgtctgacagaggctggaggaggtggctgtgtcccacccgttggcaagaatgacctggggatctgtcagaggcattaggaaatgactgtgccccgtcagttggcaggggtgttcctggctggctgaggagggggtagggtggtggctgagctctgtcacttgacagggggattcccagctgtctgcatgaggagggggagtcagctgccctggcaggcagctggggtatcctggccatgcctactctgacgtggctcgtgtgtgtgtatgtgtgtgtgtccttttaccactcagctgtcattagccccagtcaccacaagggaagtcagccttaccagagctcaaggttatgggaaggacactccaattattccaaagtcgtctgtctcagtcccagcggagtggatagccactgtcttcagggctggctggaaggagcacatgccagggatggacaggacagatgaagggaaggaggagaaggatcataaagggaacccaaaagccatcttgagcaaaggagccagcagaggcctctctagacccacagccacagatggggtatttttggaggcaatgcagttgctggagtgacaagggcaaggataagcttgggagttggagggccctggattctagtcccggttctgctgctttctggctgcctggccattttctaatctgtaaaatggggatgttatgaaaagcaccaggtcaggcccatggcactcacccaggaaatgaatggctcctttataccttcccttctttctgaggctacccaagtgaggcaggaggtggctggcaagggtaagaatgggaattgccttgggggagtctctaccagactcatctggagcctggtccagagtaccttttctcttggctccttccgcttgactgggaagcagagttggcatagaaaaaaggaagggggcagagtccctgtgagtgactcctt

SEQ ID NO: 8233 - DNA, 977 bp, artificial
  synthetic oligonucleotide
tggttgcccttaacacctgctactctaagtttagagtcctgtcccatttccctgcactctccaggataaacctgcaccctgaatgggggtgccttctttggccacagttgaaatggacatctgggaactccatatatccacaccgtgggtctctgccctcattctctttattttctgttcaaggacctatctattgtttgtgggcctttgaaggtggggaccacaatgatacatttcattaatggtaaaaatggtagtggtgagcatattactgccaataaagatgttgacagtgtcaatggtagtgatgaaggtgttaataataatagcactgatggtggcagtggtgatgaaggtaatggtgaggatgacaatagagatgattataatagaggtggtgatgaagttgaggatggtgatgcactcgtggtaatggcaatgatgttaatggacttggtaatgatgacagaggtagtaatgatgatgaagggaatgatgatggcggaggtgatgatggttatgttagaggtagaaatggtggcaaagaagaggatgagggtgatgatgattgaagtggtaacaatagtaataatgatagtagtggagataataaggtagaggtagtgatagtggtaatgatagatgtggtacttgtgatgctgaaggtggtgatggtggtgattggtgaaggtattagtgatgttgagagtaattgtggtggcagtgacagtgataatggtagtggaagtgatggtgaggatggtcatgtgatagcaataaaaatggtgatagggatagagatgatcgtgggagtggtaatagtaatggttatgataaagactggagcaattaaacatggtgataattatgatagccaagaaaccaatagatctactcactgggtctgtatcttctaccttacttttatttaaatatttttctggcaatactctccatcttagctttactttactttc

SEQ ID NO: 8234 - DNA, 2058 bp, artificial
  synthetic oligonucleotide
gtttgttttgttttgttgttttttttaaatctgttctcattggtgtttctgtttgctgccttctccagcacccaaggaagtcaccaccatattgttccttgagtcctgtgtttcttagctggtctgccttcttctctccacttttcagagtcagatagatgatagatagatagatagatagatagatagatagatagatagatagatataaaagataaatagatagttctctatacagatatagatgtatatcattccaagtttttagctgtattttgcaggaggaaacgagaagtatgtctacttcttttcctctggaaccagaggtttcccctttgttaccttgtttttccatttaaggaaggccacaaggagaaccatgaatctgctctaattgatttttacgaaaggaaggagaaaaagacaggaaataattcacaatctccaactctttcatcgtaattagtgagtgacaagtagtttgtaacactctcagtgtatcttgataatgagcttgagaaaggctgagtgctagcactcactaaagtggaggctgggatcaagattttatttcagtacctgcagtgatcaattacccttccaccttctaaagttgcttctagcctttcctcttatccaagcctaccctgtttcagtctggaagagtctcaggtgtatgcccacagaaccttggtatctggctctctaggtcttgtttgtgtgggcacaggagacaagctgggaaatccaagcccagaggttcttacccagccttgcccacaaggctactgcctaagggcttccacccctagaagctttggcccttgggatcatccctctttctcttcttctgcagcctgactttttattctcagcttccctcttccctgcagacactgcctccgctcccctcccccacccccgtccaccgccccggcatactacccagctctctaatggctcagggaagcacattccacactccttcttggggctgaggccaatgaagcagtggcagctgttcaagaatgcaggttgtgtttgtgtgtgtgttatggcgggggctggggcggggggctgcctgctttcctggcctggagccaggggtgggagatttcccccaaagggctatagtttccagggttattgggagagctgggggccgaggccaaagagagggcaacagcatatagtatccctacctctaggggcttcagtctggggtgagagtactgcagtgtttggattactgaggccactgtggtaccctttttgggggatgcttggcaaatgcttttgggggccagccctaccatagggcctgattgactaggcttcttgggaccagctcctcacctacactgtaacctcagtttttccacttgcaaaatgggggcaatattctaggagccttcatgtcctaggttcagagacttctttaaaggccctgtctattccatcctggcattttcccagatcccaaatggtcccatgaccctttgactggataaataaccattactgtgactgtgctgaaaagctagccattgttgggttttaaaacacagatttaaatctgctgtagaaaatatacttttaaaaaaccccaataccctaccacacatttttgcatgccttgaattttggacctgcccacggaccacttgaaggccccacagaccactgctattccctggaccacccctggagaaccactgtccaaaggaagcctgtgaatggggcttaaagactgaggtggggcctggggagatagtttagggagggagttgtcctgagacaaggaagtaagtcagattggcaagaaacagaactctggggatggcaacagccctgaagcctgctcagataaatctattgggaaatgggctgagtagccccaaatagaggtcagtccctgggtagaaaaaggcagcagcagcagcaatgaaggcaccagggtagtctgctcaagggatggatcctgaagagaggggacctctggtggaaagcctagtcccactgccagttgtcagtgagacagacaaatacctagaaatg

SEQ ID NO: 8235 - DNA, 1284 bp, artificial
  synthetic oligonucleotide
catgctttggggactggaccattggaatggtgacacgcccctctcttccttctcatattctctaggtctgaaatatcttttcacttcctcatagctaagttctgtcctcctctcttttaagctctcttggatgaagcctcttttgggtagcctgtcaggattgagaggccagaagatagaatgatttcaaaggcatcattattggttgactgggagctaccctcacagtcaaagaatgacccactgagggcttaggtggcatttgcctagtgccctgtatttcaggagtgctttgtctcagaatgtgagttccctgaagccttgggatcagcccactctcgagagattccgacagtgacagtgcagcagtggtctctggaagtggtggcaatgtggtcccagctgcagaagatgaagggcccagtctctgtaccctcgtttgactttggtgtgtgccagctagaggtcaggggcatggagtacttgacatttcaaatctcccatcagccagagtcatcagaacatatgatacggtagaaaaagccctagacagggagtcgagctgacctgattgagaccccactccccagcttacttggacatgttatttggcctgtaggagccttgatatgagttcatgtgtgcaaagcacttagagctgtgcctggtgcatagtagatgctcgatacattgggctattattattatccttcccacctctgtttcccacatcttccccactacatctggcccagcccagaatcatatcccctcagagtccccaggtgccctcgtgcctggcagggcagaggggggtggaggggcccctctcggagggagctggagcaggacagcaggggtccatgtcatcctgaaactcctccctgcactctttggtgggagattgggggagggccatggaggctcaggctggcccaggcactgaggtcagggactagggcttcagcacagggagtagtcaggtctaggaacaggaagggcatggcacagggaggcttggctgccagtcccagattttccagggactccatgtgccctctgctgagtccctggtcctatctacaatgtgaaggtggggatagggctggttgtgtcaatggtctccagtggtccctagctaggccaatccatggatgtgagaagatggaggagagatagctggggaagaagtctctagctttgacactccaacagggggcaatgcagccaggggctggctccaggccctctggggaatgaattaccacagggaccttgcaggtg

SEQ ID NO: 8236 - DNA, 1323 bp, artificial
  synthetic oligonucleotide
ttcccttcccagagctggcccagactgtaagggaaagctaaaatggggtcctcccttagtccccatgccaggcctgggaataaggcttgtctctagccagtgcacacagagcccatcccttgtcttctttcccttgcatggtccttctagccaggacctgaaagacagctttttctgacatttctgggcctagctgactccaatctggggttactgtctcaactctgtccctggtctactagttgaccaagcaactgaggccctcttgccttctctgggcctcagtttcctcctcagtaacctgaatgggggcatggtcttggtgaactccaaggcaccttctaattgtgaaatcccaggagttggagattgtattgcaggttctggctttctttgcccaggttccaggagaactctgattctgacttccaactgagcaccccagccacctgcactagcctccgtcccctaggaggagctcccttcaaccacacttaggtctccttccaaattcaagccttttctcacccttcctaggccttctttacttctaggggagcctggacctcttaggagtgtgtgtgtgtgtgtgtgtgtgtgtgtgcgcacacgcatgcgcatgtgaatgtgtgtgtgcacaggcaggtatgctcatgttcacacccaggtgtatctccacctctacccatatccatatctctacgtaaacagggaaaatgctaacacatcttgacccctctgcacctgcacagtatacctgaaacagttgtaaacacattcctgggacccaaattcacagtcatcaggcagagcacacatgggacttagcctttcttagtttcctcatctgtcaaaatgctcatttcatggggttttatgagacctcattcattcactcaacaaatatctatggaatatttacagtgggccaggcaccattccaagtgctcagattaaatgacatactatgtgtaaagcattaagtcccatgccagtcatgtggcaagagctcagttaaggtgaattttctcaccttcatcctcctagtaataaccaacatctattgatcacctactatgtgccatgcaccactataagcatttttattctcacattcctcacaagtcattgaagtaggcattattattatcatcccccccattttacagatagggaaactgaggcccagaaagaaatttgttcaaggccacatggctagtaaatggcagtctgtcccaaagtccatgcttttgaccactctaatgtactgcctctctgacaagagctagcagctttttctgccacaagggatttgtatgtgca

SEQ ID NO: 8237 - DNA, 2573 bp, artificial
  synthetic oligonucleotide
cttccctcttccttcttcccttctttctcctcccttccttccttccttccttccttccttcctccatctctttgttcttccctccctcccttcttattttagcagcaaaaacctttcagcaagcaaaaccttatgtgaaagccccatattgaatcagataaggaggtcttgttctggttgagaggccatgagactcgacagtcccatcaactggactcccacttgtgccccagaggccccggagcactccaaggaatggagtttgaaacccactaggactgtcagccctggcagcctctgaaaagatacctctgcttcctcttaacgtgtccctccttttcatcctcatcttccctcttttcctccctgctctttttggctttctcatgtcttctttcatccctccctgcttcactcagtgctcatgagtccccctcacatagcccaaagttcagtctggcactgctttttctgcctggggtgagtgggcaggagcctcattccagcactgagctgtaattttgggtccctggcttggccagacagtgcttgccagttgcatgagcagaggccctggagccaggcattcctgcccagccctttaaactgtaatcaaggtgggggtgatggcaccaactccaaagggtagctggagacttttgttgttgtctggaggggctatggaaggtcaagtgcaatgtcaggtacagacacatccatgagctgaaaacccctcccctatagggtgtggggccagatagttgagagagctgtgaattgggatcctgtttggatgccagagctctataaagtgccatcctgcagtggaaccctccagaaagaacccacaaaaaggctctattcagacaaaggaagcaagggcagttagcggctgggtgccaaggtctgagcccaaagcttgccttggctcccgtgctcctagctaggctctagagtcacctggattgtttcctttgggtggttactctgtgccaggcagggtgctgggcactggggatgccgttgctaacaaatagacacaagtctttgcctcacagagctgacatccaagtcaggggcaatagattataaagtagttaagtagaatagactgatacattgtgaaaaataaagcaaggaaggcgagaaaggtaggatggggtgaagaagggtacgattttttaatgggatggtcaggagggtctcactgagaaggtaacatataagcaaaggctccagggaggagagggagtgactcatgcagctatggaaggggagagcatttcaggcagaggtctctgcaggtacaaagggtgtgaggtgagcacatgcaggtgtgtttgcggaggctggtctggctggacagagcaatgggaagagtggctggagatgaagattgagagctaaaagggagggagtgaacccagtagggccgcataggttactctaaggacttagctttattctgagtcagatgggagccatggcaggatttggaggcagaagagggatatgatgtgactgaatcatgtcaggatgctccttttggctgttgagttgagaacaaattgtagggaggcacgggggaaagccaagagactagtcaggatgctctgcagtgacccagggaggaatcctgaagaatcctgcataaaggcaaaagaggtagcatacctagcctgcaggagagcagcctgaacactgatctctgcctcaaagtcataggtttctcttctctcgaggctggagaaaaacaaggctatcaaagctagtcccctgggagaattcctcatggagcagtccctcagtcactcccttatttgctcaatcagtcaacgaacatggatgaaacaccccctaagcagtatgggctaggccgagccaggccagtctctcctgtcatgtaggacttacaggacttcctgggtaaaaggagcagtgggagaggtgacctacagacctacgcagtactcatttaggccctgcgagttagggccaggggccttggaccagggctggcactaggggtgtgaccagcttcctatcgaattcatttcctggaccaggccaatctttccctttgccctggccatttccaggggcccaagacaccccgacttccactttctgtggggggggggtaggggtgcaaggtgcagggctgtgcccagccaagccagggctcatgagcttaagagagggtggctggagcaggagccaatgctgtccctggcaagggacacaggcctcttagacctgggagaggaaggaaccaaagtcccttggccaatgcctggtgcaggattctggctgtatgctcctcagccagaaggatacgggggtcatgggtcacatgttatttaatctactagcacagggcacagtgcccatggggcacagctcaccaccctctgtgattatttcacttcacatacaatacaataggaaatcgtattggtagttccagatttcataaggcctgataacaacaacaacaatagcaacaataacaagagtaatagctgtcatttactgagcctttctgtgtgcagacacagtgctggacgctttat

SEQ ID NO: 8238 - DNA, 1773 bp, artificial
  synthetic oligonucleotide
tccctgtagaatttaagtcctcccacatttggacaatagtatcaggcgtcttccagcagggagcccgagtgacccagcaattgcacttctgggaattcatcctaaggaaataatgggtcaagagagcaaagatgtatgtaccaggatgttcattgccatggtgtctattatagtgaaaaacagcttgcttacatgaattatggcatattcatacacagtcaccattaaaaacaacaatgtggctttttcagtcctgacaaggaaagagatccctgatctagttgttaaggaaagaaatgcaggtaggcagtgccggggagaggaggtcttggagcatcagggctagagaagggaacccattcatatttctgaagcaccccataatgatttactatgagccttcactacttttctaattaaaagaaaacaagcaacaaaattatttccattttgaaaacataatctcacagtctcagaacctccagctggaaagtagtcatctgcatgaggccgctgaggatttccctggacaggagagaacttcccacttgggagcaggcccagaatttcttctccctcccagcccttctccctgccaagaagcaagggtggagggggggcggtgggggagcaaaaaggcctggtggagtcagacaaacctggcttttgctgctaaaacaaagtttcaatactactggccaacatgaccttcctcattcattcattcattcattcattcattcatttgacaaatatttattgagcaccaactatgtgcctagactaagtgatgagaacacagcagtaagtgaaatagacaaaaatccttgctctcatggagctcccattttagtgaaggcagacagacagtaagcaggacagatactatggggagtctatgggatggtgagaagcactatggagaaaaagaaaacaacaagtgagaagggtgaatatggtgccagggtggaggagcaatgcaaaatagagtgtaagggaaggcctccctgaacaagtgaaatggaagtaaacacctagagcaggtggagaaagccatgtggagaatttggaggaagagcactccaagcagagggaataaccaagtgcaatggccttgaggcgggaggggtgtttggtgtattaaagtagaaaaaagaggccaagcaggctgaagcgggaatactgaaggggagaggaggagtagattaatttcaagaggaaacaagtgtgaaagtagatgggacttggtaagccatgctaaggctttggcgtttaccctgactgccatgtggggccaagggcagggttttgagcaacagaagtgacaagggctaaacctaagcaggttgtaacaggatcactttagctgctgtcctgaaaacagacggaagtgggaagggccaaagagggaagcaggggaccaattaggaggctaagacagtaatccaggtgagaggtggtaggtgcctcacaccagagtggcagtgaaggtggagagagctaattgctaccatagtcgctttctattctattctttctgctctagtctgctttatttctattctcccccaacttcacaatgagctgtggcaaccactcttctacagtaagaataagacgttcagcatgtcccaatatagaaatacttttcttagcccagctccacctcaacctgctgccaggtccctgcctgctcttgaagcctaggcttagactgtcatctctgtgaaggcagggacttttgcctgtttggtttaccgctgtacctccagt

SEQ ID NO: 8239 - DNA, 1217 bp, artificial
  synthetic oligonucleotide
ggatttcttccagttttctgaaagttttgttttgttttaatgagaaatgggtatttaattttagcatgtttttaaaatcatctataaaaattatgacacagttgtcctctaatgacaatatagtgaataacttgatagatttttttctgatgttgaatcagcatagtgaagtagattcaaatcccagcttttcctccgcttactatctgtggacttgtgtaacctttactctcctcagttttctaaacaataggagctatcacatgaggttgttaggcaaaattaataagttaatacatattttctattacatatatattatatatacatacaacatatatcatacatatatgagtaacctagaacagggcctagtatataagaagtactaaatatttttgtaaatgttgctttcttggaggtaatttctatatggttatgattgagttagcatgccatcggattttgttcgctaaatgtttatggctttttcattgatgtgattagctagtaatattcttcacataaactacttgttgtctaccttctgtatcaggcttgtctaacttcctaaagtgaattcgatagctgcctatctttttcgacactcagaaacagtttatctagtaaagaaaattatctgagcctgttgcatatatttgtattaattatatattgctgcataacaaattatcccaaaacctggtgggttaaaacaatagacatttattatctcacagtttctgtagtcaaaacaccaggtatggcttagtgagacacctctgattcggggtctctcatggactgcaatcaaggtgttggctgggtttgcagtcatcacaaggttcaaccaggggtggatccacttccaaactcattcacgtggccatgggtttttggattgagaacctcagttcctctctggctgctgtgcagaggactttctcagctctttgccatgtgcacccctccgtagggcagcccacaacatagcagcttgcttcatcaaggccagcatgggagaaccagagtgccagaaagacagaagtcagtttttttgtaacctaattttggaaaggacacctgaccacttttgctgcattctatgcactagaagcaagtcacaagtccagtccacactcaaacggaggagcttatgcaaaggtgtgaatacgaggaggtagggactattgcaggtcgttttagaggctgtctac

SEQ ID NO: 8240 - DNA, 1733 bp, artificial
  synthetic oligonucleotide
atttgtaacataaaatttttgagtgcttgaatgtccgaaaatgcctttctttcattgtctttgttgtctcttggttataaattttttaaaaatcttaatatctatcacttctagagatttgggctatgagatagagtctattatgtgtactcagtccatcattttactctttttatacccatttcttaagccaggactcaccaatgtctatggcctagggctgagaaaactgcccttctgtcatctctttctttgctctctggcccctatcaggaagatccatcaaccatcaggacaccaattgggccaccttgaattaatgggtcaaatcactatgcaccaaatatcagggtaagactgtggattgctcttccttttctctttcactcacgtggctggagctataatgctggtttagaagtagcttttaaccagccatcactctcccttttgtctctttatcccatgaaatcaataggagtgagctaatatctgaaattcagctttggccatgtggtaggaagagatccctcaggactcaaggctaggccccacaaccctgcccagtgtataagagcttgcattgaggtttgaggcccaaagctcagctaacaatgaagtgttactttgccttcctttgccattgttctgtgtgcatatttctctcctgggagccttgtggggagagctggctttggtctggggcaatattttggtattctcaggtcccttggccacacttgaacattaaatgcaccatatttccaacaataacttcatgttaatattattcttgcaattccaattctttaaaggtataaagagtaaaacaatgtgccttcggtgaagaagccaggggtgtcaatttcaatgtgccacagccttagggccaccatacacatttgcagaggttatgaatgatacagttctaggatgctcccttctcatgagagaccatgcagatgaaactctgcagagttgtgcaccacctatacaaccctgtgagatgtgcctacgacttctgtctcaactgtctctaaagatgcttgccaatccctttgcccttagaaaatggtcttgtaaatatctgctgtcctaacattccaagacttgtcattttgctttatcccatcccattgggttagacctgttagctttttgacatctgcttgggtttaacttgaggcatagagagagagcttgccccagactatatagatgggaaatggagaaaccggtatccaaagcaaggtctatcactccaaagcctatacactgtctactataggcaaggtggctggaagaatgcagctggcaagtgtctgaggttttgtattagcccacaaagggcataattatctcagacacttgtttattcattcactacattttctttaagtctctgcctcaggtgattaccttccaactctaccattcagtgatatctccaatctgtattatgttagtgaggcctctttctattgcaaatggcaggtatccaacccaaactagtctaagccaaaaggggatcttattagttcacataaactagaagtacaagggtggtctggtcaggcaatgctagatcccagctcaagtgaggtctgtccatctcttggatgcccatttttcttcgtaggcatcactgtcaggcatgctgttctcttagagctcctgaaactctaggcttatatcttctagctgatcaatccccaatgtctctttccctacac

SEQ ID NO: 8241 - DNA, 4489 bp, artificial
  synthetic oligonucleotide
tccaactctctgagatcaggaaatggacatggggagacctaggtaggccaaagacaggaagctctgggggccagggggctggttggggaaagatttctgccactgccccgagctacagattcccccctcctcctaggttccctagccctcccttcaaggccctcatagactcagcaccccaagaaagctctgttccatgaagggggcacacagggggcttctgccttgctcctcatgctactgattcctgggcatctggcccggccactccctccaacacgatcctttgggaggagggttgtaaagcacccaaagcaaccttgggtagactgacactcagcccgccacccccactacaggggcagcttagccatcagcactgagcatgcagaggcctctcccttgcttgctttatttatcttggcccaaggacgatgaagcccggatctgaggggaggatggaaaggccatttccaatatttcctctcggcctctccatgcccctgaattgccccttagtacccgggaggagagggcagaggtccatggtctgaaaacaatggcttgaaactgggggaggggggcagaggaaggagggagagggaggattcaaaacccacaagccctgtcatggacttgcaggtaatgcacagcatgctccagggtgggctctgcaaactggtggacctcagactctcaactgagtcacatagatgcagcctcagacagctataggtagatggggcagaggctggactggttcccttccttcccagggccaggactgcatagaactgccagccctaggaagcagtgtggagagtcctccgtccatgccagtagaaggaaggggcctgcaggccctcctgggtctctaagaagctccaggcttgcatctcaagagcccatttgcctgagcagagtggccccaccatgattggaggtcccagtcctccccctctttggcttctttgcactgctagaatccctatctccagttatcatgtccttcaccacacccagtgctgtccttcagccaagccacacacatggaactgctttcatcttcctcctcagctgggcctaccctttcccaagggctcagggacctcgctcctctgaattctctccaatttgtctccatcactccccatgtgcagggatgttcagctgcacagtggcctcagaggaaaagtgggaggcttgggactgcagcaagctggcctgcaccctagcccacagggacatcagggaggggagggcatttcctgtttctcagcctccctccttccttctgggctctgcagggacctgaagtgtcagggagtgggtagcctccattcagtcagcaaatgtccaatgtgggtgacaatagggatctaacttggttactgcctgtaaggatctgtcagatcagtaaaagaggtcatattactaataatagtacccataacaccaatacaacactttacccatggcaggcactgtctcaaggactgtacacaggttaatcatttcatctcacattaactacaactatctccattttacagatgaggaaatggactcaaaaaggttatatgaattgccctagtaactgtgattctagagctgggattctgtacccaggaaggctgactccagagcctgtgctcttaatcactacactaaacctagacagaaagctcacagaatgtttagaggaaagaccagttatttccaacagagaggtttagggaagacttctcggaggaggaagtgttgccgatggaccactcagggaacttggacttgcagagagatgagaggacattctaggtgaaggacaagagtaaaagcaatgatcagggactaggatattgtaagtcaggttcagaaaactctaggagctcagtgtggcaaggactggaatggcagccttgggaggcaagactgcgaaggcagtgtgtcctgtaggccatcagctttaaggaagggcagaacctgatctgagctcggtttgaaactcattcagcctgtgggagaggctactataattgtcagacaagagatgatcccgttctgttctggggtgatggcagtggggatgctttgaagatgtcatgaggtggcagaggtaatggattgacaggacttggtctccaaatgaatgccaggtgtgagggaaagtgaggagcccactgagtgggttgttatgctattcctggaactaggacactgtgagggagaagcagaatgggtgggttgaggcattttgtttgggacatggagggtttgaggtgcctgtggggcatccagcagagacccttattttggaaaataaataaggggatccccaaatgcctcaagtgcagactttaagagcaaacggtgggaggtggtgctgaacagaaaagctagagcctggactccccagttaattagttagaacttgattctatagccacagggagcccttaaagggttcttgagcaggggagtgatgcagttagatttgcatttttaggaaggtggatttgcattttaggaaggtgaacaggctgcttgggaagaaggctgaggggagatggtggggatggggatgagggaacagatatgagagacattttgatggcagaaagggtgggacccagagagaagaagcaaggtaaaaaagagagagtgacccagttgccacatggagaaggaacaagcctgagagtgaggcagggagcgatggggtggccggcagtggtgggagaagtgagagtgaggcaagttgcttcctccctgcttgtttgctcccctgggggccctagccacaggcctttgtttgaggacagaagaaatgcttccaaaggcagcgcctccctcctgctacaggttataaatctccagggccagacaccaacacacacacctgccgcaggcctgggctcagcagctgggccgccagggtaggggccagtgcttcccaaagatgggaggatttccaggctacatttccaaaggaattcccggctggtgaaacaccagaaaggagcggggagaaagagcctgtccatccctgaacagggcccagcatttaagggtgggggtggtggtgggatgaggggccagggagggaagatggggccagatggagggaaggctcataagagggagtgggggctggctggggagccaggcaaggaagggatgcacaggaggaggggctgggaatcgggaactgaagcagctgggagtacctcctttgagcttcaagcatctgacatggcctttcccaggggccaggccagccagagtcacagagagctaccagtgtaggtgacagtcaggtgtggggcacagcgatggccaacacatctcctatgcacacacagagggagctcatctcagagctggaagaaccttagcagatgccagggtccaatctcaacatgtgattgggggagcagggagctcagagaggtgtagcggctgctcaaagctgcacagcaaggcagttgcagaactgggcctgtagatgggaatacagggctttctggcataaagctctactctcttgagggaagccataatgagagagataaagagatcttgggattcttttgtcaccacctggagagaagtctttccctccctaatttgtgggggacagagaggattgagagctgactgcagcagtggtaactgccaaagcaattagactttggcaatctttggatgaattgaacatgggaaacatggaggaagtgtagacagaaggccaagaggtaattctgaagaggtagagaaaaggtggcgggagccacctagagaagatggggcaccaagctggaagacagcaggatgcttcgctggtggctgaatggctgttgggaatggttattagttgcagaagagaagaaaggaggagagggcggaagggggacatggagggtaagattactaggagccctggaaagagacacgctttgtttcagacagtagctgtgagggaccacagaaggccaggagtccccagggagcttgatctggtctaaagtctctgcctagagatccagacagaaagactctggcttcctcagtggccagtagggtgggtggccacactaggggccatcttcagagtaaaggcttctgagaggaggtaagcttggcattggactggacaggcaaattgtggcacctgtacactctcttcatctctgtcagactctggaggctgcaggcaagggctagttagctgcccaagcccctttggtgcatggacaggaaattggcacatgcactgtatgtgctcacttttcacctacacaggctcatgggtagagctggacactctctggaaagaaagaaacctcccaagccactgatgtcaaaggcaggaatgcctctagggtacttctaggcaagagtccaagggccctgcctgggctaaactacacaggcccctcactgacctggcatcctggatgccacttctgccattgatgccacactggca

SEQ ID NO: 8242 - DNA, 1742 bp, artificial
  synthetic oligonucleotide
ttctcagcactttacatatatttatatacacttactccttatatctatcctacaggagaaataccatattatccccattttgcagatgaggagacagaagtggagagaggtgaagtgacttgctcaacatcacacagttggtaattttcttctttgtaattgtcattctccagattctccactatgagtatgtttgacttttataatcagaacaaaaatgcacagggataagctttgttaagaaaaattgaagggtactgtggcttacagggcctccttggcccagctggagacagctctactgagcagccagtttttatgtggcactgcaggtcttggggtctttgtgatcttctcttggcctatcctgtctggccacagcccaccgctcagggcctgcccctctcctgcttgatatgcctcatggctaatgccccacctccccacctactggcctttgtcccttgcagggaaagcctactttgctagctggacgctcacctctactgtccatccctggaatagcagaggctggcagtgggctggctttgcctaccagccccatctcagggacatcaccaagggggatgtggagggggacatttatcttcaggcccctgtccccgaagattctacagagatttgttgttttcaactgtaacagagaggtggcattgtctagaaaggggctgacctccttaccttggccctgggccctctttactctgcagaggccactgccccatcttttcctggcttgaccactgcttacacaggtcacaagcacttctgtgtgggtgcaagcatcagccacccagctttcctgggatcacacctggctgcaagctggttcaagtaaaaatggaagctctctggaggggaggagtaactgcagctctgtgccttctcgtgccctcttcatgccatgccctggccactgttccaaatccagattccaggaatgtttagcaaggcctgcggggtgggatgtggaggctggtccccagaatatggggagcaagaagcgggcaagagggtgctatgagttctcttgcaggctggaggaggagcagcagatcccactgtaggcagctttgcttcttggccctctggaaggcaagaacaaaatggagtttgggaaaaataattgataggatgcctgggatcttgtcctggcttgtcctctaactgtctgtgtgacccaagcaaggcccttcccttctctgggccccagaatccttctctggaaaatgacaagaacagtgatccatttcactaggctgtcatgagaatcaagagacacctacacaggatgggaatgcagtttgtatagtagaaaacagggtggaatcgtgagctggttaggaagctgagagattctgagtcagtacttttccctctccaaggctccatttccttatctgtgtaagtacactggggagtgcgtgctcttcaacaactttgtgaaagcaacgagcccatttcctataaaagtacacagcaaacaaagtgttgcacatgatttcaggaaggcctttaatttcatgggtctctttttgggccacttccaggccagaaacccctgtcctaggtgaaggctttaaccccttgtctagccagctttctgggtgttaggcagcctctgctcacacacctgtggtgatagagaactcactccttgccaggtaactggttccacccttgcagacctctgactttgcttatgctcagctgaaatctgc

SEQ ID NO: 8243 - DNA, 2010 bp, artificial
  synthetic oligonucleotide
cagcttctcccagctgcctgtggttctgggctttccagcgttaccagcaaccactatgggggtccctgagcctccctcagtcccgggcttgggtggacccatcccataatgtcctgaggctgacagggatgctccaagcatgggtggatgaagaggaggaggagagagccttcccacagagcctgaacatggggtcgggaacacattgtggaggtgtagggaagaagaagacaggagagggggctgtgctgcattcagaatctcttctctgccctcttcccctcttaatgggggatagagacctacagtagacaaagaaggacaagatggcccctgaagtaggtttcagagaccatttggtatatgatgaaaactgaagcccagagatgaaaagggacttgctcaaggccgtgcatcaagggagccaacggcagggccaagactgcaacccagcctctacccatcctgctctatgtggcctttctctccacctcacagccagagacctgtctcaacctaggatttggccctgtctttttctgatcatgttactccatccttaaaatcctccactggcttccctttgttcttaagaaaaagacaagactcctgaccacaaattacagggtctgccttgatctagcccctgcgtacctctccaaccacatcttgtactaaactcccaagctccctcctgcctctgggcctttgcacatgctgtgccctcttcccgagttgatcttcctcctctttttctgttatttgactcctacttcgactttagaacacagctcaagtgtatcttcctcaaggaaacgtccacatatgttcctggctgggacacattttttcattttgtactctcatggcaccatggacctctcctccatggcacttctcactgttgcggtttttcttttgttgtgttactttgtgatgaatggctaccttccctgccagactcagagctccatgaggacaggaaccacagctgctttggctcgccaatactatcctagtgctcagggcaggccaggcaaatgaccacaataatgacaaggacatcaggagctaatatttgaggcttaccatgtgccaggcgctcttgcagctgcattacttagaataaaaaaatgtgatcacaaactatttgaggtagttactatcattatccccaacatacagatcaggaaactgggacagagaagttaaagaactataccgaggtcacacagtgagtagtgaaactgggatttgaacccaggcagtgtggctccagagcctgtgttttgacctctaccaccataagtgctcaataataaatatttgttgatgacatgtttttgtctgagcctcctcaacttcaatccttgagggagttccagccactgagcacctccctggatcttggagtggtcccacccagaacaccctgccacctccccaggtcacttcttctgagtcccctttcctggcttcccctgtacacactgcttgcctctgctactccctgggataacatgagaagtttctagggctgggcaatgtccctgggtttagagaggtactttcccacgttgaacactggctctggtcattacatctcaacccagagtccactgacttgctctcagctctccaagctcaaccccttcccagctgtgtgccaagctgattcacctccctgagcctcagtctccccttctgtgaaatagagctaatcacagtactgcacagtagggttttgaggattcagtgagtttgcctgtgggtagtttgtatctgcaaagcacaagacccttactagttatcacttgtgtcattgttattaacaataagtaagatgtaaactgaaactttcttcatcatttctagctccaaagcccgatggagaccaagagtgatacactgtactcatggtaggtgttcaatgtgccctctttttgcctgctcaccctcactacaccctagacaagcttaggactggttaggaatccccagccctgcgtg

SEQ ID NO: 8244 - DNA, 345 bp, artificial
  synthetic oligonucleotide
ctggctctggcttccccccacctcccacatccagtctatttctaatcatgtggcctctacctccttcctctcccgcccccaggcctctccaacgcccccacctactgccatggccccagtcctttcgaccaccatttctcacccagctccttccacaaccacctcttgtgaccatgtcttctgtctcaccacccctagttctgcctccacacagctgccaaggccaccataattctgggacctaggagtaatttcaaaggtttggctgttacatatacagctgttataaacatctgtgtgggtgtctttccaaatggaattgctggttcatgggtaagcatacat

SEQ ID NO: 8245 - DNA, 3001 bp, artificial
  synthetic oligonucleotide
aagggcactaatcccattcatgagggctccaccctcatgccctaatcacctcctagcagcctcatcttttaatactattgcactggaaattaaggttcaacatatgaattttggaggacatagcagagcccatgctctgaaatgtccccaaaagcagactatcggggagaaaagccttgggtggtggcagtacaaggagtcccagagcccagagctgtatgcctgaggcctgggtatctcggcccccagaatcccttggacagcagtagccccttcctagagttccctggcaaatacaagacactctgggctgggagggaggtggagaacatctagtccaaacccatccctccattcatcttatactgaagtcatctctgcaacatccacgttgagtggggtttcactggcagaaataggaaacggcactccaggctgagtgcacagcctgagcaaaaacatggtgcttagagaggccatggtggctgcagggcagatgacattagtgtggctgtagcaagactgctgggagggatggaaaggaatgtgggaagccagctgagtcttgggctgaaaaggaccaccaagattctctagaccaggccctcactctgagccataccatcagtgtctgctctcctttcccccggccaccctgcaggatttgagaagctagaagtttccttacagtccatctagcctgggtccttcatttgcagatggagaaattgaggctcagagagagacagtgactcatgctagggcccacaatcagtcagcccttttgcggacattcagtaaatatccattcatttgaagcttagttctgagcaaaagtgcagagagcctttagtcagagaactttgtagatgtgccgtaatctttgctccttcagagcaagcatccctagcttctggggccactcctcaatacttagaaactgcctacatatggcacatagtaggagctcaactcgcatttattaaatgaataaaagcttgggtaagtcaatggtagggacattaagacagccatgtgggcacacagccaaggggacagtgggagctgaaatcgagcccacgctgcactcactaagccatgtgccctggtacaaggctgcatgcatccaaaggaggtgctttttgccaccttgcactatgacactgtataggctggtgacagtgctggggacttcagaaggccaaggagtcagtctcctctgtagcctgctctcctctaaacaggcatccatttggccatgacccagccaccacacctccagagggatacccagtgagtagaagagatgcctcccttgcacccagcccccagccatcagctgatgcaggagctcttcaggccaccaggtccggttgctgactcattgagtttccagtcagctaatccccaatccttttctgctcactcccttgctcaccacctcattacacaccagcctctggtgggaattctttcccctgacatatcttccaattgcatgtgcttagtaggtactgccctcctagagccttgaacagtgagagggcagggcattgacgggtggggaaattgaggcttagacaggttaagtaacttggccaatgtcacccagcaagaacatcccaatttggatttaaactgagatctatctattccaagccttaagctttgcccagggctctccctccagatgccagggcggggcagtcccactggaaaagtgcctgatggcagatgcttctccatcctctctggtacaaggcatctgtgtcaagttgacatcagaatgtctggccgtgtgttgtacatgccacctgtgtgactctaggcaggagctcccacctggctttttagtaggggacagatggacttttgttccgcccaccaaccctgctacttagagctatggcgggacttttgagagcagggctggacttggttgggagggtccagggcagaggctgggaagcgtgtgcaggagccaggccctgacggtatgaatttctgtctttaacctgggcaggatttccctcggtagggggtgtctgcaaatcctaccccttcactgaagtgagtgtcaattctagttctgccctaggctttgcttggcaaggcaggtgggcagagaggaggagtaactgctgatgccctgtctcaggaagacctcagagccctgtggggctgggcctgcctgcctagtggcctgatttgatgccagtatctcctggttgaagggagagtaggaggttactccagagaagatggaacccccacatgcaggcccagccaacaggccactcacctttggcagcctggggcagaggggcactgaaagaagttccatttagttgcaggtcttaactgctcaaactcttgttgaggaaggaagaatgcattgcatagtgaaggagggagagagaaggacagaggcagatacatagataacagaggggacaaacagagggtgtgagagaacacagagtgtgagtgagccaatgagcaggggcgcacttggaatgaacgcatagctgggagtcaagagacctgattctaaactcagctctgtcactgacttgcagggggccctgtagccagtcactccttctcttctaggcctctaagtcccatttgtcaggctgtgggggcagggagggggaggtaggactgacctaggtaccctccaaggtcccaccagccctgacctcaaattctgtgagatagaaattgctcctcttaggctggctctggcagtgggcgtttctgaaactcacagcaatgaaaaataggaaaaaacaaactttgggaattccaagtatggctggggctggaggatgaggcaggcagagctgcagagctgtttgtctatgattcagagcctcttgtgaggtagagcacatgttcttagaggcaggactgcccaccactacccccagccgccaccaccactctggactccccacccagctcaacctcagtggggcccctgccctggccccgctgc

SEQ ID NO: 8246 - DNA, 811 bp, artificial
  synthetic oligonucleotide
actcagggatggcatggaagggagacaggtcccaaaggatgcagagaagtgacctatgccagcctctttctacaagtaggagccttctacatgttttctgcccgctgtcagcccatatttggtcccttggctggcatttgttccccagtttgagctgtaacccagtcaccaaaggaggacccatgcagtctgatcaccaagcctaagttgaaacactattcccattctctctacgcatttcataccttggaacatcgaggcccagtcagtaggaatggctgggtcacatctcactcagtagaggcagggccttcagaggccccaagtgaccagagtcttcagttttcctaaataagtgtcaccagcagtggagagaagtccccaagtcccatcccaggactcactcagcatggctatggcctttatctttgtagcgcatgtacccacaggatgcccgtgtggcacctgcccggtagccaactgactttctttctttcaaagagtcagtgtaatattgaaaaaagaaatcaagtttgtgactcctgggtttgaatctaagatctgccatttcctaactgtgtgacattaagcaagtcctttaacctctgtgagcctccactttctcaactaccaaaatgaaggtaattactactgcctgcctgccctgcctaccttgcgagccccacatcagggagggggtgttggtcatttacttgtccactgaaaaaagactaatcaggcacctactatgaaaaaagactaatcaagcacctactatgtgccagacactgttctggggcattagggtgct

SEQ ID NO: 8247 - DNA, 1693 bp, artificial
  synthetic oligonucleotide
cccgaatgcctggggatttcatcagtgtggtggccgtgatgctgatcaaggctccccagagcagttggggccggagctctcagaatgatgaaagccacagaagaggaagctgaaggagcaggacacggccactttggagtccacaaaatattagtctgtgtcagtagctccactgaagtgtgacaaaacaaattgaatttatctgcagcaagagggatttaggtcagaccttctagacactgtggggaggtgaggcagggtatagacgtccctccctgagcaaacagaaagcttcaattctcatcacactacccctaactacttactggcagtggagctccagctaattccttcacctctctgggcctcagtttccccatctgtagctgggggtggggggcagcggtagactccacggtctctacggttccttctagctcttaaagtctggaattctgtctggaggctgggccgagctggcataacttcagaaggctgtagacggccataaaagtggtgggatccctggggatggagaatcctgcagggaagccccctcccccagcccttcacctcctgcccttttaactgctgcaaccacaaccctcccctgctctcccaggttcctcctccccaaacccccacagctctgtctggaggccccattctctgaccagctttgtttgcttttaataaagttaatcgcactcctaatttgtatgtaatgaaaagataaaagggagacatgggggcgaaccttccattggagtgggagcagtccaggtccagggccggcagccgcctccccacctccgccctcaccactgccttgcccatccccggagtctgagcaggcgctgctgtctgggcgccagcccggcccagttgtccctgcagctcccccagggaagcctcctgggacctgcttgatcggcctttcctgtgcctttcgtggaggacaaagaatccccacgtgtaagtcctgacagcatcccacagttcacctttgtaggactccccatactcccagccattcagttcgttgaaggcaggggctggctcctggctgggaacacagcaagcagcagcaaaacttaattcctccactcttgactgtgtcctcatttggtctctgggaatgcgttggattcctcaatgagaacagagaagaatatactgtagcgggtggagggctactgattagattttactcatctgtgggtcaacacttctgtctacttagcccactcagccatttcttacccccttacatggcttttccctcacaagccccactcaaatggttggtcaccccaggtcctcattcttatcccagcctaagatctgggtgcataagtcccagcatgctgaagcagctctggggagctgctcccacgaggccagtcccccacaaaagaagcctggctcccagggttactccccctgcacccgcccacccccagaggcagtgtccatgggaaactaccccctgtggtggtggtttgggggatgatgttcatggggagatagggaaggaaacacaggctccccatggggaatgctcagggacacaattcagtgaggactgtggcaagggatagaggcagcaggggtcacctctacctccagcccttgtttcagaggcccatatcccatacccttgaccattcacaatagagggacagaggtgagg

SEQ ID NO: 8248 - DNA, 1383 bp, artificial
  synthetic oligonucleotide
agacctatggaatccacatctctggggccagggctcagaaatctacattatgaccagtgtttcattcataaggattttgcttgattttttgcctttaaatcttcattggcaaggggttcattttgatacctgatgttgatcgctcctgtcccaagttcacttaacaaatattcactgaccactcaacattttctgggtttcgctactaactctctggctactctctctgtttcctttgccagctcctcttcctctcctattccttgaatgctggaaggccccggggctcagtccttccctttctttttcctgtgctacccagcctccgtgcgtgagctcatcttctgtcagcttcagttcctatctgtgtgctgagaatctccaccccaggcctcccacccagccctctcccctgagctgattcagccccaccccagcttgaatgacctccaggcccctcaaattcaacaggacccatactgagctcatcttcttcacacactcagtgaactttctgaagcacacatctgatgacctcactcagaaaccttctgggactctccttggcccacaagatcaagtccatactccatagccaaaagagagcctggccgctatttacctctccagcctaccctctccccactctcctctccttggccttcatccctgactgtcccactccagatcggatcagctgaatgactcacagttctataaatgcaccagacgcccctcacccctggccctgcatgtgttacttccacttcctggaacacaggggcatagtgagagcaggccaaaggggacatctgtctttgagcaccagtctgtgggggtgcttctgagattctagttgtggtgtccttagccagcatgaggggacaaagggggcagacatttccttagcaccattgaccgtagccatgccattgttggcacacccttctcccccaggttcaccaggccaaattccatttcctctaggaagcttctccttactcttccagtctgaactgtcagtatgctaatgatcagagataaatctctaggaatagtgcctggtacataataggcactcaataaatatttgttaatgattgagcaaatgtgttcctctcactttcctctgtcaacatattctattatgatccacaatttcaagactatctcccacctccacccttaccccatcccacctccacccccactccagactatgtgctcaccaagagcagggcagcatcttctctatatatctatccccagcgtacagcaaacaagagtatgtgctcaccaaaggttcgacgaattagcttattgagacccctctctgcctggcactgaactatgtcctagggaagcaagcaatgattaaaagac

SEQ ID NO: 8249 - DNA, 1332 bp, artificial
  synthetic oligonucleotide
tgctttgagattcaaagcccaactgcacaaatacgggctagggagacagaccttaacagccacatgtgtgaaaaagaccaagggctttgagctgaccacaagcttcacaaaagccaacagtgtgacgtggtggctaaaaaagctaatgaaatctcagtctgtatgaatagaaatacagttttcagatacagagaggtaatagctctactgtactcctgcctgtccagaccatctggaatatggcgcctgattgtaggcccacatttgccaaggcacattgataaacagccagggaaggtcacgcaggctggggaacggccacatgtgagaagtggtaggagaaacagcggccatttcccctatccaagggtactcatgagccttggcctaaaatagcaatgttctgcagagaccactcacgctgagcacttactctgtgttagtcaccatgggagaaggctttaccgacatggaacccccaacagcggccctaaggggaggcattctcactctcatttgactcaggaggtgtggagtaacttgcacaaggtcacacatctagaaagtcccacagccagcagcacacaagccagatctgcttagttccaaagactgtacttttgtccaaatagctgaagacccacatggggcagagaaaataagggtggtctgagaaggcatatctgggatctgtgggtgaaaaccactggaaagtatgatttcagctcaatacatagatggtgtttgtggggttttgcttggttttgttctgttttgctttcactttttattatggaaaatttcagatatatgtaaaagtagacagaatagtttcatgaacccccatgtatgtacccatcacccagtttcaacaattaccaactcatggccagtgttgttctatccccaccccaacctactcctcatccaaggattatttttgagcctattccagacatcctaccagcatgtatacagaggatgattttaacagtcagccctgtcctgagctagaactggtgtccaggagaatgaggaaaggagctcattggcactggaaggctatgagtatccctgaggccattctccattatgaccagtccctctcctttccaacataactgaattgatggggtgcaggtcaaggagcagagagggtggtgctgccatctgagcagtgaagactactaaagtgccttgggattgcaaggtttttcctcagctagagagccccctactccccctagtctgcaactggcactgtcctatccccggtacccaaggtttgctcagaaagaaagaggcacatatctccctaccgctaacacacac

SEQ ID NO: 8250 - DNA, 1309 bp, artificial
  synthetic oligonucleotide
cctgccatcacctgcctctcctggtatgcagggaaaatggctgctgcctccgagctccttgcacagaccgggcagagcggatgtaggtgtctaaaggccaagcagtcctccaagtcaggctgctgctagcttatgctgaaactccagaagagacattgacttcacccagcttccacccccagcctagggaaccccctagagactcccagagaaaaggcagtgtgctgtaagagggggaagaggaacactggctttgggttggaatcctggctctgcttcacctgcatgcccttgcacaagtcatttcccactctaagcctcagtttccttatctgtaaaatgtggaagatgacattgacttcacactttggtgtgaagattaaacccccagccgcacggcagtgtgccaagcacagagaagacacagagtacatgctaattctcaatgtgctatgggctgcggacacagaaacaggaccctgttgctgcctttaggaagcttccagtctcgtatgtggagaacaatcgcaacagaagaagaattgtggtactcgtccttaaaaagagacacacaaattattggggatggtcagaaaacaaaaaagtaggaaaagtagagttagtgaaggagataatttcatttggcattcaactcaccacccaattcccgtttgtccttccctgtgttcattaagaccctggacacttgggcaagagcgtctttgtgtggcacagtcacataggaagtcacaagaccccccacagtccgctccaactcatttgggtgccttagtgcgtgtgcatatgtgtttgcatgtctgtgtacacatatgcacatgcatgtataggataaatgtgtatgtgtgtgtgcacatgttcatgagaatcttaggggagaaaaagagtgggttaagatgaggcaagagaagcaggtggcagggagaaaggctcccgtctcccctctgccagctcctctctccctcttcccagtgctgggtggcagcccctgtttacagagttcaaggagctcgactacccacccactgccccacttcaggcccctctcttccactcggcacccccttccatccctgatactcccgatttcttccaagctgtatttgtacacacagttcccagagcatttgcccctcccctgtcccattagattggtcccacagttccgacaactaggtgctattaatatccgttttaaagatggggaaactggggcacagagaaatgatatgacacatcccctccaaaaattgtgctcgaagataagcttcttaaaccctagtcccttggc

SEQ ID NO: 8251 - DNA, 3823 bp, artificial
  synthetic oligonucleotide
caatatccacctctccattatgtcccttgctctcatggccagccccctcaaccaccttaagttgaagcagttatcttagattacaccccagtaagaccataaaatagggagaggtgattccttcaaaagaaatcaggttgccagccagggtggctcacgcctgaaatcacagcacgtggggaggccgagacaggcagattgcttgagcccaggcgttcgagacaagcctggacaacatggtgaaaccccatctctacaaaaaaaatttaaaattatctgggcatggtggcgaatgcctgtagtcccagctactcaggaggttgaggtgggaggattgcttgagtaccggaggtggaggttgcagtgagctgagatcacaccactatcactgccactgcactccaacctggacaacagagccagaccctgtctcaaaaaatttaaaaaaaaagaaaaagaaaaaaagaaaagaaatgagggggcagggggacgggaaatgggcagcttccaaatggcaagtggccaggacaagggatgctaggacataggtatcagagcaaccctagaccaacaaagccttctgtgctgagggcgtgggtaatggccatccaggcatgtgggggagacgtgttgagcctcctcgaggctggcctcgcaccaggctctttccacgtatcgtgcccttcatcctcacctcagccctgagacacaggcagtatcatctccaaatacagatggggacctgaaggctcggaggcaggaaatgacttttccgatgtcatcacctaccaacaggctgaattgggactcgaacccaggattctggctgttctctccccctgccccccacccacagtgtggggaagccactgcactgctgtttgagcagctcctcaggatcgcagcagggccttcaggactctgttagcggcactctcttgggctctcttctccctctccctcctttcctcattcccacctctagagctcaatctatctaatctaaacaaatctctgagcttgatttagaaagggtgcttgaggcctttggtgccaggcggcctcgtgggcagaggcagggcgagctgtggtcacattccctggaggctttcctgccagctctctgcaaggctggcccagatctgttggctatgggcagggcctgagaaagagcctcagtccaggaggggacagagcaaggacttcctatttctctgctgcctcctacccactctagcagcactgaggcaggcatgaggctgcgtggaaagcagggggagtgcaagatggctacagaaggcaacccaggctatccaagggagaaggggaggattcttctggctggagggtggcctcaggggttctcctgctatcctacccctcctctgagctgactacccaatcaaccacgttggtggctggctctcctaccctccctcccctctccactgccagggcacaactatcaggactcaagccctttccaggcacttagactacctcatgggctcctggcttctcactcacactaggtgagttgccctcttagagagatgagtcttgggggactctggatgggtctgttcaggacctcaggcaggtctaggccactggcttggaggcctacactctgcagccatggctggctcagggggattagcaattatctgaactcacacttagaaatccttgacctgttccccttggtccatcagctatacggcaaaattaaggactgcagcctggagaaaaaagttccttcccactgttgcttgactgagctgccatgggcaatgccaggaggtgcatgggtgtcggtgaataggacagagagacctgcagagtgcaattccaaccctgccactattcgctgtgtaaccttgggtaaggccctcccctctctagctttccattacaacccctaggtcacagaattgctggaggctcaaatgagtcaatggttataaacaaactttgtaacacaaataatttattgagtgctcactaactgctgggcactattctaagcactttctagtattaactcatttaagtctcacggcaaccctgtgacctagggacttatggttgtcacaattatacagggggattgggggagacctaaagcacaaagaaactgtgtaactcaccctaagtcacagagctactaagtagtgaaccaaaagttaagttcaggagacttggctccaaacatttccccttatttccccttaaacactatgctacacagacagtcactaacttataatggttcgacttagaattttttgactttacaatgctgcaaaagcaataggcattcagtagaaactgtaattcgagtacccatacaaccattgtttttactttcgatacagtattcaataaaatacatgagatattcaacacttcattataaaatacactttgtgttagatgactttgcctaactgtaggctaatgtaagtgttctgagcacgtttgaggtaggcgaggctaagctaggatgttcagtaggtgaggtgtattaaatgaatgctcgacttatgatattttcaacttatgatgggtttatgtgaacatacccaaccttaaggtgcatctgcactattaaaggctgcacatgcctcagtatgatttttaaataactgcctctaactaaggcttgtcgtggtgttcttcagagaggaggctctaagggagagcaaatgaggatttggagaggaaagaacaagtgagtgcctgtttttgaagctggtggaggtatgcagaggtcagcttgtgcctgccctggctaggagcctggggccccttggatttcggggagcctctgggcggctcccgttcactctggctgcgggagcaggtcggtggggcaggagcagcgggtgagcagctaatcagaagcagcgggtctgcccgggctgcgccttgaccgcttgactcgctcctacgcagcagcgagcgcctgctgaaaggcctctgctccaccccggagctactggccgtggaggctgcggcggtggtggcggcggcggcggggcgaagatggagagcccgcgaagctcctccccaggggcaggctgcccgccactttgctttgatagcctggtccgggaggcaagtccgcagtcccgcagctcctccggcgctgcacgcattcttcccggccaagaaggaacgcggcgagctaacgggatccagatgtaggagtcctctgggcttggaccccaaataccctaaataccagccaggccaccgggagacctggggacgtgcaggaggcatgctggggactcccggcctcatcgagggcctggaccccaccctcaagccccctccagttgtgctccaggggcctgagggcaagatctggagcctgggcccaggcctctcctctctcttgagtctgtgcttggtcctggtgcttagctgcgaggctccccagctctttccccatgggagatgaggagcctggtgggtagctctgaggcccatggaagaggttatgtgctcctgttggactcagaagccctatcctctgacactgccaccacactcggttctgtccccagcctgagctggccctctttgtccagaggggactttgggcagccatgacgtccaaggatcacaagacttgagtgccaagtcttgggtgcgtgtcacttcagttttccagggctcagttacctcatccctagaatgggagtatgtgtgggcagttctgctatgtgaggaaaaatagatcccagccctgaaagctgaacctggcacctggtggctcagagggaaaggaggcaactctccagagacctctgga

SEQ ID NO: 8252 - DNA, 2827 bp, artificial
  synthetic oligonucleotide
tggagggccgacaatgctgcctgaagttcctgttctggctccatttacaacaggcttcctggagtcacggtgcattttcccaggcgcctgctctcggctttcatagctgcctcccaccacccagacccagctaggccggccttagggcacccagaaggaagcaggagcccaagtactggctcacttgggtcagtgcttgggctggctagccgcggctttcacatacaactccgcagccgcgaggagatgacccctcccctccccatccccaggccagcccggccccgccccgcccccagtgccgcgtggagggaaatcaggagaagccgaggaattgtttgtaattactgtgtttttaaaggcttttccgtgagccttcagccgatttcgggggagggcagcttgccagggagcattgaaatggaaatcctgtgttctagccgggaccctcttggaaggagattcttcccagagaaaagaccagaagccccgccccgtcccccgggtcccccgtgcgcggctgtggtcatggcgggctcagcgatgtgtggcggctttgtggaacggcattcctggccaacgggcctcagctctgcctcgggaccccaccattcagcccccgcatgaaaggccgctgcccgggcccgcagctcccactctcccccaccccaaggacgcacccattcacctcctctccccaccgcaactccctttcccccactttccccaaacgggaggcgctagccatggaacatggcacatccagggctacctcctcccaagttacccagaggtcatgtgtacaagcagcaattctaacaacagtccctcaggcgtgagcggcattttacagtttgcaatgcctttgcacatccaccaggccagttactcctcgtagcaaccccgctaggagcttctattattatcagttctcaaatggggctgggggaggggaaagccttgcccaaggcccctgggctagcaactcaatagagctgggcctaacccaggggtctgcaggatgtctccttccacccccaccccaggctgcctctcccacacgctggctgacacgcaggcaggactgttcttctggtgcaatccctgggccttgtggtctgggatcatttcctgtggcctaaagtacttatttgcaagttgtaaggactgcccggtttctggaagcctggctgaatgcttccagctgggaatttaaccttctcagacccagctgtggatcttgagagctctcttagttcccaaccattttcctggagccccctgagataaattagttgtgtctgggtggggacaatggaggagtactggactgggatccagaagacctggcctgggcctggctctgacacccacttgctctgtgaccttgggcaagtcccttcacctctctgatcgcaaatcaaggcttagaaagtgtgcttccctgcctgagtttgcaagcccagcctcttgttttcactggagcatgaatggaattgaccttcccttacgcagctcctccacagctcaaggtcttgtgagaaccttggaattgttgcacatgagagctgattaggtaggcccctgaagatagtggaaaccacttcccccatcctccagcatcggatagatgggcaaactgaggcacaggaaaggggagccagttgctcaaggtcatccagggaagctaatagtaaggtcaggattaaaatccagatcaacagtggtgataacaaaggtagtgtgagagattttagcttcctataattttccaccacttccccaagacttccttttattcacattttacacattattattatatattattaattataacattaaaaataaatgcatagttaaaatcctgtgtaaaatgtttataaagttatcttcagaaaactttcctatttttatgtatctgtaacacacatcctctgagcgtatacagtgtttgctcagcacttgcagcctcaagggacagctaacctcccaccagatctctgctgccctcaaggccctcctatagagaaacgatggtggtgactcagtagatatgggccccttgcactcttcccagaagcctcctgtttgtgtttgggaacacacagcacccgtgggtaccttcttttggcccaggaccccacccctccttaactaggggaggcttctcagacagagccccaccctcctccacttctgcccttacattggttctaggaagacaaaagtacaaggaggagagtccaagatttgcaaaggaataaagaaagtttcatggatgtttcagaggtgactctgcctgcctttccctcatgtcctcctccttcataaaggaagcaatttttttttttgacacagtctcactctgtcacccaggctagcgtgcaatggcacgatctcagctcactgcgaccttcacctcccaggttcaagtgattctcctgcctcatcctcccaagtagctggagttacaggcacctgccaccacgcccggctaatttttgtatttttagtagagacagggtttcaccatgttggccaggctggtctcgaactcttgacctcaggtgatctgcccacctcggcctcccgaagtgctgtgattacaggcgtaagccaccgtgcccagccctaaaggaagcatttctgagccttccttagtccatagaacatcaaggaactacagcatgctacagctccaataagcccttagacatctccaattcaaccctctcaggttacagatgaagaaactgaggcccagagagggggcagggactgagaaacctagcataagactgaagaccagaaacctcttctgcct

SEQ ID NO: 8253 - DNA, 3339 bp, artificial
  synthetic oligonucleotide
gctggcaggctgcccaggaaggactgtcatcagactgtgggctcttgtcactgggctgaggctacaaaggcaaaaggaagcctgagcctcaggcatcaaacaggccctgaggcagcatcagcaactccaggaacaggccagaattccgctggtcagaagcagggctcaaggttaagcctgggctagtggccaagggaactaacccatgagactgagggcagagaccatttaagtcacttttggattccccagtgctccacaaaaggaagtacttaataaatataggaaggaaatggcacttttagagtgcctcctgtgtacggccactgcactagtccctcatgccctctttgaagcagtcctgtgaggttattatcccccttcaactgataaggaaactgaggctcagagaggtgaagtttctcactaagggcccagagctgatgagtagtcaggtgactcttccaacctagagaagagagaggggaaaaaaaaaaaaaaggacaaagaacccctcccattcatggcagtggaggaaggtgcattttaacaccccaattgacaattctctgatgatcatgggccttaccacctctgcctcacactacccatctatggccaatggacaagctctacctctgcagagccagcacaggacgagatttgcacttatatgtcctaagccttcactgacaacccttggggacagggccatagaagcccccaccctcgctggcctcaaaacttggtgctgtgggacattttcacatgagaacgaagagaccagcaggaatttccgactcccacagccctagataagatcccaggtcagctaccctcttagctgaggggactctgggcaagctttgggcctttcttttcccagtgcccagcctgggagggaggagtcaatgtggcagccatgtctaatcaggcggggccccatgacacagaagctccttcatctaggcctgcggaggggtcagactggggttctgggaggggccagaggagacacagagcccatccagcccagaccagcccacattcctcagcaggcctggatggggtgagcatgcgcaacaggaagccaagcccttcaccaagaggctaagctgccatctgtgcatgcagacagcagtgagcaaagggcctgggccagcggagtcaattgcacagaaaaaaaatagcaaacattttgcttcctccccctaccccagcccccaccccaccatggtgcaacactcagcttccaaagggaatgttggactcctgctaactatttttctccagactggggccaggcatccagagtcagccttgctaagttgctgaagagagaatgatggggtggagggattctttctacccagggagtagtttgtttgtttgtttgttttccttctgaaccttgagctcccactgctccagcccagaaaaaaaagagctaggaaaaacaacaacagtcccattaagatggtatagtatattttgtctatctatcatttcatttgctcattcccaccactctatgggatagggatttttttttgggtcccattttataaataagcaaaccaaagctgagagagggcatatgcttgatcaagactcacagttaattagcactaaaactgcttcagacccaggtctgactccaaatgctgtggtcgttccactaggcgacattgcctgggtgcaaagcctctttgcaactccaacataggaccagggtggccaacgagggcccgcttggcttccctcaggaagatcccggcctgagaggtttcagtcagtgttcgagcaacatttgaattgtcttttaattatttccccccaatcatctgcttgttgaagagaatttaagaaatgccctcaaaaaggaaagacacttaaaattacctatatcccaccactgagagagaaccactgttagctaacttcatggtaggtttcctgataatctttttattatgcacatatacaatgtgaagatctcttttacatacctgagatcatggtggacctgctttgagtgctgggccaccttccagcccccacatcatatcttcatgaggccagctcaactgcagttcttctctcttggagacctgctggagccaaaatttctggttccccaccgggggcctggccttgtagctgaaagtctcgactggcgttttcccatttatatcctgacaatagactccccagttcattactacattactagatgtcacgtgggagggtctttctttaactcagggtctcacatgcacaacacacacacacacacacacacacacacacacacacacacacacacacggtactgtttcatacctccaggccttcgttcattcaggcccctttgcctgagatttctgcccttttttctccctccctccctctttctctgtctctgtcatgtatgcacatggtaaaaaaaaaaaaaaaaaaaaaaagaaaagaaagaaagaaaacaaacaaaaataaaaacaatcaaattaacataacaaaaactccaaaagagaaaaagagcatacactgagaagcgaggctcctcttgtccctcaccttggcccctgtttcttatatatcatctttcctgagatattctgtatattggttagtacaaatgaaaatgtatcttttgtgaaccatgaatgataataactgcccactgttggacaccttgcttttgtaacttcttgattttttgatactgttgcacggcaataactgtggatgtgcctcatgctgggtacaggctgtctagcgaagtatctgatggctgtgccataatttattaaaccgggcccctagtaatggatatttaaatgcctttctgtctcttgctactacaaacaatgcaacaataaagatacttgtaaaaacaaccttgtgcttttgcacatgtagcataaattcctactactggaattgctgggtcagaaagtatgtggattttaaatgttaatacattttactaaagggcccttcaaacaaatggtaacaattgacacccccaccgttaaagacaaccccacaaagacaacgtagaaagggcccatcctacactccctttccttacctgtttggtgcttctgaggcccagccccctcccagctgggccagccaggctctttgctctcaggtcaccctatgcctgcctccacattgcctttcacaaagaatatggcaaacctatgtttgtctgtctcccacactagactgtcagctttttgagggaaggactaagccctactcatctcttgcaggccccaactgaacacaccacaggcagaagctcaatcaatatttgttgaactaaactag

SEQ ID NO: 8254 - DNA, 2271 bp, artificial
  synthetic oligonucleotide
ggatttcagatggggaaaataatcagaccaggagtaaacggccttggtctttagagtgggggagggaacatgcagcggcacacggggcaggtgcctgacttctgaagccagatggacacacacggcttgtggaaatagtggtggcacggcagctcagttgccacctcccccttcacatattcgctacagcagatggggcagcacatctcctgaccaactgcgccatgatcttcagtgaccaggatctcgggaagagcgtcaatgctctccttgcttgctggtggattggccacctctacatccactgcgagagactccaagtgcgcaagggcagtttccattgcctgggccaggcgttcttcaagtgccatgtaggtgaggaactgagggtccacataggaaatggcttcagccactcctaacccatctgcaaatccatcaaagaggctccaatccacttctaggtcttcgctcacactggagtcatcttcaaggttgttgtttccatccagcatgaataccccaggttgcatcaactcgtgaccagaatcattatccccctcactgctactgtcattctcatggtactggagccaaggaatttctccttcttccagggatgcctgctcttcctgaagagatggttctcgaacttcttcaaggtaattgctgccattgctgccagcactggccccggcgccagccccggcactggcactagcaccggggccagggctggtgccagtgctggcactcaccttagcctgtggaggttcccgctcttctttccccggcagagtctcccagctttcgccactggaggacagggtttgctctcggcttcgatatttccgacgcagagcagcaatccactctttgtcactgtcagagtcttcgtcgcagtatttgtagtaatcatcactgtgcgtccagaagtcagggtcggccatggtgcgtcgtcgtctcggcaccttttctggtttcacttggtcactcctcgcttcccgtttgtcttcagggtactttggctcgggatagccacttgaactctcgcctctccctcttcttgccaggccatccgagtggccctcattgtcattggcggtatccctccacctggaagtactgtgtggcatatcgtcatcatcatcagtatcaaaaaaaatttttggtttcacgcagtttggacttgccaggtttctgattttgggcctgaccacaggttcctctgcactctttgaggtgttttccccaccaccacaaatactcacaggagccctgctgggacgtgcaggtaaattttgctcccttctctccctctccgagctgtcaccttttgtagccagcttgccttcagaagacgactgtgaggccacactactttgtggcaggaagtcagctctgctagctgagcatcttgctgcagggactgggtctaacttgtctcgctcctctctcacatcacggctaaaactagagaaatgtggaggtggcccagccaaagaccttgcccctttctctgggtcatacagcttatcatctttaaacttgccagttttccctctcactggcggtcgctcaacaggcccagccccctcctcctcactatcatctgccccataagagtcaatatgtccataggccattcctcttctgctacccgaagctctgtactctcttggcggatacctggaatagtcctcattatcaatattcaggttggttcccgaactctcgctgtcgtcccaactacgacgagtagtggaaaatggcgatcggctcctcttggtggtttgactgggggctgatctgtgcattgggacttcggagttcgtctttctctggctggcaatcctttcccgctggctcgtgggtggcctgaaactgacataagcatgccttcttccatacctcctacctgtattggactgataccctcctgttggattgggccatacaggcttgctagattcctgacccatcactctgacttaggagggtttccaatacagctggggctcgggtaggagggctcctgctccctgcacacgtttttgagatgggaaagtaaaatcagtttagaataaaggagcagggagatttattttcacttcagcaggcaggtaacagaaagaataaggggcctttaaaattagtttcactttcttctaaggcctggagtagcattccagtgactgtcaggtgtagacctggaacacatttttaatgttggcaaaatgattacaagactgggtttgcaggaaagccaga

SEQ ID NO: 8255 - DNA, 6277 bp, artificial
  synthetic oligonucleotide
tctcctctcttagcatattaattttactttttatttttacttttttagtgattactctaaagcttgcaatatacatttacaactagtccaagttcacttttaaataacactataactcctcatgaatagggcaggcaccttataacataatatttccaattccttccttcaatctcttattacagaaatgtaataagcatttctgtcattcatttcattagtatatatactataatcatccaacatattgttactattatttttgaacaagctgttattagatcagttagtaacaagaaaaacaaaatattttattttatttatgctgtcacttatttctgttttaatgttcttcctttctttacgtagattcatatttctaaccagtattatttttcttctctctgaagaacctcttttaacatttcttgcaaggcagttcctagaagtgacatcataacatgtttgccacattctatttattaaaggtgagttactaagcctaacccacactcaatgggaggagattacccaagagcatgcatgggggcaggaggaggacatcatgaggcatcatgggggcaggaggaggttggagcatttcaacctgaataaatattcccaatctgttttccaaaatggttgtaacaattcacattttcacctgaagtttattcacatctctgcttttggtgagtatttcaccagatcctcagcactcttgatataggctttaaaattgttgccaattaaaattgttgccaatctgatgagtatggaacactggctttgcttttccctgaattactagagaagttaagcatccttttacagtttttgaccatatagatctcttctctgaaatgcttgttcatatcttttgtccatgtttctactggggttgtttttatggttattgatttctaggagttctttgtatattctgaataccagatgtcagctgtatttgtaccgttgcaaatatcttctcatagtcagaattttctttaaatgtaaatatgaaattttaaaagcacttaaaataaaccatgggagaatgttttttcataatcctagaatggagaagacctttgtaagttcaatgaactatagaagagaaaaaaaaagagaaagagaaaagtttcaactacatcaaaaaaaatattctggccagcaaaaaataaacaattctaagtaaagtaaaagacaaatgcagagccaggcacagtggctcgccttgacaacttgaagccaggagttcaagaccagcttaggcaacatagcaagaccccatttcaattaaatatttgctgctaattgcataaaggactaatttcccaaatacatgaagagctcctataaatcaataaaagaccaacaaaccaattttaacatgagcaaaggataccaatatacattttattagaaaggaaatacaaatggcatttcaacatttgagaagacgttcaagctcagtgataaaaataaaatgggatgtgatttcacccatcagactgagcaatgagagacagtttgataaacactgttgttgaaggtgtggagccacaggcaggcacccttcaacattgccggtggtagggtgaggttacttggtagttagagcctctgtagtcagcaagttggcaatagctatcaaattactaatgcacatactttttggcccagaaattctacttctaggaatttgcttacagatatacttgcacatgattgaagtgaaatatgtgctgttatattccttacatcacagtattgtttttaatagcaaaaaactagaacgaacctaaacgtttatcaagagggaaatgaatagttgtgatggtggaagacctactgtaacacagctaagatgcagaatctaatgctagttgtatcagaagggataaatctagaaatcaatattgaatgcaaaaagtgagttgtaagagggtatgtatattaccatagtatttatatatgttttaaaagcacatagagggcattgtaggttcaagattgttctatcttctcagagaattatttgatcactaataaatgacgtaatgacgtatctctaataagacttttggtataaaggtcaatcctgtcagcaattctactttccagtttgtttgtttgtttgtttgtttgtttgtttgttttgagatggagtctcgctctgtcgcccaggcaggagtgcagcagcatgatctcgactcactgcaacctccgcctcctgggttcaggcgattctcctgcctcagcctctcaagtagctgggaatacaggctcatgccaccatgccaggctaatttttgtatttttagtagagacacggttttgccatgttggccaggctggtcttgaactcctgacctcaagtgatctgcctgcctgggcctcccaaagtgctggaattacaggagtgagcaaccaggccggcctccagttttcttttgataagatttttttctggtatatttttactcatcttttaaaaatatttttaaggtaatatctttataattacacacaaatatttatgtaattttagacacagtcataaaagaaatcctacgtgcatgctttactaaaactatagtcttttctgagcttgggtggccggaggagtggtagcagccagccagcctagcttcgcgaaggctctccgcgcgccgcggcccacaggcacccggcacgcgccctccccgccgccaggattcccaagaggaaggtctgctccgctgaaggggccgccaaggaagagcccaagaggagatctgcgcgattgtcagctaaacctcctgcaaaagtggaagcaaagccgaaaaaggctttgcaaaggacaaatcttcagacaaaaaagtgcaaacaaaacggaaaaggggagcaaagggaagacaggccaaagtggctaaccaacaaactaaagaagatttacctgcagaaaacagggaaaggaaaactgaggagagtccagcctctgatgaagcaggagccaagactgattagcaccatatacaatgtcttatcagtggtccctgtctcccttcttgtacaatccagaggaacatttttatcaactattttgtaaatgcaagttttttagtagctctagaaacatttttaagaaggagggaatcacaccttatcccatttttaagtgtaaatgctttttttttaagagttgaaatcgtttgttggttgtttattttttggtacaaccagaaaatagtgtgggatattgaattatgggagtctttgaccgtctcgggtgccagcttaacattccatagatggtgggttagtttttatatcctataatacaaagcatattaaatggcaatatggagtcagtcctgcatttaatgtcttgaacattttaaattacttctagtcccatgtttttttgttttttttttttagtagaattgtttcctaaagaaaaccactccttgatcatggctctccctgtcagaattgtgtgcactctataacatctttggttccggtagtcctgttttcctgataactttgttactgtgctgtgaaagatttaaaatttgaatatgtggtgtacatgctattcagttgtgaattggtgggacgtatataacagcttatcaacatgtgaaggtactggtacttgatagcctcttaaggaaaatttgcttccaaattttaagcaggaaagtcagtggaataactttaaaaaagaattacaatacatggctttttagatttttgttacatatgttaagaattgtgtacaaatcaaaatgtctgtactgatcctcaaccaataaactctcaattatgaaagaaaaaaattatagccctttctatttttacttgcctcccaccttggcctatatcagtaccccctccacaacctatgtcaataaactagtatttattattccatatttttcttcatacctgtgtaatcacatacagacatatgcgtacacatatatgtatacttctgtgtgtatatacatacacacatatgcaatacatgcacaagtttttatttgtccttttttattaaaatgagattatatacatacttttccagttcatgttcttctcactcaataacactccctggaaatcaatcagtatggctctaattactaatcttcaatggtttcctagtgtttcagagtgtggatgtgtcacaatctactcagctattactatgatttttagggtttaaaaaagctgtaagtaattatgcaatacacatctgttatggtttgaatgtctcctccaaaactcatgttgaactttaattgccaatgtaatggaattgggagatggggcctttaagaggtgattaggtcatgagggctccaccctcttgaatgaattaatgtcattattgtggcagtgagttagttacagagggaatgggttcctaataaaatgataagtttggcctcttcttactctgtgttctgcatgctcacttccaccttttgccttccaccatgggattaccctcaccagatgccagtgccatgctcttggacttcccaacctccagaaccatgagccaaataaacttctgttctttacaaattacccagtctgtggtattctgatacagcagcagaaaatgaactaagacatctttgtccatataggtccttaagtaccggggcttccattcttatgggatgatgtctcagaagtaggattgctgggtcaaatgatgtgcatcttttttattttaataaatggtgccagactgctttccccaaaggctggagccttctcacttcctcgacaatgtgtggcccagcagcctggctaacttgacttattcttggcagagattcctctccaaggaatttgaaattcaaaaggagacacacagagattgagaagactggagctgagtcatattcatatcaatcaattctgaaaacaagcccaatatcttgaaaatacagtcttagtttttgcccaagttagccagagttgaattctgttgcttgcaaccaaaagacactaataaaccgtagttatggactgagacctcaacctggtcacaaatccagccatgatcccaactacgaattcaactctaatccacaccgtagacttaatcctcacccaggttggaaactgagggccattcctggccccagacttcactgaactcctgccaagaacccctcttcaaggggtgttcctggctgtcagtggatacatttcagtggaaacatttctgccaaacatatccataacctgggaccaaaagttaaggcttctttgtgacaaccaatgcccatgacttctggagacaggggggaatttcttctgaagaaaattttgtaaaatctaagagatgttttggggacatctgggttgcaggaaataaaaggccaaaagagaacatggttctggggtgaaggtttagtttgtggaggcagataatagggatatgagggagccaagtgtctggagctgaatggggctgggttgaatcgcctgctggagcctacatgggtctctatgagagagagatcccatgctcccaaggcaagctcagaggagttgtcatcaagaggtccaggcagcctgtagcccagagtcctcctcctttgtctctctcaacattctggcactgcctcaactagcccaatgggcccccatgaggctcaggccccttttcccactgtcctgacttcccacaggccccaaagccacctgccacctcctccttcccttcaatttacttcccatcatcttttccccaggtgtgtcttctcactgcatgcctcctgctgaatttcagggattaggactgtctaccatgggacacagctcccttctcttctccccagagccaggaggctcttgccaaatctggtcccagcctcgctccaaggatctctgaagggaattaggcagaacttgctgggtgtgtggctggagagacaagccaagagtgtggggaggcgactaccatttgtcaaacacctattgttatataccaggtagggagttagcacttagctcccctatttaatctccacagcaagccaatgagatagcaatttttatggtcagatagggaagctgaggcccagggatgttcaaagatttgtccaaggctactcagccagaggtggcagagctgggatttggactcaggactgttgattccaaaggcagctccttctaggactaaagcaagaggaatgtagtggcctcagttcctccctgaaagggaggccctaccaggtagagagttccctggtggagg

SEQ ID NO: 8256 - DNA, 2664 bp, artificial
  synthetic oligonucleotide
gagggtagctgagcacctgggctagggtctagcctcaggggactaagggacagtgatagagggggccagggtaggaagcaagggcagagttcctatacttgtccagggagattaatgagatagagcaaaaactggggcaactcggagggtagaagttggggagatcctaggggacaggagttgaatttatttaacaattatttgtttatttactacacctcagatgctattctgaatattttacatatattaactcaaccctcaaaacaacccaatgaagtagatacaattatgatgcccattttatagatgggaaaaactgagacttgcgaatctattatgtggcccagcctgggctgtctggttctggtgtctgtgctattaactgctgtattctactgcattgcctctctttgacagggttgaccaaatgtggcaggccagatagaaactaggaggaggttcccaatgcctttgaggcctttctttcctatcaggccctaggggcaccaggaggcccagaggctggggcagggaagaggggtcctgtcgggaacttcaggaacaggtgcctgttttctccttggatcctgtttcctgacacttgcttgaggaaccaagaggggagggaaagcaaaggcacatgtggtcagctgggcagagcaggctcctttctgccaagtgctgccttagggaatatgatttctgctgcctgagaagtatagagggatgccagagagggggcaggacttctggtgggcacatggtgttaactctttcatctctgatatgtatgcaaaaagcttagcacagggcctggcacagagaagtaaggcactcactaaatgtgcaacaaacagcaaaatccactgggggtagggccagagcaacagctgcagcatgaaggatcctggttggcttctgggaatcattccagggagaccagaaatctccccttgagggcttgaagcatagagagacccctgccaccccaaggagtttggaagcacctgaggccagtgcctgggtggaatctgctgggagttgcaagtgtgccgctctgatggaagttgaggggtagatacagaactggtctggccaggctaggctgggccccttcctagtttggtgcaagctgaagagcccaggctggcaggatctcaagacttcgtgcctgctcgctaggaagtatgtggctgaaaagcactcttgctactcccgggcgctgggctgaaggagctgactcaatgctctgtgcctctcttcttacagggcatccagtcctgaatgtgcccccagagcaggcctctctgctctctggctcttggctgcccagttccctgggcacctgaggtctcctgtcaagggctttgggtctcaggcagggacgggccagcctgcctcctgccctggccttctttccagctgcctgcctactgtccctatgtcctcaggctgggccagtttccattcccccaccttatctcagactgaggtgaggtgggacatgacctggtgggacatcatttctgaccagtagcccttccctggaatatttctgatgctcctgccaactccctccccaatttggtttaggatagggatgccctctcccaggatgcagcacaactacaatgggttggagggcctctcattctctcctgagagcccacattgagagaatgcaggcagaaaaggaccttaattcttcggggagacctctgaaggactgccaaagggcagagggagctggagtgacctggatgatcccaaggaccacaattaagacctgtgggtggaagccacagaaatagtgattttagtccacttccagaaaagacctcctgtcagtttgagctgttctgcaaggggatggctgagtcagggcctatcgatacccccgtccccagaggtttggaagtagaggctggatggacaaccatgacggatgctgtaatagggcctttgaaaggagggtgggactattctatccccatgtccttctctgtgttttttgttgcaattgctacagccccatgggatgttgtcctctggtcagctcccctcaacagaatacctatgcaagttcttgaagttaaagacaaacaaaaaggccaagagcaaattcaagacatggctttggggtggagggaaagagaggaggaaagagacaaggagaaaataaaagtgtggggtggggggcagcgcaagagcaatgacagagaaagggagatagataaatagaaaaagggccagagacatcaaaccagaggcagggacaaagttggagacggagaactgtttcctggacttcattctcctttgtctccagcccagtggcattgaggtttctgaggaacatagctgacccctaaccctatatgttgcttcaaaagtgaaggagtggcccccaagggcagctgtgccagttgcattggtcaaggccttggaacatgcctggcctgggccaccaggcttctcctcagttgtgcctttgagcaaagagaggctttcagtggggccccagaggcgcccaggtgggaaaagccaagagaaggctctgggggagatggtctctgacctcatacatctaaagagctgccactgggtagagagggcagactagggtctggtggccccagggtacagagctgtgatccacag

SEQ ID NO: 8257 - DNA, 1707 bp, artificial
  synthetic oligonucleotide
cagctgctgaccagcccctctgaataccaggaaaataggaccacccctcccccatgcctgctttctttctttagttcctaccccctgcttctagcctcttcctgcttcctacccccaaccctgcctgttcagccgtatgctacaggctgtgggcatttctcttcaagcctcagagtgagcaaaatgaggcaggtgacctctgtctccagttaaagtcccctccatatccagttcccttctggagccccttttgaacctgctctggccgaagcaagtgtagggaccaaggcaaaatttcaacttcacccttggaagtttcgctgaaaaatcaactcacagaaggcagattaatcagagaaaaggcatacaaatgtattaacatgtgcacagggagaatcacggagtgattacccacgcccgcagtggggggcagaagcttagataccatcttgaggttacacaaagaatggggacttggatcgtggcaaacaggttatgggaagggggagaagaggaattctgctgaggggcaataaatgattaccaatgagaatgactgaattggggaacacagattaacgtgtaaacagttctctttggaatttaaacgaccctgagagacacgttattctgtgaaaagaaaccaaacatttttggttttcttttctgcaatagataataagataacagggaaggaaaaaaaattgttccccttggagggtctgtccgtggggacaacgtaccccacgttgtagtggggggggaaacatccagtgcctgttgatgtctagagaactttaattcaaaatactccttataccagggagccatattttggggtgaaattccttgtgctccttcacaggcaatgaggagagagggaaccaacagtcggccccagaagtctggagtacccagcctacatcctcccgaagctcctggccttctctggtggagtctccctctgcgtaggagagggcaaaagggctccaagctccctctggcttggggagacagaggaggtggactgggcctagagcttcttttgtctgaaatctgcttaggcctccagaaatactggactgatggagagagtaggagagaggaggaggctcggtgggggaggaggaagcagaagatgctcagctctctgatgaagcgtcacctctaagcaggctccaacccagacttttccccaatccagcaggaggtagcagcgaaaaagagctgagagcaggcccagcaacatggatctgcagcatcaagggtagggccctgctggtcttcagcccctctagctctgctctgaaaaaaatcagaggccctgggacacctaggtgtgggtgtggggtatttaaggggaggccccccatcccaaaacagctctattcagtctgtcatttttattagagttccaaataagattttacctagagaaaatatgccaccaaaaaataaaatttaacaaaccctgatttaacccatccctacattttacaaagggagaaactaaggcctaaaaaggtaaattaaggtggtcctggcatccagcataaggcattgcacccacgaactcctcaatcaacacttgtaggaggagcaattgaatgccatgaaattttcagataaatttaaagcataactgaattcactttcaatgtatatatgaacacaccacaagacctgccaccttctcaagctctctaa

SEQ ID NO: 8258 - DNA, 745 bp, artificial
  synthetic oligonucleotide
taatccacagaatgggtgaaaatatttgccaatcatatatctaataagggtttagtgttcagaatgtataaaggactcttacaacccaagaataaaaagacaacccaaatttttttaaatgcacaagagaaatttggacaaataatttctccaaagaagatatgcaaatttccattagcacacgagaagatgctcaacatcatagtcattaaggaaatgcaaatcaaaaccacaatgaggtaccacatcacacccactaccacggctaggataaattttttttaactcagaaaataacaagtgtgtgtaaggatgtagagaaatgggaaccctcctgcattgctggtggaaatataaaaatgatacagccactgtggaaaataatctgtcatttcctcaaaatattaaacatagaatgacaacacggcccagcaatttcacttctaggtatatacccaagagaaatgaaagcacaagttcatgctaaaacttgtacatgaaggttcacagcagcattgttcataatactcaaaaggtggaaatgacccaaaaggccagcaactggttaatgaatagacaaaatgctgtatatccatacaatggaataccactcagcattaaaaaggaatgaagtactgatctaggctataacatggatgaaccttgaaaacactatgctaactgaaagaagccagatacaaaagggcacgtattttattattccatttatatgaagtgtccagaa

SEQ ID NO: 8259 - DNA, 1455 bp, artificial
  synthetic oligonucleotide
actatcaacatataaatctttatttatgtgccacttaaaattccctcaacaccagcaatatgagcaccatactttggggaaacactgggatagaaagaaaatatgactcccttagctgcttggaggggaacttgcgtggagaccacctttgttgggaagtggctttggtaaccctgctttgggctagaccctgagcctccagagcccagaagtgccctgattgaaggcttatttgttattctagagaggccaggagagaagcaagaggaaatgcagttgacaagatgctggaagagccttcatactgccaagtgaccccccccctttataacccccactcccccagtcaccagttagtcattctcctcaaggaaggcttgaggcaagtagtgaaggctgtgggcctctgggcagactgaagaaggcagaaccccaggcagcaaactgtctgcatgtacagaaatcctggggaagcctttggattatctcaaggttcaggccaagctcacccatatttgataagggcagggatccacagccacagtggctgcgtgaccctagacaattaacttcatcacacctcggtgttcccattttaaaaatggggaaataagagggctttcctttcagagtggttatgagaattaacagacaaaatgtgtgagtggacttctgtaaaggcccatctaaatattatcattttattataattactattcaacaaattcaataaacatgctttggctcctttggtgcacaaggcagcattccaggcacttaggcacgagggaggaaaagcgacgggtgtggaggggtacacagagatgagtacaatgcagtccctgctgtctacaagcggaagcagacagacaaacaatttgggttgaaccatatgaaattgccaacattcatccatttttggcccacaaaccagtactacttttgacatcaggcaaagtgaaataaacccaaaatagaaaccaaggagggaatgattttctctagctggaaaaaggagggaaggtttcccttgaggaagtgagatttgactgaatcctgaaggatgggttggactccaataggctggaaaccagtgagaaaacccttgcagcctaggaggaagggagagcatagacaaaggcatggaggcggagtcgtgcagagcttgtttgggaaatggggatggaccgtgttgctaaaggcataaggtacctgggggaatgcactgcagaggagcccagagagccgagcgggacccattgttgggggtcttagctgctgaccttgtcttcccttgggacttggtggctgtccatcagcaaacaggggatgccatcattcctgcgtgcttatttgggcaagtgacccaaagtgggtcggcagcctttctatgttaccacaaaaggctgaaatggtagtcagccaaaagaaagaactttctggaagtgaactata

SEQ ID NO: 8260 - DNA, 2210 bp, artificial
  synthetic oligonucleotide
tgctccttctctgtcagagttcctgccatactccgttctctgtcgatggtccagactcctgtcctccctccctagactagagcccagctttctgactgagctgcctactgctagcctcctgcctaccaatcctgtggtcacacgctaacctcagccagctggcattcagtcctcagcatctggccccagccccattctctttgagaccttcccacccactctactgccttcacactgccagggtactgaccaaatggccagcctcagtttctcaaacatgctggacatttccctacttctctgcctcagcactccctctacaggagtgtccttctcatccaatgccctcttgtcaacgtgcatgttctggcttctttgtgaagctttccctaaccatccaccccctccaaagctcaaggtgatctcattttcccatgaatctccattgtgcagggcagatgccctttagagggctccttcatatcttctatcttctcaggtgtcatttgcatcctgctctgtgaccttgggcatgctcctactcctgttctgggcttcagtctccaatctgtacagatgcgtccagtgactcttgcaaccctgccaccctgtgatctggctcctttgggggtctgggagaacaagacaccgaagaggaagagctccaagtaggctggccccaagtggggctttcgactcttgacagcacatgctcagctcccattcctgaaaatcagcttctcagatattacatgctagttggcttgcttaataaagggataaataaatatctacttaacatgattactgtcagaggcctgagctccagagcctttccatcattggggttttattgccagagaagctaattagctctaattaggcaactcccaggtgcttaagacagggggattgggggagaggaggggatgggggagtggaaggcaggtggagaaggggaaggaaaggtgcttgtttccttattcacctctctcagctgctaacctcccatgactgggcttgggacacctcaggaacctcaagcttagtgacatctcaggtacctggttcttaactcctcacccatcttggatgaagggaggaagactcttgagaacctactatgtccaggtggtgcattaagtatgttctctgcatgacctcatttgatcttcacaataaccttccgaggtaggaagtattcattgcccatttcatagatgaggaaaaggagatgcacagaagttaagctctttgtctgggttcacaccaccaggaagcagaggagctggacctggatctgattccaaggccagggctgctgtctttggctactgctgcccctaacaggaagtttgtactgcttagagaggggcttttggatagtcagtggcttgcctttgctgtggtgcagcttttccaggatgggcccaactgggcacagccagagcttgcacagtacctgagttggtcatgtttagattcagggactcctcccccatgagtcaaagctctgggctggaaatcctggatgactcagactcctgccctcagggagctcatgttccagtggaggtctatggtcattggaatagcaagtcattgaagtacaaaacctatataaagaaatacatctgtattccatcatgacattactctgctcagacatttttcctaggttttgaggccctaaatcagcaaatttggatttccatgagactgcctggggtatgggaaggagtgtaaactgtggagcctcaatctgaatctaggttctgtcatttattaggtgtatgatcttggccatgtccctctttatctctgtctgccattactcccaccattctggacctagcatcccaactcttacctggaaacccagtttcttaactggcttccctgtctgcttcctgcttctctgtaatccagtcttcgcactgtagccagaatcagctggataaacatgagacagctcatgcgatagccctctctaagtccttcaaagtcctcaccatggcctgcaaagctgcataattgaacccctgtctatcctgtctacctccctggcctcctttcagtccacactctgtcaccaaactccaccatgttggtctcaatgttgtttgaaacaaactgacctcctttctacctcagggccttttttcttgctgttcctgccacttcaatgttctcaccccagccacatgtgc

SEQ ID NO: 8261 - DNA, 6242 bp, artificial
  synthetic oligonucleotide
tgttccctgggtggagggtgcctgtgacaataactctgtcttgacgcagaggtgagcagatcctcttgctcagagaaccatgacactgacaggaagaaaggagtgggaaggcaagcaaccctggcttccaaagagcctgccacggggagccagcacagggcccttgtcagaagtggaagaagagaagaagaacgtttattgcaccaggcaaaatgggaggcactttcacatagatgatgacattaaatccctaacacaagcctgtgaagcagggacgatcatacccacctcaccaataaggaacttgagggggtggcaaggtttacagagatgctctgctgtgcagtggctaagagcttgggctctggctcagaccaccagatttgaagcgtggctctacatctttgtagataggggatcttgaacaagtcacttaactcccagttttctcagctctgaattggagatgataatcataccgattaaataggttaaatgagataatatgtagaaacaacttggctggtgtatagcaagtgctcaaaggtcattgctactagtggctgaggttatggagtcgctgtatagcagggctacaatttgaacttgaggatggctctaaagccaacgctctttgcaatgttctgtaccctctagcttgccaactgctcaccagcactgccactcaagcctttcttttgagctaggctgaacagagcagtacttgcggcgctccctcctgctcagtggacttaatgaagctaggtgctagattgcagagcagagcactaaatgttgtaatggaggagacagcacagcgctataggagcccagctgatgatcggcacttctgggaggagaaggggagctgtcacagagactgctctgacagttatcattcaatacctactcttcccttctctctgagtaacaaagctcaaattttacctaccatggcaatgcctagctgaaagattatatttcctagcctctcttacaactagatgtgaccatgtgactacattctgagcaataaaatgtaaaagcaaatgtcacatgggacttctggagctgctgcctaaaaggaaattattgatagctaggatatgtgccctttcccttttctgttgccaaaatggtgatgtgatgactggagctccagcagccatcttgaaccctgacaagacctcgaaaatgaagctggtactaggatgttagagcagagagatggaggaggtgagatcttgatgactccacagtgccactgtgccatctctgaactgcctatctccaggcgtctggtatctgagactataaacccttgtgtgtctaagctagacttttttgggttcagtttcttgcactgagtgcaattcctaagtgattcagaaaactccacaggaaagaaataatttgcatgggctctaggaataagtaattccggacagaggaaacagccagttcaaggcacggatggaggtttgaaatgtgtgacacatgatagatttggcaggggtaaccaagaagtcagacatacagtagacaccttgtgtcccagccaaacaggactcctggctcatacaccgtgcactcactcactccacagtgtggtcccctggactcttctttaataactctggggaccagcagcttcagttgtaattgttcatgacctgtttgttttttccttacatcaaatcaaaagtaatgcaattttcaggtagccaggtgctatgatctccattttgcagatgaggaaaccgaggcttatggaggtttaccagcctgtcctaggttacacagctagtaatggcagagctggaatttaaatcctggttggcctgagtccattgccctctttctaccactggttctcaaactctagatgcatcagaatcatcaagaaggctcattaaagcacagattgctaggtcctaccccagagtttctgattcagtggatctgccatggaggagccaagagcttgcatttccaataaggtgcacagcaggggaggttggggagggagtgatgctgctcatgtgtagacctacttggaaaaccactggattagagcattagctggggactgggtctcctcatagcaggtgtgacagtgtggaggcactgtgacttagcaaagtggtgcttcgtctggagttcttgagtttatgacccttttcatctattgtcagccaggccaggatgggtggcacctgagccaagcccgggcttggcaggaatgctgagaattccaaactagcaagctgctggcaggttccagctaaaatgcagacaggcaccacccttagtccctaggttagatttctttggctccttggccctcagcctccagaagggttaatgctgacccactggaacagagagacagaatgaagaactttttgtaggccaggagccaatctgaatctcactgaaaacctccaaccagacctgagagattccataagcccccaagaggttgcttgaactggagactaccatgtaaatactttcctatacattcatgcaaaggttttaaaaagattgtcttaatagttgtgccctgttggcacgtcagtttcaggctctgaattcctagagagcagggaatggatttgcagggatgaggaattaaaactcacaatgacagagaaaacggtgatgacaattatagtgttagggttgatgttggtggccacagtgtaaggagaagaggagagggaagtggtggtggtggtggggaggtggaaatgaaggtgagggaggtagatggatgtgaggttgatgaagatgtaagtggtgagtgagggtgacgaaggtagtgaactgagttgtccatacccctctgaagacactttccctcttatctctgtatgtgtctgtttcgccttctagaacctcctctggggcagggcctgtgccttgctcacctttgtgtcctagcacctagcctggtgcactgcacatcgtcaatatcaacaagtgcttgctgacgaatggagtgtgaaatggcatggggcaggagagatggcaaggctggccagccatgatgacctggaagaagcggccacgttggaacactcccttgcgggagcagaggctccacagaatgatgtccatgcccctggagctcagagagagaactgtcccggtgaggtacaacaatggtgctccctgccagtggtggctgtggaatgagcacggggggctctagagactggcctgtctagtccagctgggctcagtgggccccagccaggcagcagcagcagcaactttggggatttgttgatttgtagagcctgcctgctggaggcaggctgtttttccataatcatcttttgtctggctgaacaatagaggtgagggggcagccaggcaggtgggacatagcttgacaagacccaggaagaggaggggaggctcccacactgcttctagccagctgccccactgcaggcctcccttcctagctcgggccctctgccgcggacccccaaaggctgctgagaatcatcaggcctgggataggctcagcctgggaccccgcccccaaccggggctggctttcatacctccccacacacctctttcgctcagaagcttcgaggcttttgataaatgttggcgcggttcagcgcccgaagaaggcaggccgctcctgggaggagcctgtcgacattcgacactgggagaaggatggccccacatgggagcagggtgggggtgggggctgcagcccaattccccacagaacaaaaagagatttctctctcccttgcaccagctgctgagtcccagccccggcttgatcatttttcaaactgcagtaaattaacattttctggagcaggaaaaccacactgagaggcctaaataccaaatttagggatggcctcaagcccctttgggcctgcttcccctccccccattcttgctggggactggggaggacagagccccaaaggaacagcttcttccatttcactcacacctttcctgggactggctgagggcccctcccccgttccctgcacacagccctgcctgtcacctcctctttgctgacattcccttctccacctctcccaccccatagaatgtagtgcaggcgtgtttattcccacttggcagaggcgagccggaggacctgggaaagagtgggggagaaagggtccagtgagagtgcagggaggggtcctgacgttgggcccctgaggcacaagttagaagtcctgatacccctggtttcccaaacctgaacttgatttatttccactgagttgtgaagcatacagtttagataggacaaggaagcccccaggctctctggatcatcttcctgtctctgcagggtgggagctcccctattccaagccttcaagggaagacattccgggaataaagtctgctgtgggtatctctgcttttgtatctccttgttgagatacagaagtgttcgtttattctgagcaaggcggttgccctttgctgtgtgcttagtatgtgtcaagtagcacgttgggtgctttccaggcatcatgtcattgaaacctcagagaatacttccagggaagggaaacagaggcagacactgaggctcagagaagtgaaatgactttcccaaggtcccacgtcagaggcaggactgctgtccaggtctattgggtgtcagagcagtgctctcttctcctgccactgtcccgtcacccttcccgctcctctgttcagtgggcccagctgcccatggcgaccttcccctgttccctctgtctcttctgactcaggactgcccacagaggcttgaaccagctgcactgtcctgtcaccagctggggcctcagctctagcagtggggagccaggatcttggcctcacaatggactgggggggggtggccacagctggaagcagctggaaggcaggccttgtagaaggaagtgcaatggcacacacacacacacagagatacacagagacacacacacacagacacacacacactggggttgggtgggtgctcagggaaaccattccctttgcctttccagagagcagaaggaaaaaaaggagtcaggctgtggcctgaacccttgtgtagctcaagccctggggcgcttggctctctcaacatcagagggctatgaagtccctcaaaatctggcacccatctaccttttggaacttatttcctgccccttctctttatactctctggttcaaccaaactcaacattcctcctctgtgccttccctcatgctgttcctgctgcctggatacctgccctcctcacttccccgtatgcaaattctatccatcagctagggcccaggtcaacagccacttcccgcaggaagccttcttggtcctcctcacctcgatacctccctcttctctgccccaacctgaaagaaattcttccctcctcggcacttcctctcttaaggcattagctactttctccctggaatttgaatcatctggatctgcctcttagactccttctagaccaggagttctccgagggaggagcttggtcagattcatctctgtattttctagcaccttgcttgagatttctctgaaatgtattgtctaccgcatacctcacacgggagggtggcatagtgtagtgggaaaaacaaggctttggagtcagaggcacctagggttaaatccctgccctgcttctttccagctggtgcccttgaaccagttaccttcccactgaggcttgattttcctcagctcttgtaagataaaaataataattgctggctgggcgcggtggctcacgcctgtaatccaagcactttgggaggctgaggcaggcagatcacaaagtcaagagatcaagaccatcctggccagcatagtgaaaccccatctctactaaaaatacaaaaattagctggtcgtggtggcgcgcgcctgtagtcccagctactcagaaggctgaggcaggagaatcacttgaacccgggaggcggaggttgcagtgagctgagatcacgccacagcactccagcctggtgacagagtaaggctccatctcaaaaaaaattgctactacccagggttatggtcaatattaaatgtggaactaaaaaataaagcacctcctaaaatatgtggcacatttttgtgttcaatagattatttgctcattacttctccctttaacagggtctgagaaatgaatgaataaatgaatgaatgaatgaggagatgaattaat

SEQ ID NO: 8262 - DNA, 1106 bp, artificial
  synthetic oligonucleotide
atatccccagcatgctcacagctgggaggcgcgagcctcggggcctggtctcagctcgccaccaccttgctgcatgtacctgggcaagtctttgcccctctctggaccgcagtttcctgattcatcccacaaggggctaagttcttttggaagctaagaggtgaaaggcaggcaatggcccttgggtgtgtaccctggggtagagctggagggtggagtgaggaccacagtggtcccatatattggtgtttgacttatctctgccccagacctcttccagcactgacattctacaattccaggcaccaagagctgcccagatcctcagagtcagggagcaactatgccagacagattccccaacatgctgacatcagggcccacacccaaccccagtccctcttccagtgcaactcacagacacagacagactcctctctgtcacaccagtggcccctagcattttaaagggggccatggggacagagggtgaatctgggagaagccatgctcaggcctcctgggattgacagtcaccactgaaaaatgaaaaaaatagaggacggactgggagagtcctcagatatctacctctccattgtcttcaggggcaaactgaagcccagggagaggatgggaaaggtcacacggccagggccagaggtcagagccggagctgggatcaggccccaggtctctggattctcaatctccctcccctccagaaaaggctgcacttgctaagaggactggagggtttctgacccacagctgcctccactcccagattccagcagcgctggatgttccctccctcactccctgtctcaacccgcaaaacctgggagcgagcccacagccctgggaagaggcagggccaaggcccactccaccctaacatcccgactcctccagggagaggccgcccgagccagggcagagggaaaggagagggaaagcagaagagaatggagaagggggaaggaggaggggagagaagagaagggagaagagaggaggacaaggggagaggagcaggaggggggagagagaagcggggagtgaaagctgaaagctgataaggaagaaaggaggggaaaggtccg

SEQ ID NO: 8263 - DNA, 4009 bp, artificial
  synthetic oligonucleotide
ccattagcttggctgaggacaaagagggctgctggcaataacccttacatttgcttgcactatgtccctgaatcctgccatagtttcccccagcctaccttaaaacagtcagggttggtgactttaaccccacatgacagaaaaaatgagatatagagagtaggccagtgatcgatgtttacaaagcacttctcattgaatcttcacaaggaccttggagttccagcctcttttgacagatgggaaaagggagacaggcatgtaaagtgagattttctgaggttacacagccagatcatgtcaaagctggaactgaaattcagatctttctatctctgctatttccatgataccgctcagcctctgtggaaggagtgggaggttgggaggtgaagcccaggacacaggtaggtcatttacactgaggaggtactgattaaatctcatggcataatggaaagaatgtggactttagaatccctacagactggaattagaatcccagagttgctgtgtgaccttgggcaagttgcttcttttctgagccccattttctcgtgtctaaagcagattgaaaatctctactttgtgcagttgtttcatggattcagtgaaatctcaggtgggcaagtgccccatttggtgtccagcacatagtcaatgcctatcagtgtgggaccttctttatatgttcattgagttatatctgactgaagcgaaaaggcagaggctgctggcactgtggccagtcttgctactcccatgcctgggtgaaattagggctggggctgggcctggataagagtcccagagactgtgctagacttgtcagcaccaagtctcagacctggccctgagaagccttctgggactaagtcggccgcaatgccattcctctgccagtccaactctttactgggaactcaggaaaaaaagggtggggggagtggatgagcagggtcgggatctaagcccacctcttctccctgtattctcatcctgccttccctctctccaggcctgcagagaaagcagtaccctgcctccagcagttctgcccctcccccacctgagggtttccctccccacaaccccagggctctgggctgtttaatggggtggagctgtctttaatctgctccataaatgttttctggatcctcattagaaaccataatgtcctattaatatgctgatgagatttcatttggggctaggtaaggaagagtagctgggaggatgtggggtgggggcgagggaatggaattccccatggggatcccaagggaacgaagcgtagctgagctcatggtgtctccccctagtccttgggaaactcaggaagactcagtcgcaggccccatcgttccctccacacagacccccaggggtctgagtcagctgctgtggggactggcagatagatgcgcacacgcccctccacaccccaccactgaatatcaccttggggcctcaccccagtgaccagtgttagtcaccaaagcctacactcattcttcatttgttcctaccactggcatctacactgaacatgttggggcctagcacccatttaggccctgggcatacggacttcagtaagacacaatatggcgcttttggacaatggaaagaagcaaggtatgtaatgtggccagcatgtagccggctcccagtaaattgtggctatgaagacaggtttctgtccttgtgttgctcctaatctgatgggtaagggaggcaaatgtgtaaacaattaaaatccagttgagatgatggaggagtttgagcataacaaagagggaggggctatgtgtgttcatgcggctgggtgtgtgggtgcaattccttagatatttacagatgcggcttctgtgccaggcctttctgtgtgctgtgccctcagccaggaatgcctggttctgctggctaacctcacatcatgtctgtccctgcgatctccaccataggcagagaagggttggcatatgcagatgaattggcatctctgtcttgtttccctgaatgagctgtgagctcgagctggtgcctcgaatggctttcactaatggtcatctgcatgctcctctccaagactccctgttcagcaagaaccctattccctcacttccttcaaactgccttggccactgctggctcctgactcctggctcagaccctctattcctggcttcttaaagtcattcatattgggagccctgattcagctagccctgacttcctaggcaggcagctgatccctttctgcagggctccctgcctaactcccctcccatggctacccctgggagcaccttggcctgagcctctcctattcccctcccctcttcccaggaaaactccccttcctggctatttggcctctgtcccagctggagcacatttgctgtggtacctcacagtttgcaggctgctctttcaacccagtattcgggtacttggtcagtcatctgggctctgaactcctcaggaccagtcagtcacctatccctgtctctgtgacaggtggaaaggacaagtggaacaggcagcgttcaggttctaacaccactacttatttgctgggtgaccttaggcaagttacttaagctctctatgctttgttttctataaaaggggaataataatatctatgtcacagagaccttgtgtggattcaaggagataatgtgaataaagcactcagcgcagtgcctgacgcacacgaagtgctcaccaaatgccagttatcattccccagccttctcagaggttcatacaggttattgccaagcccacactgtggctgcccagcctccaggtctttcccctgcccctagttcagcttattcctgttgcccaggttctgtctttggaatcaggccgacctgagttcacttctagttctaccacttaactcagtgagtatttctctgatcctcagtttgtttctctgtaaactgggactatgaattgcccccccccaccctcaccaggttgatgtgaggatcaaatgaaataaatggctggcatcacagtgcccatcacaatgtctgtcacatagtaggaatttttcttaccagatccatggagctcaggtatgaaaccagcttggcttgggcccaggggtggggtaggcacagagggaggagaataactaggaaaactgacatggatgacaagaacgccctagtaagggtagtcaggctcaccgaggcagtacctgaagggcatagtaagcttagacatgaggtaggcagtgggcactgacaagagtgctgagctgacttttgggtccagtagaagcagtaataactaagtcttgcagaatgcagtcccaggcagtaacaccctcatccctcggggtgggagtgggagtagtaaaaggaggggcctggggaatatgctcgtggtggtggtcaggcaaagggtgagagatacaaggaaaaaggcccgtactagagagaacccagcaagtggggatcaggtagaagcagagcatgggaggagagcctgggcccccactccaacaccccacatacctggtctgctgtcaggagcattgaactgcaggctggtggggcttaggtttgggggactaggctgcctggggttggtttcccatttactagccatgtgactttgggcatgccactggcctctctgtgcctcagtctcctcatctgtaaagtagcaatcatattctctaccccaaagggttgtgccttactatgtgtaaagcacttagaactggggttggcatataagttttgctattaatagtattactttagctattactttatgatcctgcctgcccctcccaggtctgtcttaggccctgggccaggaagggaggaccctcaggagagccagtccggctggggataaagtctgctgaggctgacagtggggaaaagctgagatgggtgcatccactctctgtcttcccatcagtacctgctcctctgaggtagtctcatctccaacggccctctgagctctgatc

SEQ ID NO: 8264 - DNA, 2323 bp, artificial
  synthetic oligonucleotide
tgctggagaagcccaagaaagcaggaatacagtatacttggagccagcgccagcatctggaggctgctcctgccacctacctgggaactgatgctccccagcatctcctgcacctctgcaaggccctagctgctggtgggcacagtgggtgggtgcggtggggggcagtgcgggaagcactgagcctttagagaatcctcttagtggaggaagctgctggggtctagactcctcctcactgggccctatgctcttgtgggtaggatatggctaagggccttcatctcaaactttccaggctggtctggaaaactggtttctctgcctgcctgctacgaagaaaatgctcggttggaagggagaagaactgggttatggttggtgcctgccgctgatgtgctgctccatggtttttccagccctgggcctcagttttctcatctgttaggtcagaatgactgtgcaccttgccacgtcagctgactggcttggaagagtgacctccaagagttcaggcaggtgggatggctgatgtggggaggctggagtggagggcacaggggtcaggggtggagagagactaagtctagagaggtgatgtcacttccacagaggggtctccactgatgcccctctcccacctggatctgaaatcccaccctatcacatgtattagttgtgtgaccttgggcaagtcactgaatccttctgtgcctcaatagagtggggattaggacaatcttacaaatcactcatgagatagtgtgtataaatgaggttacccttgtgaagcacctagcagtgcctagacagaactcaggtgagggagagggacagtgggagcactgtcacatggagaaaatgcctgcaggagccctcaggcacagctgccaccagccaccagccccagcctcccacccctgccctgctatgaataatgaactggtatcgatcccctactcgggaaattccctgtgacctgtgataaaaatacacccagcctgccagcctggagctccagacaggttttcaacagtcagggctgagcttatctgcacatcccccaccccactcccagccctaagaggggagctcagtagaacagggcattagagactgagaccaggtggtgcccaccatctccaccatcccatctccaggtagatgagattaaaaagcgggataatctgtggtgggagccttcctagccaggccccaggagggaggacctgggtttgaatcctgcctctatcgcttcctgccaagtgtctcagtttcatcagctgtaaaatgaagatagccattccttcctcatagagatagtcctagattcaaatgatttaaggtatgtataaatgcccagcacagtgcctggccaatgggaggcactcaataaatggcagttaggccttcccaatttttcctcctgctccctgtctttgctgtaaaactcaggactgttttgcaggggaatgaaacattgagtgacttattaaaaaataagaggcttattgatatataactcacaaaccataaaattcacccccttaaagtgcacaattgagtggtttttaagtatattcacagggttgtgcaaccatcatgattatctaattttaggacattttcatctaccctaaaagaaatctcttgcccattagcagtcactaccaattcccacctcctccatcccatgaccttgacaaccatggatctactttttatctctgtggatttaccttttctgaatattttatactagtggaatcacatcacatgtggcattttgtgtctggcttctttcaattagcttaatgttttccagtttcatccttgttgtgccaggtaatagtacttcattcttttttatggctaagaaatattccatcatacagataaactatattttgtgtatccattcatgggtcgacagatatttaggttgtttccactttttggttattgtgaataatactgctacgaaccttcatgtacaagttcttctgtagacatatgttttcatttatcttggagatatatacatatataacattttgaggaactgctaaaccattttctaaagcagctgcatcattttacatttccaccatcagtgtatgatggttccagtttctccacatccttgtcaacacacattattatctttttgattctagccaaccaagtggctatgaactgatatgtcattgtggttttgatgttgagcatcttttcatgtgtttttagtcagttgtgtatcttccttgagaaatatattttcagatactttgccaatttttaaattggattgccttttgtgtgt

SEQ ID NO: 8265 - DNA, 1365 bp, artificial
  synthetic oligonucleotide
aagccccttctatgcatgaggagaggggaggggtcattgcagtggggagaagagtgtggtgatgagtagcatgcatcaaatgcctattttgtccctggtgttacactaggcttttttttttttttttcgttatagccacattaacccggtctgatatacttaggtgtctcaatggtctcattccacttgacactttgaataaatattcttttccccattttacaggtaaggaagctgaatctcagagaagtgagttgcctaaaatcacatagccagtaaacagtggtgcaaggattcagttccaggtatgttaatgaatagagtcaagagtctttctctgacattcaggactctagccagctccccagggactccaattgaagactgagtctcagtcaggggctcatggtcccaaatatcctttagaagcagcaagtctggaacaggccacggcaggcccagcagctgcaggggtgtcacacactgctgtactgcctggcccagagcctcatttttctgtgtcccaggcctgaaaagctgggcctgttttcagggttggactaactttttccccacagagtatggatagtccacagtggagccaaatggaggctgctcccaccccttgaaagagaggagaaagggggaaggggtgcagaacagccttccagaagggatagctttgccgagtttcagcctaatatcctggagctattcctaggtagattgtggtcagtggaattatgcttttatcaggctgctgggagtttcaataaaatctttatggccgggaaagttctctttatggaaatcagattattgaagtgcctgccggaggaagggcatcaccagcctgcctttctccccactgcctccttcctcctcttcaggatggcttccccactcagtttcctccctcccctccccatgggcccccagctcccaggacaatttcagctccacaggttgaaacacagagagtgccttggcaagtaaatgagcactaagggaacttattgagggtgttggtgggactgcaaaattaatgttgcaaaatagctcttgccctgtccccccttcatctttcccattgagaagccctggttttgccatttctgggtcaagttatctccactcctggctcactatgttggcaattcctagattctaatccttgggacacaactgagccctcctctacccccaccatctcctgccctgtccatctgtctacagaaccttctggaaccttcctgcctggcatctcatggggctggggttgaggcctggtcctgaggcaaggttgctacagctctatggggactagcttgggagtgtcctgccctgtagctctttcttgggggt

SEQ ID NO: 8266 - DNA, 2068 bp, artificial
  synthetic oligonucleotide
tggtcactagaattgatgatgacatagcgtgaatgccctagcatagaccagcaggcaaaagatggcagagcttgggtcctagtcaggtagcagtgtgctcaccccgtgtggtaaaatcaggcagtgatcctataaagagaacaggtggcaggaatagaaaatcaaggccttctctctagttctaggacccagcttgggccccttcttcacatatctgttccctgctctagggtgggctaggcatggactgagaggggcaggacaatgccatatggagggaaagctgcctacccttaggtgggaccctgggccgaaagtcagtggagaggggagcttgcccagatacttcctccaactgcctctgagcactctgctccttcctgctctccttttccttttctcctcttggatcacctccctctgctttctatgtgtctgtttctaggtctcactagtcttttgaactctgtggcaaattctaggtagatctctgggcagttttcatgtatactgcccaaggaaggtctttcaacaaaagagctggagtctgggaaccaaggggaggatccaggctgggactagtccctgcttggtcacaaatttgctgtgtgacctcaggcaaatcacatcttctctgagtctctgtccccatcagcaaggtttggactaggtgacctctaaaggtccttccatctaaaaagttccacgatttcagtatgtgtgtgttgatgcatcccacggaatctctgtacatctttgtttttcttcaaactgtcagcctatttctctgtcttttttccctctctctttctccccccttcctttcttccctccctttctgcagttccctcttcctcttagactctgtcaagctccccgacctctttcttcctctgagatgttctgtgctgcctttcaccattgctccaatgctgttcttcagtaagcacttatttatcccagctctgggcacccctctgccacaggggtcccatatgcactcagggtaccaatctggccaacttagggcctgagaaagggggactgggcagccgtaataattaacgcctaggctgcctaccatggtcctctgctgccacctgtcgttagtccggagtgacactgctctgggggctgctgagcccacaggggccactaccgctgctctggccgacaggaatccattacatgcagtgtcctgccaggcctgatttaaagctcatcctgtaatccgtcttgcgccccctctgggcctgtctccggtttcctagcctgtgaaatggatggaagttgtcttcagctctggcagagagaggtgaggagtagaggctctagggacacctggctttgcagcctgcccctgtgcttgtcctggtgggtgacctggggtgaatccttccccatccccttctttgcagcctgcagtattgaaatggatgatgtgggaagacatggttgagagaaaaggggcaagatggattcctgtctttcacacaagcagtacaatgctgagaaactggaaatggacatacccactgcatctacaaacctttggccaggtcacaactccatcttagcagccaagcctttctattcattcacccattcacttattactcacccattcattccaccaagcagcctggggctgtgggaaaaagcactcagcgggaaatcagaagcccaaccttctcggctcagctcagccacggttctccaacctgggccaagcccgtatctttctctgagcctccattccctcctctgtaacatgaaggggttgggacagaccaggagaagtctaaattccctccctcattctgccattctaaagtgatgattctccaattgcaggtgccttgctaagcacactgggtgatgaacaattacagatccccactcagaggccagggaaaacctgcctcatagcccccagacaccctccactcacctcctagacctctggctggccttttcaaagcccaccaatgagcaggcccttgctaagttcctcctttcttcccccggggcactgttctggtgccaactgtcaggtcatatgacaagc

SEQ ID NO: 8267 - DNA, 513 bp, artificial
  synthetic oligonucleotide
agaacttcagatcctctctctgccagatggccaagaacttgacatatgctttcccagcactttctctgcttcaaatgacctacactaaaatcaacaaccaactgtagctgaaaaatttagtgccttcaacccatgtaccacctcatgaatggaaccctgcaagttctctaacatgcctcctcagtataggctccaagtcatttctttgaaaagtatacatattctttagcatcttcatgccactctttaaactcctttcttaggaggtgatttgctgccgtatgtcctctccaacatacccatccccaaacagcccacaaaaccccagagtttttggtacctggtagcatccaacataggctgtgtcctttgttctgtcacctgcctcaggctcctgtgtcccacaggctccaatgtctacttggctcttcctgtcaattccaccatattcctcagggaatatgaaaggtctctgctctccagaagcaaacctcttaaatttctgtgtctgtc

SEQ ID NO: 8268 - DNA, 1106 bp, artificial
  synthetic oligonucleotide
ggttggtaatgatgcctctctttcattcctgattttagtaatttgaaccttctctatttctatttcagtctaactaaaagattgtcaattttgttgatgttttcaaagaaaaaattttttatcacttttctctattgtttgctattccttatttcattcatttccattccaatccttattcttcccttccttctccttgctttaggtttaatttgctcttctttttgttagacaaatactgccaattttcttgccatgtcattctgggttagttactccatctctgagagctttagttcctcatttgcaaaatgctaggacctacctcttcataggttgttgagaggataaagtgagataatgctgaagtacttggtgcttagcctggcacagagtcagtgcttaacaaatggtagttcttattgcttgtttgtgccaggtcctgtacttggcgtttcatccatgtaatgctgcaattatgccccatgacgtcttgcaagagtggaatcaattataagactttaaaaatatcttttacttatggccaacccaaacacattcgaaatctagaaaatggggtaaaccatttctccactgttactagttgatagtctttagtccacagatctgcctcaaatgggtgcttggaaggctgtcattcctgggtacccctccttccttcttttattactcctttgcccccacccccacttctacccccagggtccttgcactattctgctaccacctcttgtggtcaaggatggtgagattgattggccctttatggccaagatcagtgggaagagctcctggctctggaaggacaggggaacccctcattcttcagatgaagcaccttccagaccagtaaaccactctattgcttctatccatttcccgtctgaaaaaaaaaaagtcaatacattgttacaatagatggcttcttcatgtgaggtaaacatggggaggaatgattggatgacttatgatatgaaaagacttctcaccaggagtaagaacagtgaagtgcaagcatcctaatggaaccttttgcgctcttgcaaagaagagtactgcaacatcccctcagtgagttgggagcg

SEQ ID NO: 8269 - DNA, 412 bp, artificial
  synthetic oligonucleotide
ctgtctatgaacaggaatgtgggctttcatcagacccaatctgctggcaccttgatcccacagttccagcctccagaactgtgggaaataaatttttgttgtttataagctacccagtatatggtgctttgttaaaacacccaaacagactaagacagatatttgtctttttattttttatttttaaatttgttgcattgtgctcagtaaatgtggtctgtttacaataaattttaaaaatatttatcaagattggcaatttacatgaacatttcatatgcacctgaaaataatatgtatttttaactgttgggtacaaagttttatatctatatacataaatgcatgcacactgtttatatcatcaagtctattaatattattagccaatacctctctattcttaattatt

SEQ ID NO: 8270 - DNA, 1717 bp, artificial
  synthetic oligonucleotide
tgcctgattccaaagttaatgctgttttaaaataccaaagtgctgatttatgaagagagtgggagctgattgaggcaactgcgagatcactggaccaggacccaagccacaggaggagaaccacagatcctccagcagacaggacagccacaaagctgaagtgctttggctttgtggagggcatatgccagagtattgccctccctccaacacagaggcagtagaggagcaggttgttggagaagcccccaagccagggaaacccaggttttccttgggcccaaagtcccaggtcacacatgggtcagtgtccaaggtgacttggactctagtgctctgcccagatttactgcctcaagacctctactcagcttccttctatacttagctctactgataacaggagatgagtctgaccgtgacttcacactgagttgtggaggatggagctccttccttacgccctggccctaactttcaccactttcaggaggcagttgcctccaatgtgatgaggcaggaagctacagagaggggctttctggccttgacaagcaatctgcaccagatccaggaccaggagccttttggccaaggccttgccctgcctgggaagcagactccagagaggatctgaagagcagtgctagaggggtcccatctacccattaccagatggaaaatctacctctatcttgacaggtatgtctcatgttcacccattaaaaagtactcagtgaagaaagaagctgcttcccttgaaaggagaaactcatagcactgaagagagaatctatggaagaagcagctctagttttcccccaactctgaccctttgaatttctcctttccccttagggccctaggtctccgtctgatctcaccatcatcacttccttggtaaaacagaacctgggggctcccaggttgaagcaacgaatatcttggggaggaggcatgcaggagagaagctctcattcccagtacccccacagtgaactccatggtagggcttggcctctttctttttgcccctgctgccacatactacatgccccagcgatgtgtcactctctttttaagactctggcctgagagaggcacaaagcctatccttggctttccctgggcacagtagagtgagcaggaagcaactgcacaaagaactttctgaagcagtctgggagaaggagagggacatgccagaaacccaaacagtccagctttcacagcacatgtctcagagccaaccacagccaagttttctctgagactcacacattctgtctgtactatattcaggctccaaagcagcagaaggctggctccttccctctccattcctgacctgtgctcacagggtaggcacctcttacctccaacctcagggggcaagtgtttgagggctgggttccctccctggccagtactacagaaacctgcgtcacagtcttcttggagtcctccccctcagctctggttccctctctgaagaatgcatttcttttccaggtgatccttaggactcagttgttgattgataccatttattaactgacagttcaagtgagtgccaaccccctacgttgaggggtttggctatgacctttataggccccacagtctgacaacactgtagccctatgagacctttaacatccaaatatcaagagttacccacacatgtacaacaagggtctgatttcatcagagttgg

SEQ ID NO: 8271 - DNA, 4772 bp, artificial
  synthetic oligonucleotide
cctcccaaatgcctgacagttttgtcccttgtctcatttcctgctactcccttccccacaaattctcaccatcaatatagccaaactgccacactcgtggcttcacaaacatacaaagctgctccctacccctgaaacttttcatctgcattccttttatttggaatgcccttctcaaccacccaccctaatcctgctactttagaaactagctccatttgtccctcttccagaaaccttttatgtacccaccccagtccacctctgagtagtgctaacgatgcccacccatttcatttgatccttggcatcccttcgtgttactcaggggaaaaccaagactcagaaaaggaaaagactctcaagggtacacagcatatcagcagttgagttatttatccaaggctctagttcatgaatcctcccactagccaatatacatgtcttgtttccttatatagactataatttcctttaaggaaggaatgccttggctctttcatctttccagggccttactggagtgttaagagaattctagagtcagactgagtttcttttttagctgctctggttactttaggcaacaaccacactaaacctcagcttctttgtatgtaaatgaagataacagtagtacctatctcataacactgttgtgaagattggatgacgaatgcatgcaaaatgtatagagcagtacctagcacatagtacgcgctcaattaaggctattttctttattgttattcttaacattaacaaatgcttgccggcaacggttgacaaaaaattacaatgtgagttactgggagtgaggaaggcaagcagaccacagggtcagtggagtccaaacaaggttagtggcgcgtcaggatgtttgtacgtccgaattcctagtgccatgtgactctgtgagggcccaagcacatggttccatccgggcggcgcagcttctctaactctcagtcagctattctcagcagcctgtagggggagccaaaaagctaggacgggggctggtgcttgggtggggggcgggcgggtggggggtggaggctgctggaaatattcctaagggcaaacaccgacaccccaccactactatcttagcccaccgccttgccccctccaggacgctctccaaactcagtcttcctcagcagctaagctgggagctgtccttcagcaccaagggccgccttgtcctcgggcaggacggtgagggcgaaggtggagttagggacactggactggtccgatccgcagccggctcgagcgtcttccagtcacggggacggcggaggcgacccagagaggcagcaagcagctacgagatgcctgctgctccttgcctccaagaatcaccctcagaagtcccctagccctcgggggagtgagggacggccatggagaggaaggcgggcgcccgggttagtgggggagggggagcgccgaggcctgggactcagcgtgtggcatgtgcacgcgggcagcgggcggatgaacggaggcgctgaagtgaatggagttgggggtggactggaaacatccccaaacagcaccggctgcggccggcgggggctggggcggggtggggtggggggagtcctgaggcgcaggcgcagtcggggcaccagtcccgctccctcctcctctccgtgcctctttctccgccctgctccccgccaaacacacttgcacaggggctctcaaggtgttctccgcacagcggaagatggcgacagactgagggtgcatggccagcgggagccacggggccgtgccgctgggctgcagccacagcggtgcgaacgagaggcggaagcgagaggcgcactaagtaaagcccggtgtctgcgtccggcgcctgtggcgctgccgggagccaggtggcccgcccgagccggaactccaggagcagcgggtgcggagccagagcggagcccgccagggactggccccggcgaacacccggagcgcgaacgaagcccgaagggcccggcaacggaccggccggccggcctaggagggcgcgagcgaggcagggagcggcgtggagcgggcagcgggcggacgggcgggagcggagcggcgcggggcgaggggagcggagcggagcgcggcggcggggcccgcacggcggcgctgaggggcgcagagctgcgccgaaccgagacggccggtttggagtgcgagccgggcggccgccggcgcggagtgaagtggcacggagccgagggcagctgaggggcccgacactatgaggagtgcggcgccgccgccgcagccgccaccgccccagtgccccgcaccgcccccagccgggacgccgggcagcgcctagcgggccgggcggcggcgcccgggctgagagcgacggagcgcgggagcggcgcggagacggcaccagagcgccccgcgactccggcctgagcggggcatcgcgccggccggcctgcctcaccatgcagcccccgaggtagagcctggacggcgccgaggagcgcagagcggcgcgcagcccgcccgccccagacggccgtctggcctcgcgcctgcctgttccctccagcccggacccccctgaaatatgttcaggggcgcttggatgtggcccgggaaagacgccgccgcgctgactatctgctgctgctgctgctgctgggctcccaggccgagcgacaaaccttgcgccgactccgagcgggcgcagcgatggcgactgtccctggcgtccctgctcttcttcaccgtgctgctcgctgaccatctgtggctgtgcgcgggggcccggccccgggccagggagctgagcagcgccatgcggcccccatggggggccggccgggagcggcagccggtgcctcctcgcgcggtgctgccgctgccgccgccgccgcccggcgagcccagcgcgcccccaggcacctgcggccccagatacagcaacctgaccaaagccgcccccgccgccggctctcggccggtctgcggcggcgtcccagagcccacggggctggacgcagcttgcaccaaattgcaatctttgcagagacttttcgaaccgactactccggccccccctctgcggccccctgactccctttcccgtgccccggccgagttcccctccgccaaaaaaaacttgctcaaaggccactttcggaacttcactctctccttttgcgacacctacacggtctgggacttgctgctgggcatggaccgccccgacagcctggactgtagcctggacaccctgatgggggacctgctggccgtggtggccagcccgggctccggggcctgggaggcgtgtagcaactgtatcgaggcgtaccagcggctggaccgacacgctcaggaaaaatatgacgagttcgacctcgtgctgcataaatacttacaggcggaagagtactcaatccggtcctgcacgaaaggctgtaaggtaaggactggcttccgcagccacagcagccgccctgggcagcggcagcggccgcagtgggaccgggagaaaaaaggaagtctccctttctacccaccccaccactcccaccgtgcccagtgcagcactaccagtgccaccctgggaccttccctagtgaagaggcctcagggattcaggtcaggtaaccacctggctaacttctattaattccgggtttgggcaccttaggcctggggcttcctggcgccctgctccctcatgagtggggaggggccgcagggccctgggctgacaatgaggtggcaggagggattgtgctccccccagcctccatcctcagccagccatgcccctctcctttcagaggctggaactgaacgtcctgggactggctggtgcagggggaaggccaaagatgggaggaagaatatttggcaaccaaaccctcaccctttggcttctgccagtgggtgagaggacgagcactcctggtggtggggcacaccacacacttgaccttatgtgacctgaggtgactggccagagccgaggcaggtcgagcccaggggctgcctgtcttctcccaaggaagtcacctgcaggctcttctcccctgacaaaggaaggagctgggaacagggaacagcgactggtgggaaggccactgaaggttagtgcattctcatacaaaactcccagtgccttcccagcaccccatggtgacagtggggggaacactggctttctagctgctggggataggtatccagaggagaggtgaggcagctgcagaccggcccgcctagggaagagctgagtgttaagaaacttcttgaccctcggcggggttgctctggacagttaggtgggtgagggctgcaaacatttgggacttgatggtactgccctgctcgcccagcctggccaggtgacctgcctttgggaggaaagagaacagcaaggtcaaagggtcagatgacaaggagaccaggaggggtggtggcctcacacatcctcgagctggggccaagagctggagagtgagacagttgctttctagcctagctcgtgtccctccaagactttggggaggggcagaaagtgccattttccatccagcatggcccttgtggacttctgcagggcttccatgcttttagcgggttccctagggattggggcagagggttgggaaggaaaagggtagttcctcgctcctgacttcactttctccttctcctttttcctgctctcgtaacctagcagtctccctcccgcctccctcagcctcagctgactcactgcctcactcaca

SEQ ID NO: 8272 - DNA, 1552 bp, artificial
  synthetic oligonucleotide
gtgggtctcctgtgaggcgaagaagaagaagttcaaggagtctgaggcccccaaaacccaccagcagcaattccaccactcctatttccaccactaccaccaacagtaccatcactaccacccccatcatgatcccccaggccgtgtcagcaacaagcccgccctgctgccggtctctgggggctcccgcctcagccctagcaggatccggctctgcgtccttgttctcatgctcctccataccgtggtgtccttctccagcaaccagggtggtgggggattggggctggagacactgcctgccctagaggagggcctgacacgggaagagtgacagtagggagggaggacagacctccaccacactgacatcagctccagctcccccaggttgggggggagggggctcctcccatgggaggtgtaggataaggtgggggcgggggaaatgggggaatgacacatcccccccaacctacccccaccccaaaagcagctccaacagaatggccagagggcctcagggagctgcaaaactcatccaggagaaaaaggcaggagcagcaagtgacccctcccaagctcccatctatggggcttagcaaaaaaagggaggaagtgggggctggatatgcccacccctgccaaaagccctgaccccagggaaggaggctgctcacccagccttggccctgcagggaatgttggggggcacagaggggagaagctctttcccccactccacattccttttgttgccaagatccttaattccctcctgcccatatccctacaggcgacggcagacagtgcaatggccctcctgccacttcagcacaccttgccccacctgggaccatcacacgtgaagcaccaggctgggagatgaggtgcacacagttgcagctaggtcggggccccagttaagctgtgccccaccaccctaggcaatgaggggcaggaaaggggtacagaatgaatggtgaaagagagtggagatacggaagggggagaggagaggagaaatgtggacagagggcttgaagacatggccgaataggctactgccacccggctttggggagatgggcgataagtgttgaggtaggctcgagaactgctccccaaatcagtgagaattgcattaggagccctctggggaaagagcacaggaactgagttgctgggcctcaaaacaaaaggctgcaggcacatggttagactgccgctgtctgaaggaccatatcttacagaaggtgcacatactcccaagggccactcttgccctggagatcttggccttggggccaaagacatttccatttccgatctccatggggaggagggacttaagcccaagtgggtcaggcctggcccaggtccttatactcccctatcttgtcctagcccaggcctccatgaaggagaacctggtggcattgccccagagctctccagagatgagcctcccctatccccaccctgtccccgtccccagcctaccaaagagtattcacacctttccatccctgactctatgggttactgtccc

SEQ ID NO: 8273 - DNA, 1209 bp, artificial
  synthetic oligonucleotide
acaggcccagacatctggggcgggggtggggtgggtctgggcaggaactccggcttcataggaaccctgagaaaatcaaactgaaatcctgcccagggaaatctgcagttgtccaacaagagcttcgctttaatacatgtggtaatttttttgttgtgcttattcagactgcagcagctgcagagggagaggcccgtgaagggggcaatgagactggagtggggtggcagggtggggaaaaggtaaaggccgcgttgccacggaagaccagagcctaatgaggggaaagcggtgaggtgcaggcacttgggccttgggagaggaaatcccggggaatgcaggactgagtctgaagacagacagcaaagagagggccagtgagagcctgactggggaggcgcatggtttggatgatggtggtgggggccgaggagggagggcgtgagaaagcaacccttttactgctgatggatattgtctcttaccataagtcagcatgtgaagtatttgtctattgcaaaactggagagataaaattctggaaggtcattcccaaggataggagaggggcacctgaatgaatcatcagagaaacccaggggaagtgggtggagttcgtaacctgaactaggaaaggcctgatgattcactgggctccaggcctgtcaatccactgtactctgccaatggtctgagaactgaaggtgtccctcaaacatgacactggaattcagtgagtgctgtaaagggggaggggagggagttttgaaacaggaagcgacagggagtctgctactgccctttgaagggggctgacctgagtcatagagctagaaaggacctcgagatcatctgacccaacctctttgttttatactcaaggaaccggcattcagagaagggaagaaatttgtccaaggtcacagagttagtgaactacgtagacaaacaggcttcagaaagaggccacataggttactagagagaatagtctcaggtgttagcccagatagggtctgcaaatacttggcaaacataatgccgcttctcactcctctgtccctggtggacattgcaccccaatttcagtgctgacgctactttgaagtccttcttaactgagtacactaggcattgacatggaaaatgaaagcaatttgtaatttcaggcctacaataacagctgtgtgtgtcacagaagggtagaac

SEQ ID NO: 8274 - DNA, 129 bp, artificial
  synthetic oligonucleotide
aacttctgaaattcttccactttacttcatggaattcctggtcagtcatcaccattcccctgtatccacaactgcttctttatacgttcccttcattttttgtgctttactgaaatcaaattctcctct

SEQ ID NO: 8275 - DNA, 379 bp, artificial; identical to SEQ ID NO: 6594
  synthetic oligonucleotide

SEQ ID NO: 8276 - DNA, 3924 bp, artificial
  synthetic oligonucleotide
ggtgagaccagtgtggcccctgagcatcaccatcaccaccaggagatggctgtcatttgtttccttttcattttagaggaagaaagggcagcctgtttaaactgtgtatgcaagaaagtcaacatggccagtgacaacacagacaaaacacagtgtaaaggctgttaaagttcaaactcctcattttactgccggagaaactaaggccctgaaaaagcacagtgacttgctcagagggacccagcaacctagtggcaggatgaagtctcctgactcctggtctagcattctttccaataatcccgggctgtgataattaaagtaaatcagcctggcagttttcctagcatctagaattcctggactggacaagcaggacttgagagcagctgttaaacaccttttttccccttagctctaggatgatgatattctttgtgaactttatatttcatgggtaggggttaaagagacgacacaaagatgtttttgaagcactgagaccattcacaaagtgtacagagaaaagttgtctgtggctaatatatttaaggcttatgacctctgtgctctctggactgacctgccagcagatgcttttggttttgtgttttatttctcttattttgtcttcttttctatttctatctatgtttttcttctcttccaccagcctaggtcttaggcctacacataagtgcccccggcattgctgagcctccatgatgacactcaagatgcctgctgcaagtcaataaaattgttaattattcattactcaataacacggaatgagagtgcgtagtgactatgaagcatacatggttcccctgctatggtcatttcgctttctataatctcagactagtaactcttgtcaattgtgactcttgatttaatcctttccatccttcatttcagggtctattgttctgccttttgccacttttttttttttatctgaacccgtttctgattggtgcagctgttgaagatgctgcagttgcagcagtgtacatctggaacatttggctgacttgttgaacttcccccagggagtactccaggagaaggatgggaggggtggagaggccagaacagttgcctgtaaataaagatgccagtagtgtctggccattctgtggaccacacttgtacaaatccacttcattctggccctcggtttccctgtctactcactgaagacatacgttctccaatcaaaactgctgcagtggaagaaatctattctggctgtggatgctctcatacagcattttttgcattgtacagggatcgatagatatttgttgaattaattaatatatcaagaaatcctaggagactgttttacccttcaagggacaacatcatttcagttccgcttggcatggggcggcttctctgttacttagattgagccttcagagtcactccaggagtgaggctgcttgagtcccacccattcccatagttcccaggctcctgggtctccttttcttcgggcgagccattgaattgcaaacacagcaggcatggtttcattccaaacccagagctgttttaattagtttaacgtctgttaaacgctttgaagattggaagcaacagataagtactggatgatgttattaacaactgcagttaattgcaaacatttctattaatgctagtttctgcctccttttctttgctctactttctttccaaggttcccaaattcttagcctccccctcctttcctccccgtactggcgctatagggttaaactggggcggagcccagggatgaacgacagcgccagtcaccaactggtacggggcaagcgggaagagctgggtggggcggccaggcagaggcgaaccctcacgcccccaggccccgccccgcggctggaggcccggctggaacggcacggggcggggcgccaaggcttggcggccccgtggttgggcgtcccggcagccgcttgagggatggggcggggtcggccgggacctcctccttcattccctcggcgggccgagcctcccctctctcccgcccctcctcctccctttcccacccctcggagtagagctgcacatgcggctgctccctgctccgtcccgcccagccactgtcgcgcaggaacgggtccctgcagcccccagccgatggcaggacagtagccgcctgtcagaggtcgtgaacggctgaggcagacgcagcggctcccgggcctcaagagagtgggtgtctccggaggccatgggctacccggaggtggagcgcagggaactcctgcctgcagcagcgccgcgggagcgagggagccagggctgcgggtgtggcggggcccctgcccgggcgggcgaagggaacagctgcctgctcttcctgggtttctttggcctctcgctggccctccacctgctgacgttgtgctgctacctagagttgcgctcggagttgcggcgggaacgtggagccgagtcccgccttggcggctcgggcacccctggcacctctggcaccctaagcagcctcggtggcctcgaccctgacagccccatcaccagtcaccttgggcagccgtcacctaagcagcagccattggaaccgggagaagccgcactccactctgactcccaggacgggcaccaggtgagtcacctagtaggggcggcggcggccccctcccctcgcgggtagggcgagggccctccgccacaggggcctgggagcactcagcaacctcgagccaatttagagggcaggaccagggagggaccaggcgagcaagggagaagttgcccagggcaggttgtcttcggtccctggcccagctaatccagactccctggggaccccttgacttggaaagtctcgcgcgcgcccgcggcccctggctgcgggctgcctcgagaaaagttggcgacgctcccgtcgaggaggtgcctgcgctgccccccggccgactaacggcttggcccttctgctcgtgatgaggttctctgcccgcggtgcttgttttttcgtgtctagagctgatgccagaaccagcaggctcccctttggagttggagctgtaaacagctgtaataactgttccacgcccgcccgttgaaacaacttttaaccgcattttcagcgcgggtccttgtgcgctgaccagaacgtgggcttgttcacacttacctgcaatttgagactgattgtcctcggcgttctagtgaggatcagcgcccctgaggaattctggtagaaatatgccgtcttgctagacaacttctgaacagcaattttaaaaatctatggaaataaaactcaccctttgcatgccggttctgattcttaagcggggtaggtgtgcggtgggaagggtgggtgggaagcgcttttactactgttagcttgagaacgggaatctgccaatggaataattactcaggactcgtcccccaagagcagttttgtttgtttttgcaatctttatggtgtttgtgccctaataagcaaactattagctttggtgtttgttttctattctattctttctagctttttattcaagtaaatttcgttcacttaacgtaaatactgtcttggttgccatatgtgaaacttaggagaagcatccaaggatcctttcgaggtggctaaagaataataataaaattgtacctcttagggaagagagcaagttgtacaaataagttccttgaggtgagggacccaagccttctatatttactgccacatccagagtcattgtcacaactctgtaaacattatttgtgccactttgacctcccatctaaagtggtacgcttgatagagacatcatattcatgataatagtgtaatgttaggactgatacttaaaaaaaaaaaaaaagatgtgcattgtaaagttgccctgagccttaaaatgtcttact

SEQ ID NO: 8277 - DNA, 651 bp, artificial
  synthetic oligonucleotide
ggtggctttgtagtaatatccgttgattttaattggcatttctcagaagactgatgaggttgtgctctttttcatgtttattatgcatttgcatatcttctgtgaaatgcctatacaagttttttgcccatttttctattagtctgtctttttcttatagatttgtaggaattctttatatactctgaatatgaactatttttgtattttttatgttgtaagccattcccaaatctgtgatttacctttctttatggtatcctttgatgaacagaagtttttaattttaatgtgtttaattttttagtattttcctttatggatagtgttttctgtgtcccatttaagaaatattttcttaccttgaaattgtagatattctcccatattatcttctagaagctttatgtttttgacatttacatttaggtctatactccacttgaaatcgatttttgtgtatgctaagatacagaaactaagcttcattttttaaaatatagatatccaactgatccagtaccattaattataaggactgtctttcccccagtcctctatagcatcacctttgtcataaatcaggtgcctgtatatatgcaagattgtttctgaactgtttattctattctgttggtctctttgtcatta

SEQ ID NO: 8278 - DNA, 1505 bp, artificial
  synthetic oligonucleotide
ccacatccctgccaacgcttgttgtgatcttttttattatagccatcttactgagcataaggtgatatctaattgttttgatttgcatttccctaaagactaatgatattgagcattttttcatatacatattggccgtttgtatatctttgaagaaatgtctatccaaatcctttgtccatttctaaattgcattatatgccttttaatttttgaattgcaagagttcttaatgtattctgcatactaaacccttattagagataaaatttgcaaatattttctcccattctatgtgttgtagttctttatttttattttatcctgaggcagggtctcactctgttgcccaggcgggagtgcggtggcatgatctcggctcactgcgacctccatctcctgggctaaagtgatccttccgcatcagccccctaagtagctgacattacaggcttgcaccaccatgcccggataatttttttattattttttttaatagagatggagtttccccatgttggccaggctggtcacgaactcctgacctcaagtgattcgcccacctcggcctcccagagtgctgggattacagacatgagctaccatgcccggcctccttattttttgaaccctctcctcttttggtttccatggcaataggctttcttatttttttttcctacttctctgactattccttcccaagttcttttagaaggttctttcctacgtatctcttaaatgttgttacagtcatgtgccacataatgatgtttctgtcaatgatgaagcacatgtacaatgagggtggtcccgtaagattataatggaggtgaacaatttttattgtctagtgacatctcatagctgttgtaacattgtagtacaatgcattaccttttctatgtttgcatatgtttagatatacaaatatttactattgtgttacaattatctatgactttatgaatattatgtacagtgttcagtatagtaacatgttacacaggtttgtagcctaggagcaataggctatacctgtgtagtaggctataccatccagatttgtgtaaatatactctatgatgttcacacaatgacaaaataaccaaatgacatatttctcagaatgtatccctgctgttaagtgacacatgacacactatttcctaggtctacactcttgccttcttttctcttgttagtttatatattctcccagtgtgatctcttttaaattcatggcttttaactgtcatctatgtaggaatgattttgaagccaagatctacagtatatacagttcagacctctttcctgtatcccatatctgctgagctccagtagtatttctattggaaatcttttgagtatagcataggcaacttgaaatcaatttatcctaaactgcatttatcaccttcctaccccaaacctgcttttcctcccctgttcatctcagtgagtactactaccattcatttacttatctaagccagaagtgg

SEQ ID NO: 8279 - DNA, 1204 bp, artificial
  synthetic oligonucleotide
tatatgtgaggatttatttctggtctttttgttttgttcacagacctgcttttgattcttggctttgttacttagtgggtgacaatctgtgggttacttaacctctctcatgataactcccatgatagaaagtaagcttcatgagggctgacatttttgtaccttttgtttactgttatattcctaattaatcaatatttgattacaaataataatatttgttgttgaatgagcaataacttcagaaggctgttgtaagaattaaatgaaataatatatgtaaaatgttcagtacacttcctggcacatagtgggtgagaaatgttagttatttaacttatttttctattaattgtagaactcctaagaataaattaaatggtaaatcttaaagtggtactgtttcaagtgggtctctcttcgaaatcagaggacagtttggtatgggtatggagttaccttgaattgagtggccctcaattggaggggcacacaagaacgcagcacaaccatcttcccctctcataagttgctgagactggctcccttgtttctggcaccccagagacaaaggctgggtgaacactgctgctgagatgccaaagaagaaaatgagggtttagggtgaagtggggtaaggagagcagatatttaggcatttggtaggcagctctttaggtctgaaaggaacaaaatatgtgtcactgtgatgtactaacaccaggcctggcaggagaattagggggtttggatttttgaggatctaccatgggccaagtgtcaaccattggacttagagatttacatatattctaatttgtcttcacaatttccctgcaaagtagatattatccccattttacagatgagaaacagcctctgagagattaaataacaggttataagtagcagaactgggatttaaaccaaaatttatcttgactccaaagcctgggacctgaaacaacatggattttatttaatttccttataaattctagcccttctggtaatcgtgagaacagctaataaaaattttgggctcatgtaatgttttcgtttgttgttttttttttcctgacacataactgctaagcatttacattatcaccatgtcctgttctgttgttttaactggcaaattggaggtaccaaacagtttttctgagaaatgtaaaattttctaaattatatgcctgtgcat

SEQ ID NO: 8280 - DNA, 376 bp, artificial
  synthetic oligonucleotide
gctaagtctctaatgattagtaaaacatcctgtggagaaagagtaggtgtgcattttgggcagaggaaacaatatgtgcaagggcacagagtattgaagaatttgatgtattcagggatcaaatataatttggcatggctaggatgaaggctgtggggcaagagaaagggatagagtaacagattcaactggaaaagttggcaggaagatgggtaataatgaagcattttaagcaggagagtgtacaaactatgtattggcagataattgacagtgatgggaatgaactggagagggctaagaggaaaagtagacagaagagttgagaggctggtttaatagctcaagtgaaaaacaagctagtgcagtggcagtg

SEQ ID NO: 8281 - DNA, 1413 bp, artificial
  synthetic oligonucleotide
atcaaatataatttggcatggctaggatgaaggctgtggggcaagagaaagggatagagtaacagattcaactggaaaagttggcaggaagatgggtaataatgaagcattttaagcaggagagtgtacaaactatgtattggcagataattgacagtgatgggaatgaactggagagggctaagaggaaaagtagacagaagagttgagaggctggtttaatagctcaagtgaaaaacaagctagtgcagtggcagtggggatacagagaagaacccaggtttaagaggaatgatagaggtactagatagaacacatctctaccccatggtgtacaggtttcccccataaataatgaatggtttgtatctattattcttttcttagtaaactgcatatatagagtgtacccccaatggaggtagggataagggtttaatggggaatcaggtcaaatacagagtatctcagaatatataaaaaccaaataaaatgaatctggctgggtggaaattgatgcagagattcttaggatttggtaaagtgagtaactgtatctgagtgagtatctttggatgactatatcatggcctttcttcctaagtttctgtcatatctctccttttcacttttagctccatgtttctttttcactgagaaaaaagaaagcagtaagtagtgaaacttcaaaagttcctactcccatacctattcacctaccagcatctgtgccacttttctctctctcctgtggctgtagatgaactttccatgtttttaatctaaagccaacctctccacctatgtactaaatttcatctcctctttcccaccaaaggacattgctccatcaattataccctacttttccttctctttccttcacactccatagccaaccccttagccattctatcaacttaacattctatgtatatccatgccatttctcatcctctccactgctaccaccctgatataaaccactatcaatctctgaactatattgtatcaatagcttcctaacttatctctctgcttttactcttgccccctattttattctaattacacaggatccagaatgaaccttttaaaacataagtcaaatcgtgtccctctttgctctcattggcttctcatcttactgaaaataaaatcaacagtccagtatgttctacgcaaagctacctctctgaccacattttctaccactccaccccttattcttagcagtcaaacaagtcaagcattttctagacttgggatctttgcactttctgatacctctgtctagaatgtttcctccccctttccacagatatgtaccatatggtttgtttcctcacttcttttgggtctctcttcaaatctcaagcatctttcctagactgccctttatagcaagcaaaa

SEQ ID NO: 8282 - DNA, 1478 bp, artificial
  synthetic oligonucleotide
ggagtagaattactggatcatatggcagctcttttaaccttatgaggaactgctagattgttattcaaggtgtctgcaccttgttcattatcatcagcagtttatgatggttctgtttcatcacaacctcaccaatacttattttctgtctgtaaataaagttttattggaacaccaccacattcattcatttacgtattatctatggctacttttgcagtacaactaaagagttgaatagttatgatacagactgtatgactcaaaaggcccaaaatatttactaattggcccttcacagaaaaagtttgctgctagaggtattgttataaagttgaagttagtcatgttatattttgaatgtcttggtgaagtatgctaattacaggaattagtctagtatattctttcgtatgactttccgaagtggcctcaacagaaacctatagtcacttaaaacaaagtatacttgtatggccagtatcttagctatgcaattatatctgttagacagaaattctatgattaaaaaagagaggcaattcattgtcataatttgtcatcaaaagcattataacaaattataaaaatactagaaaaggtaggtatagtatcaaaatgataaataccagtaaacatgatgctccagaacatgtaaaatatatattttggagtatcatagcatagcacggggaggggaaaattaagtttgcaagtcaagaatagtgtgggggagggagtttggagagaaaagacaagttgggtagactttggaggatacggcaggtgctaaatcttagaagaatctgcaatgctcactttgttcccagaagtagctacacccaagtcaacccctggcttgttttccactaacggagccaaatacaaactggggtggctacagatatggaaagctggtatcaagatcttatttttgataagtaaaaaggactatacatgaggagtgccatcaagatggggatggggtgactgggaggaggaagagaaaggtgagtcagtcatgcacaaaacttaattattttggctcctcagcagttttgtttgtcaccaagtgtgtgtagacaaataacattaaatgctcttaaaaaaaaaaaaaaaaaaaaaaaaaacattaagcagctactaaggagacttctactgagaggagaggaggggttaaggagccttgcccagaatttattttggtcttgtgtggccacacaaatgtgtgtcttagcaactgcattcaattatgaggcacattagtgctgctttgtgtggttatatagtggtacttgttttaaacagggccaatttcattatggaggagctttcctggaggatttgttcatcgaagtgtctcagtgatagagttctgcttcaaatatattgaaagaaattacaggcctaggatagggagcgggccaataaagcgtctggtacctggcttctctgttgtaaattaactggtaaaaaga

SEQ ID NO: 8283 - DNA, 2184 bp, artificial
  synthetic oligonucleotide
aaccacattattataattttgaaatacaaaaaaatttgagacacagagaggtaaagtgacatgtctcaggtacccaactataagtgacagacttgggctttgatcctaggaagcctggctccaaaatctatcttcttaatcaccataagagggataagatgtagaaaataagtgtgatattcaactgaaggtaaattagaaattaaagctgtaattcatgaaattataatgtatgctaatagacaaatactaattttatagaaattttattttctgtgcaacaattgtattttttttttcttttggagatggagtttcactctctcatccaggctggagtgcagtggtactgtcttggctcactgcaacctccgcctcctgggttcaagcaattttcctggctcaggctcctgagtagctgggattacaggcacgtgccaccacacctggctaatttttgtatttttagtagagacggggtttctccatgttggtcaggctggtctcaaattcctgacctcgtgatctgcctgccttggtctcccaaagtgctgggattccaggcgtgagccactgcacccggcaacaattgtattttaaaaatttttctttttatttcaacagttttggggggtacagctgcgttttggttacctggataagttctttagtggtgatttctgggattttggtgtatccattacctgagcagtgtgtagtgtaaccaatatttagccttttattcctcgtcccccttctaaccattcccccactgagtccccaaagtccattatatcattcttatgcctttgcctcctcatagcttagctcccacttataagtgagaacatatgatattaatatctggtttttcattcctgaattacttcacttagaataatggcctccagctccatccaagttgctgcaaaagacattattttgttcttttttatggatgagtggtgttccatggtgcatatataccacattttctttatccactggtttgtcacaaggcacttaggttgctcccatatttttgccattgtgaattgtgccactataaatatggatgtgcatgtgtctttttcatataatgacttgttttcctttgggtatatacccagtagtgggattgctgaatcaaatggtagttctacttttaaatctttaaagaatctccatactgttttctatagtggttatatgaatttacattcccactagcagtctaaaaaaatattccctttccaccacatccatgccaacatctatcgtttttgaccttttaattacagccatttttgcaggagtaaggtagtatttcattgtggttttaatttgcatttcccggataattagtgatattgagtatttctttcatatgtttgttggctgtttgtatatcttcttttgagaattgtctattcatgccctttgcccactttttgatgggattatttgttcttttcttgctgatttgcttgagttccttgtagactggatattagtcctttgtcagacacatagtttgcaaatgttttctcccactctgtgggtttcctgctctgctgattatttcttttgctgtgcagaagctttttagtttaattaggtcccatctatttagttttgtttttgttgcatttgcttttgtagtcttagtcatgaattctttgcctaagccaatgtctagaagagtttttccaatgttatcttctagagtttttatggtttcacatcttagatttaagtcttttatccatcttgagttgatttttgtgtaaggtgaaattttatagaaattttgttagcacaacttttcaggactacatctgtttcacaaagtaaaggcatacttgtagattgaaaagaaacaattaagatgtcagaaactctctgatataagttttattttgtagtttgcattctatcacaccatatcattactatcaattaagatttctttggctacaagtaacagaaaactcaactcaaagtggttctaatagtagggttttttttttttaattatctcccataacacaccagtcaaatggttctagagttgggaaattccaaggtagagtgatgttatcaaggacccaggtactttccgtctttctctctcacctcttgcatgttggcttttgcctttaagcttgtcccctaatggttgaa

SEQ ID NO: 8284 - DNA, 128 bp, artificial
  synthetic oligonucleotide
aatcattcctcaggataaattccctggagtaaaatttataggccaaataacatgtctattttaaataaaaacttatcaaatattgaaattattttccttctgtatgattctataaatcattaaaaaca

SEQ ID NO: 8285 - DNA, 1466 bp, artificial
  synthetic oligonucleotide
tggctatatttaaggataaatgataaacatcacagatggttgtttgcaaagatgtatgtgagtgcttggttacatgggcttcatccagtggtttgctgtaacttaattatttaactgataggatcagaaatggaatcacctgagacattatggtagcacctgcttctgaaaccattatcaaagtgatctttatgtcatctttcttcccagggtctagtgaagatgaccacctgcttgccttggctttaacttacttcagtgctcactagtcatgtttcttttatttctccacctagctttaatgattttttagaaataatttcattcattatatgtgggtgctatattaacatcaaaccacatttctcttttcataaatcccctaaaagcacatctttctaagcaaaacattttagtttgcaatgaccctgtgttatagtttgccattaccttattttctatatttgacagtattgtctaatgtattttgggcaggctttttgatcagcttttttactgacaataacaggcaagtatttccattagtcttccggctccttttatccctatattctttcttctttcttcctgtcttttcatcttgcttcttccccatgcattttttctatttatcttaaaaatatttttcttgtgtgatgtgccataaattgatgttgacaaaatggtttctatcaataaatgaattcttaaatttactgaaaattttaattgaattttttaaagccagaatgactccttgttcttcccaaagacaaaaagctgttcatgtccacacctgctaatctaagctgtggattcttagtcctttgaaacacacaaaacagtgctcagcaaaattttttattttttctaagtgccagaatactggctactgctgaggtaattggttagccacacgttgtatatgttattattatggcttttaaagctccaagtataggtagaaactaggaaaaaaatttgtataatcctcaaaatattaaacttccataaatagtatttgcataggtgccacatgagatttcctttgaaaatcaaaaaaaagaaatttatggaaaactaatactcgtgtaataacataagttaccactcaaaaggtaaatagtataataactgacagtgtatcttttagggatcatggaaacgcttgaaattgtgagtaggacagcatttgatatgaaataagcttgcagaaatgattcagtagctaactggatattggtgacatagaatgtttccgaaatgccagcctgtgataagatattctgagaccttgaatgcttaagtatgtttgtagagcagtttttctcaatctttattctttagaaccctagtgtaacaaaagatatgactagtttggcttgaggagagtagagggttccatagccaaagaagtttggggtataccacatactatgtttctcccttatatccttattacacat

SEQ ID NO: 8286 - DNA, 933 bp, artificial
  synthetic oligonucleotide
gattacattttatggacatgatatagtttatccattcacaggttgaaggacatttagattgtttccagtttttatgattatgaataaaactgttataaacatttatttatggggttttgtataaacataacatcatttctcttttttaaatatataggagtagcactactgggttgtatgaagaatgtgtatttaactttagaagaaaatgccaaactgttttgcaaaatgaccataccactagacccagcagggtggctcctgcctataatcccagcactttgggaggccaaggtgggaggatggcttgaggccaggagtctgagaccagcctgagcccatctctgtgaatatatattttttaaattagccaggcatgatggtacacacctgtagtcccagctacttagaaggctgaggcaggacaacttgagtccaggagttggaggctgcagtgaactatgatcataccactgtattccagcctaggcgacagagaccctgagtaaaaaaaatgaccataccattttgcatacccttgagcaatatatgagagttcctgttaccatctcttcgtactgttcatttttaaaattattatctcagacatcctaataagcatatagcaaaattccattgaaatttagatttctttaatgattaataaagttgaatatcttttataatgtagtaaagtgtcagtttaaacctgttacccattttttcttttttttgtttttttattatgacttttgagagtcctttatattttttgtatagaagttctttataagacatgtgatttgtaaatattttttctcagtctgtgagttgtcttattgctttcttaccagtgtctttcacacagcagaaattttgaagtccaatttatcaagtttgttctattatagattgtgcttttggtgtcatatc

SEQ ID NO: 8287 - DNA, 2788 bp, artificial
  synthetic oligonucleotide
ttgaaggtcccagctgataggtcatggatgatgatagtgatggcagtggttgcaataagaaaaatagattttatattcaacaacatgaaagagaaatcattttgaaaaataatagatgatttgctgattttacagagcctggtatgtacctgcctcctcttgaggggcatgaagtaccaatttcataaatacattaactctgggaatgatagaagaaaaggtgaaaaacattagctatgcaagacccctattttacccagaagaaaaaagaggactttgtttttttagtctaaaggtaatgaaccgattgataaatgaacaatacagctgtttctcaaagtttagttcaaggattgggtgcacccctagtgagcaagttgaaaagtcagattctagggttccacctcagactgactttaaatttgggaagggtaaggcctaggattctgcattttgacactcatgcctagtgattctgatgtacactgaagtttgagaaccactgacctatagggttctcattcttaggatccttttgacttgattcctgccaatagtgtattgaatccttagtgtactctccatgatggatctcaaaaactaggcccaattagagtcaaaaaaaaatcttggctttaaggaatggattggtgatagtccgctctctggtttaagtatgtcccctccaaaatgtaggtgttgccaatgtggtggtattaagaggtgaggcctttaagaggcaattaggccattatggctcctaccttgtgaatgggtttaaggtcattttaaaagtggctttacgctatttaataaatggtgctgggaaaactggctagccatatgtagaaactgaaattggatcccttccttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcaaaaccacaatgacataccatctcacaccagttagaatggcaatcattaaaaagtcaggaagcaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcaaagacttggaaccaacccaaatatccaacaatgatagactggattaagaaaatgtggcacatatacaccatggaatactatgcagccataaaaaaggatgagttcatgtcctttgtagggacatggatgaaattggaaatcatcattctcagtaaactattgcaagaacaaaaaaccaaacaccgcatattctcactcataggtgggaattgaacaatgagaacacatggacacaggaaggggaacatcacactctggggcctgttgtggggtggggggaggggggagggatagcattgggagatatacctaatggtagatgacgagttagtgggtgcagcacaccaacatggcacatgtatacatatgtaactaacctgcacattgtgcacatggaccctaaaacttaaagtataataataataaataaaaaaagaaaaaaaaagatatgaaagtctcttatcaccaggctcaaacaaataaagatcctcaataaagaaaaataaaaaaaaataaaaaataaaagtggctttacgcagtattcagctctctcgcccttctgccttccatcatgtgagtacacagtgttcctcccctctagaggatgcagcaacaagatgccatcttggaagcagagagtagcccccacttcataatcaaacctgttggcaccttgatcttggaatttctagctcccagaactgtgagaaaataaatttctcttctttataagataccgaatctctggtatttcattataacaacatgaacaaagacaatctaattattctttcaagagagtgagatttattagggcctattatgtgccaggcccagggctaggcactagctatacaaaaatggatgtgtgatcccttccctaaagaggcttatgagtaattttctatgaattatctagtaaaatcaaggacattagccatgaaatagaaaatgaattaaatttactctatgtcatggtaccaaaaaagtaccaaataattttgtgggtttagatatataaaaaatatgtttgtagaagtgtctggagagtcactagcaataatggatgtatccctcatgtctcactatgaacgaactgtttccagctgagatccctgtaatttgcaggtgctgtttaccatgtaattttaccctagga

SEQ ID NO: 8288 - DNA, 2168 bp, artificial
  synthetic oligonucleotide
cagcccaaaaaattctgtgacagatggcaccaaagatggtaaagtcccattttacaggcttgtccctgaatacaagagaaatagctattcctattttgggaacctttaagatctcactcggcccgtccccagctgcccccattgggtctgccttcagcaggaaggagagggaagtgttaacccaggccagatcctaaccatgcccagaacacaaagaggggggtctccactgtgggatctggcaggacacaagggatttgcagtttgttccattctataacaatgactacagtcactgaggacaggctattctgggcaagttcatgaaagccatggggtactgttctcaaaaggatctaattccagaagcaactttcattcatttccttactgttttttatttattcattatcattccctctcccctcttgccatagcaataaaaaataagatgcttcttgtatgcaaatttaggctctggagtcagacatctatctgggtttaaagccgaaattgcccacctacttcctagctttgcgaccttggataagtcacctaaactttctgggcctcagtttcctcatggataacatagggagattaatacttgtcttagagatatttcttcaggatgttaagaacattaaatgaaaatgcctccgggcgtgatggctcacacctgtaatcccagcactttgggggccaaggcgtgtggattatttaaggccaggagttcgagaccagcctgaacaaaaagatgaaaccccatctctactaaaaatacaaaaattagctgggcatggtggcacacgcctgtggacccagctacttgggaggctgaggcaggagaatcgcttgaaaccgcaaggcagaggttgcagtgagccgagatcgcgtcattgcgctccagcctgggcaacaagagcgaaactccatctcaaaaaaaaaaaaaaggaaaagaaaatacatatcaagtgtccagtaaataagtgcccaacaaatgttagctactattaatattatctaggagcccatgaacatgacattattggctctggcagcagccacttcttgattttgtctacagtgacttttggggccacttggcctcttcccacaggtcctgcaggggaagcagagactctcccagggctgtctgccccagctgttgctatcagagcttctactggagctcaccaaaagtgcccctctggggacagggtgacctgcatggaggaactcctcaggctcttcttttcaggacttttctacacaaacacataatagactcacatgttttgaaaaacaatattggtgtcattctattgaaattggcttttaaacttaacaatacattataaacactttcttgtgtccttaacagtcttcaatatgatgattttaaagcctgccttctagccaatgaatgtgccataatttatttattcaattttattgttggacgtttagattgctttcaatttctcaccactataaatatgccactgtaatatccttgcagctgaatctttgtctatatttctgattatttccttttgataagatttgtagacgtgatctaggtcaaaaaggaggggctcttaatgcgtactgggaaagactgcatgaatttacactcccaggctatgaggctgttatattcccacataattgccaacacggaaaattatcattgttgctaatttgtcagatgaaaaatgttgtattagtggatgtttcattgattactagtgagattgaatattcctctatgtgtttatttcattcatgcaggaataagtatttctctttttttgaatttcaactttattttagattcaggagacacatgtgtagatttgttatgtgggcatattgcatgacacttaggtttggagtacaaatgatcccatcacctaggcaatgagtatagtagtcaacaggtagtttttcagccctcgccccttccgcctccacctcccccatagtagtcccaggtgtctattgtatccatctttaggtccttgtttacccaaagtttagcacccacttataagtgagaacatacggtattttgttttccaggaacaaatatttcttattttgttgcctattcctgaacttcacttaattttctctgaataagtttgtctttttcttttttttgt

SEQ ID NO: 8289 - DNA, 1928 bp, artificial
  synthetic oligonucleotide
caaagacaaggtctctaactgccccagtctggcatacatagtcggaggctggcagatgcatagaagaggcctagacggggaaatcaagatggctccaactctgactgccacgaaaaatgtggtttctggagtcccgggtcaagaagcttccctctttctgagcgccagagaagagttccagaatgaacaggaagtgcaaagagagagccagccgagaggcaaccctaaaagaactatccatcagaggctcagatcacaactgctcttctatgcattggcttaaaaatcaaattccattctggacaaatttccttattgcacgcaagctgctctaatttcaagaatgtcaaatacgcagccaaatgcaattacattttaagcacagcactcacttgaaatatagcacaaatttctaaaccaattttaatcaaattacagagagggcagacatgctcagcaacctgaaattccacctgatccagagagcctttcctgattagttagaagagtggccagttcactggctctcccctgcctgttgtgttcactgtctgctctcaggtatgtctttatccttattcttgtacactgtgtagatgtgtttgttgattatgcatttctgccctggttacctgtttgcttggttaatcacatgtcctttatgcctgagcagtcttttggctatttccttctggtgcctctctgtgggcatgggcctggccttggaatcctcccatgcagggcttctgcccaggtgcttaataagggttctttgagaatgaaagctcaaaaagtcttaggccaaaccaggtggctgctgggacattatgtgacagcaagtctaagccctcccccagaatttaggcaataactcatttattatctgggcaatgggtctaagtgccttagtgtcactctggtctagaagactggcctacccctcacagccaagcatcaccagagatgcctgcatgtatattcctgccacaggtggctggaggaagagctgcctgtgtgctccctctaatgctcagcccactgaccaagacctgagggaatcatatccagggggcagctgacagaaaggagatcagaagttagctaatgaagaggtctgtgactggctttgggagttcttccattgggaaacccacattgttgatttctggattgccccaaaaggcttcaggaccgtcattcaggcacaaaagggctctgggctccatggactgcctgtagctcacacccacttcttggttctctctctctctctctctctcttcttccctctctccttctgcctccctctccctcttcttccctctctccttctgcctccctctccctcttttcttctcctctccctctctctgactctttccatctttgacagtgtgtgtttgtctcagtctttttctcctccatctccatctctctgttctctctgtctctgtctctttctctttctcttccactcccactcctctctctgtctctgtctctgtgtctccactctcactcttgctctctcccccttctctctcctctctcttactctcactgtctcatcactacacactccatatgtccatatacagaaacacccatttttccctttaacaagcccacaaattaaaaaaggtaatttcacttagaaactaagagaaaggaagtagcccagagcacagatgtcagcctcagtcaggatgttaaaccaaccccccttaactctttttctgttgtgtgatgaggtctcagggctccagcccccacaggaactgtcgtcctgccagaatttaactcactggaacccaagagtgactcactgggatggacagtcatgagttggatgacaacttgctgggatctctagcatcagattgaggaatgagggtggactagatggagcagataaatgacttttaaag

SEQ ID NO: 8290 - DNA, 2096 bp, artificial
  synthetic oligonucleotide
attcgtaacattatagtaaatgtccacttgttaggtaaaaggaacagaagagcctaaacatttttataatagccttttcagaacagtggttcttgacttttttttttttttttttttttttttttgagatggagtctcactctgttgccaggctggaatgcagtggcacgatctcggctcactgcaacctctcactccctggttcaagcgattttcctgcctcagcctcctgagtagctggaattacaggcgcctgccaccacatccagctaatttttgtatttttagtagagatggggtttcaccatgttggccagggtggtcttgatctcctgacctcatgatgcacccacctcagcctcccaaagtcctgggattacagggctgagccactgtgcccggccggttcttgacttttcatgggtcatggaccccttgcccctttgacaatttgataaaatctataaaaatttctcagccaaaaaaaaaaagaagaaagaaaaagaaagcatacaggtagagttctgtataaaatttgtgggagttcaaggaccacccccaccacactgaactctctgtggacttcagcttaagaccccctgatttgggtgaagacctactgaggaacatctgattctggagagtctaaagtgggatttcaagcagagatatttcaagatacgtctcttggaaatcttgatgtttttccttgacttctctctttccttcaggctcttacatccaataaatcaacaaatcctatctattttatattttaaatatacccacatcccactatctccatcactaccttcctatttcaggtcaccatctctcacttggattgtggcagtatcctcttagttgctttccctgcttatatccttgcctcatagcccccacagcccatactccacacaacagccagagtggcccatatttttaaaagtgtttttatgtcactctattcatgtcatgtattcaaaagcctccagtggctttcccattcaaaataccatgatatttgatatttggttattgtgacctaccaggttctacacattatggccctggctatgtctgacctcattttctatcactcttttttatctcagccatactggccaccttgttatttctcagccatgtcaggccaggcacgctcccacctcacagccctcgtatttgcttttattccttagcatactcttctagatattggcttagttattttcctgaagtctttgttcactgtcatctcttcagagagttctcttctgactaccttgtatataatagcaccgctacttttccaccatcactgtatgcatttgaccttactttttgctctttcatagcacttatcacgacctaactcatctatttctttttgtctactcccactggaatgaatgcttcatgagaccaaggacttttatatgctgctgtgtctccagcactgagaatggtgcctgtcacacaataggtactcagtagacatttgtcagatgacatactagaatgcatcctgaaaaagaaaggcagccagggtggttatgagtcttcagatgataaaaggatgagccagaagagctgcgaaagttttgcccagaagaaaaaaagagttgatcattttttaggctgtttcacaaggcattcctgcatcagtggcaggtaaatgacccctaagattctatgatttttttgaaggtgtagttcccaaaatggaagcatcacaggaagcactgtgttgcgatactaagcacccaccctagtaaaggccagtataatcaaatgactaaggtactcatcttccctaaaggacttgctgagatccggttacttctgtatttttctggcttcagaaggtactcctcagcccctgctgggccctaacttgtcatctgagggaactgcctggtggctaattctggggtatagaatctatatccctgccaaggtggaaattggtatgcttactaccctatcatttgcaaaggtaaaatcttattgaggccttcttttgaaggaatacctcttcatttgtaagttcatgggtaatgcttttctgtggaacagatacaagcagaagaagg

SEQ ID NO: 8291 - DNA, 2067 bp, artificial
  synthetic oligonucleotide
catagccacctgtctctgttgggcacgctacagcaatagggtattgttgtcactgtctccttgcaaaacagctgtccccaaaacctgtgcatcatttcctcacagattccttttaacccactcatcaaaggtgcaagtcaacagggcacggttcgtttctgtccatcacaaggaggcgtgggttctagtcccagctctgtcactgtcttagcccctctgagatggcagccaatatctgccctacttacctcacaggccagggtggggagcaaatgaaatcatataggcaaaagcactttgaacagttataagacacgacacaagagtgacgagtaagagcagcaggctgttggtaagctggagggacggaggaggggatgctttttttttttaattttggtaatagagaaggggtctccctgtgttgcccaggctggtgtcaaactcctgggttcaagcgatcctcctgcctcagtctctcaagtagctgagattacaggtgtgaaccaccataccctgctgatttttgtattttttgtagagatggggtttcaccatgttgcccaggctggtctcgaactcttgggctcaagtgatcctcctgcttggcctcccaaagtgctgggattacaggcatgagccaccgtgcccggccttttttttttttttaaattcagcagttcacgacttaaacccttgctcctccgatgctttctcaatcagtcttctagatctcaccaccagccaagaggtttgtgacatgcttttcttcatgtgctgaaatgaccagcaaaaaaaaagaactatgcacagtgaaaactgggaaccagtttttacatatctgcctgccaggccacctttgacaaatgtatgtgaaaagatgatgggcaaagtcttagatttcagtgtcttgttccaactggcaacaaatccctcaaagagagtagaagtgagcaatgtcttaggctggcctagtccagtgtggtagcaggaataaaaattatggctactgtgtattaagcacctactatatactaggagctttacatacagtatttctaatcctcacaacacccaagggagatactattatagtctcagtctgtcgatgaggaaattgaggtttagagaagagatttcccaaagatcactaagctctaagtggttgagctgggcctggattccaggttggcctgaggacatatgaaggtaggaaatacatcctggtggtacactgctctggggataaccccttccctttctctgtccaagttttgagcaaaaattcctgctggccccttcagggacagtctgagacctgctcactaggggcaaaccccactcagaaatctacccctcctggggccctcgcatcactcaacccgcagtggaacatttctgcccccaatgccaagcccacctactttccctttccctgtccagccttacttagctggtctttgttcaagtaaatcttttatttttatttttattttttttagagacagaatcttgctctctttcttaggctggagtgcaatggtgcaatcacagctcactgtaaccgcgaactctgctctctttaacctgaatgccatcaactcatttttaaaaatagagacagccttactatgttgcgcaggctggagtgcagtggctattcacaggcacaatctttgcacactgcagccttgaactcctgggctcaagcgatcctcctgcttcagcctactggtagctaggataatagatacatgtccacacccagctattttttctatgttttactttgtagagatggggtcttgctatgttgcctaggcttcaggtaaaccttttaaatattttctcccagatgctcattcaggggttcctacatgttttctaagccagtcacagcatctcttcatctaccaggcctttcaggacaactaagaccagacccaggccatgcatgcatggggtttgggagacaggggctgggaggaagggtttctgcctgaactctgaggcgcttcaacactcaggaacagatacagcctctgctaccctggtgcccttggccct

SEQ ID NO: 8292 - DNA, 374 bp, artificial
  synthetic oligonucleotide
gggttggtcatgccaccttgggcgaagaagagatgtgtgggtattccaggtagagggaacaacatgggagagctttcagagactgtgaaatttggcctttatctcataagcaatagtacctgaaagtgacaaatgcaaagggaaatttcaaaagattaaatgggtagtgaagggaagagaaaccagggaccaagagaccagaatagaaatccagccctactccttgctactgcccaataggcagtcattgatgactcaagataacttatgtcctcaaagacttgccatggctaaccctaccactacctctctgaccccacttcctactcctttctctacttgttactcaccacactggcccacttgctgcccct

SEQ ID NO: 8293 - DNA, 1050 bp, artificial
  synthetic oligonucleotide
tttatacttttctgagtgctctgaaaattttatgatttacatggattattttcataatcagaaaaaaaaggaaataaatttccgttttggaaaaaagcaagaaagccattgtttccaacctggaggtgcaaacctctgaggagtggaggagtaacttaattattacaaggactccagaaacctctacctgacccgagcattgtttagaatgaataaataatatgcttacagcacacttttctttcaaatgcatataaatactgtcatgatgtatatacatagtggctttagtttgttacgtattatcatgtggagatccatggcattgtaaacgttaaagtactaaggcaatggttgggatctagtgctaaaaagaaaaatatatatacaggtcaactctcttagcttgaaggtcttctcaacaacttacttacttttttttccaagggaggcaggaggaaatagaggagaaaaactgagaattcacatattattaaaagttaacccaggaggcttgcttcctggagaagacaatttacaaggatgagagagtatgaagagggagttggtgtaggcccaggatattctattctggaaagacagagtgctaatctcccccatattatcaggggcgagtttccaacctcaaccacaggatgtcaacacatcgatagggcagtggtgccgtaagacctgagtgctaacatttgctctagagccaggctggtttccagtaaacaggaagacctggagtgggagggcaaagtaggcagaactttttcttttgccaaagtgcctcaaaggtgagcgtctgccttcctttctctcattctttcttctccccttttgtaatgtgttccttgtcttgtttctgtatggcctctcatcccccactcaagtccccgggacatatgcccccataggactctagtgatctcattacccgtaagaaatcatccaatcatagaccccaaactaagatcctcacttactgatccttctcttaacgccgaggccctagggctttcaggcattaggagcagatatact

SEQ ID NO: 8294 - DNA, 1206 bp, artificial
  synthetic oligonucleotide
ttaacatcatcagaatcaacctcctacccccactctgtcccagcagcaatagcctgctaatcttttagccactaatcttttaggcactaatctgctttccaaactcttggcacctgaactatttatagcagtgttttatgcccccccaccaagaaccctattcttttcccatgacccccaccaatcaaaacactcagaggactgtgggtataagaggctggggaggcaggcatagcaaccagagctggagactgatgtgaacttcatctctctccccaggtaatattccaaagccctctacttctagcccatactaagccctatatcccttgctcttagcatccctcttaatatatcaggcagcagttgagggacacccttcctgacatagcctatagacattcaggcctagagaccctccaaagacctctggaagctcccctaagctcaccccctgggccaggctcagtaagcatcaaaggaaagcactagagagacatctccctctctctaaggattcccatccaaaggcctagcccctggggacctggatggggataaggatgggaaaatctaggaaaggcaatgagagggatgagttggttcaaggaggactttcaacctccatagagacttctgtcaccaaaaactgagagcatgaaggcaccaaccccttctctctcacacttttctcccttctttgttgagagtcaagggcatcatgaggtgaactcaggttcaggatccattgcaggagcagaaggagacagaatccattgatttgtccattcattcattcattcattcattcattcatgtatccaacaaacatgtcttggcacctagtgtgtgccaggggatgtctagcctcatacagaccaagaaacacatttttctcacacttttctggatggaagcctctgtccagcctctttccagagaagttccttctctctcagggttctcaagagttccccagccattctaggaagtttggccctttctggagaatacatagtatggttagtcaatgatttgtacaaaataggaaggtttttttcccctcttgcccaagatgggcaagaatatggctgaagaagtacccttggcagaagggagaataggaggtacttgatgtgggtgaggtgtctgtctaaggaggaaaggttacatcacactaggtgtatatggatggtatgctggagt

SEQ ID NO: 8295 - DNA, 3155 bp, artificial
  synthetic oligonucleotide
ttccttcagactgcaaaattatcttggtaaatagcagataacagctttgacataaatatgatgatcatttaacagagaaagcttgctttgtgttccttgacaacatgtctgccacactaataaggaacagacttccctaaggtcattatttttttcaccttgaagtaaatttgcatttgtagttccttttaggtgccatgcttatagttttagaagctactactgtacaattaagtagcaagttataattatgcatcagttaacgacagggataccttctgagaagtgcattattaggcggttttgtcattgtatgaacatggtggagtgcatgtatacaaacctagatagtatagcctcctatacacctgagcctactgctcctaggctacaaacctgcaaagcatgttactgtactgaatactgtaggcggttgtaacatcatggaaaatatttgtgatctaagtatagaaaaggtgaggtaaaaatacagtatgaaaggtaaaaactgatacacccgtatagggcaattaccgtgaatggagcttgcaggactggaagttgctctgagtgagtcagtgatgagtggtgagtgaatgtaagggcctaaaacattattgtatactactgtagactttataaacactggatacttagcttacactaaatttattaaactttgtgtctttcttcaatcataaattaaccttcgcttattatacgttttttactttataaactttaattttttaaatctttttgacttttttgtaataatacttagcttaaaacacaaatacattgcacagcggaataaacattttcactctgcatctttattctgtaagcttttttctttttaaaaaaatatatttttttactttttaaactttttgttaaaaactaagacacaaacatacacattagcctaggcccacccagggccaggatcttcaatatcactgtcttccacctccacgtcttgtcctactggaaagtcttcagggacaataacatccatagagctgtcatctcctatgacaacaatactttcttctggaatacctcctgaaggacctgcctgaggctgttttacagttaactttatttatcataagtagaaggagtatactcttaaaaatgataaaaagtatggtatagtatactaaacacataaactagtaacaatcatttattattatgaagcgttacatactgtacatagttggatgtgctgtacttttatatgactagcagtgaagtaggtttctttaccccagcatcaacacaaacatgtaacatgttgcactgcaatattataatggctaagtcaataagcaacaggaatttttcaccatcgtgtatacattccacatgattgaaatgctattatatggcacacgactgtaacaattgaagttaaagtaagaataacctgtctattgtctaattgtttctttataaaatcttgctacagttgtttatcttcctctagcttcaatccaaactttgaatttacgggataaaacgaaaatgcccgctgggcatggtcgctcaagcctgtaatctcagcactttgggaggctgaggtgggcagatcatttgatgtcaggagttcgaaaccagcctggccaatatggcgaaactcgtctctaccaaaaaatacaaaaaaattagctgggcatagtggcgcgtgcctgtagtcctagctaccctggaggctcaggtgggaggatcgcttgggcctgggaggcgaagccgtgatagcacacactgtgctgcagcctgggtgacagagtgagaccttgtctcaaaaaaccggggagggggagtgctgagtaactagtaatctggattatctgacaagagaaaatataaaaactaatctacaaaataaacatttttaccagaactaagcccaaacagaaatatacttttttttgaaaccgaatctccctcagtggcccaggctgaagtgcagtggtgcgatctcggttcactgtaacctccgcctcctgggttcaagcaattctcctgcctcagcctcccgagtagctgggaccacaggcgcccaccatcacacccagctaatttttgtgtttttagtacagatagggttttgccatgttggccgggctggtttcaaactctgacctcaagcgatctgcccgcctcggcctcccaaagtgctcgattgcaggcgtgagccaccacgcctggccaataaactcaaacagaaatatattttatgggtctttctgcaaacagtactgataacataagtgataacgaaaaacacagcctctgttcaataatgccttctatttaataatttaaaaaatacaaacgggggaaaagaaaacacaaaaaatttaccatcctatggcttggtgtggtggctcacgcctgtaataccagcactttgggaggccaagatgggcggatcacaaggtcaggagatcaagaccatcctggctaacacggtgaaaccccgtctctactaaaaattcaaaaaattagctgggcgtggtggcacgcgtctgtaatcccagctactcgggagactgaggcaggagaatcgcttgaacccgggaggtggaggttgtagttagccgagatcgcgccactgcactccagcctgggcggcagagcgagactccatctcaaaaaaaaaaaaaaatttaccatcctatttctcagagataaacatcaaaataattaataatttatatacttttgatcttttcctatccatacactcatatttaacaattatttttaagctgcttttttcagttaactatattgtgaacatctttgaataaatgatgcttttttttttttttttttttgagacagggtctgctctgtcacctaggctggagtgcagtggcttgatcaaggctcactgtaacctctgcctcccaggctcaggtgattctcctgcctcagcctccaaagtagctgggattataggcacctgccaccatgccctgttaatttttgtatttttagtagagacagggtttcaccatgttgcccagtctaatgttaaactcctgagctaaagcaatctgcctgcctcggcttcccaaagtgctgggattacaggtatgagtcacggaacctggctcattaatggatgattctttatc

SEQ ID NO: 8296 - DNA, 564 bp, artificial
  synthetic oligonucleotide
gtgtgagtcctgctgactccaatctagaggaaacattaaatacccttcgctatgctgacagagcaagaaaaatcaagaacaaacctattgttaatattgatccccagacagctgaacttaatcatctaaagcaacaggtataagggacttaaagtttgatgggaaaaattacaagtatgtgagtggaatgatagagcttctgttttcagtttcttctttatcagaagtttagagatgttggttaggcattatgtttgttcggggacctcttaaaataactcctattaacgtgtttgctgtccatttaagattgggggtagcattggaaagttcactgatgaagaagtgagcagtgagagatgagatgagaggtgtagacaggggctaaattctgaagttccttatatgacttgttaaagaatttggaattcaacctgaaagctatgaagagccattgaagagttttaagtaggagggtgatatgataaaatgtgtgttttggcgagatcattctagcaggtatagagaaaatagattagaagtgggcatgactagaagaaggaa

SEQ ID NO: 8297 - DNA, 1182 bp, artificial
  synthetic oligonucleotide
ggtaaccagaaaaataaaataattttagatagtgatgagtgaaaaagaaaagaaaatatagtgaagtcatagagaatgtgggatgggaaaagagcactttagaagagtgcttggggccaggcgcagtggctcacgcctataatcccagcactttgggaggccgaggtgggcggatcacttgatgtcaggagttcaaaaccagcctggccaacacagcaaaaccccatctctactaaaaatataaaaattagccgggcgtgatggcgcacgcctgtaatcccaaccactcaggaggctgaggcacaagaattgcttaaacctggcagaggttgcagtgagctgagatctcgccactgcactccagcctgggagacagagcaagactccatctcaaaaaaaaaaaaaaaagagtgcttgggtaggccgggcacggtggctcatgcctgtaatcccaacactttgggaggctgaggtgggaggactgcttgaggtcaggagttaaagaccaggctgggcaacgtagcgagaccccatctcactaaaaacaaattttttttaaagaagagtgcttgtggagctctctctgagaaggaaatatctaagctgaggcctaaacagtgaagagcaagtcaggaaaagcatcagaagaacatttcaggaaaagggaacagaaaatgtaagacctcagggcaggaatgagcttagtatctcaaggaacagctaaaaaggccagtgtgactagaatgtatcaagcataagctacagtcaggggatgggtagtcaagggccagatcatggagggccttgtcagtcgtggtacagtttagattatatttctatacaaggatatctactgcaacatgatttataatagtgaacaatttctttcaaaacaatcttaatatttaacattaggggactggttaaataaatcgacattatccccatgaggaaatatatacaactattaaagtcaagttttttgattttcaaattttgtaaagtgatatatattattctgctaatcagaaaaaaaatgttattgtggtttctacagagcaactacagagcaaaggtgatggttctcatatgaaaaaaacttaaaggcttgaatttgactataagctcagtatgaatccacaaagatgtgacaggaaaaaaaaagcaactgattttaggcct

SEQ ID NO: 8298 - DNA, 1275 bp, artificial
  synthetic oligonucleotide
gcggcccaggcctctgcctctcccccgggctcctcagatacactaggagggagactgggatctgccctctgccagggtccctgatggtcgagtgtcccttcccccaggccttcaccatggccgagtcccccggctgctgctccgtctgggcccgctgcctccactgcctgtatagctgccactggaggaaatgccccagagagaggatgcaaaccagcaaggtggagtagggatggaggggggaggctggaagtcagaaggcagaggctcactggaggggataaggaggccaattgtgctcatagacagcttgggggaaggggctctctctcccaggaagaaaatctccctcaaatatggaaagagctgccccccgagcagagcagcccaacacggggcaggcagctccctttagctgccacccgttggggactctgagtttgaagtaggtattggttgtgagtttctctcctgcccctttgcagtgcgactgtatctggtttggcctgctcttcctcaccttcctcctttccctgagctggctgtacatcgggctcgtccttctcaatgacctgcacaacttcaatgagtgtgtcatggattccccctgcttccccagcatacctgtcaacctgctccccaccctgggacccgggggtggcccactgtcagtcatcccccagccctgcccagctgctcaaacccagctctgctgctacccaatctccttagaaaatccctccacaaaatctcctcaatccttggagcccctggccacgaggggctttctcctcactcccttctagtcttcctggatccacccaccccacctcccctcaggccactattgacaccccttcccccacttggacacctccctctcccctcccacagattcctcttccgccgctggggacactggatggactggtccctggcattcctgctggtcatctctctactggtcacatatgcatccttgctattggtgggtccggaggccgctggcctaaccccacctcagccttccttcctgcttagttttagctccctattctcatcctggccactgagggagggggctaattcttgggtaggagggaagtaccagcctgggaagcccacctcagtaaccttgctcccctcttggcaccccataagtcccactgctctcttcctctaggtcctggccctgctcctgcggctttgtagacagcccctgcatctgcacagcctccacaaggtacagtagggatgggagtgcatgggagaggg

SEQ ID NO: 8299 - DNA, 1485 bp, artificial
  synthetic oligonucleotide
gctgctcattggggttcggatgtagttgctcttcgttatttttagctgctgactcacagctcctggcatccgggtttggggctagcaggctgggctagggggctattaatagagcaggagcacagccccgacccagttcagtttggaaacacagagagcaagaagcgtcccctgccactatgccctgtggagatgtggactgagcagtggctgggccagatgctgtctggatgctagttacctcaccctggtatctctaccttggaactcttgagggaaaccccacgaggagactcctgggcacagctctcccctaagctcgccatggcttggggctctgccacaatcaagcttctgttgtactagccgagaaggcagagatgcgtcccaagtggaaagattgttttggtcatggccttggcctgcctggacccactcctgggccagaatgctaggttactagaaggaaaagctatggatttctggtcccccacagccttcataaggatggagtgcttcagcatggtcctaacacagggggcacagagctggggatccccaaaccagacacagagctcagaagctgccagattctgtgcttatcacacccccaaccccgccattctttttatttctttccattttgttgagctctgtcccaactcacagggatttacagacctcatgatctctcccttgtctggagagaaaccgtattcatgaaagccactgcttgtccccaatgaggtatgaatgatcctttatatattgtcattcccattgacctttttattttaatgggctaacgtaagagtttcctaatgtatacattgggaatcgtgaggaaatcttgatggactgatcaaaattattcccacgcaagctcaattttctagaattcccattgactaagggtgcacacccacaacaatgctcctcccctccttgcaaatcagaaacttccaccttcatcgacccgagtctccagcccccagatgaaaccacatttggggcaagagtgatcgtttcaccacgcacaatatggaggtcactcagtgaagctctattttcaagaatgagcccagcttatcagacagacagcagcagaccgcgcggtcccaaccccgtctacttgctgaaggagccggagtggcggtggaaggggagataaatggtctctctgcttgaaaatccgttcctgaagtcctccatcgcctggttgcctagcaaccagagctgcttgcagcggtgtggggcgcttttggtccgtagggggcgactgtctccctggggtctcaggctggagccctagcagttgggagggaggttccctagttaagtgtcacagtgtctcagtgtggctgacctcctcccagccttgtcaacccagtccggtctgagcggcagggagcctatggaatgaggagaagcccactatgagtctgaagggattttgctcacaatcattaaaaatgaagagagaga

SEQ ID NO: 8300 - DNA, 1609 bp, artificial
  synthetic oligonucleotide
aaaagatagtctttcttgtatgtcatccttcctccattcccccgacaagctgagccaggagagggtaaggagatgtccttggacaagtattcctaagctctattccagacccatagaagggtttctctctcttcaaatcccttcttaccttttcacctgtcctggactttcatcttgatatcctgaagttccttcccccatcataaccatgcaggggtggagtggaggagataggggtttgtgggccagggacaaggacttagagctttctgttaatccctgttctagggttgagttctttactggtgatggtagaaggtcaagtgtgaggtcacagtaatttcagggcctagagactgagagaacaatagtcttgtgtaggaggcattgacaggacagcgggcctcatatgctgccttcttctttggtcccctgtaagagaaagcacctccctcaccctgctccaacgtcctttctgtccatcctgctacctcgtctttacttctggtggccccagctcagagcaagcctggggacccattgaacatctccctgcaactccctcttggaagtggggtggggtggagtgggcagaggacaggctaaaactggcgatataagggcacaagatcgggtgcctgagctttctggtggcccacgtcctctgcccccgcccttagagccaacagttccctagagattgggggagctggggctgagcctgggggcgccgctgcctctgttcctttaagtagccgctgtttagcattcctgccgccgccgctgccgctgccgctgcctgcctctgcgcgctgattggctggaatcaactgagaagggagccagggagagatgctcttgactccactcagatccatcctggggaccagagcagaagcggtcctcacagcacccattctctgcttgagctcccgcttcttctttgccgctgggcctcggcccagaagccacgacgggcgacacggagccgccagtgctggagggggagccgtgggtgcggggcagcgtgggggccgaggccccgggacgcccgcccggccccaggccccgctcagcccgggcgcccccacgggtgccccccccttcttggtccgagcagtgtgagtgtgccagggagcccggcggcggcggcggcggtggtggcggcggtggcggcggcgtggaatccggcgtgggctggggggtccgagccgcggggggcagtgccatgcacaagcaccagcactgctgtaagtgccctgagtgctatgaggtgacccgcctggccgccctgcggcgcctcgagcctccgggctacggcgactggcaagtccccgacccttacgggccaggtgggggcaacggcgccagcgcgggttatgggggctacagctcgcagaccttgccctcgcaggcgggggccacccccacccctcgcaccaaggccaagctcatccccaccggccgggatgtggggccggtgcctcctaagccagtcccgggcaagagcacccccaaactcaacggcagcggccccagctggtggccagagtgcacctgtaccaaccgggactggtatgagcaggtatggaccagcggaggggggagc

SEQ ID NO: 8301 - DNA, 1946 bp, artificial
  synthetic oligonucleotide
gggcctccgtgtcacctactgtcacataaaggggataggacaagatgatgtctgctgtccttccagttcggacacagtgggagtctatgatcccccagtcagggagaactgtggttcagaaggggaagggttatctgtctaggccactgggtatcccctatggacactgggtgtggcatggtttgcctgccatgctccatctctgccatcccccttaggccaggcctgcacccctcctagtgaaccctgagacactgaagcacagcctctcggtgagtgcaccactggctggctcagtctcagacaattgatctgggctaaatgagcagcttggtttgggctgatatggttggaagcaaagcagggattggtggggtgagtgaggagcggcctcttccaggtcagcctgtcctcatctgtggccaagaggtgacctggggtgcacttgggctcttctactctgtgggagtaggggaggaggcaggttgactaaggggcagatggctggaagggcagggggcactaagggaactgcctgtgtctccccctaggtgaatggcagtgatggcatgttcaaatatgaggaaatcgtacttgagagggtgagtctgccagtggggaaaagcggaaagggaaggagagggttggagccaggataagggagacccctgaatcatggtttcaagacccatggggggacctgcatttagaggatggtgaaacagcggccctcagaggctgcttcactgcatcaatcaatcaacccactaacaaatattaattgaccttgctcactgaggcctggggaattggggaggggatgggtttcccaaaatgatcagcagaggctgggtgtctgacaaatgtgcccagcctgccatggccccttctgaggcctggagaactagctctgggatataaggggagatgaggtacccagaactctcctttgtgccctcagagtgaacagactgtgcctttccacccacttctgcagggcaactctggcctgggcttcagtatcgcaggtggcatcgacaatccccatgtccctgatgaccctggcatctttattaccaagattatccctggtggagcagctgccatggatgggaggctggggtgagatggcctggaagcagggttgtgggtggcagggacaggatcgagatgaggggaggaaagcctgcctggcaggatgacccttccattagatctgagggcggggtgggagggcagaggaggggaggacagagaagtgggaggaagcaggagagggggtggaggggtaggggcacagtgtcatgcctctcgggcttcccccacagggtgaatgactgtgtgctgcgggtgaatgaggtggacgtgtcggaggtggtacacagccgggcggtggaggcgctgaaggaggcaggccctgtggtgcgattggtggtgcggaggcgacagcctccacccgagaccatcatggaggtcaacctgctcaaagggcccaaaggtgcggccctccaggttcctgtgctccagccagagccttaggccccagatcccatcttgccccatagggaattggaagggaatggccttactccttgcctgactccccctgttccaactcacagcctacttttttgacctcaggcctcacccttactcatctcaggatggcagcttagcgtttggatcccccggggggagctcctgtggggccagtgggttggctgggggagggggtttggatttgggatcgacaacactttaacctctccttgtggccctctcccacctcctgctggctcccgctcaggcctgggtttcagcattgctgggggtattggcaaccagcacatcccaggagacaacagcatctacatcaccaagatcattgaggggggtgctgctcagaaggatggacgcctacagattggggaccggctgctggcggt

SEQ ID NO: 8302 - DNA, 1835 bp, artificial
  synthetic oligonucleotide
tgagactgggagcaagaaaggaagagtcttgcgtggggctttgggctcctccgaggaaagatgcttgtaacaagtgaaggcggtgggccgggaacgtgccctgggagttgggcggatgacactgtgaccttttacagagggcttccttagatgtggttagttttattcgcatttctcatgtgcttgtctgctctcttcagtttggattctaaactccttttggggacctgggatccccctaagaacccaggcgctgcaaccccctggggctacatagtgttagctgctgattaaatatgttgttggggcagcaggtaggaggggtcatagttgatgggtgagattttgagactgcagaagagtgtctgtgaagtaagtgtgcacatcctgtggatgatgagtgcagtcaaccccagggtgactccactgcccctaactgcttcctcttcttgtggtccagggtccatcacacgggttggtaggataggagaatctgggaaggaagaggaccagtgagtgggcctgagatttggtctctggagttcagggtagggatttgttcacccgagagagtaggggactgtccactgggaagttgactgcaagccctcgggaagaagggagggaagaggaactgaaacttggcacctgacagaacagcagccaagcaggtttcaggagacaaagggaggctcagggtatcatacatagggaaccacgtccttactccctacagcaagtatggaccttgttccaggctggccctcaaaggacaacagtccatatctacctagtcctgactcctccactcctttcccaccagagagcctcgcaagatcatcctgcacaaaggctccacaggcctgggcttcaacatcgtaggaggagaggatggagaaggcatttttgtctccttcatcctggcaggaggcccagctgacctgagtggggagctgcgcaggggagaccggatcttatcggtgaggagacaaaggagaggtgggaggatgggaactgtgccagtctaaaatggagagcgagagaccttacttcctccgaggaatgcttcttgagatgaagggagggctaaggactggagaaaacttctcttgtttttatagacatccttagtgacagggaccgggactagacttatctttgaagaggaaatgaatgcctattggatcttaaccctgattggcatttgacctttatgaagataattgttacactagagatgtcgtatcctttaggccttgttttaggggcaaggttggaatattgggaaaggcatctaaacaggcttaggggtggggtacccatctccctctcctaactgctaatgcagaggaccctctttcttgcttttggggtggctcacagcttctctctttggacaggtgaatggagtgaatctgaggaatgcaactcatgagcaggctgcagctgctctgaaacgggccggccagtcagtcaccattgtggcccagtacagacctgaaggtaggagaagggaaggtgggaagagatgatgtgggggagttagacttatattatgtgttggctttttgccatcctaggtaacaaagccacttgaccaggtcccttctacctagagcagtaacctcttcctctctccttttcctgctgggtaggggttggtttgggcggcttgaaagcatcaattaaggctgtgctcagagcctgctgatgtgggctgcagtgcaggagaaggccagtagtgggcagcagcctactggaagcagcatccaaagattagggcgactggaaaaaggggagggggcggagggcccacaggagaagactgggaactg

SEQ ID NO: 8303 - DNA, 6317 bp, artificial
  synthetic oligonucleotide
gagttccagggatgaccttgttctatacttgtatttaatttaatttaatttaatttaatttattgaatgagtaaagcaaagacccttgtgctccaaaggttgccaagaggctcaagagtacagttgtagaaatagcttttgaaagtccgttcgggctagcctggctgcattctttgcagccataggatggcattcaggtagtttgggagtcctggcctcctgactggccatctgccatctcagtcgtcttaggaaggaaatcatgttagagcatctgtagtcttgattcaagaaacaatgtcagacatattggcttgttcattaaagaaggctggagaatgctcattcctgtcaacaagcagacattaattgtgcaactactctgctttgcccagggtggtgcttggtggagcctgacttggtcttgcttgttaatgagtttcaatagtgtattaagatgccaatggggaaatattggcaggcttcactagctgatagaatttgggggtggggataatatgtattttaaaaagcaacaataatgtatgtaagtgttcagggctaccagagggtggggcagagcttcctgcatcagtgatttctagaactacctattcccaaacactagtcctgggcttgcactcataatccctcagctcatcctatcatctgcaagtgctgtgagccccaaacagtcgctcattgcgggctaattggtccttgaatgcctctccaacatcataattgccataaggcctgacactttgagacagacaaaggaggaaggtgctcttaacctgctctccatgcacctttcttcaagatacaccagggaggcccgatcactccttttgtgttgacccacactgtgcctgtctgagtgctcgggtttgtgctgttaggctgctcttcagaggctgctggaaatttaattcttactaaggtcaagggctgatgagtgactgttgctttataactttctgtgcatgctttatacagactgggcaagggatgggctgcttagttgtcaaataatgtgtgccctttatccagtactttctggccaaaggaataaagtgatatcttaggccccagttactatgggagggaacactctcagggttagaaactagggagtaactgggagggtcttctgtggacactccatcccctgtagctaggtctcacccaccattcacaaggattcagaatcccacatgaagcataagacatggtctcagttttcaaagggcttccactttggcggtgtaatatgaaacattaaaaaaaccttgcaagaattaaatagcaataagtagaaaatataaagaaaggttgctgccaaatgtggtagcaaatacagtatggatttagaagaatgaaatttggagtgggcaggatcacaaagctgggagagacttaggctgggcctcagaggagttgctgagctgggtgaggggactgacggagcatctcaggctatagacagatggctcgagccacaggtagagaggtgggcacaatactaggttattttagcagaagcaaccccttgcctttgaggctatagcgctaaaatgctcatttgctttgcatcgagaaacctgcttgaccagtttccttcttagttaccatttgctttgcgttccggttcattaagacatcacggtggctgtgccaagtgcttataatttctctggatctttccaacccaaatctcacaatttaggatctcaactgcaaggacttttgcctgataatctgtttactttgagctggttatattcttgcttttccatccagcagagaggacccagctgaaaggaagactggacaaagtcctctagagcacgtacattatccctgtgggtgggtgcatgcatcccttcgaggatatttttaaaggtcacctcttaaacaacattgtctttcaagacctttgggaacactttctccttagggagacaagcagcagccttgagagctagagtgctgaagatgagctcaagaactcaaacctgcacatcccctggaagttgcatctgctcttcatggtggtatgacagctctggaaagctgttttgtagcctaccatcactttgtttttacatgtcacattttccctgggctacactctttcccttgctcttaaagaatgtaatatttttctggcctggcgttgatgtttgaaaagttccaggaatacccaggctctggctctccctggcttcgtagagatatgtggccataactaagaagtaacatattcaggggcagatcatctttcttgtacatcaagcactgtgacttcaggctggggatggtaatatatttccatgaattttattctctcatggcacagtgttttcctctgatgtgaccagtccctaacttggaggcctcaatgaaattatttttatcttaagtacagaaggaatatgagtttttgagacttccttctactctcccaacacattatcttgtcagataagctgaaacacacacagatatgcatgcatgtgcgcatgtgcacacacacaagcacacacataatgagaccagggtggcagttggttaattgcggcctttctttaggtattaagagacaaataccttttgctttttttttttttttttttcatgctcactctaattttgagtcaggttgaaatggttggttgctatgtcatgtgggccttgcatgtgtaggacttccgtcctgggacagtggttcagcctgatttgaaaggggagtatctgccttgactttctctagtgcctgccctaaggataaaaggaggaagaggagaatatatcagtgttgtggaaaaaggtattccttcttcctctcatcaaacctaccatgagccatttatttgtgagaggtgccagtccctgtcacttcattaggattccagggtgttcctaagacagactgtcactgctagatggccacagtttagctgcttcttaaagatcttaggaaagcagtcaatatttttaaaaaaattattaaggtctaatttacatactttttttggttacacgaaatatatctcatgggagaagttgtttgactttagtacgctggcctactctcttttactggttttatttccacatgaaagtttagccggataatgggataagaaagctgaggtaatgaagttggtcccataaagcctactaaatgaatgtcaaactccttagctggacagtgcaggctgtccacagtcaggccccaacctgccattctctgaggcccagccagacttggatgcacggctgatccctgaaaataaccctgtgcttcttgcctccagacctttgcttacactgttctctttagctggaaggacctctccccagctctaccttttgaaatcctaaatcttcattgagaaccaattcaaaaagcagtatctccttgtagcttccccaaactagatgtgatctgtactccctgtgaatccttctaggccttggtttgtcctccttttgggcttcttgctacaacatccttagtatactacaccctctgtcacctagtaagctccacaagacaataaactttgttcttgtatctcccatgtatctaacacatactccgtataaagaagactaagtagtttttctttgagacagagttttgctcttgtcgcccaggctggagtgcaatggcgcgatctcggtttaccgcaacctctgcctcctgggttcaagcgattctcctgcctcagcctcccgagtagctgggattacaggcatgcaccaccatacccagctaatttgtattttttagtagagacagggtttctccatgttgatcaggctggtctcgaactcccaacctcaggtgatccgcccgcctcagcctcccaaagtgctaagattacaggtgtgaaccaccgcacccaaccagactaagtatttaaatagtggaagaatggtatttttccacatgtagctgagtgaagaattagcttttttttctttttctgagatggagtctcgctctgtcaccaggctggagtgcagtggtgtgatctcggctcactgcaccctctgcctcctgggttcaagcgattctcctgcctcagcctcccgagtaactgggactacaggcatgcaccaccacgcccagctaatttttgtatttgtaacagagatggggtttcaccatgttgaccaggatggtctccatctcctgaccttgtgatccgcccgcctcagtctcccaaagtgctgggattacagatgtgagccactgcacccggccgataattagctttttttgaaaaagcacatgtgactgtgacttaggccttatgaaattttctgagatagaagagccctggtctgagagtcacccagtgtgcagttctagatgaggctgtgtgcatatctgggcctggctttcattgtctttgaggaaattttctagcttagtcaaacaaaatttaagcaggaaaaagaggcaaagtagatttagagaaaatccacatcatgggtttggaaaacaaataaaagttatgacaaaggaagggattgttgagggaattgggaatgattagcctggtagagaagatctaggaaagactcagactcattaaatactagagctggaaagaaacttagagagtatctaagggatttcctttatcagatagaaagttggacaaaatgacctctgaggctttagcggtctgcaaaattctttttctatttgcagttctgattgatagaaaaggaaattcttgttcaatttttttgcattctcaactgtgaataatagtctagttcagaatctcaaacctcagatactacatttctatgtcttttacaaaaccatagcttaaaaaagcattgtccatcctgttcatatttcttgtccattcagtattcataaattcatcaaacaaaatccagatagacttgggtaccattttttattgggaaattagagttagacaacttccttttttgccttgtttgccagggaacttagaaccaaacgtgttcctcatctgaagtaaatgactcaaaccagtgcttgatatatctgcttccccactttttttttaattggcttaatgttttttgaaaattgtgaaaggaacacatgctgtggttaaaaacataagcccgaatagtacaattcccaatgtgcagagttaactactggcaaaatctttttgactttgatctgtgtttatattgtttttacttagcttgtgctgtatgtgttttaatttttttttgttgttttattttgttttgttttgttttcgagatggagtctcagtctgtcacccaggctggagtacaatggcacaatcttggctcattgcaacctctgccgcctgggctcaagcgattctcctgcctcagcctcccaagtggctgggattacaggcgcccaccaccccgcccagataatttttatatttttagtagagacggggttttgctatgttggccaggcaggtctcgaactcctgacctcaaatgatctgcccgcctcggcctcccaaagtgctgggattacaggcgtgagccaccccacccagccggaagtaaactgttacatcaattttagttgaagctcagatatttaaaaaattacaaacagttggattcccggcatctagaaaacatgtttacgtcaactctactttatacacttcagcttgttactgctgttgccaaaggtcaagcatggttctgggaagtgctaaaatgtatcttgtgttttaaacttacaaccagtaaactccgccctctaatcttctacaaattcatcctaactcccctaattcattttattttatttatttattatttattttttagacagagtctcgctctgtcacccaggctggagtgcagtggcgcaatctcggctcactgcaacctctgcctcccaggttgaagcaattctcctgcctcagcctcccgagtagctgaaattacaggtgcccgctaccatgcccggccaatttttgtatttttagcagagacggggttttgccatgttggccaggctggtctcgaactcctgacctcaagtgatctgcctgcctcagcctcccaaattgttaggattacagacgtgagccaccgcgcccggcctcctaaattcattttaacatcttccttccttctctcaccaaactaatttgtgcttaattcaagttctgttcttttccttactatatttgttctaatctttgaaacccataatgacatccagtgtttctcattgtcactgagaatgaggttgcttcatgatgctcttcttagtaggagtggctgac

SEQ ID NO: 8304 - DNA, 349 bp, artificial
  synthetic oligonucleotide
aggggggaactagaacccttatttcaaataaagttgtataaaagtctaatatacaagaaaagataaaagataaaagttgagctgctgtggttgaacgaggagtgggtggaggcttggagtttcaccttcctggaagtccctgatgcagtgccacaaaatttccacggttctaaggaatgcagcttaaaaaataacttatcttgtacagacacatcattttacagatgaagaaaagagtagacccaggtttcctgacccctctgtcaagcttctttaagcatataaaatttaaaagagaacttccggtttctagttatgcatgtaaggagcttggaagttgccagtttct

SEQ ID NO: 8305 - DNA, 1044 bp, artificial
  synthetic oligonucleotide
aaaactaaaaaacattgatgaaattgaagaaaacaaaaataaaatagatatcctgtgttcattgattgaaagaattagtattattaaaatgtccacactactcaaagtgatctacaaatgcaaggaaatccctatcttaagtccaatggcatttttcacagaaatagaaaagctaatattaaaatttgtatggaaccacaaaagactctgtgccaaagcaaccttaaaaacaaaaacaaaattggaggcatcacgctttctgatttcaaattatactacaaagctatagtaatcaaagcagtatggtactggcataaaaacagacacatagaccaatggaacagaatcgagagcccagaaaaaaaccccaaaaaaccaagtatatatagccaactagtatttgacaaaggtgcccaaaatacacaatggaaaaagcacagtctcttttgtgcttgggctgggtgcagtggctcactcctgtaatcccagcacttcagaaggccgaggttggtggatcgcttgaggccaggagtttgagaccagcctggccaatgtggcaaaaccccatctctactaaaaatacaaaaattagctggatgtggtggcacatgcctgtaattccagctatgcggggagggctgaggcacaagaatcacttgaacccaggagacacaggttgcagtgagccaagatcatgccaccacactctagcttgggtgttggagtgagactctgtctcaaaaaaaaatgtgtttggacaactggacatccacctgcaaaagaataaattgaacacatcctacagcacacacacaaatcaacagaaagtgcattaaaaacttaaatgtaatacttgaaactgtagaactcctaaaagaaaaaaatagggaagaagctctttgaaattggccttggtaaggatttttttgtatagaacaccaaaagcaaaggcaaaaaaaatttttaaagcaaaaacaaacaaatgggactatgtcaaactaaaaagcttctgcactgcaaagaaaacttcaataaaatgaaaag

SEQ ID NO: 8306 - DNA, 316 bp, artificial
  synthetic oligonucleotide
cataaagacaaaaataatagcaaaaattaatagacttaaaaacacatcttctgaggaaatattaaaagaaaacgttgaagtaacttagataggaagagaaagttctgaaaacttaatgcttcacatacttgaagaaaggcatatgataagcattagactactggggttctagtttttaattccatctgcaataaaatttggattaatccaacaaatgtttattaagtacctttatattccagtctcactgaaggagctcacagtattgtaactggtagatatcccaacatgcacaaaaatgcaaaatgtggaaaca

SEQ ID NO: 8307 - DNA, 563 bp, artificial
  synthetic oligonucleotide
tggaacctaccttttctgccttatttttccacttcatcccttcaaaatcctaggctccaggcaagatgaattataagctttcccatctttttgcctttgtacacaagattccatcctcctggatgctgtcactccaattcactaaattacacattttacctattctttaagctttagcttaaaagccttgacctctgtgaagccttcccagaactacttgcaagaactccgtcatgtgaattctcatgatacttcatgcatacctctcttaaggcatttattatttcctattttgtgtctttgtacttatttgattcaatgtgatctctctcttcttgtggagattaagattagaccatgcctaaagcaattttcaattccatcttcaagcatggtacccaactgtatgaatgtttccaaagtgtggtatgtgtgattattttacacagccaaacattttttaatagtgagatatttctttaaatgtatattagaaaaatattaaatacttttttttacttatgatcatggtaaaatgttttccttttaaaataagtatattt

SEQ ID NO: 8308 - DNA, 1990 bp, artificial
  synthetic oligonucleotide
actcaaatactaagatatataaatggaataacaactacctaaccttcaggctgtaattaaagtgttgtccaatttaagactctacaacttgaggacatgtgagggccttggagagatttcagaataataaaaagataaaagggttaaaaatgagccaagtaaggaaaaattagaacttattatatctaagaagagaatactaagggtgactcaacagttttcaaggatatgaagaaatatccatttcagtgagcagctgttctacatttccacaaaagaaagtaattttacttaaattattacagcatatatttcaacatagaagtaggaatatcttcaacatagaagtatctcatgtaggataactatcaactccagagaagcctgaatgttatccacctctcccacctttactggcttaattccttgtctcaaagaatgggtcaaagggtagataaggcatctttggaatgtgaagatttagacttcttttgggtctagctatgttcaaaatttttcgttagcctctgtcccccaggttccagcataaggttaagccctttctgcactatagataaaggggattaattagtggtaaacatgcaaatacccatgtaaattagaattccttatcaaagaaaagtatgcttctcctcagtgttaatgggtaagagggtttggatttaggattcttgcctggcccagttaatgtgccaaaatggccaatttgacatccaagggagatttacctggcctgatatttttaaaaaagaaaaagactggacaactaaccagatgtgcctgaatctcttactctgtctctagcattttcctgccttgtatagacatctcttcattttgttttgaggctggagtgcagtggtacaatcatggctcactgcatggctcactccacaacctcctgggctcaagcaatcctccggcttcagcctcccaagtagctgggactatcatgtgccaccatacctggccagatttttaatttttttttttttttttttttgtagagatgagatctcactcggttgcccaggctagtctccaactcctgggctcaagcaatcctcccaaagtgctgggattacaggcataagccaccacgcccagctaaacatctcttcaactgaactcttaaggtctacgaaaaaagagaatgtaatatcatattttacttgtaccacaaccactccaccctatccccagccctgctgttagcataggaccagacacacagaagactattagcacttgttaaatgagttgtcatctgtccaaatttttgttaacactttattttatagctgcttttctatttattctgcagttcattctctaacactgctgcctatgaaggttgcatctctctttacccttcctttcctttatttcacagaaatacccattcttccctatcccctcagatatttttagtcatctcattcatgaactaccaaaaacctcaacttcctcacagcccccactcttctacttagaaccaaatactgctaagtaacattaatttcctttttttttttcttttgaaattttttgtagagacagtgtctcactctgttgcccaggctagtctcaacctcctgggctcaagcaatcctcctgcctcagcctcccaaaatgctgggattacaggcatgagccaaccacattcagccttaatttgctaatgttttgaacacatcactttctgtaccttctttccatgttgagctacatcaaaactagctttgattttctaaatgacaagactgctacctcccctcattccaacccttgccaaaacccactctgtgtagggaaaccatttcagagctcactggtcagatgaatatccacccaccaaaagttctgagagttcacccacctttctgcctgtgtcaaatttatttgggaaaaaaaacagtgtcagttgagataaaaagcctatagaagaaatgtttgttggtgttgtgtg

SEQ ID NO: 8309 - DNA, 1431 bp, artificial
  synthetic oligonucleotide
taaaacatttctctccttcagatgctgatccgacacaagttaggaaagcgctcggtctcaaggagactccctttcttatttctgctcccacaagcctactgtctgccttttctggaatctaccttccctttaattcaaggctttgctttactccattatcccagggagacctcattagaaagcagccggccttcctgccctccctcttcagacttctcacaacctagtttagttatggagctcagcgatatatcgccttggctttccatcccccagccctcttccatcctccctcccttccttcagtcgctacagccgtgattcctatctccttgaattcctcactctaatctttttccatccaccccaccctatccagccatgcttcacttcctcatgggtagctttcctgcatccccgtccgatgtctccctcaggagttttctgcatcctccggccacaactgaatcggcagacctcgttccaagcctattatacccctaacccccaaatgacccctaaggcgtcttccccgccgttagttgcccccgcggtagcctccctcccccctcccgctcgcgccgcccggtcctccctcagctgtctccctcaccccgtgactcacccgcatgcgaacctcataggtggtgaagcgcgcgcgtcccacgcccaccgtctgaggattaaagatgtcgatctccaggaagttacttggcggcccgtaagcgtcggtcaggtcctgcggcttcgagttaaggcgccgggtatcagctactgccgtgtccgacatctttccgaaggagagcctgggaccggggaaagggggtgggggacagaggcctgaggcaggagcgcgcacggcccctcccgcttgcaaaataactagccaacccacaggcggcggcggcgcgcacgcgcgcccacgcacgcacgcgcacgccgcacgggcctgggccccgggctctgaatagcggccgtgctgactgctgcgcgccctgtagagtggaggccatattcaggcttccgggtgatgtttgtggccacccgggaacctgcatccccaatacgcagtacccaataccctgcctagcagcacaggctggctccgccaatcgcggctcctcaacccaagaaattgtctcgtaccgtgtatcaatcaacagtgggcactgccccgtgagccaggctcctacagtgataggccgaagcccagtgacctgaataagtcctggttttccgcgaaaatagaagggtggtctatggagggtggggttccaacaatagtactgagaacctataacgtagccgtcccacctgtgccactgatggtttcagttcacgccacacacaatggcgcactcagcactacgtatggcgccaggaaagcagcaagcaactaggatggggtaaagaaagacatttctctcttac

SEQ ID NO: 8310 - DNA, 8965 bp, artificial
  synthetic oligonucleotide
ccacctcgttatatcctgccacgccgctctcctgccgccgtatcgggctcctggccgcgaagcaggacgggagatgtagtcctcaagagtgaccagggtggcacgactgcagaactcggtttcccgactggctttcgaggcgcgtgcgcagatggctgccccggcgagtggtaaacagagacgtcaggagggggctgctgcttggagcaaaacaaaagggaaacccggggggcggggggtggggggggttgataggggaatcggtgcgggaataagggaggccgcagccgcggggacccggaccctagtaagagtggcgagaagggaagaggcgggggaagggggagtcaggggaggggcaagtgacgcgggggagcggggcgtgggggagggcagcaatccgggtggaggaaatttgggaggagtgtccggggggcagcaacttaaaagggggagggaactgcggctaaggagacgttcggtgatgggagcgcaatatatgaggggatacagtgcctcaggtttaaaagagcaggaagctgagtgagaggttgcagaaaaagtgtcttcgctcggcagaggttacaggtggcatctcagaaagagctttgaggctacaggctgtagtcgggaaggggatcggagaactgtgtgaagggacagcttagggactagcgtcctgggactagggggaagttcgcgactttctgaagactggcaggaatgtgcctcctggccctcgatgcttcccccctgaggggaggcatcgtgagggactgtggcaggcttcactgaacgctgagccggggaggtccaactccacgtatggatccggggaatgagaattcagccacagaggctgccgcgatcatagacctagatcccgacttcgaaccccagagccgtccccgctcctgcacctggccccttccccgaccagagatcgctaaccagccgtccgagccgcccgaggtggagccagatctgggggaaaaggtacacacggaggggcgctcagagccgatcctgttgccctctcggctcccagagccggccgggggcccccagcccggaatcctgggggctgtaacaggtcctcggaagggaggctcccgccggaatgcctggggaaatcagtcatatgcagaactcatcagccaggccattgaaagcgccccggagaagcgactgacacttgcccagatctacgagtggatggtccgtactgtaccctacttcaaggacaagggtgacagcaacagctcagcaggatggaaggtaattatgaccctcttaccttcttcccaacaccatctaccccctggaccccctagcctcccttacttctactctggggccccttttactacctcccacccccaccccctttgggaagcccagagatccaccttcaatctccagttagacaaacatttacttagtacatagtatatgccacactcggtgcttgatgctgaaggatcacagatgaataagacactgtccctgccctggagaaaattgaattctctgctcactgctcaatattcgcagcactttggcttgggctgccccaaacacttattcccacagagaagtctttatcctatgtacagcaggaactgtgtggattccccacatgaacctacccttccctcctcccccacctcccaccccaacaccttttctcccattcctgtgggattacttggattccctgcttgcctcccagtacctcagtgtagtggtactgttctagcactgctctacccaggaggagggagtgcagtggcaaagggtaaaaacaataatattcatggggaaaggtagctgatctcatgcactaagaagaaaaagggctgtgagctgccacttggctcagcttaccctgtgctgccaagaaactctcccttgtaaggggctatccaagttttggggggaagtcatcctttactgttaaggaatattagtcatgaagaaggaggtagggctctgactttagagcacaaagttgggagttctcttggccttctgtgaagaaactgtgagagaatatctcaaaggatactctgaaaaacttgtcctgagaaaatatggggctgtaatcacaaaattggggagcctcaagccctattgctggcttgtacctctctaggtggtgaggtcagcatataaccaagtacagaaggttggatgagcagaggaacttcccctaggtataggagactgagggatcagatctgtgctatccctaggggctgggcagaacagaagataggacagctgactgagacccttggcactatttctgggtagactgccacgccacagtctcagctcataaaaagctcccctccttggacccagcctacacagctgtttttcttttcccttaggttcattttccagggtagaggaaataacaagttgttagttatattgtgggagtatagtccgtccttataatctacacttctgtggggctttagagtttacaaagtagtttttaaagtttttattttattaatctttacagcaattctgagattccacattttacacattaggaaactaggtaccaaaaggttaggaaattcacctaataacagcagggtgaggacttgaactcaggtctaactataaatcatattctctaaaaagagcctggcttgctctaattggaatgagggcaaagtcaaatcaggctgagcctgggacttcaaggcccccccacccctctctgaggggaagtctcatgcctgaactggcctccctgatgatatgccaaggttactcccaccccaccagggggcggcactcacttagaacaagaaagtttagattaggtggcttagggagcaattagcagtcacccccaccaccctgccctccaacatgtaagagttatgggcttttgggaaactgacctctccaattaagagtctgtgtaccacttgctagttccaaggcctaaagaagaggagacaaacgggccttgtggctattaagtagtagggaaaggaatggatcttctcaagtagatccagaattagaggataaaaagaggagaaatcatagtgccaggtcatggtcattgtggtccttagttactatgaggtgaggccggatggacaagtgccactccttgaaggaacatcagcacagttgaaatgccattacctcagggtcccaggaacacaaggagttctttggctaaagaaccctggaacaagaagcatcattccccaggcaaaggtgctccttatcttaagagcaccagtcagagaaacaagtagtttctgaccgtcccatgtactcagcctcctagttgctctaagcacttctgggctcctcctgaatttctaaactaaagacctccaagtgggaggtcaaatgcccccaaggttgaagagtttatgcacaaattcctgagaaatgggggaaaggcactgggaaggaggtagggaaaagaaggcaggtttcgggaaggggggtggccaggggagggccaaaccccttgtgtaactagcctgccccgcggcaatcagtaaatataagctgcactgggggctgaagaagctgccaatctcagctccctgggccactggaaagcatcgtttccctagtagaatgtcaccagtgagggaggaagggaaaacatacagcttccaatacccaaggcactgaagagctggcagagcctcaaggggagcctcaccattgtcaacccaggggcaacccaccaatcaggtacaaatattgattatgtactgtgagcttgagtaggtatagaatatgtgctgtgagcttggtgctctgggagggctttgatgggggatgtgggactggaggacattacacttggcacttacactcgatgagacgaattacatgaaaccataagccacacaatataaattgggtgaaattgtgtggcgcagattttaaaaatactatactagaaatttggctgccaaagtcaagcagccgctttataaaagaggtggaactgaagcttggtcttgacggaactagtaaaacttagagaggggagatccctcctcggaaaagaggggaggggaagattgcacctcacgcatttgaggcacagcaggaagcctgaacctgaactgaatgtagttgaggatgtgtgttgtggattggaagaaataaggctgggattcagggaggggggaaaaaggaatctttaaattctatagagagctgggtggcccaaatgctctgtggggaatggagcacctgctgtgctgagattccagcccttcagcctattcagagaactggctctgggcagggcgggtccatcctgggctggtgctgtaccactgtcccgtaaactctacccaaacctgcactcaaggaaaggggtgcaatgctctttcccacctgaacctagttcttgctgggcaaggagcacgtctccccagtgcccaccagccccaggtaccgctccccccaccccccgcaaaacacacacgaagccctgggaagagcagagtaccaggagcttttccagggtgggcatcccccgtgctctctgcagtggattattacacgttatctcccacccgctgtacagagaagtctggagcagaggctgagcagcttgtctgggagcgggaaatgtgtgtggtctcccctcacaccccacccccacccctacttctaccagttttcccccctggattcaactttctttgagtctccaggaatacccctgctgtgttccagcacccttttatcttttatctttttctctttttttgtaaattatttaaagtttttcttaaactttaatgacctgggaaatgaagccccgaaatgaaccctgctgcggtggtggcaccaaatcctaaaccctagatcatcagggtccagcatcctcttagacttgaccgctggccactgacctcccctacagtacctcacgcccctttcctgccatctctgcccctccagaactcgatccgccacaacctgtccctgcacagcaagttcatcaaggttcacaacgaggccaccggcaaaagctcttggtggatgctgaaccctgagggaggcaagagcggcaaagccccccgccgccgggccgcctccatggatagcagcagcaagctgctccggggccgcagtaaagcccccaagaagaaaccatctgtgctgccagctccacccgaaggtgccactccaacgagccctgtcggccactttgccaagtggtcaggcagcccttgctctcgaaaccgtgaagaagccgatatgtggaccaccttccgtccacgaagcagttcaaatgccagcagtgtcagcacccggctgtcccccttgaggccagagtctgaggtgctggcggaggaaataccagcttcagtcagcagttatgcagggggtgtccctcccaccctcaatgaaggtctagagctgttagatgggctcaatctcacctcttcccattccctgctatctcggagtggtctctctggcttctctttgcagcatcctggggttaccggccccttacacacctacagcagctcccttttcagcccagcagaggggcccctgtcagcaggagaagggtgcttctccagctcccaggctctggaggccctgctcacctctgatacgccaccaccccctgctgacgtcctcatgacccaggtagatcccattctgtcccaggctccgactcttctgttgctgggggggcttccttcctccagtaagctggccacgggcgtcggcctgtgtcccaagcccctagaggctccaggccccagcagtctggttcccaccctttctatgatagcaccacctccagtcatggcaagtgcccccatccccaaggctctggggactcctgtgctcacaccccctactgaagctgcaagccaagacagaatgcctcaggatctagatcttgatatgtatatggagaacctggagtgtgacatggataacatcatcagtgacctcatggatgagggcgagggactggacttcaactttgagccaggtacagtaccccctaatcaccacagcacctcatagcctattaccactcctaggtgcccagctagtcccatgatctgggcgaaggggagatttaggacaagtggtagccagagctcctggggaactggagggaagatgtcatattacagtagcatagtttccggatgggacctccaggccccttagctgtgcccagccctgcaaggtagcacagaaaaggtatgtgtatggaagcgggttaggtgccaccatcttctttggtgggaatctggatgatagaatgttggcaagccccaggtaagcctcttaccttgttctctgtttcttcttcccacagatccctgagtcatgcctggaagctttgtcccctgcttcagatgtggagccaggcgtgttcatatctactctttacccttgagccctccccaggaatttgggaccctgctttagagctagggtggggtctggtcacacacaggtgttgaagaaattataaagataaagctgccccatctggggacgatatggggagggagatgggaggggaaaggggagagggtttttctcactgtgccaattagggggtaaggccccctctcaggagccatcatcggctttccccattcctacccacttaggctttgtagcaagatgagcaatgctgttggaaatgtgaagtcaccagtggccttacccctgcctttgggagcaggatttttttgtagagagtcttatctgagctgagccaggctagctggagcctgggatttctatgcagtggccccttaggccagtgatgtgcggtgggtgggctgtttaggggatctggaagggccaaggtctgagcactggagtggctcgccaggccaaatcacccttagaaggctgcagataacagaaaggctttttataaacttttaaagaaatataaacacaaatatagagattttttaaccatggcagggtgctagtggtgggcagaatgcttttttttctttctgaaggctttgtgatagtgacatgatacaaacactacagacaataaatattaggagacacagggaagtggggagaggtggggagtaatagtaaacacagggaagagctcccctacggaccaggtatagagaaaggtctatgcagaaataggttagagtttccctaacaaaaaagctaacccaggtcccctcattccttcaacttgtgcctgggagtgtgtggtgttagggtgcagccacactcttctatgacccagcatgggttagtgctatggtgggagagtacattgaaggcctggaattagcttggggccagggaagggactgggaggggagagaagagaaggagggaaggatttaggatggtaaagttaggtacagagacctccctgttcaaggcccctgacagctgtccctgcccttcttccccttccctgactgcaggggttatgtggaagtgtgtgtggcagcaggcagcggggaggggaggaacagggaagggggagctggggagcttggctgagggtctgggaaatgagcagggatggggggggatgtggatcaggtttactagcacctgccagggaggccatctggggctccttctccaccccagcccccaaagcagcccttcccccagtgccctttgcatcgtcccctcccccacccctgctgtgggttcccatcatttcctgtgtcagcgcctggcctacccagattgtatcatgtgctagattggagtggggaagtgtgtcaaatcaataaatgaataaattcaataaatgcctataaccagctctggtttctgctgccttgcttctccccttggataagggggagggaggggaaaaggcaaagggcgggaggaagaaactgcccaaaggcagagacatggaggagggtgggggaatttcaccccggggaggtggtggagtgtgggggtggagggacacctaacccctgcaggagtaggcgggctgtgagataggcctcccaaggggaggtagtctggtttgagaagaccccaccccctactccgttcctcaaaggctcattgtactagacttcacagccttcctcacccccacccatgtgcttgccccagccctctcctgccgctcccatccaccctcagagcctcctaggtgcctggggcgtatgtactcaagccttagtgcagatattgggagaaggagtctttctagaaaaagaaatctcacgttaaattccagtaatttcacacctagtattacttcttttgcttggtggttttattgagttggcgacctttattcttcctgaagtctggtctgttcctaaaggtcggagacttgcgagtggacttctttttgtctgatcgtcctgattgcttggactagaaaaagaaagtaagtaaacaaagaggcccctgcagggaaggtttctacaacccagggccaaaggaaggaaaaaagaaattggaggcaggaaattcatctcagagggctggggtgtaggaacattcagtcggctggtagggagaggggggtgctggggcagatcacatttggcaagtcttaccgggacactcgcagggggttcaattataacgaccttcttggcttctttcattttaagcatctgaattcgtctcctctccagggcatcacattgtatgcgcagtgcaactaagaacaaggaaaaggcacctgcacctctgagaactagagaccttacccttcctgatgctcccattcattgttcaaaccatcagctggagccccacttggcctaagatggaaatgatggaatggtgacagggagatatacggagaagatggccaagaaatgggggaagtggggagtaacgcatgcacattccacctggtgtgagctaaacgtccctcctaaagtggacctggaccctgcccgccttttcctaggctcctatc

SEQ ID NO: 8311 - DNA, 1403 bp, artificial
  synthetic oligonucleotide
taggagtgcttaaggccttgtgctgctcctctaacaatggcacttgtggtttcaacgatctcctctgcaatgttgatgtgagacttggggtggggttttgctagtggggcagtgaccagggcagggggctggttgtgatcctctgaccagggacagagttccgtagagtggaggcacaccgctttgagtgggcctccacactgagtcatggtgtctgtctgttttttcctccaggtcagtgacctatcttttcatgactcgctggctacttttgttgccatcctcatcgctcggcagtgtttgctcctggaagatctgattcgctgtgctgccatcccttcactccttaatgctggtgaactaccaatctgtaacccctagcatttctagacctcaaatttcaatacacactggacggccatcctctcattgttcactgtgggagaccttgctgcggctccctggccttcctcagaaggccagtcctttggtatgctgaaggctagaagaaacctgttttttagccctggatttgcagccctgacctttccaatttctgacccttcaactgcgtaacagttctctgctctacctcgctttcaatattatcttgctttttctcctttcactttacctcatcttctctcccatgcccctgccatacacttgcatgcatgcaggcacgcacacacataaacccacatacagtttaacttcatcccttccagatctgttttgtcttccttttagcttgtagtgaacaggactctgagccaggggcccggcttacctgccgcatcctccttcaccttttcaagacaccgcagctcaatccttgccagtctgatggaagtaagtgaccctgatctgaaccagccaacagtagaaagtgtggttcccctgcctccgtggattctacttttgcttcccctgacttcatcgccttccccagacaagcctacagtaggaatccgctcctcctgcgaccgccacctgctggctgcctcccagaaccgcatcgtggatggagccgtgtttgctgttctcaaggctgtgtttgtacttggtacgggggtaggaagggagtggtgccagaagtgtgtatagggtggagtgccagctaaactacaagggacagtctttctcccttctgaaggtggtctctctgacctttggggaggaggggagggagagaagtatatttctgtcccatagggcaggatttggggtgtttctacctctgtgggcccagggtgggtctccacacgtgttccaatctcactctgccctccctatctcccacccgtgaaccacaggggatgcggaactgaaaggttcaggcttcactgtgacaggaggaacagaagaacttccagaggaggagggaggaggtggcagtggtg

SEQ ID NO: 8312 - DNA, 1866 bp, artificial
  synthetic oligonucleotide
ttcttctctctctctctctctctctctctctctcacacacacacacacacagacacacacacacacacacacacacacacacacacacacacacacacacattctcattcccctctcgtggtggctgattgccgggcgttcccaatctccctcccccaccccttcagccagttcttaaaggagcaggcctgcaatctgggaaggcgggagaaatggaggaaaactaaatgtgcatgtggcgtgggtgtgcgtgtgtgtgcgtgtgtgtgcgggagcatgcgggagtatctgtgtgtgcctgtgtctatgtgttgactgtgtaactgtgtcagaaggcctatgtgtctgagtgtgttgctatttctgtttctgtctccacctatgtgtcaccattatgctgcatgtgtctggatatttacctatgcgggtatgtgtgattatatttcagtaagtctctatgtgtgtctctgaatgtatcattctgtgaggctctggctgtgtgaggtgctctgtctcagaatgtgggactatatgaggggatctctgtgggtttggaatatatgtctctgtgagtgaatatcgcagtgtctgtgatcctggcttggtctctctcattccctctttgagtctttgtgagtttatttctatgagtctctgaatatgtgttccccatgctccgttgtttattttataatacaccggaagagcatccacaatgcctagggtgctaggcagaactctttctgcctcacttctggaattcggtgtgaattaagagagagccaaccgaaaggaccaaggcttaaggatttgggagcagtgagggctgaggagaaatgtacaggaggggcgcaggagggtccgaggaggactcccgtgaatggctgtcccgccctctgccctgcctgagggtgagggagtctctctgtgggactctgccgatttgctgctttctgttcttgtgtcttagtgtcccggagtgaggttgacaatcccaccctgtcctgaagtggaggtccctgtgtgggcttaccaggtcccaagggctacacagctctgttcaagcagcatgcccagggacctgagctccatttttgtttctccccaccccctggctgtcacatgctattctggctccagccgaccctgatgaacccctttggctgtagaattgaagttgggcaccgggaacttgcagtggcaacaactgtcactgtcaaaccccttggattttccagccatggccaggcacatagaatggttctgattggcagtggatcatctgtgggatcacagtccctgggcccctgggcatgtgaaacctctcctacctataagagaatagcccaagcccagcagggcccccaaagaccaactctgttgccctcccagaccatcttggatgacgcatacttccctctttccacaggcctgtctggccctgagggagtcccctttctgaagctgtggtgcttggacgacctgctctctacattgctgggcacctgtaggtgtccctcgagagctcagttttgaggttcaagtcagtgtggccatgaaggggctgcctattgggctgatgctgtgaccctggagtctgcctctcctgccagtccccctgcccggaacatgtggctgcggcttggcccgccctcgctgtccctgagccccaagcccacggttggcaggagcctgtgcctcaccctgtggttcctcagtttggcgctgagggccagtacccaggccccagcacccacagtcaacactcactttgggaagctaaggggtgcccgagtaccactgcccagtgagatcctggggcctgtggaccaatacctgggggtgccctacgcagctcccccgatc

SEQ ID NO: 8313 - DNA, 3771 bp, artificial
  synthetic oligonucleotide
aggacagcactggcaggtgttgagctaatgtgttaagacggtaggtgccaccggaagttcagggagccagaggcaatttctcccctagagctgtgctcttgtcctggttgaaaagccattttgtaggatgagggcagttcctgttttgatgaatggctgtaaggaaatctagtcatcagagtccagaccggctgggaaagagggctctttactccctccaggctgagggtatctgatgtcatagatgcctgggttggcagcacagccccctctgtttccacacactgaccagcatccagacagccggtcctctccctccacagccatcgccaggatgcacttctagcctccttagaacaggaaggagaatctgtgccagcttagccccagatcctaaatgtctcccttctcacctctagtctcttcttttttctcttcccctccttgccccttctctccccctacatgccccactgcttttctcatctatttcttcccttccttcccctttcccccaccccagaaaggtggcatgatgcagtggaaagaccatgggctttggagtcaagcagacctgggtgtgaatcgcacctctagcacttcctagctgtgtgatcttgagcaagtcactttacccctctgaacctcagtttccccatcagtgaaacaataataaggataggacctatctcactggggtgtaaggatcaaacaatatggcagaagcagagtgtctggcacatggtgaatattcagtacatggttggagctgtgaccattattcctatctctttgtttctcttctattttttttctctctctctcaccatccctctctcctcttcccctttcttctgtccctctctccctctctggctctctctacatctcagagcaatgcttgctgctctcaacactggttcctgtgggcaggaaccccatttgccattaaccagagcaggggctccaacaaggaagaccagagggaaagcttcatctcccattttctcctgtgggaatcagggtcagctgaggcccagcttgagcctgcccactgggccccaggagctcaggcctggggtccctctacacgtctctgccctaagtacctcgtatccacaacctccacacttgctggcagtgtcacccctcacccttggtacctgaccctgctctccagctcgacctgcctgtgtacacacaagcagccccttccacccagaatgaatccttcccctgagagggtctctggctctgtgccctggcccacttgctgctacctccttcctcactggaaaggtagttggttgagatgggctgttggggacaaggaggcggggcaaggcggtgcagagaggccagcacagcaggggcctgcaacaccatcatcctgatgaaggtctgggcctcagcccacccattccctcagttcttgccatccctcctgcctgtcctgggcccaggcccggagctggcttgctgggccacactgcagtcatgctgtttttgaattctctctctgttttgttctctgttctgtgctgttgtgtctccccgtgtctggtccccaggatccggcgctaagaaacagggcgaggacttagcggataatgacggggatgaagatgaaggtatttgggggctgcagggcgcggcggctggtgcatggcacagagcccctccccttctcgatggggagaagccccgtctgtctgtctgtctgtccgttggtgtgtttctgttcctgtacaaggccgttgggctgttcatctgtctttggccctgttggccactgggagttccggggtgatggacatggctggcaggagcaggggaccacaagcagagccatggggaggacatcctccttgcctgggtctcccgccccttccccatcttctgtggttcagaggcacctgcccctactgagcagcagggagagtggagagaaagcaggaccactgagggcggggagaggacaaagacaacggaacggcaaggagattacctgtgtttcagtgaagagacccctgtgtctcacagggagcctggcttctgggagaggggccccgcaggatggtgaactgggaagtgaggcagtgacaaccaaaggggctggaaaagcagcaccagaacctccccagccttctagaaaagagagagatggtctcggggctaggggctgcagtaggtacaagacaaggccagaaagactgggctaaaatgccaggctgaggccaggacaccacagccatcaatagatggcataagatccttgggcaatgatcggaccagccttcctccttggagaaacaagttctgtttgctccgcagcagagagcattcccttcctcctccatgccctggccctgcccctctgccccgaaggggccaggcagctcaggggggcccagtggtgatgggtagggctgtgctggcatggcagagagtattggtccagttcacggactgacaggctacaggcagaggtgatcaggcctggagccttctcttgactgccccagccctgatgccgtgccgcctgggctcgggagcagccgcttgatggtcccttgttgaatggcctctggggaggctccatcttcatcttggtgctgactgggagcaggctctgtcattcttagttcttccccatccccaatgcttctggttaagtctgcccagggagaatggggaaatgggcacatggctaagaaaccatgtcaacaaggttccccccaccctatctctgccattcactcccctttcccacatccttccttgttctctccctgtgccaccccttattcccacacctcttgtctctgtctgcactggggggccagctgctgccaatggccgtttttccatgtaactggtctagtcttgggggtttcagggctccccagctcctgctctctaaagccatgtcaggtcccaggactcctgggtgcccagggcagcgactcacttgatgtggctaaaggaccagcccttcctctttctgctgccccccgcccccagggcccagccatggcccactgaggcctggctgtatcacatgcctggctgccttcagctgggaggcacttgaaaccagagcctttaaaaatatcactgaagccccactgtctcgggctgatgcttgagctccaggttgagcaaccccatgagtcctgccctcagggatggcggtggtgtcctggcacctgggatagctttgctgcccgcacccaccccctgggctggcaggggtgggggagcaagggcatcccacccagcctgtgtctcaccccttctccttgcagacatccgggacagtggtgctaaacccgtcatggtctacatccacggaggctcttacatggaagggacaggcaacatgattgatggcagcatcctcgccagttatggcaatgtcatcgtcatcaccctcaactatcgggttggagtgctaggtatggttccctgcctggtgcctggaaggaagactggcttcgcaaggggggaggaaagaatgctggagaatttaaaaacagatagccttgcttctctagctggtgctaataaccacagtcaaaatggtgttatcctctggcccctacccaaatgctaggggcttccccatatccccaggccctttcttggaaggtttagatgccaccagaaattcaattcaaacttcacaccttctctcaggtcccaagccaggtctctgcttccagactttgacttggctgagttttgtaggatgcttcaattttccactgt

SEQ ID NO: 8314 - DNA, 1040 bp, artificial
  synthetic oligonucleotide
tccggataccacccacagctcccacatcacccgcaggcccaatggcaagacctggagcaccaagcggccagccatctcacctgcctacagcaacgagaatgcccaggggtcctggaacggggaccaggatgcagggccactcctggtggagaaccctcgtgactactccactgaattaagtgtcaccatcgccgtgggggcctccctcctgttccttaacgttctggccttcgctgccctctactaccgtaaggacaaacggcgccaggagcccctgcggcagcctagccctcagcggggagccggggccccggagttgggagctgctccagaggaggagctggcagcattacaactgggccccacccaccacgagtgtgaggccggtcccccccatgacacgctgcgcctcactgcattgcccgactacaccctgaccctgcggcgctccccggatgacatcccactcatgacccccaacaccatcactatgatccccaactccctggtagggctgcagacattgcacccctataacacctttgccgcagggttcaacagtaccgggctgccccactcacactccactacccgggtatagctccaactcagagcacagccaatctccaggctccctccctcccagatccaggaacacatgcacacacacacacacacacacgcagacacacacacacacacacatatatgtatacgcacgcacccacaccctacagcagatccacctgcacaaacatagacagatgtggacatgcacccgcatgtacaaaaacacaaatacggaagtaaacctgaacaaaccctttaaatggggacgcagatgagtcctcggtaaaccgaggacccatgaaacagcagctgaagccagctccctgaatctgaccacagacactcctggggggcctgaaagcaacagctggacacccccttggtgctcgccttcggcctctcttggaactgcaccaccgaccaactccagacttgggagctttaaagagcaggatagctcttcctcccca

SEQ ID NO: 8315 - DNA, 1245 bp, artificial
  synthetic oligonucleotide
tctccagcttcgcctttttctttttcttttctttttctttctttttttttttttttttctgagacggaattttactctcgttgtccaggctggagtgcaatggcgcgatctcgactcactgcaacctctgcctcccgggttcaagcaattcttctgcctcagcctcctgagtagctgggactacaggcgcgtgccaccaggcccggctaatttttgtgtttttagtagagatgggggtgtgccatgttggccaggctggtcttaaactcctgacctcaggtgatccgcatacctcggcctctcaaagtgctgggattaaaggcgtgagccaccacgcccagccagcttcgcctttttcaaaagaaaaaattgagtctgtgggaggcaaggcaatacagcctgtgaatggaagtcaagactagaacccaggggccaggcgcagtggcttacgcctgtaatcccaacactttgggaggccgaggcgggcagatcatctgacgtcaggagttcgagaccagcctggccaacatggcaaaaccccgtctctactaaaaatacaaaaattagccgggcgtggtggtgggggcctgtagtcccagctacttaggaggcagaggcaggagaattgcttgaacccggaatgtggaggttgcagtgagcggaggtcacgccactgcactccagcctgggcgatagagtgagactctgtctcaaaaaaaaaaaaaaaaagactagaactcagggatattggaaaccccatccaatgtactttgtaccacacaacattgcctcttgcaatcttattatattcgtcacttccttttcatcactattgccacctccctagattaaaccttcataatctcatgcctagattgttgacacagcctcctacctacctttgcagcctctagcctacttagtccccagtgcaccccgtcacgttaatcaccctaaagcactgtttctaccttgtcattctcactgaaaagcttttagtggttcctcactgcctaccaaataaaaaataaaattcaaatttccaagccaggcactaaaactcctccaaaatctggtgccagcccacctttccatgcctcattacccacactacccttttataccctatggcccagccatatccaatatcctgtgttccttgaacagcttatgcactttcatgccctgttgcctttttacacaatgtcctctcaacttcaagcattcttcctttgattttttcct

SEQ ID NO: 8316 - DNA, 4116 bp, artificial
  synthetic oligonucleotide
tcccatttcccaacttttgcagttgctgttaccccacccctttcctctacagcatagaggaccacccagggctgaatatgaggcttcttccacaaccagttgctctgctgtggagcatgcactggggtcaggaaatgactccagggatcactgcacctcctatggtccagggctgcatgtcctcctcacattcagtttcctgctgctagtatgatctccttgcaacttaatggcagaagtggcaagaggtgggagaagccttcttagcctgcctaagggatagaggagaatttcctccctagagcaactggcaagctcctgaaaccacgaggttgcaatatgcacttggggttgggggctgggcagcaatggggtctcagacagaccctataggtcaacaacagcattggggactgctcaaggtggctcacacctgtaaacccaacactttgggaggcaaaagtgggaagatcgcttgagcccaggagttcaagaccagcctgggcaacatagcaagccccccatctctacaaaaaaaaaaaattgaaaaattagctgggcatggtgacacatacctgtggtcccagctaattgagaggctgaggtgggaggatcgctggagcccaggaggtcaaggctgcagtgagcagtgattgtgccactgcactctagccttagtgatatagccagaccttgtccccaccctctaataaaaaacaacccacagcattagggagaaaaaggagagatcttgggtttgacagaccatttattcccccaaagcaactttgttatcttttcctgagaagatttttttttttttttgagacggagtcttgctctgtcgcccggactggagtgcagtggtgcaatcttggcccactgcaacctctgcctcctgggttccagtgattctcccacccagcagctgggattacaggcatgcgccaccacacacggctaattttttgtatttttagtagagatggggtttcacattgttagccaggatggtcttgatctcctgacctcaagtgatctgcccacttcagcctcctaaagtgctgggattacaggcgtgagcaacggcgcccagcctttttttttttttttttttaatggttagcctttgctttctacagacactatctgcagaagcacagggagcctgctgtagaaagacttctgtctcagatacattgtttcatcctacctatcctaccgctttggaacggtgtgaccttgaggagttacttatctgagcttcagcttcttcatctggaaaatgggataacaggcttcctaaatgggtcgaaagaaaaaatgtatggaacaacgctcagcacagtttgtggcttcataaatgagctctctttcctgtcctctttcctctccatattccggagaggatctaagcctcagggaaaatcctggtgaccttaagcttctgacggggccatgggggagggcctcagcccagagcctctgggtcccctggggtcccctcttcacatccacctgcctgtgttttatctccctccccccgcccccccgtggccattcttctggtggggctatggggcgggtgcggcgatggaccgggcgggcacagaacaggtgggtgcaggctgggtgtccggcgctgggacacaagtgctctgtgtgtagggtgggcggaagtcagggcgtttgatctgaattctaaagggcgttgttcagagccccacaaaggtctcattgtgcagacactgggtataaagcagcatatgactccccagcaccgggcggtgatgaattgggacgcaggcgcggagcccagggaccactccccctgcacagacatgagaccataggggacctgtctgggtggcctcagggataggcgctccccaaggtaagagggctttgttgagtttgccccaggtctggagttaaggagctaggggacagggagccataggggatggctgatatcggaacaagatgggcttggcaaagaaaggggctggcgggaaaagaatgttggatgaaagcgaagaagggggatggggctcagggaggtcaagtcaagtgagtgaggaggaggagaagctggcaagggagatggggtgacgaggaaagacatgaccatccttcctttcctgctactggctcttggaagagttgagggggggtgcgcaggcagtgctatggcgcccgactttccaccccagctttctgacagcttgcttcatggctggtgttttgcaggtgtgaatgaggcaggatgaactggacaggtttgtacaccttgctcagtggcgtgaaccggcattctactgccattggccgagtatggctctcggtcatcttcatcttcagaatcatggtgctggtggtggctgcagagagtgtgtggggtgatgagaaatcttccttcatctgcaacacactccagcctggctgcaacagcgtttgctatgaccaattcttccccatctcccatgtgcggctgtggtccctgcagctcatcctagtttccaccccagctctcctcgtggccatgcacgtggctcaccagcaacacatagagaagaaaatgctacggcttgagggccatggggaccccctacacctggaggaggtgaagaggcacaaggtccacatctcagggacactgtggtggacctatgtcatcagcgtggtgttccggctgttgtttgaggccgtcttcatgtatgtcttttatctgctctaccctggctatgccatggtgcggctggtcaagtgcgacgtctacccctgccccaacacagtggactgcttcgtgtcccgccccaccgagaaaaccgtcttcaccgtcttcatgctagctgcctctggcatctgcatcatcctcaatgtggccgaggtggtgtacctcatcatccgggcctgtgcccgccgagcccagcgccgctccaatccaccttcccgcaagggctcgggcttcggccaccgcctctcacctgaatacaagcagaatgagatcaacaagctgctgagtgagcaggatggctccctgaaagacatactgcgccgcagccctggcaccggggctgggctggctgaaaagagcgaccgctgctcggcctgctgatgccacataccaggcaacctcccatcccacccccgaccctgccctgggcgagcccctccttctcccctgccggtgcacaggcctctgcctgctggggattactcgatcaaaaccttccttccctggctacttcccttcctcccggggccttccttttgaggagctggaggggtggggagctagaggccacctatgccagtgctcaaggttactgggagtgtgggctgcccttgttgcctgcacccttccctcttccctctccctctctctgggaccactgggtacaagagatgggatgctccgacagcgtctccaattatgaaactaatcttaaccctgtgctgtcagataccctgtttctggagtcacatcagtgaggagggatgtgggtaagaggagcagagggcaggggtgctgtggacatgtgggtggagaagggagggtggccagcactagtaaaggaggaatagtgcttgctggccacaaggaaaaggaggaggtgtctggggtgagggagttagggagagagaagcaggcagataagttggagcaggggttggtcaaggccacctctgcctctagtccccaaggcctctctctgcctgaaatgttacacattaaacaggattttacagtaaatgaagaggtggcttgtgtgtttgtcaagttctttctcctgcaacctctgacctcccccaggatgagctggccttggttttttactgattaagaaaggaacagggcaaaagaagtagttacttgagtagctgaagctgcaaatgaggaaatcactgtacttctgggccgcagagccagccccggagccattcctccctgttgcttttgttgttgtggttcttgtctttttcattgtctaataacagctttattgggatttagtttacatacctccttcctctgattttgaaaagattaaaaatgacaactccctctgaagagacaagaaatgattgggaaatttctcctgccccagagag

SEQ ID NO: 8317 - DNA, 638 bp, artificial
  synthetic oligonucleotide
ctcactctcccagtcatcaaggctagaagcctggggttcatgctcaattcttccctttcccctaacctttataacctttaccttttattattattattattatttttgagacggagtctcactcactctgtcacccaggatggagtgcagtggtatggtctcggctcactacaacctccgcctcccacgttcaagcaattctgcctcagtctcctgagtagctgggattacagacacctgccaccatgcctggctaatttttgtgtttttggtagagatggggtctcgccatgttggccaggctggtctcgaactcctgacctcaaatgattcaccagctctgcctctcaaagtgctgggattacaggcatgagccacccccccagaacctttacttctaatgattcatcagatcctgcagacttgaccttcaaaatgcctgaaatttactttgaatctatctttttttcccttccctatccccacagtccccattgaggtccacagaacctcttagccatactccttccaccaatctccaggctttcaggcctactcccactcgctattcttcatattgttctggggattgtctccctaaagaaatagatctgagcctaccaccccttggttggaaa

SEQ ID NO: 8318 - DNA, 942 bp, artificial
  synthetic oligonucleotide
cgatagcaaagaatcacagaaagcctgtcattctaccctccccgacagccaaacacacccaatggtttcctacctgtccaccacccagaaaaagcaggcaagcaagtaaactgtcttaaatgaggaaagaggggaaacaggccagagggtgacctcttatttatgcaacagctactgcctatcaggtaggaggactggctgtttctaccctttctgcacacaggaacaggagagggaagctaggcgccaaggagagggccgacctggcaggtatggtgggttatggcagggcatggaaggggaaggcagagaaggggcaaaagcacaggggagggggcagcctcgtacctcgccctttcctctggcggactggggcatagtagcggatgctcaccaccttggtggtgccccgaggggtggtacacttgcgggactgccgcaccacattggtgaaggagagttgcatgtgttcctcagctgtctgcagcccaaaaaacttagtgttgaagaacatgagggtgttgaggaggacaaagggcgagtagacccccagttgcttacactcccagaggtgctcctcctccactcgagagaacaccgtatctacaatggtcaagggggagaggccagtcaggagggagtggctacccaaacccaaccacttcccatcccatgtgccctgctcatttcccacacaattctcatttggtgagtaacctttgtatataaaacactgtcacttcgctacacttgctacactacacagtgggactgggctttaaaaaatatatactttccacacctgcatttggaacgcctctcaccaccctcaagttgtagacaagtaaatgtaaaccttgaggagtcccacgatttcttgctttctttctttacttaccacccaaacccaggccatctttttctggtcctagagatagctct

SEQ ID NO: 8319 - DNA, 1528 bp, artificial
  synthetic oligonucleotide
accaataccaccccctcgggcagagacatgctggtagcaccctgtctccctcgtcgccaccatctatggcataccacaaaggtcagatgaggccttgtctaactcctcagcctctgcaatcatttctgccatagccaggatgtcggcctccaaggggttggaagggatcttcaccttcagctcctcaatggtctctacaatcttgtctgtgctctccaaggtagtgggcaagaacatgggcacaggcacctggaggcacgaatcccaactaaatgccaagaaccacaccagcagttggggggaagttggggggacagatgatgagtgaagggggacagttgatgagagtaaggggaaaggaggacccagccaggaagggcagggaaactcaccgggataggcatcgagaaaggcaccgggactttctggcagtacagatgcataggcactggcacgaagatgggcactgggatgggcagcacgatcacctgtggcttccactcttctgtggataagaaaggggtcttctcagagaccctgctggactggtcacatctgacccaccaaaagctctaacatgctcagtgtcacaaaactgcccttgaatcaaaggctgaaagacacctctatgattctaggacaaccatatgaatgaggcttcagctacctaagaaatccccttgtccagctcacggacatagggctggcaggcctaggactctggaatacagcctgtggcatcgaggtaccctggctcacctgtttgacttcctttggacttcatctccaccttgcaggagacgccccgattctgcatcagtggcttacacatggcagccttgtttttgcggggtgttgctgggggtggtgggggtggaggggtgggagcagtgggagctgatcgggtcttcacagggatctgcaaagacagaggaacatttgtgccaccaaccgccgtaccctcctctgagattatcctcccccttggcttttgccccgaccttgcccaaattcccattttcctctggggtcctcactgtgttgctgttctccactttggtttgagagggtgtctggggttttgactcaggagactgacctgtagatcaaaacaaatgaatgctctcatccaagggactagctctccattttccttacccctgttccaggagagcttcattaacaggtacaccaaatacagatgggaacttctaggatttgacccccttgccatcccagatctagtctcctctatgccccagcaatagcagcctaaaagattatttgttcctggagaatgaaacattacattttcccccaaaacccacatttgagaccttccacttagatagcctgaagagtctgttatccctggagttgtggaggggcaggggtaacattctagaaatagcagtcttcagtctcactaaatgtagagtttatgctgagatttccttatctcagaaacgtaaccataacccctatatgctccatcctaccaggaaaggcacccactccctaacaatat

SEQ ID NO: 8320 - DNA, 1496 bp, artificial
  synthetic oligonucleotide
gcagagccggtgtaccacgctgccattgctgacctcgtgcaggacctgccacacacatacacgcaccctgagctagggcctggccaccaccgcccaccccaatgcaaggtcagccccccacctcaccctagaccttcacagcagacagtgggcccagggaccccccaacctgcgccgcaggctgccgacttgatggtgaggtcctgggaggtaaggaaggccagctgtgcacatcctggagaagctctgtccttgaatacgctccctcatgatggccgcctttcctccccactcccctttccacagggcctggaccctgcagccccaggatgggaggggcaggtcagggctggccaggctctgtaaatcagcccccactgagtgtcctcacctctccagtcttctggcatatgctgcagcgagtagcgtcggcgggatccccagactgggggatcgggcgctgctgctgggcctcatacagggagagacagacggatgtgcagaactcatggaaggagcctccagaaccagtctgcgccacaaccgagtccttggtgttccagatctccctagaggtgggaacaggtttgaatattcactcaagaccaccctctcatttcctcagcttccgcccctcctccaggatcaatgaccacagagccaaatactctgactctctccctacatcactctctcgcccagctccatcctgctaggttcttaccaacagtctctgtcttactcatactcctgcccagatccctgccctctgcatagcccccaagaccctcacgcacttcttgcagaaggtacaggtctttttgcccgagggcttcttggagaaagtggtgaggcaggatgacgagcagaagagctgaggcagccccttgcgctgataggcagtctgccccttctgcagtggtgtccggcaatgtgcacaagtcatcttggtgcccactgcagagcgcccggccctttgtgacacacttgagcgtagggacatgcgaggagagcgccggggccggaatggcacaaagtcctcatcattggggtcatctaccatggcatcagaatcctcatctgacactggaactgagaaagtggggggatggacatgagaaaggccaccaaaccaggtctccaaccatcccctgaccaacagttcagtccctctcctgggatccctgttgttccggcctttacaccctggcccttgttacatcagtatcttaagaccttggtgtctctctcccttggttactctgtaacctcccagggagggaaagggagaggctctaaatgagaagattcggagacagagatggcatagctgaaacaggaaactcgccattctcactgctcttgttttcaatttcccccactgcccctggttcccatgccaacccatagcagagacaggcacttcatgcgcttcatggagcaggacggcaggagctagaagatccatgccctgccgcatgccactttcggacctt

SEQ ID NO: 8321 - DNA, 2007 bp, artificial
  synthetic oligonucleotide
ctactcgactgcaactcccattcccttccccccttaccttttaccccccgcaactcaggctgaacgcccccttagagtctcctaaggccgtcgccaccaggagcctttcccgcccccgcgatctcagtttctattccctccccactctgcaggagccccccagctccccagtctttacccaccctgtctggccccaccccccctccccgcgttgctaggtcctccctcggcccttcccccgcccccacaaactgcccttcgcaaccccttccccccagttacctttcaggtcgcccacttcctcagccccgtccccctttcccattgctcctccagtcctcccttctcctgttgcccacccccaacctcaggcatttacaggaagacattttggagctacgatctctccttagacccccccaccaccgcctcccggctactgcaagatcccgcttgcaggttcggttcggcttgagcaggcccgacccctacctgcggcagggttagtgcaaaggctacaagcctagaactgcagacagcgacggccccgcgctccttctctacctccctccctagcagccgggacaggggtcgcggcccctttaaatggcagcgccgctcgcagcgcccagcgctctgcaccaggcgggcgggcggtgccagcaaccaaccccattggctggctcgaggagggggctcgcgagacagcgccggcccccggcgcgagactcccagtccagtggccgcctggaaattgcggagtggaatgcagccactagagacggcgcctgagcccccgcccggggccccgttagttgagaaggaaaagatagcctctggagctttgaagccggccccccgggaaaggcggcgtcccctttccacccaagggccgagtgcgctcacccacaaaaaacacagatctacgcacctgctccccttacctggctcaagagtctggcccccgtcacaccctgctcgccctacctcctggagcccactctacccgtgatcccctcctctcattcaaatggttcccggtcccctccccctccccgtgtctctcttagcttcccactcgtgttcaccccctcggcgtccgcccccctcaatagtccctacctacgccatgcagcaggcgcctgccaagattaccctcccccatccccacctctccgggtcccgccccctgggcgactgttggggtagtgagtgacagcggaggacggggggaggcagggacccagccctcacgtgcccctccttcccttgtctgcagccacggggcccccaaaacagtctgagagtcagagttatggggtatctgaagcttgatccccagccacacaggtcgggttaaatggctctggctcagtggcaacgcctgtgcagtaaccgttactgcttgatgacccccaaaccaggtcctgcaaagctaccccctactctctcaacagtcttagggtaagttctgggatcttctccctgagtcttcctgcaggagctccctgtattatctatggagttttcctccctcaccagggctgatctctctctctctctctctctctctctctctctctctctctctctctctctctctctctctctctgtatctctctctctctttctcctccagccccctttctgtccttgtctgtctctctcttctcgctctctctctctctctccccctatctctttttgtctccttctctgcctctctgcttctcgtgcgcacgagcacgcaggcgcgctacacgctcccccctcctggatggtccttagcatgtgggtgtggctgaggttaggctagagaagtggagtaggggtaggtggcactagcgttaagcctactgcctttaaaaaattgtgccagcatccattctcagtccgcattatattaatagttagagcactttacaatccccgctccccacttcccaccacagcccctaagggctgagagcatttagtagccgaactactagaggaggctcaggctg

SEQ ID NO: 8322 - DNA, 443 bp, artificial
  synthetic oligonucleotide
tgaattgttcttctttgtcatggttgttcaaagtaacaaattgtttgcctctgacaaaagccagagcacttaaggtgatgaattacatataagtcatcaggaaggtggctgattgtgttattagtactgaatttatttattagtctactttttctttgtagggtgcaaaaatgcagagtaataaaacttttaacttggagaagcaaaaccatactccaagaaagcatcatcaacatcaccaccagcagcagcaccaccagcagcaacagcagcagccgccaccaccgccaatacctgcaaatgggcaacaggccagcagccaaagtgtgtatatgctaggtgatggagtagaaatggattccctctgggaatggtttcttggtttttagattagtttctcgggcttataagggaataggcctttatggcacacctttgttctt

SEQ ID NO: 8323 - DNA, 891 bp, artificial
  synthetic oligonucleotide
attctctaaattagcacctactgtctcagtgactatcacattaccctgtttgattttttccatagcccttattgactgaagtttccttacatgagaagcaatagaacatgattgttgaaagggcaaactatagcagcaggatgcctggatttaaattttgtctctctacttactagctatatgatcttcaactacttaagagctctatgcttcagtttccccaattgtaaaatggggatgataacagtgcttatatcatggagtcattaggagtattaaatgagttaacacatccaaagcccctagcccagtgcctggtacagggtaaacatatgttagcaattgtattgcataattacttgtttacatgtacattgtttctctttcactagaatataagtctatcttagtgcactcttcccagcaactaaaattgcctagcatgtgtgattaataaatatttgttgaatgcaggacctaaactggaatggcaaagaacagataggagagaggctgggtgcagtggctcacacctgtaatctcagcacttcgggaggccgagtcaggtggattgcctgagctcaggagtttgagaccagcctggccaacatggggaatccccatctgtactaaaaatacaaaaaattagctggacgtggtggtgagtgcctgtagtttcagctactcgggaggctgaggcaagagaatcacttgaactcagcaggtggaggttgcagtgagccgagatcgtgccactgtactccagcttgggtgacagagcaagactttgtctgaaaaaaaaaaacaaacaaacaccaacaaacaaacaaacaaaaaataggagagagacatgtaaaatattattaaaaagaagaagaaaaccctgaactt

SEQ ID NO: 8324 - DNA, 2460 bp, artificial
  synthetic oligonucleotide
ttgaagaaatttaagcagaatttgaggacttagttttaaaaaatgtagtgaaggggctaggtagcaaaaactttttgaagaaattcattgacctgctttcttagatcaaggactttttgaaataaaaaggctctcagagatccaacttgtagcctccagtggcttgtaatactttcttgctgatgtggcaagctaccttaagtcgtttctagaacaagaggtgaagtataaataccaatgtgacaaaatgtctgaacagtagacttgaaactgcaggaagatcgtaagaaccgatttgttcaaggaagtagaggcaattcatgactcaatctagacgtgtggtttaggcagatggcaagtgaattcatttatcattgttgatctgctttgagctcagtggaatcgccgactgtgacaatgtgcagagctagctggtggaaatgaagtcacaactcgaggagagtcatggattttgacgaacgtgaatcacctttaacatttttatggctgccttcggagtgcaaacgcccagcatgtccctgagttattaaacatttgccctatcaccgtgggcaggagtattctgaataccaaaacgattttgaaatttcaggctatacggccaacattgaaggtgtctgcattcaactggccctgtgaaagcttcagtctttttcatcgaagtgctgaaatcgatggccgagtcacaatgaagacgggctcaaatcggaaccctctcgctcctcgttttgagcagctgtctttgagaggcaatcttctgaattgactggctcagaattgatccgtgagagtcgtaaccatccgtttttgtacgaatacagttgataaacttttttagacgcctttggcatttatgtttaaaacgacaccacctgctaagtaacaaacactcttcttaatcgcggtggcaaaaacgtatccgtcccgtgtgtgtttgtttttacccttccgctacactcttaagaaacttggccgcttccgccccagagagtgccctaaccacgagtcgggttgacagggctgctcgcatgcgcggtctccaccgtggtgtttgtcgcaatgggcgctgcgcggaggactacatggaatctcgactttgcagcttgaagtcattttgttggcggcgctggttaccggctacctccgcgcgggcacttgattgtaacagaaagtagttccggcccatgttgtttcggccgaggagccgtcgccgccatttcaagaccgtactaggtagatggtcaattagagttcccagggtttgaagcctgtaactgctgccgccgctcaagccctccagagcattgctacggctgctgcccttgtactactacctccaaatacgttcttgctggtagtggcggcagcaggaccaattacctcttttttgctctccctcgagaagctccagatggcgtcttccgtgggcaacgtggccgacagcacaggtaccggtgtcccgttctaccttggcagatgcccccttggggtctcgcgccgtcctctaccttgtatcactccttccctcccttccctcgaaccatccccattacatcagtgacattgctaagcttttcgtggtctactggcatctgatcacatcgggttttccgctgttgtccgcttcccgaacatttcctcctcctcccttgcttgctttttgctgcctttcttgctttgtttttatttcgtaaatgttctagcattccactctctccaggcgcttttatcacacgtgcgcgcttagaatgtcgtggaatggactgcattggaatccctgccctttcactcctttgcagcggttttctcccctaattccagctcatcgcctctcctttttcccctccatctcctccttcatctccccccccagtcttttccccttagccagatttggtccttctctgccaatctagggcgggggtgccgttccgatgtaatcatatcctcactttgcatcacccgaggacgatcaaaagctcgtcgatggtgccacaagtcacctcgagaagaggggacattgagcagcaccctgctaggcagtgcctttctggtgttctttcggttgagcggtcccggtttagattggaaatttccaggggtttcctttgccatcgcccaattccaccgctgccctcagcctggatttcccaccctgtccgcggggaaccacacccttcccttcgcgaggttgccagccctgttcacttcctatccttgggggagaaaccaccccgatgctgctgctttggcgttgaccaccctgcccgcccaattctcgctttgtgttactttctcgatgtattcctccgccgccgcctctgggtctgccatccccattcttcagcccagtatctctttattcacagggtgtaatattcttttaagtttccatccctgcttgaagagtttgtaaagcaactggagtgtagctgcaca

SEQ ID NO: 8325 - DNA, 1782 bp, artificial
  synthetic oligonucleotide
atgttaatttaattagacaatactctggaaggaattttatcttctttcaacaaaacatgttttatagtattctgacttacggttgcttttgagttttactcatttggatatattaagatgcacacagtgaagcaaattaaactccactttacgctggaatgctttctttagcatgaaaataccaggtccttggatttgggattttaatttcctatggaaagttgcttaaattgtggacactggaattaatctgaatgtcactgaggaatttcacatgaagtgtaatccctagtcaataagaattatccattacattattttatgggaaaactaggctaaattacatccattcaggtaaaaggaccttagcttactgaaggatctaaagagcaaagcaaagatctcactactcaaacactcagcctgcttccttcaagtccccttgcaggccagctttgtgctttgcagaccaactttttaatgagatactttgcttcctcattcaacattgaagctaggcttcaattaaaaggttcgaggaagctccatttaaaattgttttttttactattttttaaaattgtagtgtatatgataggaatttgcatttaaatatgttcatttttgcatatgttaggagtggaaacaatctggaaaacatttttttttcatccaaaaagtattctccttgggcatatctgatggaaaaaaaccttgattttattttcgtatctttagtctgtgttctttctagttatttggtactaattatgtgcaatctaaaaacactcccacaagtatttgttttttaattataaaatcatagtatatgttctttgtagaaaactggaaaaatacatattcaaacaggaaaaaaaatcaaaattccccataatgttgccatctaaaaataacctctattttagttgatatcccgtattcatttttgaaagccattccttaatgctagtttgatacacactaaaagtttagcttacaagttcaaattctgccagcttttcctgacagctatttgcatttttttcagatgagtgattattggccattttctttttctttttctttattttatttatttatttttttgagacagagttttgctctgttgcccaggctggagtgcagtggtgcaatctcggctcactgcaacctctgcctcctgggttcaagtgattctccacctcagcctcccaagtagctgggactacggatgcctgccaccacgcctggctaatttttttttgtatttttttgtagagacggggtttcaccatgttgtccaggctaatcttgaacttgtgacctcaggtgatccacccgcctcggcctccgaaagtgctgggattacaggcgtgagctaccacgcccggccttattgaccattttctaaataagcacattctatctttattctcttaaaattcaaattttctgttactgataatcctaatactaggattcttgcttaagtatgtgaaaccattaccgatttgttgttcacatttattttttatgttgtgaaactggactaaaggaatagagggatgattagtcataaaagtcaaatagcatttgtgtttaactgttgagaaaagtgaaagatcagtatgattattatggaactgtttttaattcttgcttaaagactacaattttagtataatgacatttgagtctagggtagtatgtggtagatttctagatggtccctaattaagaagtattgttgtatttagaattgtccacctaatttctttttat

SEQ ID NO: 8326 - DNA, 1198 bp, artificial; identical to SEQ ID NO: 5960
  synthetic oligonucleotide

SEQ ID NO: 8327 - DNA, 4697 bp, artificial
  synthetic oligonucleotide
gttaaagacataggcaaccagattttttcatgcttcagatgttttctaatgccctctttctctgatttagctgtggccagaagagctccgaagagacaggcgaggtgagtaggagaattaatgaaactttactttttttttttttttaaattaaggggggaaaaaccccatgctctgtctaaggaaatttaagagtaaacttcacatttcctctgtggacactctgtggttctcagcaggatcatgatggctgtttgacatcacaaccaggttgaaaacattagattccttatgcctgacccattatctaactggtcagtttcttctttgaggtatctctgtgaactatgccttaacatccaggctctactagtctaagcccttatcagtgtttactcccttttagttttatttttagtttactttagtttttatttgtatttttattttttttgagactgagtcttgctctgttggaatgcagtggcacgatctcacctcactgcaatctccacctccggggttcaagtgattcttctgcctcagcctccagagtagctgggattataggcacacgctaccatgcctggctaatttttgtatttttagtagagatggggtttcaccatgttggtcaggctggtcttgaactcctgacctcaagtgatccacctgccttggcctcccaaagtgctaggattacaggcgtgaaccactgcacctggcctaagtctaacttttagtatgtagagcctggacttccttatagctattatgtccccctcctttagcattttgatatcctctgtggactatgtgtcacaataactaataacaagatgacctatgatgtagccaggcgccacattggaggagtggcagtggcggtgaagtggtgctcactgcggtgtgactcccctgggctggagtttggatctggctgacagtggatgtccagccggctgctgtctggcgagctgaagggttccgagcaggaagtgcttggcttcacctcaggtggtgctgcataactctcgtaagtgatagcaagaggcaaagtagcctgccacagagcagcagagagagagtgctgggacccctggcagatgagacagagaagcaagaggccccagcatcgtggctcactgcagggagcagtggcagctttgaaaccatccattcattggctctgcatgaaacggagttcagtagttgtccatttacctagatatcaatcccaaacagtaggctgtctccaagaagtacacccttaacggggacctccttgcccttttgccctttaatttttgactgcaatctcttcatcctcaagtcctttcccccgaggctcttttctcaagactcactttcatgtctttattttttattttacttttttttagagacagggtcttgctgtgtcgcccacactgcagtgcagtggcaccatcatagctcactgcaaccttgaattcctgggctcaagcaatcctccctgctcagcctcccgagttggtgggattacaggcgtgagcctccatgcctggcgtctctttcatacctttaaatagaaataaattacttggcagaaaacaggcttttcactgatagctaatgatactcagctaacattcttcccgtgtttttgattcagcagtaaggactgagcagctcattgcttccaatttttgttcacttgtgctgttgtgatcctaatttcctaagggcttaaagcccttaaaacctttttgcatttcaggaattctgattggttgttttcttcacttatttgggatttttgataattggttgcttatggcgtcgatagccctccttttataaagtatctcttttatttttgcagttgcatccttaatgtccagtcaaggagtggtgacaccagtgggtcttgtaagtagagtccactcaaagcaggaacattttgaagtgtctttgtagagatgactcaactgtgatttgggatgtctggcctaagttggttctaagttcgtcacctctagggctctctttaggtcggtgaaatgaaatttccctactgtcaggagtggaggaggttctctgcttcttttccaacttactttcctcctttttttttggctctgggtttccttacttttatttcctttctatccttcatgggagatgtaaattttaagcagctctaatttatagactttggttttagggagttaaagacataggcaaccagattttttcatgcttcagatgttttctaatgccctctttctctgatttagctgtggccagaagagctccgaagagacaggcgaggtgagtaggagaattaatgaaactttacttttttttttttttttaaattaaggggggaaaaaccccatgctctgtctaaggaaatttaagagtaaacttcacatttcctctgtggacactctgtggttctcagcaggatcatgatggctgtttgacatcacaaccaggttgaaaacattagattccttatgcctgacccattatctaactggtcagtttcttctttgaggtatctctgtgaactatgccttaacatccaggctctactagtctaagccctttttggtgtttgctcctttttatttttgtttttagattagtttagttttgttttgttttgagactgagtcttgctcgaccaggttcgagtgcagtggtgcaatctcggctcactgcagcctccgcctcctgagttctggtgattcttctcctcagcctctcaagtagctgagattactggcacacgccaccatgcccggctaatttttgtgtttttagtagagatggggtttcaccatgtttttcaggcttgtcttgaactcctgacctgaagcgatccacctgctttggcctcccaaagttctgggattacaggtgtgagccaccgtgcccagcttgtttcttctttttaagtggcttcctcaccttgatctcttacttctgatccagtcggtgtaccacttgtagttggatctcctgaggcactgctttgatcatatcaatcctcaattcaaatagctcgtaatagaaaaatcaagctgtttaccccaatatttaacgccttctgtgatctggccataacctctctttcagcctcacctgctactgttcctattaatgaatcctctgttctagccagagcttgatggaggggtgtttcccaggtgccaaactgtagggggtgctgaaaaaaattgctggagtaaatatgaagtatggtgctacataactgttttccacattgactccttgaattactgtacaaatgcaaattggtcattcttgttccccccatcaagctagatagtgctgtgaagtgggaaagtttttgttctggctatctccgatttatctctattgagtattttcataacgtgtaagccaccaactcctgacaccaatgtgtgaaatgtcatttaaaatctgcagttgcaggccgggcacagtggctcatgcctgtaatcccagcactttgagagaccaaggtgggcggatcacttgaggtcaggagttcaagaccagcctggccaacatggggaaaccccatctttaataaaaatacaaaaattagcagggtgtggtagcatgtgcctctaattccagctacttaggaggctgaggcacgagaatcactggaacctgggaggcggaggttgcagtgagccaagattgcgtcactgcaccccagcctgggtgggagtgagactctctcaataaataaataaataaataaagtcagcagttgcaatcagctgaaattctagagccaaataatgtataaagctattaatcgttgatgatcagttttgttaattgtatttctaaagtctggtttattgaggtatgatttatatatggtaaaattcaccctttttaggtgtacagtttgatggattttgacaagcatatatggtagtgtaaccatcaccactatcaagatgcagagtatttccattgctgttatttatattttaaatgttctatcatggctcctaagaagtattccagtgtataatattatacataatgaagtccttatttgataattaaaatgtatctgagttttaaatagaaaaaatagtttcttccagcctctgctagatagatggtgaacaaatgtttaaagaaaatcagttttaagggacctgcaaggagtgcccacaggtcttggtccagtcccaggtgccatctatatatgggatataggaagagtagatttgggaggaaggtgatgagtttggttttgggcatgctagaatcaaggagcctgtaggcagggctgataatcaaaattttctaacaaccaacagaacacaggcaggaattagtcaggatggttgcctgctggtcaggacagacaccatcaataaacaaatcggtaaggccgtacctctgcatactgactaaatatcagccctgcccacaggatatccaggtaggaagttggaactgtggagctagaagtcagaagagaagttgggctcaatataatgaattgggctggtgtaattaataattgattgtattggcatgagagggctggggataagtcctgggattgagtcgaggaagatgagtgaggaggagtgaatggaaaggtgagacgagaaccaaaagacgactttgtcccagaaatcaagaaaagagttttaaggatggagtag

SEQ ID NO: 8328 - DNA, 757 bp, artificial
  synthetic oligonucleotide
tccatgattctcatggtgacgcatggaagtattatgccaggaaatccaacaggatacacccggagctgcccagggtcacccgttgccataactataagattaactacaaggtccattatgaatgtactggatgcaaaacgaggtaagactcttctcagacttttcccagttacgttttgctggggcctccaagtggctcttcagtgattttataagtagatggctgtctgaactgaagaggagaacctctctcctcctttccacgttctctttctcctttctcttccgtaatttgagccggcctgaccactgctgccgcttggtgcccgggtctctgacaacccagagaaaagtattgctttgggcccaaggctaacatctcagagctgatgctgaggtgcagtgactgattcttttgttgtgtgttgttccattccttcccaggattggctgctacaccaaatcgttggacaccagccgcttcatctgtgccaaatgcaaggggtctctggtcatggtgccattaactcagaaagatgggacccgtattgtgccccacgtgtgaccatttgctgtgtatgtgcagaagtattatagaaaaattatgcaggagatggctaggattagccttggggatgtgatgaaaacacttggcaggaattacaaggcaatgaagaattcttaaggttatcttagagtatattaatgtgagctatatcctttactggtaagaagttttagaaaagtttgttttgtg

SEQ ID NO: 8329 - DNA, 1771 bp, artificial
  synthetic oligonucleotide
cagttttcagccagactgccccaccaaagcctccaggctagggcctggaattaaatttacacccacatgaggcatacttgcaaggcatcaaggcccttcccctcctgtggacagatgtgactctccttgctctaaacagcttgtcacctgcagggttcaggccagagggaactgagggcctggcagaggtcaggagcagtgccagtggagggagcaggaaggattccagaaaccaggccagttaggatgagcaggacttggccagtagctacctatgggggtggaaaagggttgggagctgggaccacagtctcccagtgctgacctgtgaagaggtttgagttccatgggcttctgcaaatgagaaaattgaccatggaaagccacatttgttccatttaaaggtctgtcttatattcagcaatcatgttatttgtcccctttttttggtatcaaaagggccttttctttatgaaatgatggggaaaatagatggtagttttggaaacatcttgtgatggcagaagttgacaacccaatgtgggtcctctaaatcagcagtccccagcctttttggcaccagggaccggtttcgtggaagacaatttttccacggactggagtggggatggtttcgggatgaaactgttccacctcagatcatcaggcattagattctcataaacaatgcacaacctagatccctcccacgtgcagttcacaacaggatttgtgctctgctgatctgacaggaggcagagctcaggcagtaatgctccctccccctgcagcttacctcctgctgtccagcctggttcctaacaggccacagaccggtatactggtccaccacccatgggctggggagccctgctctaaatagatgttgaaatgttactggtccatgtgaaagataaaagtccaggccgggcacggtggctcatgcctgtaatcccagcactttgggaggccaaggcgggcggatcacccgaggtcgggagtttgagaccagcctgaccaacatggagaaaccctgtctctactaaaaatacaaaaattagccgggtgtggtggtgcatgcccataatcctagctactcgggaggctgagacaggagaattgcttgaacccaggaggcggaggttgtggtaagccgagatcatgccactgcactccagcctgggcaacaagagtgaaactccgtctcaaaaaacaaaacaaaacaagacaaaaaattagccaggctggcacatgcctgtagtcccagctactcaggaggctgaggcaggagaattgcttgaactcaggaggtggaggttgcagtgagctgagatcgtgctactgtactccagcctgggtgacagagtgagactccatctcaaaaaaaaaaaaaaaaaaagacaagaaagaaaaaaaaagaaaaaaaggtaaccctggtgtcctccctggtgtccttccagtctcctcacttgtttgtatcatgtccttcccaggttgctgggaaggacacatgagagaaaggcagggcaagagctttggaaaggagcagagagctttcctttctgagctcggacaccctgataatcagggccgtaccctgatatcagggccgtgtcctgatagcccaagctgggctatgggtctgagctgttcccagtgaggccatgatgttgtgggaagaatgctaaacttgtctgagttccagccctgactccaccctgttcgagctgtgtgactttggacaaattacatagctgagtcgagccagttt

SEQ ID NO: 8330 - DNA, 2302 bp, artificial
  synthetic oligonucleotide
tcttcttcttctaagggcaccagtcttattggattaggcctcaccctcatttaaccttagttacctccctaagggccctgtctccaaatacagtcacatcggaggttaatatttagacgtatgaattttggggaaacacagttcagtccataacaggaactctttgagaatgagatgaaagctctataccctctccctaggagactgcaaacaccacctcccacaactctgcacacaatttcagaaaagttcatggacctcaggttgagaagcactgtttcaggccacctttctgttttcacagatggagaaatggaggttttgtaaggggaagtgattttcagtaggttaggagagagccaggtcttttgattcctcgtctagcgcttgtcctaccttactctgccatctgttgtgcctgtacagaactgcacaatagccagagacaaccatcctgggtgaccccagcacaccacaggtcctctggatggagtaaagacaatagctgctccttcacccaagatgctctcatgggttaatctggctctagctgtaactgacagcaaatgggatgtattgtagtgcttagaactagtcaagaggttgggaagaagctgcaccaactttgatatcaatccacatgaggcctgcgtatgaggagatagagtggtttctgccctgctgaaggacaaaatggagactgcggaggtgcagccttgaactatctggtggccttgacgtggcactgcccctccagctcttagattcctcacttgcacactgaccatgagttggcctgttaaatttctccaagagttcttctagttccaatattctgtacttctatgatcttagagcaggaaccatggagaaaaaaaatcagttgaggtgtttgggtcctagcattatgggcaaaataattttttccctcaaatttcttctaatggtatgatagaattagcaataaagaaaatgtagtctaaagggatgaaaaaggctgggtgtgctgcctcacacctggaattccagcactttggaaggctgaggtaggaggatggcttaagcccaggagttcgaggctggagtgagctatgagcatgtcactgcactccagcctaggtgatagggtgggaccctgtctcaaaaaaaaaaaaaaaaaatgtagttggaaaagatgaaaaatccctaatgagaatctgagaagaccctttacttaagtagtaaagtaaagtttcaacataagtggttccttgatttctgcttctcactcaaccttaagtaagtccttacagttgctggacttctaaataatggaatcagggaatggagtggtacttatcatgaaaattgctatttatctctaggcagaggggtggctcccagaaccagtaatagttttgtgtgtgtgtgtgtgtgtgtgtgtgtgtgtgtgtgtgtgtgttttggagacggggtctcactttgtcatccagtctagagtgcagtggtgatctcggctcactgccaggctctaccttccaggctcaagcgatcctcccacctcagccccacaagtggctgggactacaggcatgtggcaccacacctgtctaatttttttgtatttttcatagagacagggttttgccatgttggccaggctggtcttgaactcctgagctcaagcgatctgcccgccttggcctcccagacaggcatgagccactgagcctggccccagagaatagtttttatttcatttcatcaattgatgaaataaataatcccaacattcgtcctacttgaccctattaatgccataaaccagtgtggagccttcactcaagccaccctcagggagtacaaggctagaaacaaaagcaggggaaactcatcctgggatggaggttgactttttaggaaaatgcctctggctttattcacaacaataaggccccaaagggctgcacagtccagcctgctatctctctgtttgtcagggccccgtgctttgtgtagcacatcagtggtcttagttgggcctgaggagaagaaacaggaagaaaagagttgctggggaaagcagctggcaaggttggcgttaggatggaagtgccaaacaggcaaaggagatgcagcccatcagaaggattgccaacactgcttccattttaattggcacaaatggccctttcaatcccagcagctaacagtagagaagaggagaaactcaaaaggcatgagatcactagctgcctccacttgcatcccagcaaacagcttaaaacggcactgccctcacctggtcaaattcatgtattac

SEQ ID NO: 8331 - DNA, 1350 bp, artificial
  synthetic oligonucleotide
aggtcctggaacttgtcagtgaggaactgcatggccgctgaaagagagaggcagaaatgggcactccagacccagggaaacagaaacccacgccctgccccggtggggaaccacctagccctgcaaccagaaaccccaccagccctgggactgactcatccacgcgtcacctgaattaaatgtagaaatgccttctaagcaggaaagtggttctcaggtgctggggcatcccagaacctttcagaacgtgtttcaaagacagataagccagccagcaagcaaacaccatacaagccctaccaggcttgtagggaaaacacatgaggtatctctaaccgtcgtaagaggagagttctgggactcgtggactaagtgtacatggagttcagacaacacattgctgtctgtgcacacccctagctggaaaggcacagaaggctccagggccaggcctgcttggttctcttccccaaaggaaagtcagtcccagtgatgccgcctgtacctacagtccaccctgcccccggcacctgcagaaagacactgctgtccatccctgccccagccagggctccctcatacctagttggtctctaaggtcctcaatttccctctgcagccggatgcactagtccaggagacaccagaggaagataaatggttagtcaattctggcctcctctctccctgtcctccctgtctcccccaacccttagtagcccccatagcctgcagcccagtggcgaggtgggttggcacagaatcctcaatggaaaggaggcaccctctctccctggggtgcagaaggtggaggcggcgggggtcggggggtatgcagctatcagtttaacctagacacagatcccaccatctagtgtggacctggatttctaggagccacacaaaacattacccgaggacagccctgggctcccgggggctattgctgcctttccggtcttgggggatggacaggtggctgccagtcacctgaaagagaacacaaaatccagcttccaagccgcccagtgaggtggaaaaggcctagcagggtctaaagtgaggcaccatcaccctctgctggcaacatgttgcccctgctctgcccagcatctccaaccctccctctgtgactgtcttccctgttccccagtatgagcccatctgcacctgtggccccctagcgttgtgactccgggttggacaccagcagtggggcagccacagccaggccctcggagggccagtgtggctgagcaggacttaacagaaaagggctcagtactgccgaaagtcttccagagttggagtttggagcgctgctccaaatcgccccccaccacacaaacc

SEQ ID NO: 8332 - DNA, 10913 bp, artificial
  synthetic oligonucleotide
cacattctgctgaaatctcccatagtttccttcataacgccacaagtcttttttcgaagtctcagcctgtgctcagagtcagggtcaaagttcaaacaacgtcaaagtttatttttgaaataaaggtttatttcctcacggaattcttgaagggtttgccccatgtgtgtgaagcattgagactggactgaaaggaatttattttaggaccctgagccgtctttggctcacacgcttactgccctaggagatgattgatggccatgtaagtttccagtccacccttggaggcccagctctggggttacatccctcccactcagcgaagcctctgttgcctctagggcagaagcatgctctttcctctcaaatcttgtagcactgatccactcaatgtacccactctttttttttaactttgcatgcttcattaataatttatctaattctatatgttttgataaattgttaataatcattataaagataaactcaatccacaaatccctctcttttcagagtgtagcattgattagccttgatactgtctgcattgttaattgaattataggctctatctgactgaaaagctggcagttcgatttctttgggctactgggctgcctatctgaggagagagagtttaattgtattcttaactgcagagccatgcatttataccaaaaagggtaaatgacatttaaaaagagagtcgattcaatctagtatttgccaattcttgttaatttctcttggtacagacacttagaaccagagaacagaatgttagagttaggattaatgagcagccttttcatacccccactgcctgtatatatatttttattgagtctcatggcaagagggtgtggggtgaaatatatattcttaaaacttagataaaacacagtgcgaccctgtagttccagctacttgggaggattgcttgagctgggtagttcgagttcagtccaggcaacatagcaagacgttgtccctaaaaccagaaaaaaaaaaaaaaaacttagataaaacaattgactgtagaggaatatcaaagagaaagccaacatctcttcttagccaccaagttgctactatctggcatatttgagaggtagcaacatggaggcagttttcttgtttctcatcctgaaataagactgagggctgtactgggaagctgggtaggttacatgaggtttgctcataaattttcattttgcagctgtggaaactgccagctcaaggaaggagaaatggcatatcctgtgtcacttatttattctttcaagttcatttttattgaaattctaggttcttagcagcagctaggaaggcagattgggagatgggaaggaaagcagaggccttactggtcttgagtggtcaatgctcccatttcctcctgcctctctggctactccttctgtctctgtttctaggtcggatccatacctgattccacaggggcttaggcttaggctcagagtgcaactccaaaatctggtgtcaggatgaactgctgcaggcctggagcatgggagttggtgggtgcgtgggaagcatccagcactttcaggtctggcttggctgtgaagggcctccccttctcttctttgcaccttcattttctctctctccttctgaatgtgaaatgccaaggtttataggcaaatcaaagcaaatgttgaattcacagagcactttctggctacttggctctggagatgtgagcgcaggtggggcgtagcagccttggcctccacatgaaaagttcttaagcacttccttccttgtgtcaggcaatgttctactccagaatccacaacgactctctatagccccttcggctgagttgaatcctttagtaaggctcttcatatcttgctctgcctataatcctccatttattcattcattcattcagcaggcattttcagagtacctgtggtgtacccgtcactgggcttggcactgggcatacagcagtgaacaagacagaagtgattcctgctgccatgcagctaacaatcatgtgggggagacaatattattacaaaggaatattagtattactattaaacaaggatgttcatatcaccctccagtacactgtgccagatactgtgctagagggtgatgtgggagcacaggagaggacactttaccctagctgctttcctgcccagccagcttggctggagcacggtatttcaagaactctaactttccctccacataccagagcctggctccctacgctccttcctctgaggctttctgcatctctgctcacctcttgaacccaaggcagccccttattcgaggtctcacctttcctgttgggaagagactggataagaagcaaggtgacaacttatattcccttggcttcttccatcatacatgcagacccactctagtcctggcaagggaggagggactctgctgtgaagtgactccattgcaaatacttgatgtttccttgacgaaagccagggccatctcattgatgaggctggagtgagagcagactaggctgggggaaagggggtagggccaaagctggtttgcttggaattgggcttgttattatagatctctgaaagattcatcagcatcaggaatcagagtagtgagggaggctcagcgaccaggcccagtccaggcctgctgtgctcaggcagtgaagctctgaccacacagtctccttcaatctgctcgtacctcatttcttcttctccagagcagagatcagtctaaacagctcataggtcaaggaaaagtatccctggagagtccagccaagtccctgcttcctcccagttgctctcttggctcaggtttgagtttgccaaatcgagaatttggggtttttattctgcaactggattttacatttcagaaagggtacaagtcttttgcccatttgttgattcttattttaatcagaacccaacttttctaatatccatgttctaatttactaaacaagaaacaactatatgctgaaaagggaaatcggattacgcttttactttatttttaattgacaaacaattatatgtatttatggggcacgatgtggtttgatgtatatatattaatacattgtggaatgattaaatcaaactagttaacatatccattacctcacatatttaccatttttctgtggtgtgaacatttagaatctattagcaattttgaaatatactagttgtagaaccttcttgaactgcttcagggacaattaattatctgaaggaatgcatgaaaacaggccacgcttagaatcattaatgtagatgcaggtattctgttcaaagtattttactggccagtgtggtggctcatgcctgtaatcccagtgctttgggaggctgaggcaggaggattgcttggggccaaggagtttaaggccagcctgggcaacatagggagattccgtctcttcaaaaaataaaaactaaattagcaggagtggtggcacgtgcctatagccctagctactcaggaggctgagaccggaggatcccctgagcccagagtgaattcaaggctgcagtgagctgtgaccacaccactgcactccagccagggtgacagtggtagatcttgtctcttaaaaaaaaaagtgttttgctaatggattataaaggattataaggatgtgaacatttgtaagaggaaaaatgagaagagaatgaagagaaggaagaaaccgaagtacaccaaagtcaaagaagtgggttagaggagagtcagatgggagctcagtgtgttgaaaataagcgttctgagtggaaaggtcctaagtgcatgaggacatatgctcacgtactctggttttctgaggacaataatgtgccccctcttttctgccttctggaatggagagaaatcaggccgtgaccacagggttgcccgcactgaaagcacatctcggctcctgtaaccctcttcggagagcatcccagcagcccagcctggccagggatagagcctatcccagctggcggaccctaccagaaggaggcgtccctgggctctctttttgcataaactatggagtggcgtccctctatctgaattaagtctattgttccagaaaatgggtttgtttctattcatccactccaatggctttacaatgtccagccactgtgggactccctagagacattgtcttcttgaacagtcgaataagatatttggttttttggtccttatttccaagctcctgggtgctagaaggttgtattcacagcctagtctagcccgtgcgtggcaccgagtacgtttgggaaaggaaatctagatcaataaagtcaaactattcggtcggtcttcgctgattacccgctggtgtgggcgcgggtgtgcttgaatttttttttttttttttgtaattatgaagaaaaagtttaagttaaaaaaaaaagcaaaaaataactttaaccatcagaactgggagtggagctcctcaggaggaccggggcacacattctacaccgtaccttacgtcccccctcacgcagacattccttctttcacgctccagctcgctctttttactcctacttccctttctccctctcccggatcaagcgttaatctgcgaatctctgaccgcaaaagaagaaaaaaaaaaaaggtgggtggggggatcccgaagtagcagagctaggaggaggaggaggagaaaagagaggaggaggaggggggaggaggaggaggagcccggcgaagcagagtcagagggactggtggctccggcgagtgtgcagccccgggggagccggcgctctaggcgaggaacccgtcagcccgcctacccgcccgtcgtctttggcgcccgcacgctctccggcccgcgcccaggggcctgctacacccggagctggggccgccgctcaggggcgctcgggccaggggcgctgctcggggtgagcccgccgcgccgccagactggtcccctgcgcccgcgcccgcggccgggatgccgttctacaggcgcacggtggtaccccagcgcctgtgcccgcgcaacccgccgcagcagctggcggagctccgcgacgtgagccacctggcagcgctcagcctgctccggcagctcgccgacctctgtggccactcgttggctctgctcgaggacctcgaggggcacctgctggccctggggcgccgcacagacagcctgtaccggcgcaccgtgcgcctccgccgccgccttccctgccgcctgcttggcccggaggaggacgaggaagagctaggtaaaaacggcgccccggtggctcgcggccccgcgtctaccccgcctctaggggcgccggtcggcgcttagcgctgtgcccaccctctccccgcctctctccgcccctcccctcccctccattcggggagtgaggggatcccatttccccgacccccgcctccgccccacggtcgccctaccgctggaacttcctgctcttggacccggtcgcgccgtccggagtggccccgtgcccttgggactcccgaccctggggttggtggccgcctcctggggttttggctggggacgcgctgggtccaggacggcttgggcgatactccccctacccgcccacctagccccaggccctcggcgccgtcctcatcgccgcgtcgggagctaaatggccgagccgctggcttctttgctcctgtctaggagctcggccacttcagaaagcgcgccgcagccgaccgcaacctacgcggcggcaggagccggcggtggtgcctacaggctttaaacctgtgcaacttcccgctggagcgtggacgcggctcccactcacaggagtgtctgagcgtcctcccgcttgcttctctccgcacgttttgggccgctgtgctggggagtggccgggaggggggaggggagaatgtccggggctttgctgaccccctacccactaccgctagggtctggctgttatttgctggagagaatcatttaaagaaactatcatcagtttcctgaagcgcattcactttaggaatcagccatgcctgagaaaccaggttccagtggtgccctcactgagcacgcgggacgtgtgagagggtaggggggctacgcgagcccttgtcctttactgttttggatcccagcactttacacggggaatcctctgtctgtggaaatgcagtgcccctgagagtgtgggacttctgctgaaagcaaggggactgagtaggctggaaatgctgactacagctggggcatgccaggtaccagggccaatcggttcctccagaaagctggggagagaaggagcagtgtggccagaaagtttccaatgggggcagaagatgactgctggctgatttctgagtgcaagcttccagctaacttgggaaagaattgcctgggccagcccctcttcattgcagaccccaccccatccccaccccttccagaaggactggagtcaggccctggcacctctcttcataaaggtctctgacctctgaggtagatggcagaggtctctggtggagataaatgaactgagtcctattggaaaagaaaggtggaagccacagatgactgccagatggaatgtagacgttggaccaggagcctctgcatggcaggggctcagttttttgctggggtcccactgattacaggattagtctaggagaaatttgataagtcagcttgaggagtagttttcaaaatccctacacagtttgcagagagccacctactgagttcagtagggtaagttaaggacagttttttcaactctaccttcctgtccactgaattagcaagccctttctgtgggagggaaggcagggcttcaccaagtcacctttgggacctaaccctctccggtgatctgccaggttagaaggagatggctttatgcaatggatagcttgcaatggagaggaacaattgttaagttaaattaccactggtttggcttcttggcagttttcaagagcaggaagagtggccatctctcatccctggtgtggcctcttgcttttgagaatgtacatgtcccacggctcagaggcacccaagggactgctgcataaatggaacacagctaccttctgtaagttggtgaaaaggtctgattttccattttctggtctaatgccctaccctagactccccttgaagttctcagtgcacacttttctcttcaggagctgtaattgggtagcactgaaattaggccttctcagcaatggtctgaacataagtgccaaatgcaaagagagttggggagcgtaatcagtgcaccatctggccactcccttgtcgctcaggcataagcttcaacagggtgtttagcaagccgaatattagattttgaccgtaagtaagtaaataaatgaacattgtcatgtcttgcccttttttcttccctatgcgttttcctcctaggattcccactcccttactgaccattttgctgggggtcagcattttaccctgcatatcctccatctgtctggattgccctcagattcttcctctagctatttattttgaccatggggcaggagaaacctgggaaggtgggaggaaggttggaaagcaacatggccagagtgaatgacagctgacaggccagcagtatatagcctccctgcagtgacaacttggctgccactgactgagtagtggcaagtcagactggcctatagcctgcaggctgggctggggccctgagaagcagcaggggaggacagagagaggaggagcgagatagaggaggagaaagtggatgctgaagaagttgaaggtgcttctctacacaatcacaatcatgggtcatgcccccaccatcttcaaggttacaggggtggactgggctaggctagttgcctcgcaacatcccacccactccactgaaggctgttctttggtaacatgaacccctttgagactgccctaaaagctcttgtaactggtatggtgtgggagatggggatggaaggaggagacggtagaccacaggactgccgaaggcccctgtggttgtggatctgtggcagttgccacaccctaggcatggccctgcctataagttgaggttttccccacatctggttttgaatgtgtcctgttttatggcatctgtggcctgtacactgggttcttcatctaaaaaatggtgtagtcaaagccattgggaaatagctccatgcctgccaccatatgctgagtcaatctaagctttccaacttctcccttggagatctatataatgtttgtaggtgcttagatgataattacaaaagcaatcaggccatccgcgtagggatataatatctcctttgccatcaaggaagtcactgaagggctagataattctaggtatgtttaataacactggaaaactatcatgttacactagctcatgaacttgctgtgggaaagatgttctgttgcttcttacaattattttggcttgaatacagccagttgggtccgtggtgaaaactccctcttcatctttatgtaaaattcctacttcttgattttccaactttatggcaactctggctccaaatcagaaaggacagctggtttatttgtgtttaaatcataattccagtgtgaggatagactgttgtaaatctatacggagatgaaaaaatgaaaaaagcacctccagactgcaatgagtttgccattagatgaggtgttgtggaccctgagtctgaccgtccttgctaatgaagagaagagatggcctcttgagtcagatggagtggggagggtggcaggaatttggggacttggaacaggcactcagccagggcttactttgtctctgtggtacgtttcatcccgaggctcttgggacagagggttgacagagtatggagggagaagcaaacccattttcttttctcttcccaccccaccctgctttccattttctttttaaataccatgaaattcctggtctgcttcatggtatttccatgtgttgaaaacatcttccctggagatttggataccaaaatgtccactagaatttcttccactttagaaacaagacatttaatcttctcttttttaagacacatgaatagctaaagtgataaaagtgtcaggatgttggaatagtagagtaataggagaagattcaagttatggctcttgggctcaaccttgaccttgacgacattgattaggttttaggaggagagtggtatatttacatcatctgttcctgtacctctctggtgtggtaccaacaattcagtcattaaccaccatatgtgtcataacacttgacatcccggacccagaaaggggaaggtacctgtccaaaggcacccagctggatcaagaccttcagtagtcatgagtgctgaaaagattttagtgcctccccatatgtaattccaagtgaaagcaatactaaacctttaaacaaaaatgttactctttttaaatggctcaaagctcacatggatgttgaaattaaaatatcttactagattctttctcccttcctctctgtcttttgtacccctgctgttggtggcctaatcatgtatttaatctgctgatttgggaatgtggtaccggctgggtcacacagcaggtcagtgacaggaggcctccacctagaagccatgccttctgacaaccagactagtgctctgccctctgcagtgatgctaagttcaaagtcagttgttcttcgagagtcattttcttggcattttctctagttggaacttgtccaggatgagaaataactcctgttacctttagtaactgagggcaccctgtggttctgtagttgtggccgggggtgagctgaagctggagaggagaaaggaaggtcaaactttctcatatagagaatatagagaataggtgtgaggcaacaggctctcttgttaaagcaaaacatagtcttctttgaatggaaaattgctccagaaaaaggatcttcaggtgggaaggggtggctggccagtgaccctgacactgttgcaatccctcctgatccctctgccatctttatacctgttcttctcccttgtagctttcaatccagttgtagacactacttgccacacacctgcatcctgactattttctgttattctagtagaggctggttggcatttcagaaggcaccttttattaaaaaccaatgggaacaagaaagtaacattattaccaaaagtgcatttagcatacacatttacagggtatggatttcttatccttcagtgctcaagtagcttaacaggctcactggctttgctgctgtattccctttctgaaggcctcaaatcgtcttttccttagatcattattttctagcctcgaaaagtgggcacaactgcgtctggaccctgtctgacctttgtgctgggtgctaaagacccagaggtgaataagacccaatgtctccattcgaggagctgccaagctgcagaggtaggtgccatctcattcctgaccacatcagcatgtggtgcctgggaatcaggtcttatttaggtggaggagagctgataaccagaaccaggaccctagttcacataccagaagattcttctgctcagtccggtttggcgtccaaagatggaatttggacttttagaattccctatggtaaaaacaaaaataaaaaccaatctgtcattctgttagtgttattgtgaatttagcaatgcttttaaatgaatttgcagttttaaacactataatgttatcttcatgcatatgaagagtagtgcttattcagtccatagacaatgcttggtggatctgcaaactaacagacttcttgtgataactctatggtcctctagagtcctctactgtcagttgggaatcgctggccttcctggttcaagctatcagctct

SEQ ID NO: 8333 - DNA, 3065 bp, artificial
  synthetic oligonucleotide
atgccacaaacaggaggtatgtttattaagtgtacaggtagtttgcagtaaagtgctttgtatgaggtcatgcacaagaccactaggtatcagccagttaacttgggaggtttgagcaattaggcagctcttcctccctcccttcctctctccctcccccctccctccctccctccctccctcctttcctcccttccattcccttcctccctccctctctttctaaaatgtaagctcctcaataagatataagctccttgagggtagtagtctttatctgttttcactgttgtgtctccagctcccaaaacaatgcttggcacctaataggcacttaataaatacctgttagattgaataccttctttctttctttctagctatcgcacactctttgagtacttgactctgggccctgccctgtgctgatttctgggggtacagagtagaactaggatgcaggcccacagtccagtggggagaacagtgagccatagtgctgtggagataaggtctaggctaccggggcaaggcagaggaggcacacctgactcaggacagaggctgagcgaagcttccaggaagatgtgatgtctgagttctgaaggatgatctggagctggccgttgaaggttgaagaaggtgggggaaggaattcctggctcaggaagtagcctgtgcaaagccctggatatgtgagagagctggtgtgggggaggaattcactgccagtgattcaggaggagagggagcaaggcacctcctgactcagaataagcccccagggtggaggtggggtgggaagttcctcacatcctgtttgttcgtcagggagttggatatgagggtcttgagaaggttaaactgcatggttcaaatgaagttgtaatattaactaactgtggattttctttatctacactcaagttttcattatccttgggcagatgagacccaggcaacctcggctccttcatgctttgcagggccaggccctgggcccctctaaaaaggctagacagagcaggaggggctccgagccacagtgagaaagagagagaaagcaagagtctacctgcctgtgtgtccccggctgtgtgtatccagttgcactccaaagctaaatgtattatttatgcccctgcttttctgtgagtggggaaatttgaggcttgacgatatcttttattattatttttctttctgaatagcatagattcttcagaatcgtctgtaattcatcaaggggaaaatcagaattttttttttttttttaaaatggactcaaagaggagatgagtttttaaaaaatatctatcatctgtttttattttgactggaatcatttgcttccgagcacagtgtaattagctgcctgacaatttatagcctgatccccagtaactgaaaaataccaaactcaaattattcccccagactaggaggcccggaggtgattgaggtctccttacgttaacatcctctgtccttgggggctgagggggagggcagttctctgcccttgcaggaggtggtatctccgagttgtcagcaagacaggccttgttgttatacactgagtgtctcctttgactcagtaattccatttccaggattttatgctaaagaaataatcagatattgtggggggaaaaatgtgcagggaacccccactgcattttttggttatttgcattagccagaaaaaggaaaataacttacacattcaataataggggagtggttatataaattttcctaggtctatgtgatagactaatatacagccatgaaaagctatgctctaaatgaattataaggctacatggaaatgcacaaaataatgctgagtaaaaaccaaagataaaatttactactatatacaatatcgtctaaaacagagcacccacacagacacatacacataagaagaaactggagaagcctatgccaaaatgctgacaatgattatctcagggtgatgggattatggggatgagtggtagtattttccttctaccattctgtatttgtcaaaatttccccaatcaacatctattacttttagtaaatagaaaagacaatggatgacatgttaaggaaaaggatctttggatttggaatcgtcagcttccaggtgaagtcccacttgcccagcacctactatctgactctagtgtctctgagccacagttcctcatctgtaaaatggggttaaatactacccagttcacagggttgttgtgaggatccaaaataatgtatgtattaatgaaatgcctggtgcctatgctgcaaccatggacaccatcactaaatactaagaaggtgaaattccacgaagcttgctgaaatccctggatgggggtactgtcaagatgaagttataataagaatgttcctagacagctatgaattgcagccattcttcccttttccagaatatgtaaagaatgtttgtgtgcccacggaggagccgcatctagcctttgaggctgtcagctcatctttcccaacccgaggattttcctttcctctgactcctcccttcattctcccccactgacatctgttcactgcctcgccaaccaagggggaaaacattctttggaactgaagctgaggcaccaccaagagtcaaggcagctatgagatgtttattgtcacagagaatatgtggtgctggctgaccacagaacctgccaggctgggatgccaaggagggactttaatgaagcagcagaggatggatgcaagccgcatagccaggcagtgtcccctgcctttgggcagagctcttgtccaagtgtctcactggctctctgttttcttccccttgggatgtctgcatggctcctggttgagctcaccagttttacagaaccagcctggtttatgggtgaagaaacaccttctcacagaacttatggggcctaagcgtgtttcagtaaagtactgggcagtttgcctgagggcccagcatgcctaactctcaccagcgtggatatgaagcgaggaaaacctgagctcacagccaggcagcctcaaggacataggcacacctc

SEQ ID NO: 8334 - DNA, 2035 bp, artificial
  synthetic oligonucleotide
ctttctgggcatagtaactagataaaggtacttcttcctccatgtgcagtcagacaaggcattgggcttggctgaattgtgtctccaacttgagacccctttgcagggtacccttgtaggaatacaacttgcccaacagtataagtggtcctgtagtgccaggtgccaccaggcaccaggtatacagaaatatgtcagtgatataccctgttcttggataatttataggacagcccctctaaatccccactggctttaactcgccccatctgctgccagctccacccctcctgcgtccctgctggcagagctactctctatggtgatgaaacatccaccctccagatgcccaggctgcaggctgttgtttgacgtggctgtgctgctcctgtctggggatccaggctaaatgtctgctttccacaatgaacagccagagttactggttaattgtggtggctcattgcttctgggttctagatgggaaaacatggaaatcatttaacacttcactatggctttaaaacttttctgtgttctgtttaaatgggctttgaaatggtgagttttggtgtagctgagatatttctgccctttaattttcctgttctttaataaaggaaagcagtttatctttaatctggtgatttagagctgactctgaggggtaattcctaccccactcattgtactataactttgccaggctttttgccaggtattggtgataccaaagtgaaaagacttaccttttgctcttcagtcttagcatttagttggggagacagtatggaagaagacaactttgctgcagacctcgctacagaccctttcacatagggtccaatgtgaaaagcacagagtactgaggcagggaaggttttcatagcattttcctctcgtgtcttccggaaaactcttattcattcctccagatttctattcaggcattccttcctgtttacggccctctctgactcccttcactatgttcctgctatacttttttcactatgttcctccaggtagcctaccctatgggtaggaggcagagactgccagtatgtattgaccatttttgaattcatgtttatttccttcttttaccacctcttgaaaagtaatatgaccctcttctttagaacttgaaagaacaccctggccatcccttggcctaagataaactggaagctagaagttagaggtctcttcctaggagaattaaagcccatcttaaaggttgtgaggatttggaaacagagtagaactattgaggccttctgatcccaatacatttagatgaatataaagagttccttctagctcaagggaaatcagagttacattaggtggttgtaggctagtgacgggcctttgagagtagaaagagccctgattatgaacttggcttactttgctaattttgcccaatgtaagcccaattccagtatttgctaatggaggtaatttttggtgttgagcctctgttttctgtttgtcaggaggatcaaatgaaagcctgtatgggaaaaggctttgtaaacaaaaaatcaccccccctccccaaatgttatgtattatcatcttttagggcaaggatagtggctgactcattcctttttcttcaaaatctagtttggaagtaggcacactgtgaatgtttgttgaatgattaactggcctagtaagagatgagtttttgtgtttctttaaagctctgcatgttatctaataaatccgctatattagttaatgcctacccttagcttttttggtaatttttgccattaccaatactgtgaacctcgtaacacccaagaggtggttattgactcctagatattttgcctgcaataggatataccagtgccaaattgacagtggtgtctgggctgatgcctcttgtcttaagagcttaggtttcccaccagactcctcaagggttgtattttattcctgtctgttttcccccactgccctggtatgcagtaagtgctcaatacatattttctgagtgactaacagagagagggag

SEQ ID NO: 8335 - DNA, 1363 bp, artificial
  synthetic oligonucleotide
tgacttagtcgtgggggaccaagaaaatccttcctggagaaatcaataattaggaaggtgcctgagttggaggagatgtatgggaagagtattccaggcagcaagaacatcgttctcaaaggcgagaaaggaggatgcttttaaggaactgcaaggagacgaatttgatgacctacaagcacaagagaaagagcagcatgagatgagggcgagctgcctgagggggaccaattctacagggtctgtgggccaccgaagcaaagaagtaacatgatctgattttgatttcaaaatgctcactctggctgctgtgctgagaatggactggagaggggtgtgcaagatcagtgccagttaagaggatattaccgtagtccgagagagagatgagggagggctagatgaaggtggcgatggcaaccctgcagaggaggtggacagattcacagatgcaagagaaatggaggaggtttcagagtcagtccttggttcttgaggcctatgtgatggtgttggcaggggtggtcttcaccaaaataaagagtacatgagtgtaggtggctttggaggaatcattgttactgagtttgagatgccttccagatattattaagttatctgatcctcactccaaatcatccctatgagaaaggtgtaagactcttctcttcattttgcagatgaggaaactgagtaccagagaggttatcatggtttgcccagtgctggcctgccaataagtggcaaagccagaccagaatcctgttattctaagaacaacccttgtgctttttcttttccatgacaccagagctgactccctagaaaggcccatcccaaatagtttccaataataagtgaagatcactactaggacttctcccacagacaccaagtgtttcccagccctccacacctatgctcccagggaagcattggcctcctttttacagaattcatctctacagcattgctaccaagcccctccaggagtgtttagatcttccaagtatctgatttgtaaacctggatttgttgtttgtgcacagagagctacactgcctcttttcccagtgagagtcgccctgtccaaaagccttcctttttctctactgttagagacaagggtcacctgtcagtagtcaatgtatggaaagctgaaatgctgagacattgagccagaagatggatgacagaaagactaataatagatgacatgtcaaggtgcacttaacttttttttttttttatgttcaagtagaggactgtgaggagaaggaattgaacaggtggcaggaaatggggtgaaatgaaaaactaggagaaagtaaaacaaatacataaattcgaggagtaggaaaaa

SEQ ID NO: 8336 - DNA, 1107 bp, artificial
  synthetic oligonucleotide
gctctgaagccaacctgtctggattttgaattccagatctgccactgattggctgtgtgaccttggacaagttccttaacctctctgtgtctcagtttccttacctaaaacgagaatattaacactaccttccttttaatgattaagtgaaataatatatataaaatgctttgaactgtatctggagcatagaaaatgttcgataaatgttagctattataggcaacaaggaagaggaacaggcttcataggaatgatgatgagttcagttctgagcatgtcaaatttaggttgtctgtgggacactcaagtgcaaattggttatatggatctgaggctcaggagatatttggctagaaatataaatttgagagttatcagtttatagatggtaattgagaccttggaagactgtgcagggagaatttgtagagtgggaagaaaagaaggcctaggagcaagacctgagaaccctcaacatttgtggacagaggtaaaagagcctaacgaggaagctgagcagcaaccagagaggagggagaaaaatcaggagagaacacagcatcatagaagccaagctacaagaaagtttcaagatagaggcagtggccaatggttgcagtgctttggagaggtcagtataaaagaagatctgataaacaacaatgggagttagctacgagaaattgttggtgagactagtttcgtggagtggtagaactgtatgtcagactacattgggttgaagagtgggagtgaggaaatggagacagcaagtgtaaacaactctttccagaagtttgtctgtgaaaaggaagggtgagcagatgattgcaggttatgggagaagagagggcatgcttcagtgctgatggagaagaggctgacagtagagagggaaagatgggagacacaggtgagggaggggacaattgaggcttgaagtccctgagatggtgggaggagatggaactcgcagagtgcaggccaggttggaagtgttaatcttggttgggaggagtcataagagggaaggcagaaagtatggatgtggtgagtgaatgtgcagatttggttgtgggaagttgctgcctggtggctttctct

SEQ ID NO: 8337 - DNA, 2268 bp, artificial
  synthetic oligonucleotide
aataaataccggttgaattgaattgctgacactgttgtgttgaggcagtttggcccaggcaggcaaataagcccaggatttgcagtcttggcctgtgtggctttgggcaagctatttcatttttctgagcctcagtttcttcatgtgtaaaatgggaataatgacacctatatcccaggggttgtgagcatgtgcaagtggtttggtaaactccaagtgctgcccaaattagtgtgtggggtgcatcacatgcgctctaagctaggcttttagttatccaattatcatctaggtctgcagttcccaaatgcaaatcagcactcatccttcgtaaagtttttactcttctgaattaaaaaatgatgatgtaggccaggcacggtggctcacgcctgtaatcccagcactttgggaggccgaggtgggtggatcacgaggtcagaagttcgagaccagcctgaccaatatggtgaaaccccgtctgtactaaaactacaaaaattagtcgggcatggaggcacgcacctgtagtcccagctactcgggaggctgaggcagaagaatcgcttgaacctgggaggtggaggttgcagtgagccgagatcatgccactgcactccagcctgggcgacacagcaagactctgtcaaaaaaaaaaaaaatgtagttttgtttttttttttttgagacaagttctctgtcacacaggctgaagtgcagtggcatgatcatggccactaatttttgtactttttttttgtagagatggggtttcgccatgttgcccaggctggtctcaaattcctgagctcaagtagtcctcccacctcggcctctcaaagtgctgggattacaagcatgagccaccgtgcccggccgatgtagtttttatgaagccaaatttgttcagttttttaaattctaaaattgtcattccaattgtttgatgttaaaacatcattttgttgtttatgacatcttggttttagtatatggcagtttttaaaattaaaaaatgctcttacttgatcaaataaaatgttggcacagctatgccagatcccccaacaagaaaagtagcatagaggggctgatagagaggaacctgggctgggcgtgggtgagaaggcatttgaggtgggcttcctgaaggcaagggggcctgaggagagttaagaagggtgaataggagaacattcagcaacaaagggtgggaaagacacaagctggagagctgggccaggatgagtccagacaacctctagaaatctgtgaagtctgggccgccacccagcaggtgagcacctctgagcttccctgtggagtgttagggtcggggagtgagccgatttgtcccagacccgcctggctcacacacggggatgaaaaagtccaggtcactgcattggacagccactgagctcccccaccacagcccaaaggggtgccttgcggtccgtccaggcaattgctgccacactctgcatcaaacccccaactccccgtctgactttgcctatcctccacctcctctcctactctggcagcttcagtaaagcaggaatcactcagctctgtgtgtgggaaagcacagagcccacagcgcaaacatacaggctcatcggaaactcgaaatcccccctctgccttccacataccaagccacacacaaggagtggcagtggggtagaggctggttcctttctccagaatgccacagggctggcctgaggttgtggtgggggaagcacttccccctggccagctgtatgacctctggattccccagaccacacggttggcagcaggaggcccctggcggctgggagcgccagacccatccgctggggcagagagtatgaccacctgagcatgcgctttcgcattccaagtggtgggtctggattatccatttcttggttttctccagacctctgctccatccatcagagtatttttttttccacctggaatcctttggccagtgggtgcagccataagtttgtccagccaggggcatacgccaggtgcctgccgagctgtccatctggcccaggcaagaggcaaaggataacttccagaaaaagagaaagcccatgagggcagggcagaaggcaaggctaaggagtggaagtaacagtcccaatgcccagcccaaagacctaagcctggccaacaatactcggcaggcatccctcgctccctgtttagggcaggttgccatggtattttgcctgctggtgcactgggactggaaaaaaagcagag

SEQ ID NO: 8338 - DNA, 937 bp, artificial
  synthetic oligonucleotide
aggcatctttgtttcccactaggcctagcccacacgtctcaaaaagcacttattgaactggggaggcaaaaaacaaagtcaattctttgacctggaagctcatctgagtccatgtatgtctcctctgggagctgtgagaggagggaaaatgacagaggatggggtggggagggtaggatggctgtagagggaagtgatgggaagctttcgaatgacttaaattgacttttttttttttttagttttcattcaattctgaccacatgtttcccatgaatccttagggagaaggaagtcagaaagttagtccttcgcctctccctggctcgccctggagtaccacatggatgagccaaagagcaggacagcctgaggaacttgcctcgtgggcctcacgctctgtagcaactcagaggcagagagaagctcctgggaggccccatatgtgacagcttctaaggaagctgcttgtggtgcatccatgaaacagggtggaacaactgctgattttgaacaacaaagctacttggaggccacattagactcagaccctgctcaacatttgggttctccccaccccgctcttcttttacattattgaggtaaaattggcattcactaaatggcacatatttgaagtatacaggttgatgagtttgatcatatgtatgcacctgtgaaaccattactacaatcaagataatgaatatttccatcacccctaaaagtttccccttattgatcacctttaatctttcttcatagcctaagtaagggaagaacatggttttattgttgatgggttattcttatgttagaaaactatcaggagcagtggccttggggacctgagtccaacttaaccctctgtgagcctcagtttgtccatcaataaaatgggatagttggacaaaaaaattgctaaggtttcctgtca

SEQ ID NO: 8339 - DNA, 648 bp, artificial
  synthetic oligonucleotide
catttttatcaagatatcactctttaaatctctgttgggagcacaacctctctcctcccacagcttcccagcacacctgcagtatggtctcttggcttttgcccaaacatttgtattttagacactgcttctccacaccccacacttgtctctccgtctctctcttcctttcccctctctccccatcagtaaatgctttcaattgcttctctaaagagcctataccccgtgataccctcctttccttgaccttagacccttcttattatgacaattattatctccaggcccattccctgccccttcccctggctgttttctctcctcctcctgttggctctgagcttgctttctttatagtgatggtactttttttctctcccaaactagctccttcctcatcaccattcctcccagcatcctggtttgcagcagtcaggtgaaagagagaagcaggtcccggagggtcttggggcatgtccctctctgtctcagggagaaagctgctgctggccctaccactagtatcctgtgagaataacagcccagtgctgccagaacctataggtcttcaagagaagatagaaactccagattttaatgtaaactgtctcacttttaaatgttgaaaactattctttttttccc

SEQ ID NO: 8340 - DNA, 1784 bp, artificial
  synthetic oligonucleotide
tgcagctcttgggcccaaagggcctgcaaacatgttttgttggttggcacattaacgtgattttgaatgcctttctggaaagcgtgtgtgctgtggttccccactcttctcccattttcttacacctccccacctcccttattttcattagctgcttggtgcctaaaggcatttacatttgtgactcttggattaggtggtgtttactcacctttcaactctggcgtggctggaattctctgtttgacctgctttgaaatgaaaattgcaagtgctttgcttaagtgattcccagtgtcatctaatatacagcagtcaggccagactaactttgccttcccaaaacaggccaccaaagaacagtggaatatgccgttagtatttctgactttggcagtcagctgcagagggagattttattccattgaaaataattgtctttacatagcccagcacaagtggtgcccatttatagactagaaaggaccaagcacagcgtgcctattggcagccagctgggcctatacagagggcactggttgcaggcacaaagtgtgaatttagcccaagttgcctagcccagtcctttccagaacaaagtgctgaatgaggggtgtgtgctagaagcatttctctctctctgtctctctatgtctctctgtgtgtctttctctttctctctctctctctctctctctctctctctctgtctttggctgtcagtggcctagtttgcactaagactccatagagatacgcacagagggcagggaagatcaaggaggcattctcatcactgggttcctttgcattagccaggcccaagggccacatgagttgcagatctgcctggccacaggcaggcaaggcacagctcactgggagatgctagacaaacacagcagctgctggaaggcacttgcgtagtctggacagcaactgagtcccacacatttgggcagcatctgggtgaaaggtactgggaggtgggcagagagggctggtgtgggtgtatgtgcccatcactgggcatagtcaggcactgggtcaaagtggaagcactgatgacctgtggagccaaatggctgcagtcactgggtgtatgtagagcctgggtgtccccaaaatcagtgtggagggcgtagaggggctattcagttagggacacataataacatatccacctgtatgtagcagttgtaggcatctgagatagtgggtggggtggggaggtgaggaaggaaaaggggagaagaaagactgtttctgactaagctgtttcatgtgtccagaacaactgcagggagcttcctgggggaaaaagattgactatgtatctttgtctccctgtttctgccctttcctgctctgctgcttaggaactcagggagacaaagccctagtactgtttgtcaaagtcaaatagaatggataaagcaaactttccaaagaaactttatggaacacatttcaaagccctggagaagcaattttagggttttttgttttgtttctttctgtttttggttttctttgcatgactgccactaacttatgtcagcaaggcgttaagtgagacacttaagatcattgcggctgccaggggaagtgggtacacccgcttgtggggctgtaagacagcacagtcgctgaagggcattagagctgggctgggttgggctaggctgtggctgggactgaagaccgtgaacacagcgggacatgatgtggtgttggtatgactgtgggtgtgctgtgtgttatgtacatgtttgtgacagcac

SEQ ID NO: 8341 - DNA, 2566 bp, artificial
  synthetic oligonucleotide
gggaagaaaaacccacaaagagctaagaacgtgccagtggggaggccttacagcctccctcgtgcagccttactctatgtggatctgctaagtctgacagtctccagcaaggggctggggagtcacagcacagctagtgctctcctggcccaagatgtgccaaaggccacctccaggaccactgccctccacacgtcctctgaactccctggcccagtctctttactgcccccataacacaatgtgcttctaccaagaatgataggaattcaaatttatcgaagtctttgaaagtttgccaagcactttcccatagctctccaggaggcagaatagcctactggttaggaacacaggctcagggcccatactgcctggctctgccattccactgctgtgcgatcttgggtaagttacttagcctctgtgcctcaggttcctcatctttaaaatgggaataatcacaggatctacatcttaaggctgttttcagattaagttggctaatgtttaggctccctaaaagcagagatttttgtcttttattcattgccatgtccctagggcctaaacaatccctggcacctggcaggtactcaacagatatttattaaatatatataaagggcttaggatgggagctggcacttagcacaacaagtgttagtttttgttgttatcttttgcattctcacaatagttccaacaggagcattctgaatttcatgcatgttagtgttgctcctccttgtaaggttcaagttctaagtcaaggtactgaaggaatatgcaacagacttaaaatggagggcaaaagtttgggccacagaggattaggagtacagctgtcaaatattagtaaaagcattcgttcatccattcattcagtcatctattctacaaatatttcacaaatactcctaagggccaggccctgagctgagagctggggatgtattgaagacaagatagacaagggtttctacatttgaggagcttaacttgtaatggaaggagactagcaaaaacaagtaaagatctaaaaagcacttattagcacttattcagatagcaataagtgttatgaagaaaatcaagtagtataatgggatagagaatggctggggttgtgtatgtgttggggttgctttagtttatggtcagagaaggcatctgaggtaggaacactggcacttttctggggcgtcttggtctcaggtcaaggacctctgttgagagttggcctgtgacaccatatcatcaccacctcatccttctgcctaaggcaggggtaagctgctcagtgtagttctggggatctttacgtggaggtttagtgtgaagggctggagagaagggggctatgaacatgtggcgcctgcataggaaggttctggcattagttgtcctctggcaaaacctattggttgctctaggttaaacgatggtcagtggcctttcagctcccccttcatctttctgcactctcagggaggaggtgtctggccgtggggtcctctccactgctgatctatactcaatgccctcatgccccatgctcattcatgacaccaccttcacacatgcaaacactgcctcatctttcaagatagctcagacaccatcaccagtcacactggagggcccttattcattacctgtttgagcatctccagagcatagtatggaatggatacctaataggtgcttaataaatgaaggaataaatgagtgactgttgttccttctgcttcctcagctgactggctcattcccactcatgcatcaagactcagctcacacatcatcttacatgagaagcctccctcaacctccttgtgtctgacctggggagctcttgttcatccttgatgttccccttgacttcctcagccagaatttggccctcccacctctgaatgctccaccacattctattaccctctatcgtatccatcgctctacaggcactgtctgctactgtcctgtcacctcccctaatctctgattttctcaggcaaggactgtgttttggtcatctctatatccccagcactagcccctagagggcgctcaataaatatttgtgaaattaatggggaaaaaaccgtgaatgaattgtttgtcaattttgcttagagtggtgtgctggggctggcttgtagtggtttgcgagaatcaattgttaaatatttaggaaacgtatgagccagttgttaaatacagccatcattaaaaattaaattatatgagaaaacagaagacaaactgaaattgagagacattctacaaaataaatgaccaactaaatacaatatgggtcctggattggatcctagaatggaagaaagacttcagtagaaaagctggtgaactccaaataagtttgtactttagttaatgttgtactaagtttaatttctcagttttgatcaatgttttataattatgtaagatgtcaacataaggggaagctgggtaaagggtacacagaaactctctgtactgtttttacaactcttctataagtctaaaattatttcaacatttaaaaaaaaattgtcaa

SEQ ID NO: 8342 - DNA, 606 bp, artificial
  synthetic oligonucleotide
tactattgttgcttggggtgagtcaattctttgcagggtgggattctgtgcattgcaggatgtttaacctcatgattccctgactctaaaggccagtagttccccggagtcattttgaacaaccagagatgcctctagacatttccaaatacttccaggggacaggagagtgcagccctggttgagggccactgtggaggaacttgacaatggggcgtgaagcaaggcaacctccaaggtgtgaatgtgttgagtcctctgagttcacttataaattggtggtttagaactggggaatcacgtttgctttatagagatgtaagatgattcatcagtggctggattaggcccagaagcccataatgtagctgagttacatggttctaccagactgggttagtgctgaggggcaggcatcgagatggcaatttcggacatgttgatgagatgattacttgaaaatgtccagaaagtaactagaatctgatcccaggggcaagtgagaggtcagctctcaagatataaatttgggataagcccacgttgaggtaggagttagacctgaggcccaggttccattaaggttatccagggagaaggtgttgg

SEQ ID NO: 8343 - DNA, 1461 bp, artificial
  synthetic oligonucleotide
tgtctacttctgtgccaatgccacaccctgttaattactgtagatttgataccttgtataatgtcatccttcatttgttcttttccccaaaaaaattgttttggctcttcttatacatattctttttcacatggattttagaatcagtttgtcaggttctgtgaaaaattcctctggagatttgattgaaatagcaatgagattatagattaatttagggagacatcttttctccttttctccacacaactttttctccttcagaaagaccactggggcctgcacgaaagatgttcaggggtcaaagaacccacataacccatccccaacacacacacacacaaacacacacacagagacacacacatttgtgtctgtgtatttgtgaggacctacacttcaggctctgagggtaaatatttattataaacagaggctctggacacttgctctgctgttcagtggtacttccaaagtaggggcaactcttccttttcctgatcacaaacaaaccaacccaccaaaactctggcttgattacataccttgttgaacttcacagaagggagtgaagagtggaccaagtagagaagcagcatatggtaacattaggagccagtggggctgtgctgttttatccaggagagcccagggtgacagcaagttatcatgaatggtggaggatgggaagtaccagaaattaggagtggcccctgttccatgctggtgtctgtgggttggggtcctgtggaactaggaaacaacccaccccagaagggtgcactcattcatcatgcccctctatataggggaagacgggctgggtagcagggcctattgggcctgaatgttctggatagaccaaattgtgggttcagaggaagttctagctacctttgggtccactgctgacataatactctccagttctgtggagattttgtctttgtggggtgctgacacctggatacattacccttctacaatacagccatgctacctgcccagtggtgtgtcccttcaatgttgccagctggcagcaggtgctcgcagccagctgcacaggtgttgatgcctggcctcaaggtgggactgccagagcagctcaagcttcccactcaggtgctccagcaaattgtaggcccagaaagacattcagtagcgtgaggcagccttggagttaagctggagccctccagacttttcccaaggaggaagtaggggctggcttaggggttctgtggtatgtgcagatgctgtctgggcaagcagcactgccctcacctgtgttccagctaacaggatggacactgcacccagatatctgcgttctccccctacaaggtcatggtcctcaaggcaggaatggggtctgagccaccagcactactctatggacctaactgtctaacaaagctggcaaaatattactcagatagaaggcagaatcaattgtagtag

SEQ ID NO: 8344 - DNA, 1796 bp, artificial
  synthetic oligonucleotide
tgtgcacagaggggcaggatggccacttaaccgagatcctctgaagggaattcataatcggatggctttggaagacagggtggatgtgatcacatcccaaccctgatattctgggatcctaaaggattaataaaagtgatggaggaattctgcacgtgtgtgtgtgtgtgtgtgtgtgtgtgtgtgtaagaattactgcacctcttacttcctctactcttgtcccagattctgaggccttgtcccttcggtggtagaaaattccatctcattcaatccatctcattcaatcttggggctttatttgcctcctggactcctgctaaaatgctgaatttatttttgcaataccaaggcatgtaggcaaggagaggcaggaaaggggttcctgtcactggtcttctgtacacacaggttgctaccaagggaccaagagctttctaattgcagttcaagccagacctcctggcagtaaggcagaagcaagtacagggccctgtgccacactaggacccctctctggcttctgtgaagaagactagccacgtggtggtgggggagggggcgcgtgatgccacagtgacatgcccttgaaaatgtctggaagctactgcttgtggaggtagctggcaggacagactgagtccatgctgtgtctctggagttttagttggccctttgcatcaggcgtatgctcaaaagcagtttatgagctaaagtggtgacgggaccaaaaccgaagtcccatgaggaccacgtgctgtttggcatggagaagaatcagaggaaagtgatctttggtcttcaggtctttgagggactgtcactggatgatgggagtagatgcggtctgcgtggggcctcaggaggcaaagctgaggtctgtagacaaggaggaactttccaacagaccctccatgggtgcagtggcctgccttgaaaaggagccaagggtcttggtaacttttgcaggttacttttttcacagagacacagagtgagccctagagaagaagggcatgtaggagcgagctttctgcttctgagggagagagaatgggaaggaggggccaccctcacctgggatgaaggcccaacacccccctgacctccaccttcacaacttctcacctggtttggcctccctcatctctctccctcctatggggctccctgcttccactctccagcccattctccactctgcagcatgagcgagcctttaaaaaacagacgcagctgctcaaaatcctgtgatggcctcccatggcccactggtgaaagtccggatttatttctcttctctattgcctcctttctactctctaaaaacagagctgagataagatcgtttctcactctaacacagctctgacatttcataaatctttgtcctagacaactggaaagggctatatttaaccttccgtcctgtagcttttaatggagggacttgcttcaggcactgccttctaatgccacaggagaccagagtttttctttgttctctaccagcagagccgcgacctcgacagacagaggccacagctggcctctccctccagtgagacgcacaagttgcttggccaggcatcggccctagagcatccaccttcccctgtctctaggtgaaggaggtccctgtcccaccctgtgaagtgtgacccttcaactttcttatctgcatatacttgaaagactcctcattaaccccatagctgagataagtgggccaggtgagcacaagaataggtcagacagggcctggaggtatgggcttgggagtctgggctagg

SEQ ID NO: 8345 - DNA, 4010 bp, artificial
  synthetic oligonucleotide
tcaccctaacactgggacctgcctgcctgtccatcatggagctctaagtatacttgaaccacatgtgaggagtaattggggcaaattttagattcaaccctggatttggcaatgccctttaccatgagcccaccattgcaacgcagggtgcagtaaagcaagagcattgcaaagctctttctgaaaccagaattttgccataatgcctcctgctaacagtgttgcctgattagcagacacaatgggaccatcaggccttatcagcaccacttggtctaaaacagaaaccaggaagggctgtctctcagtgcttggcccctgttgccatggcccctgttgccatggttcccaagcacttttgcttatgatttctctcaatcgcttatagcatccatcagcaagcaggacctagaagctctttcgggcagactgagaagaaagctgtaaacaggaaagataagagcaagtaagggaagtaattaaacgagcaaacaagaaatgtagatggaaagaatttggggtgaggcccagaaaacagcttttgttatgtaaaagaaatcttcttgagatgtgatagaccaaggtgtctgggtcagaatttgccaagaagtgcccattatgtagctgccatgtggtataggtacagcaactctgtgccctggattttccagaaaagtcccagtttcaagtattttattctgtttgtcagaccaagaattctgatttgagattcagaaaataaggtcactgtagttagagtagtcatccaggaaagcctgatttagaatccattgtcctcccgggctggttggcagggaatccccacaggacttgcctctagggccctgaaggcctgagtaaagtagccccttatacagccaagaaatatcaaagtgcctctcaactccatgccctccacactcccgtagctctctgaggggtttagccagaaaggcatgggcttttgacccccatagacctggatttcaatatgctctgcattaactctgccaacataggcaatgctctgagcctcaatttcctcatctgcaaaatgagagcaataacacagggttatgacagggttattctgagcatcaaatgaagtttttgttacctttaaagcactgtacaaatgtgcactgctaaaatccattccttcattcaacaaataagtgtctactacatgccaggcatgaggccaggcctgagattacagtggtcatcaaaacagacagggttcctgctggcaccctgagctttcaggtcacaggggtagacatattagccaaagatctcctcatccgaggtccaagcagaagggagatgcagtagggctgctcttttaaaaagctgactgtggctgcttcgtagagccagagggcaggagagggggctgggaggccacttaggagacttctgcctgcaatagtggcttggtctagggtggtggcagtgctgatggtaagaaatggccagattctggacagatttggtaagtagaatcaacggaacttggtgacggactaacttttgggagtgaggaagaggcaaggagatattttagctaactgtgtccccaggacttgggccactggagcccataaagccaatcccaaggctggtgaggtacaatgtatggagggtccatttctccttatctcgcctctgtagagcagtatgatgtcagtccttcagtccagaaatcagcttgctagacttaatctgaaaaaagcatttagtacttaaaaattgtataggataatatatggcattctagctttatgttgaacgcagaattcctcttaaaggtaaattgtttgcttccaatttttaagttgttttaaaattgacaaatgtaattatttgtacatatacatggggtatacagataatgtatagtgatcagatcagggtaattagcatacccattatctcaaacatttatcatttctttgtgttgggaacattcagtatcctccttctagctatttgaaactatatattatcatttgggttttttaattctttcttcttttagagactgggtctcactgtgttgcccaggctggactcaaactcctgggctcacgcgatcgtcctgcctcagcctcccgagtagctgggactacaagcacatgccaccatgcctagaaatgatacgtgatttttaactatagtcatcctgcaatggcatagaacactagaactttttcctcctccccagctgtaattttgtataatttaacaaatctcttcctagccctccaatttttgaatgggatattactttaaaaatagctgagttaccattaacttaggatgctgaaaacgttcttcagtctaggtgatctcttctgggaccaacatatgttctttgaattggattcctttcaaaccttgggcccagtagtttttgtaccaacaggttggaagagaagagggcccaaaaggggaagaaatgggaagggccacagacaaacttaagtttcataacagttaaccacacttaaccgcagttaactatgctttacagcttccaggggaatttcacatatatcatttgttgtcatattctgcaaattcaggaccatggctgtctcctgactccccgtccagtgttcctgctactgattgcactgccaggttcttaactttttgggggagaagggggaggggaaggtctctctgtgataaacaaaaaagttccaacagacattcaaaacccttctttattctaaagaatttattccatttgcattgagaaggagtgtaaaagaaaatttggtattttcccacaccacttgtcccctacacacatcaacaggtctttcatttctcagttcttgcagacccacccttcggaagctattatctgcttgacagtctgctgagacctcttgtctttcttcctctctcaattaaactctaaggactgaggttcccatctgccctggagcaaacacatctcttgttatacctgttttccagaagctggagagcttttttcctttctccaaccgctatagttctcttttcaaaacacttaaaccctcttagtgatttttaactgcaggtggcaattaaattggtttcccaaacatggaccaaaccttctctccagtgcctcctgcatttaccctgcctccacccacccttgaaccaggaaagaaaaaaacacacagacacaatttactgagttattgtcctctcttctgtgtagccctctcttaacatgaatgtggcaaaattgctaggaagaaatggtaggatgtatttccactaggtaggtctctttctccacagcggccatctttgattattgtgtctggaatcgagcagtacccaaccaacatggtgcccttcctcaggctcttccttggcgggaagacagaggcagcagttgagcaaggggagccaacagaagtggaatggctcctcattcatagacccttgtgggttttgaaggagagaggaaagagaaggtttggaaagaataggacagaaagggaggaataagaaagaggaagttggccgggcgcggtggctcacgcctgtaatcccagcactttgggaagccgagacgggtggatcacgaggtcaggagaccgagaccatcctggctaacacggtgaaaccccgtctctactaaaaatacaaaaaaattagccgggcgtggtggcgggcgcctgtagtcccagctactcagctggctgaggcaggagaatggcgtgaacccgggagacggagcttgcagtgagcgaagattgcgccactgcaccccagcctgggtgacagagcaagactccgtctcaaaaaaaaaaaaaaaagaaagagagaagaagttgaaaggggtgtttacaagtggaggaatagaaataaagctatgaattgaataatagaaactctgatttttaaaattttattttatttattttttattttaatagttttatgttacgtaaaccattatatgttatttttaaatatatgaaaataaatatatttaa

SEQ ID NO: 8346 - DNA, 1466 bp, artificial
  synthetic oligonucleotide
ccccattaccaggccgaggagtggaacaccagcattccttttcccttcctactgctgcctcctccagccctgcagcctagaaactctcagtggtatcagactcctgaagcaccaggcaacagcccagcttctttctgcttggtcacacaagctgtggcctcccaaatcatgcctgggctaggaagacagagcagtgtcacaggaaatctaagtcccatgcacatggtgatctcaccccagcctctactgcttcagccccctcctgaggctggccaaagcgtagaagccctgctgattaagcctcttccctgaatgttggcagcctaggctctgcactaacttagcacctagtgcagagcctgtcacgtgcatgggagctacccagtagcattctcttggacggataaatgcatgggtgaattaacatgctttggatattgtctttgttgtacctcctcagggctcccaaagccttaaaactagaacttgtcacctcatcactttagaaccttctatttgcaggcatctatgcacctgctgatctctcccactaagaaaaggtgacaagagaaaccagccaggggattcctgagggtagtctaggagtctcgaagccttgcagtggtcttccaggctgaatcatcctacctcgagaaccaagagcatgagagttggcatcagacagacttagttcaagtctcaaccctgctatttcctgtatatataatcttagtcaaaagtcatttcaccactcttaagatttagtactctactctgtaaaatggggctaaaaatacctacccagcattatggtgaggaataaatgagaaaatgtgttaggttgaatcctatgaaactgtccaaagcatttaaatgccagcaaatttgtatggttcaacctaatatataaagtagcctttataaactataaagtataataaatagccctatataagtattcattattcttaacagatataatttgtaagtcacagaatattgtttcttgcagtattagtaatccctttcatcagaatacaggtcaaactaacagaagaagccacttatctgacaatcgtgggctgcaggcatttcctggagcattttggcctgggaaatagggagcaggtatttttaggaaactagactggttcatggaaagcaatggaggtgaacaccagggtgactcgtgacagctcctacctggaaatgattaacccgcaaaagcacagtaggagttggcacattctcttgccccagatgggagtacccactccctagctccagtagcaaagcagaggctgcctaggacaaacattccttcccgggggacagagccaaagggtcctaggccagcagacatctggaggaaactaaaaacagcttcttgccaacttttccctccctagtggcagctatcaagcccaggtagctcctcttgacctagcaaagtcccacgcctggga

SEQ ID NO: 8347 - DNA, 2788 bp, artificial
  synthetic oligonucleotide
cccacatcgtctgctccagagccttcgctctgctgcctgggggcgggaccagaagagtggtcactgagcacagagaccttctgcacacagagcagcctgagcaaactgcagcaggctagtagtgtgtgcatcccacacatttctccagtgagcatctagacgtgaaatcccgaggccttggatgggctttctagttccagaaatttgaggacatgcgggtccggcagggaagaaggaaacgctgagcccaggttgccggcactgtaggcagtgaaggagagcagtcaggtcacaccacacagttcccttccccgccccagaccatagaccctccaacagctttcaggtatgtcgagcatcaaaccccaattcctgaccgcagcccataagactctgaagtaatatggcccctgaccacctctgtgacatcttttcttgccatgctcccctcatacatcgcacatacactggctcctttcagtcatccttttccaccccagggcctttgcatttgctgtttcccctgccaagtgtgctctttttctctttgtgcggctggttccttcttatcattcagatctcctctgctttagtgtgaactccgtgagggcatggactgtgtctgtcctgttcactgttgtattccccaagcttatgggcccagtacacagaaagggctaagtatttgttgaatgaatgagctattttggtacctgctgtgtgtcaggcactttacaaacattaattcgtttaatcttcaaaacaaccctgtgaattaagtgtgattgttattcccattttatagatgaggcactgggaggtgacttgacttgcccaaggtcacagggcttaggaagaaacagagctggaactggaacttgactcttgacttatgctggcccccctaaacacattgctccaaagtgtgcattcaggcaggttttgttgttgtttgtttgtttgtttgggagacagagtctcatactgtcgcctgggattgagtgcaatggcgcgatctcggctcactgcaacctccgcctcccaggttcaagccattctcctgcctcagcctcccaagaagctgggattacaggtggcaccaccatgcctggctaatttttgtatttttagtagagacggggtttcactatgttggccaggctggtctcgaactcctgacctcatgatccgcccgcctcagcctcccaaagtgctgggattacaggcatgagccacctcacctggcccaggcagggtcttcattgagaaaggctggggctctgtccttccgtgtgctgctttatatggctaacttaaacttccccagaaaggaattgaagcaattctggtggcctctcagctggggttgttaaacaccctggttgttccaccttttcattcttatttattaaaaactccacagagttagagaagttcttcagaaagcaaagcagagttctctgctcaatgagaaagtcaccccattccagtaggagatgcagccaaaacccacaggacggggcatcaccccaaggatgccgggaacagaggggtgaagtgcttttctctggtcccatattttctccaccagcttcttagttgcctagatccttgctgctcaaagtgaggtatgaagaccagcagcagcagcagcatcacctacgagagtgttaagaaatacagaatctcagcacacacacccccgctccacctactgcgacagaacccgcgttttaacaacatccccaggggatttggtgattcatgtgcaaaaaaagtttgagaagcactggcctagaagacagcctctgagaatgacctcctcatcaccagactgggagctccctaaggacagggactgtatctcgttgtgtcctcaaggtcccctgcacagtaccagccacctagtaggtactcagtcgtgtttcttgaatgagtaaatttatgaaggaatctagtcacatacagccagcttaggcacagatagaatcatttactatgcatgtttgcaaccctttcccctgccgtgaccccctccagcaagctttccaacaaagaaacccaaccccagccccgggacactccttctagcctgtggtctcaagagggaggcccagcaacagggagttggtttctgtaggccctagactttggacaggacgctgaacggcttgtcccctccttgtttcttccatcctcccacctaaaaaaaaaaaaaaaaaaaaaaaaaaaacccaaagaggaacttctaaggtgcccacactgtttattgctctctttactgaggccatggcctcctcagcacacacggccaccacagtccctttcccacatctcaaatggccccctggaaattcgagttcctcccaaagtgcagaaggtgctgtcaggtgctggctaccaagcccttgctgcatgtggaaccaaaataaacccctgttgatatggaaacgggttgaattattttaagaaaaaaaaattgctccttcattaaatcgcgttgttatggcaaccggaattaggaaagtaacttggccatggaggttatgtgcaatgttttgggactgagaattttcagaatagtggaaaacagtttgtgagtgcatctccctgccccggactctgcctggaagaggaggatgaaggccagttgagcatctggccggccaccctacctgggtggacttgtgcagggtggctgggggctgctctcaggggccgagcctgcagtgatgcaggctgaggccataaaggtttatgtgggaaagacagctaactgggcggagga

SEQ ID NO: 8348 - DNA, 3361 bp, artificial
  synthetic oligonucleotide
tctggaattctgcaggtcttcttcaggttctgcaggtctgaaactccctgaagtcctggtcagcaaatggggcaggtatggcagcaatagcaggggcgggggatgcaaaagaagggtgtgttctgggtggccatctggccccagcactcaaactcgaattcggccacgagcagctcggtggcccccctgtctcggagtgaggcggaaaagcacaggggggcgtcttcgaacttggcgttgtcctaaacgacctgtgcggcgaatcagttggggggagctgtagaatggtgaattggtgcctggaaggccttccagaagtgggactcgattctggttcctccgtctgctaggctgtattatgggaggtgatgcacccaggaagttttcggcgtggtaaccacttgtggggccagaagtctgggatgacgcgtgaacaaaggtcggctccatctccatcagctcatctaggtcatcatcttgggcctcatccagtggctcctcctccacctcaccataggtctcctcagtccctggatcctgctgtggctctccttctggtttctggcccccatcctcatcttcatcttcttcatccttactctctccttcctcctcattcttgttccttatctcctcctcctcctctttctgtttcatttcctcttcctcctcctcctccttctcttccttcttcttcatttcttcctccttcttcatctcctcctcctccttctccttcatctcttgctgaaaagccctcatgcgcttcctctggtccttggagtgaagcctgtgcctgcgtgcctcttggtcttcatcttcactgtagtactcttcatcttcactttcttcctcattgggactcggagcaaaagggaagatgatatttcgaactccagggagcgggataggcttgggaacgcgcacttttctttctatctccacacattcgagaatcagctcatccaggtcggccatttctgttgaccataagagctctttgcggaagaattccgacaggcctttgaggaattggttttggaggcggcagtcatcccaagacaagaattgggccaggaactgaaaagcatctgcatagctgccgagggtacagtggccctgcttgagcttgcgaatggcctttttagccacacgtggggggatggggccacagaattccttacggatttcatccaggaagcgcgggaagttggcatgcaaggggcttccttcctgggtgaccgagatggcccagtccttggcttcgccagtgaaaaaggagatcagaaaggccacccgctcggcgcccccggggaaatgaacctcatggtcggctatgaaggtctctagctgcatcaggaattcagccaggtagactgggtctcctgaaaagggctctatctcaggccgctccagcggtgccagagggggttgcgggggcggttcctttgacgcgggcggaggcagcgccggcgggggcgggatgggcagcagaggggggtcagcgggcccgtcgggggtgctgcgatcctggatcacgttaatcaaaagatcatccgagatacagtcgggctccgcgcgtgggggaggccggcacaagaagggcagttctcccccgggaatgacttcgatctcactgagcgcgaactccaagttctcctccgcaaggacgggcactatgggtactggccagcggatgtagctggagacattgccccgcaaggaattaacctcggccagggctctcccgagctggaggcccaaattggcattctccccgcgaagggcatttaattcttcgcgcagggccacattcgccatgcggaggctgttgagatttcctgacgcctcagacatctcgacaagcccaggggccctggggctccgtggtggggaaaggggaactggaactacgggcggccggaggaggccgaaatgcggcggcggggctcgggagggaccgaagtgcggcagcggggcacgggccaggccgggccacacccaccggggcgagctcggagggcggcgctctgggcggagggcccggcggctcggcccagggcgcgttacctcgtcgccggggccggagagggcgggcggaggcacggggcccggaggcgccaggcggaggatgcgggcgacacggtggcggcggcgaccgcgcgaccgggcgggcgggcgggcaggggcgagcggagcgggagggagcggactgcggcaggatctgtcgaggaaaaatcttgcggccggcgattccccgccttttaagcgcagcctcgcactccccccaccccacgcaggggcgggccttggggaaccgcgggcgcccactggccgccgcgcgccgctcccctccagctcgcctgcgcctctcactgactctctccttccctagctgcagctaactcgggtcgggaaaatgcgacagcgactgcccactcgaggtcgtcatggcgacagccagtgaacgtgttcctctcctcgggcaggcccccgagtgtagaggagctgcttcgggaggcgcagctcaatctccagagcctgttgcaaggtaccgagagggaggggggctgcggccggagcccagaagcgagatgcgcagcggcaggagggaggcaaagaagaaagaggacagggaccagcaagataaagacagagagtttaaaaacaatcgacaaagcagtttccagctttcacctttcagcctaatgattctgaaagaggctatttccagggctgtttccccccatccccagccccttttttcagctcagtagcccatggggaaacaaggacagagactgaggcagggccataagttatgccattcaccgagagctgggtgggagactcccacaatgtgggcctacattccctccagcccccctcttgccacatcgcccatgcctttgggatcctggcaccagaagacaaagggggcatctgcaggatctcccactctgggcttcactcactctgctcttgcaataacccctggatagctactgcctcaccaaagtaagcccaatacacagcacccagaggtcacctattttgtcccccctaaccaagcctgagcttctcgatgtaaagaatcacatcttgctacccttaggtttccagaagcacctggcacaaggctggattccctccccacctgccaagaggtgctcagtggatgttgagcatgaaaagaggtcttgtcagcactcctttatctatactaataaaggttaactctaatggcgaatagaaaactgctgatgggccaccaacaggatgacagccataacccccaccccctaccagggcagtggtgaccttggaaaagcaagatgccaagggacaccatgagccttgt

SEQ ID NO: 8349 - DNA, 4444 bp, artificial
  synthetic oligonucleotide
gtagcccagctggctgtggctctgggggcatgtggcacactataccatgctcactattaatccatgatctacactccatcagctgtaaggggaagagaaggagggccagtcatttgagaaggagatagggccagcgacatgatgaaaccatgatctcagtaacctaaagggatcagaggggtcctgtgagccagcgccagcctgtgctctgctgggaaatgttgatgaagatgatgaggacagctctggccacatgtggcaatgctccctggatatggggtcctccactgtcactggcatcatttcagaaaatcagaggcaggaaatacagcccacagcctagggaaatataccaaaaggagtgagggctgatgaggaaagactccagaagtgatgttgaacattttgtgtctaaatgtctatcttggccaggcacagtggctcacgcctgtaattccagcactttgggaggctgaggtgggtggatcctttgagctcaggaattcaagaccagcttgggcaacatggtgaaaccccatctctaccaaaaatacaaaaaaatagccaggcgtggtggcgcacacctgtggccctagctactcgggaggctgagatgtgaggattgcttgaccccaggagtcagagattgcagtgagccgagatcacaccactgcactccagcctgggtgacagtgagactttgtctctaaataaataaataaatgtctgtcttcctctcaatgaggctgtccctgagcattgcccacagagccacttgctgaggtgtctgtgaacgtgtgcagctgtgtggctggctgaatgagagaaagggagggggaatcacagacctcgccccaccaccctgccttgccttgactctgacccagccatttcccagcacccaaagactgacctagcactttaagagaaatacagctctaaaaaatttttttaataatattaagtaaggcatattattgaggaaatattccattttaattgtgttgaatttgaaaacattatcaagtcagtaaacaaactgaattaacagatattttgaaagtaccatgtaactcagatgaagtgataactataatctgtgtcaataattttcctaaattgaaaagccagtgccaggaaaaaaagagagagagagaaagagaaagaaatagagctcaatcaccatgctgtgagccagctttggtaaaatgtgaccaggtgactgtaggacagactatcaggcatcttcctggatggtggagggcagtagggcagcctcttggagacactggcctcacctggcccatataaaggccttctctgagaaaagatcacagtcaagcagcatctagtcccagtccgctgctctacaccagtggttctcacccctggctgtacctctgaataatcacttgaagacttctagaaaatgcttctacctgagccctactcccagagatttcagtgttctggggtaaggtccaggtgttgcagtttcaaaagctgcccagttgagtttaatatgtagcccagggttgaaaaccactgccccaggccacctaaaacttacaggcaacctgggtgcagcctgggaaacccagcatgcattcccagggccaagttgggaaggatgaggaagaagtgccacctgccttggatgctattcatgcttatcacgactgccatcattctcttctctcaggccaatttccaccgtgctttaaacagaaaccaggatgcacccaagtgtctttattttggctacagggcagcagtttgataaacatgcaagtttgcgacactcgttgtttaacacagagacagccgtgaaccccaagtccaccctgaggcggaggcggaccattattggattctctaacttttcccagcgagaccaaggtgaccccaccacagctgattccccagtcccttccccttacccactcctgccaatcctgccacccaggtggtactgtggtgatggggaacaggaataattgggtggaggagggggcctccggatgtcctgaaaaagccaatatggtaattaagaatagctaagggcctcttgtcaagggtggcaactgaatatggagagtaggtcttccgggctaatgaatccattacattattgtttcccattataaatgtaatacaaccagatatgccaaatttaggcaaatagatgaagagagagggttcctcaccatcatcttaacagaaccattactaccattaagtgaatgctggccaggagcacagaccagggagatagcagagggtaagagccctggtctttccgcttactaaccaggagaccttggccaagtgacataacctctctgagcctcagcttcttcatctataaagtggggataatgatactgacatggtggaattagcatgaagattagcgttattgtatgtaacttgcctaccatgtgcctggtacatagtcagtgtccaataaatggtggctattgttacaaattctcatagcagtagtagttataataataataataatgacatgacagtattaattgtttgtgtgtatgagaaaacctttggggatttggaacatccaaacggtttcctcacatccgtagattatcctcagcctcttatgttgcaaagcctaaaagtgatgggtgcgaacaatgcaaccagactcttagctttgcatcttgggcatgctccagagtcattgctggagccaaacgtcacaccatgccgtccttagttcggaagcctctactctcatctctagatggatgaatgctgaggtctgtgatggtttcatgagcctggggtgaaagtatggggaaaatgcaaggtaatcccacgtgacacttcagctctaagaggaataatcaaagctggaaagtatttggcagccatctggaccattcaagggcaccgtatgtctcactgtggggtgatgggcaaggacccaatttccccagcatcttcatccatggaagggaagaaccaaggaattctgaccaagctgttggcaaatgcttcttggcaaaaagttggtgctcctgtctcaaaacagctggtgggagatcccttgctgtagcactcatgtcctgtgtttatttcctccaggtcacagcaacagcccagcaggcagtgtggcccactctaccacctccgacatcaggcccagtcactcagttccagaaggggttcatggaagagttgcagttggtcaggatgctcggttcccaagtctcacctcgccagtactgagaactccttccagtgagccggacgaacctcaccaggcacggagtggcccaaaccctcctggcatggagagcatgggaatggtgtacagtgtccccagttcttgcaatggacctacagaatcaaccttctccacttcctggaagggagatgcttttacctacatgactccaagtgccaccagccagagcaatcaagtcaatgaaaatgggaaaaatccttcctgtgggaattcttgggtctctctaaacaaagtcccacctctggttcctaaggaggctgctaccctccttgtcgctcgtgataacccagcaggatgcagtgggtcagctggctaccctgagcgccttattcagcaaaggcacatgcccgaaagaccctccaagattggccttctgaccagtgggacctcgaggctggagacaggccccggtggggccagcagattccgggagcggtcactgtctgtgcccacagactcaggcaccacagatgtggactatgatgaggagcagaaggccaatgaggcctgtgccctgccttttgccagtacgagctctgagggcagtaacagtgctgacaacattgcctcccttagtgcccagcaagaggcccagcacagaaggcagaggtccaagagtatctcacttaggaaggccaaaaagaagccttccccacccacacgcagtgtctcactggtcaaagatgagccaggcctcttgcctgaaggtgggtcagcactacccaaggaccagaggcccaagagcctttgcctctccttggaacatcaaggacatcactcgtcccacccagatgctcagggtcacccagctattccaaaccacaaagatccagaaagtacacaattctcccaccactggtatcttactgactggaagtctggtgacacctaccaatccctgtccagctccagcactgccactggcaccacagtcattgagtgcacccaagttcagggcagctcagagtctcttgcctcaccttccacctccagagccactacaccttcccaactctccattgaagtggaggccagggagatatcatccccgggaaggccccctggactgatgtcaccctccagtggctactccagccagtcggaaacaccaacacccactgtttccatgtccctgaccctgggccacttaccccctccaagcagcag

SEQ ID NO: 8350 - DNA, 1202 bp, artificial
  synthetic oligonucleotide
acagtccagcaccctcatcagttctctggtttaggtccagatctgatgggactggtcaagaaggggatggtgggggctcctgaagcatttgccctttcttgcctcttgagaccttctttccattggcaattcaaaacaggctgacatacagagggctagcactctaatttgatgtggactcagccactcagacctaggtctcaggctgcagcttatcctagctcagcaaattgcttcttagaatctttagcttgatttctgtcatttgagcccagggatctacccacttactgaaatctaaattttaaaaaatcagtgatgaaagtaattttcaggatttccctatttaaaagcatccatgaaacagttcctttatgccttctgtttaggatttccagaattaggaagggaaaccaggcttgtgccttggatccaaaagcagcaaaaatactacacttgccaaaagcaaactgaggaatgagcattggccagtcctagtatgcagtcaagaggtggacttttgttaagttagcccttaccatttagtgcttactgaatgccaacaatgcacttagaaaaataagggagacaagaatttacagaccataccctaaactggaaggtacaggaaagacacatctcctagagctgggaatgtgtccctaacatttcaagaagaagcagaaagtaggagagatcacgatctcagtctttttaggattccaacacaaaatggaagggagccctctgtggggtgatattacaaagggtttttcttgtctttctttaaaaaaaaaaaggcattccttactggcttgctaccagcaattgaactgtattctttatatagctagagctgtttgtgtcttcttaaaataaactttttctgttaaaatcattttctgtttcaccctctggttttcattgtagcaatgatacttttattcagacactcagcccagttttgagcatgtttaaccatccacacgagtatggggcccacacacattggctttgatgctcacgaacctgagagctcaaaacagctatgtggcacagaatgtcctgcagaaacctggcccactgagccatgggcctaaaggcaggtaacccatgttctgggacttcatttcagggatttgagtccagctgttcatggagtcaacaagggggagtgagcagccatcaccaggcctgagggg

SEQ ID NO: 8351 - DNA, 1315 bp, artificial
  synthetic oligonucleotide
agtcactgaagggtcttaactgggagagtcacagtatcagttctgtgtttctaagagctccctctgagatgccgcagaaggtagtttgaagagaaggtgaaactggcagcagagggatcaatgttccgatggtctagagaatatgcagaaggctatggcagtggcggggagggcaggggacaagccagaggtaattagtgactcctagttaacattatgacaactgaagtgtttagggatggagtgtgctgatgtctgtaacttgctttgaaatgcaacaaaaataagaaaaattgatgggtgaatatgtgataaagcaaatctagcaaaatgttcactgttcaccataaaattatggggggcagggagaagtgttgtttaggaggcagaatccactgaacatggagaccagtgcccaaggctgaggatgcagaagacctcttccccagcagctcccctcttccttgtctacagtaccctgcccactgtcccccacccatactatgttccttctccttgcctctgtgcttctgcagcctggaaggtccagcaccgcaggcagaggagagcacattccaggttactcataataacatactgatgcataaaccaaagcttatttatgtcccatgttgggggtataacttgaccctgtggcctcttgcacagtgtccctaaatgcctcaaggtccctggagggctgatttggtgaacatgctctcagaaaaaagagaactggatgttcttagatttcatttaggggatggcaaagcctggagtagcatggcatcatggagagggtaccaacttggaagtcagacagacgagttcgttgcccaaccttaccacagaccctagctagctgtgaaacttggggcacatttcttaacttctctgaccctatttcttcagctttaaggtggtaatagagctgggtggggtgggtcacacctgtaatcctagaactttgggaggccgaggcaggcggatcacttgaggtcaggagtttgagaccagcctggtcaacatggtgaaaccttgtctctactaaaactacaaaaattagccaggcatcgtagcaggcaccagtagtcccagctactcgggaggtggaggcaggagaattgcttgaatctaggaggcggaggttgcagtgagccgagattgtgccactgcactccatcctgggtgacagggcgaaactctgtctcgaaaaaataaaaataaaaaaagatggcaatagtaatattttccaaataaggctgttgtgaactctaaaagagatcacgaagggaaagctcctggctcatagtac

SEQ ID NO: 8352 - DNA, 1859 bp, artificial
  synthetic oligonucleotide
tctctgtatcccctagacttagggcttgataagctgaaaagaatcaagaagggcttgattaattaaggctcctctggcttttaaggagaccatactggagggtcatttgcccaaaagaagaggcatcggggtctcctcaggttttagaaatctggtcaaacatccagagctgactcccacaccctactgcgagaagagcgcgagcgcgcgtctcaaaaggctccgcctcaacagttcgggtccccaggaggatccgggggccaccccacctccaccctgggccaggtcggttagctagacccgcccagcggtccagacataccttaggtaatgagcagcctgctctgggctcaaggcctcggcttccggaaaccttcgggatgcctccatgaccctcggattgggttccagttaccccggcgggagtttggagcttggagcttggagcttggagcttggagcttagagtttggagcttgaatttcgctcactcccgccccgcgcatgctctgtgcgccgtggagagggacacagccaaccgacggcctcgcggccggccaatccgcgaccacgcgctgcgacgcctccgcctgagccccgcccatgacggtgggcgcctgcgcctacgcgcgccgggaagcagaaggtgatctctgccttcgagacacggagtgtgctgcctcagtctgtgatccctcgcgtttcaatccaattcaaaccatgctgcagccaattcgttcgcgcgtgcgtgtgccatcattgtgagtggaggagactgcccgatatgatcccagtcattgcggcgacccctggagatctccaacgcctgcgtcccccaaccataccctgccccgcatccacagatatcttcccttccttgatcgccagtacctggcactgaccgtgctttgaattcaaacaccctgggaggcatagtccctgtgatttaaactaacattgaagaagcgaccagacgcggtggttcacgcctgtaatcccagcactttgggagaccggggcgggcggatcacgtgaggtcaggagttcgagaccaacctggctaaaatggtgacaccccgtctctactaaaaatacaaaaaattagccgggcgtggtggcgggcgcccgcagtcccagctactcgggtggctgaggcacgagaatcgcttggacccaggaggtggaggttgcagtgagccgggattgcaccactgcactccagcctgggtggcaaagcgagactccatctcaaaaaaaaaaaaaaaaaaaaaaaaggctgggtgcagtgcctcacgcctgttatcctagccttttgggaggctaaggtgggaggatcacttgcacttaggagttcgagaccagcctgggcaacatggtgagactcccgtctctttaaaaaaaatttttttcttctccacagggcgttatgctgtatttattttcttaaaaagagagagagaaagagagaagggtcttcaagaatctcaaaccctggaggtggaggctgcagtgagccaagatcatgccactgcactccagcctgggtgacagagaaagactccatctcaaaaaaaaaaaaaaaattaaagttcttatttaagaaataagtaactaggttcacatacttggtataataaaaggaagacaaaaataatttaaaaaaaaagaagtagtgctgtggtcatcatttcttcagaagcaccaactaagatacagtcattttcaaatgcagagcctaaaaagaaggcagagcctagagcttaaggaaatgtgattgagtttaagtggcttgcttgggtgacactaaataggaggttgtgggccaacaaaaattgtccttgttcatatactgttaagaa

SEQ ID NO: 8353 - DNA, 150 bp, artificial
  synthetic oligonucleotide
aaaatagcaggaaactgaattaaaaaaaaaaacaacccacaaaaccaaaatgctattaatcctgccacaatatttttaattacgtacaaagatctgacatgtcacccagggacccatttcacccactgctctgtttggccgccagtcttt

SEQ ID NO: 8354 - DNA, 1635 bp, artificial
  synthetic oligonucleotide
tatctgcttagaggttagggtctttcaagaacaccatactagtgaaacgcacagcaacagaaatgagccaggagtctacctgtgtttctaaagttttcacaatttattaccgtctgtttttgacacgtatggaacaagattctgacatccgcacaaacacatgtgctgctccttcgtacactaaagccaaaagctgacaccaattttactttaaaaagagtaaggaagcctttttaatgctgtgtccagatgcttaccggccacgtatggtaaagtcaggccgtgccaaaaaggcaatgacaaagaaaacctttctccgccgggcacccccagcgcccaccaacctcgggctcgcagtctgagctcctggcccagccgcggctccggcccgggaggaaaagcagcttctcccgggatcaggacgtatggccgggtcagaaaccgaggccttcccaacagcagcaccagatctgcgcctccccaaccctaggccagcgttcgcccttcgccctggagcccgtcccggcctaccacggaggccgtgatcccttcgcctctgcccggccatccccagtaggaatcccgaaacctcgggcagccccggccgggggaggatggaggcggatacgtcctaagagctcgctaactaaacggcttaccatggctgcgttaggcaaggaaagaggacctccgtcttccggtgcgcgtagaaattggggctggagactgcgcgcgccggattttcagctgctccgcccagctcagccctttgctggcgcgccgggactctttcttgccatctgctggtgggaggtcagaagtcccgagttgaggaaccgccgcggaaagagggtgtctcctaagggcgatttcctccctcccctttttccgcccttcctcctcccatatttgctgagcgcctcttgtgtgccttattctgtgctaggtgctgggaatacaaagatgagctacacaacatccctggcctcaaggagagttcaaagtgagcttacttccagtctcacgtacagatgattctacgcctgtaatcccagcactttgggaggccgaggcgggcggatcatgaggtcaggagatcgagaccatcctggctaacacagtgaaaccccgtctatactaaaaaaaaatacaaaaaaattagccgggcatagtggcgggcgcctgtagtcccagctactcgggaagctgaggcaggagaatggcgtgaaccccggaggtggagcttgcagtgagccgagatcgcgccactgcactccagcctgggcgacagagcgagactccgtctcaaaaacaaaacaaaacaaaacaaaacaaagaacttgtatataatcaatagaatacattttaataaatatttaatgttatttcttaaacgtattttgtctgtcccttttttgtgttcccttgagccagccaggcagcccatactgagttgggaagagccaacaacgtttttaaccccctcttgcttctctgcttgaactctgacatcctcccccttgcttcctgtacaacgcatttggcacttatagagactcagggaggagagaggatattagaaatcgtctggttatatctaactaaaatgtagatctgatcctgcttcgaaactgc

SEQ ID NO: 8355 - DNA, 1193 bp, artificial
  synthetic oligonucleotide
cctctggttctgtgggctcgtggtcccctcagtcagggtaaatccctcattcttgccccagaggcttgtgttcaaacttggtgagggcacacagcacattaggtagcaaggacaaatttagttacctggcctccaccaaactgagcacctccaggatggagcctgccctaattcatctgggcaggccccttgccactgaacagagagctcggcactgtgtccagcacttgataaatacttgttgaatgaataaacggagtcagcatcccacttattgtgccaagtcctactgtactatccctgagagcatccagcctgtgcctgaattcttcccaccatgagatcaagctcctaactcatgaggttccatttcacaagtctctatctgtaccatccactttacccctcagcagtctgcagaggagcaagagagggaaacattgttggctcttctcaagcagacagtattaaccaagcagacagtattaactaagagggcaggaactcctccttgtctaaaactgggatacaatccacaataaagcatgttataagtgattattggaaaggatcgattaattggaggtgaggagtagagagaaggtgaaggtgatgagataatggaagttggttctgaggtttttaatctgagagcactgggaagatggtggtacaattaacagaaatggtggagaagttgctgtgggagtggggggataaccatgtgctttccagctagagaggataggagaaatggctggttagagctgcagatctcacttaatcaagatcacacagcccgtttggggatgaggggacttgtctcttgcctcccaggtgagtggtttgtttttatgccataggttatcaaaggacttgaggaaatcaaagcatctttttcagtatatttctctctctcaatttgtatttatgcacaaatgacattctaacaacaataaaggaaatttggaaagagctaagtaaatcgcaaacagtacctccccaaacaccctaaacacatcatctgtattcatttgttcctcttcctgttctctttctgatcggcttgtgtgcatgcatacttttacataattttagtcctagcatacagaccattttgtattctgtttttattatattagaaacactttccaagttgctgcataatcctcataattactactttaacagct

SEQ ID NO: 8356 - DNA, 864 bp, artificial
  synthetic oligonucleotide
ttagcaggtagttaccctacttagcatgtaggttctggtctactttagtgggccagtgacagtttagtcattggccaatgacagtttagttttctgagcccatgcaatgttactttggtcggcttgatttttctgctattcctggggtttctgctcaatccttgctggttctgtctacaggggcagaaggtccttccttctttgagctgcatatttttggtgggtgatcttccaggggagagagttgctgaagccactgtgtgtgagtctccttatgccattgggtggagggaaaggagacacagggctttgttcctgctacctatgcaggcaaattgggttgcctgctggtaccccagttctggagggagccactgagacagcccaggactttgcttgctgctacaagtagattggaccactttctgggggctttagttgtggagcagggcttagatctccccactaggtgtgtgtctggcttcatctttccccgtcctttgtgtgtgcatgcgtgcatgcttgcacgtgtgtgtgcgtgcgtgcatgtgtgtgtgtgtgtatgactgttggttttaggttgcatgcctctttggcacccagtctaggagtatacaggagataaaaagaaaactgaggaagctcaccatgtcctgaagttcctgacctgtctgtcttctttcctgctttcagtgtccttttatcattgcttattgaataatttctagggtatagagttgcatttgaaggagaggagcagtcattttgttccagaatcagaagcccctagtgtagttttaaattacatttcttgtagtgtgagtgaggttgagcatcttttgataagtttttaaaccattttaa

SEQ ID NO: 8357 - DNA, 14308 bp, artificial
  synthetic oligonucleotide
tctctccaccccaagggctactgccatcctgggggtcccagagcttatactcatagagattaggggtggcaagctggggatcaggcgctgaatgcagcctcctgacctgtttagtttggccagaagtgcgttttttgaaggccccagcaggggagggaccctgggatcctctagcctttcagagttcggctccatccacatcctgtcattctgctttagctgccatgcctgtgtccacactgcccttgtgttgctaggagctgtgcagattctgagaccctccttcacctcccttcctagctcccccaatcttgcccatgtgcaatagatagatagggccgaagaaggatcctatgacctgggaagtcaggtccctccttcctctcccttcctagctcccccaatccagttcctgtgttctcctcagagacccaaggccctcaagcctgctctgctctccccaccttcttccagccttcgtttcttccttttccgttttcctacccttgcctcatcagccccctcaaaaccccatgtctccctgttcccagccttagatgaatctaaccatctacctttattgaaatcatcttaaaaacaagatgttaaaagttggttaattatttgctttcctacaaacctccagagattcttccagagccacaggactggtggcactaaggcgaaggcttgtttccagaaggccctatggactctgccttttgtgaacttctccaacctcatctcctcccgtcccctctgccagccctgtgacatagcctgcatgctgaactcctggttttcagccactgtcacccctctcatgcacctgtgcctgtttaacagctgttcccctcactcattcttcccttggctgattcaagtcttatttcgaaagccaaaactttcttctggtggatctacctttatgtaaggacagagagcaaggccagcaaggatgcaccacaaacagataaacagttgctacctccgtggagaaccagaggcaatcaggattgagggggagatttggtcaaagggtactttagccttatctgcaaagcttctactttttacaaggagattggataatggatttattgcttgtgaaatatgaaaacaaataaagcagttcaatacaaggagccttccccagacttcccaggcagatggagctgtttccttttctgggattgaatagcaccttccccctctgttctaggaaatgctgttttattataatttgtttgtgcctgtctttctccttctgagatgaggaactccctcaaaggtaaacttcatctaattcatgctcccagtgtctagcaaagtgcctggcccagagcaggtgctcagggagtgctgaatccaatcaacgcccctgctagcacactcttttgaaagtgcttgctagggggcaggcctgatgctagtcctgagaggctgattagagtcgttttcagcattcaaggaagaaggctgtctgggagtccgaaacatggacagagtgtccaggacattgggttgtatcaacatgaggacaaggctttatcagtgtatcacaaggccaggatccagtgcagtgccactgccttgccacttggcatgcttctgaagccactgcttcctcagcagttaattgaaaggcaagggatagatcgccaaatgttgaacttgtcaagcctagttctgatctgtatctctaagatggagaggccagctcaaacagggtgggtcaggaaggtaggagttagggacactcaagaccagctcagagtgtcccaggctgggaggactgagcagctatgtgaggaacctggagaaggcacctcaaaccccagtttaatgatgggagtctcttgcttttgcaattttccagagaaatctgagctcccaggtcacaggatccttcttcagccctatctatctattgcacatgggcaagagggcaaaggaaaggccttaatgggtcagttggattggggctagagagtgggtgggggtggcttttacagttggtgaagtgtgtgccacgtggccaggaatgtgcctttagacttggatgtgcatgtagcaaggaggctgcacaaaggtctgatcagtctctcttccaagaaagcccccaaccagcccctgtatgccatggtgttcctggagtcttagggcaatgagaccaggtactcctgaggagatagccacagtggtgctggcagcaggaattcagtgaacagcccccttcaccctcccttctccttccatcccatccagctccttcccagctagccactcacaaccccgccatgggcctcagaattgctaaagggacatcagaccatactacacatcattagatctcaatgaagaacacctctagttggcccgtctctttgtaagtaactttatttttatttacaacagaattggtggctttattcctccatctttagggacacttggcattagcagctagatggaaagtccgcagtgaagtcaaactcattctgccccagccacagctccggaagctcattggctcggtccaaccccagttccaccaccagcgacatcagcacttcctcatccactgggtccgaatcgatgatagcagggctctgggcaccagcagaaggagagagtgattctgcccctcccgcctgggccccaaagtcccagttttgcaggggtcctgcctccccgggttggcctggagtggcagcagccatcccctgatactggctattaagtttctgcaggtgcatactagccagcaagtgaggggcggggtgcaggttgaaggatgggggtttagtgggaggggtggttgtaggagagcctattggagatcccgaggaactagtgggagccccactggccttggttccatttgaggctaccccagggtagtgcagaatggccactgctttgcgatctttcaccgcaaggttggagtaggccacggagctcatctcttggttggcatcctagaagacagagaaaagcacaccatagtaaccctgctcctggcttgtccttcaccattcagcagatttagaaggttcctacctgcacttcatttgggactagaggtggagaggtagcaagacgacccccttgaaaattaggctcccacctcaagcatccttttgctgccatggctctgagcactgaggccagagcccagttacagtgctggagcacctgccatcctaagtgggttcactgctttcagctccttccccatagcctccacctcaccatcctaaaaagggcacctcctgtccctcttctcagcctcactttagtctcttcaacagagtggttttgctcctactcaatttctctgctcccttccctgccatctttcaacacccctagtgggttcaatctgaccacaatttaggcagaagctgttctcattctccccagagatagtcctgttgtctcctctctgctcaaggacactgggtaatgcacctaggagggcctggcccatgaccccggaaaatttgtctttccctgcctcatctgtaaaatggcaaaaattacctccttcgcaggtgaggtgccacccttgacatcaagtgcaggcctcgacgttgttggcatttcagagccttggcagaagttggataaattggcgggaagtgatgctgccagctggagctgttgtgctgcaagtgaggaagaagcagtggtaagggcaaaaggcttcactgaccaacaaagcactagcaaagcccaaagcagggcaatgccacgcagctatgaggcaaggatggtgactgagttagaatcaagaccagagatcacccgagcacagggaggagatcaagctggaacttttgcctgaggcaggaaaggtgcttgattcggccaggtactgcccaggcagccacctacccatatcaccaagatgggacatactgcttcctcatgcaagtgacttcacagtcccaaggtgtatgtgtgggggtgagggtggcactgttcctggttcagaggacaggaatgtccctgagtaagcaacatattgtctcaatgggctactagcatccaggctggagagttggggcctccactgggactgggagaatgtgagaagaagtcagggcaaggaagacctagaaagctagaggctgcagcacagggaaataacaagtctctagcgcaaatgtcatggagctccaaagcatgaccttgggcatgcctgtgagaagccaggctgattagggtggtctgggggctctgaggcagctggagccagagaagctaggaatgtgtcactttcctccatgtctcaagccccctccaagacagccccagcattgggctttcctaggatgcctaccccagaaacctgagtccagccattcccatctatagtgacaagtgaggcacagagattcaatgcctttttagtcaggtagcagcggttctgggagcagaatctagcacccctatggccacatgcctcacctgaccactggctaagtcatcatacctagctggattcaaaaggcttccaaagaagtgatttcctggctcaagtgccaaaggataagggaatgaaggcaaaagaatacctccaaaccagaaaataaacaaacctctgaaaatctcaacttattttcctggaggcctgtttacaaagaagaaaaaaatgtcccatagctaggcacagtagcaccctcctgtagtctcagctactcaggaagctgaggtgggaggatcacctgagccctggagtttgataccaggctgggcaacatagcgggaccctatctctttaaaaaaaaaaagccccatatattctagctttcatgatcaattagagatgtagaatttcatatttataaatacctcttggtccaaagaatcttgaggaccttaaaaagagtctctaatctttccaaggaggctagaattctccgtgacactctccactccgcagcggtcattaagaatctgctcagacacttctagaaagtggccacttactacctctctgtatcatctttgcattgcttacttgggtggatgggggtaggggagggaaaaaatagagaaaggggtaaacatttttttaaaaacatgaggaaaaaatatcagctgttgggtcccgcatcattgcttgattgaagccctgctccttctctgaggcaaccgtagaaaaatatttcaaaagcaagtgatcaccagacaagaagtctaacacatgtcgtcttcaagagccctagcacaatcagtatcagacaattttcctgtcctaagaaaaatgtctgggggccctgtccatcttttcctgttcctatccagccttccctctcctttttgccgcttggtacccgaatgtacaaaacgaagaaaaaacaacaggagcagcagcaacaacagcaaaaccaaaagagaaacattagaaaaatcaaaagagagaacgagcaaaaaaactctctctattctgatatcagttcgtgggggaagaccattttaccgcgcctccctcttcaatctgggagctcccccagaagaggccctgtgtccattcagatcttctgccttccattactgacccaccacccaccctgaccccagcctgggtctgcgctcaataggcgctcagtaagtgttgttgaatgcgtctgaagaagcaatcgcatttccatcggcatccctggctctgcttccccggctttctgccctcctccaccaccctctagcccgttcgtgggcaaaacttggcaacgcggaaacgtcccagcccgctctccaagccgcgagctgaccactgcgaaacggctgcgacaggcggctgggaaacctagagcaacaagtgccttctcgccggctgatgcctggcggccccccggccaccagttcccagtcccgctgcccgctcttcgcttcaggccttcccttgggcgagcagccccctcccgcctagacaggggtgggaaggggagagggaaaagagaagggagaggcaggtgggggcctcatctttaacctgttgggggaccaaaagttaaaatggcaccaaccggatggttccatctcgattgctattttctcactcagaaggagaaatttaaaaatccaaacagcactgcggcttggcttggacgcgctctaaccagaccagtcagtttcgccacctgaaaactaaaggcccgttgtttgcggacagctcggctgccctcctcgccgcatcccagatggagccgcggaaccgggggcggccgggagcatcccttgcacggcgggcgcgtgcacccaggccaccggggccctgagcgtccgttcccgcaagtgctgtatcaggaactgatcttagagacaggatggacaggcaggaaggggcacggggtgtcggcctccgcggcgagtccgcactccggcgccggctgctgccactctcgcgcctgatcaacacttactgagcgcccgctgagcatccgacgcggcagcaggctgagcctaccccctagccaagccgcctgcggtcagtgctaaaaccccgctaggagaagagtgagagaggctcggagaggtgcggtaacttgcccaaggtcacagcgctagaaagtggcggagccgggattcgcagccaggtctctctgactccaagtccggtgctctgcgaagcagggactcggcgcgcggctcgccagcccgcgtttatagggagaggggtgtgcgcgtgggtgtgtgtgtgtgggcgtgtgtcgggggaggggagggctgaggtcgactgggcagtagaggcaagttgcccaaattcgctaacttccatcccgcaattccgctgaactcggcccgaaaagccccctcttgcctcaattccccgaagtaaatctgagctttgtgcagctccggagccagagcgtccagatgcggtccgggagattagcaaagtcggtggaagccaagctggagaaagcgcgggcgcagggagaaaaggtgctgccgtctccccgggagaagcgggcacccggccccgctggccggcaggggggcgcgctggcaagcgaacccgagcgctggcgggcgggcgggcgggcggcccctcgcccccagcagagcagctttccaacagaaagcaagtctccccagaaccctccggcccgcctggcggccgcccactccccatacccgctccacgggagtcctcggccccgccgcccagcccggcgcccagcccggcggcccggcttacctctgagaagccgcctgccctggagagagggaagcgcggagctcggtgagccgcaagagaggcggcggagcccccagcccctggcacgcacgccgccgccaccgctaccgcgaaccggtcgcgctcagcgcccgcggccgcgccgttggccacccgaccccggggcgcctgggaaaagcccgcaccgcgccgcgccgccgctgcaccgcacagtgccgcgccaagcagcccctgaccgagctggtgcccgcccgcccgcccgcagcttcggcgccggactccggggcggtggcggtggcggccaccgcgctcccttcccggcgctggggacccggctctcaagcccccattgccgcccggagagccctgacgcacacgcacacggcagcagactggcctcggctaggaatcccaggaaggacagaccctttttttccctttttttttctcccctcaatttccacgtctttataaccggcttagggcattattagcacatgtcctggctcgtgggcgagttggtggcaaaatctgaactggatactcacggagggcccgcgcgggtgctgtgccgtccgctgctctcttcctcctcaccgagaactgcccctcgccggcggactacaagagggcagccgggcagagcgagcttcctctcggcagctcagcggtgccccttctgcagctttgccgccgggcacatttttatagcagcggctggcgtctgtggccctttaaaggcgctcgagctggtgcagtcaccgcggatcgtgtgaaagcaaagggccggctggggaacggagtccacgcggccacgcgagtccggcagccctgtggaccggccaaggctcccggggtggggctggcgagtccgggctatgggcagccctcgcccggagccctggccagtgcccggcttctaaagctgtcgggggccagggcccgggacaccggctctccccaccgccctgcgtggacttgcccaataaattccacttagtaatttcactgaggcaaaggagagccgttagtgtctgttttctgacctaaatctagtcgggggccaaaacgggcttcaggggttttgggagagagctgtgggctcaaggagtgacctggaagagcggggcgcacacgagacgggggaatggtcattagttttctgcagggctgtcttggagcctgtctgccttttgggggggctgtactatctcattcgttgaagagctgaggctgggggctccttttcctcttaaagtcgccagattctgggcagagtcgcatggggggcctatatggcagcggtggctcttctagaagttctgagctggggttgggttcgagggtttctgttctgtggtcatccagggcaggaggctggcaggatgcgacccggagaaatgctactctcccggaccgtggggccaggtacagctcactaggctcgccgaaaagccaacagtaggcaacggggtacgaagagcttgccccagggttcgcggagattcctcctgccttcccacgatgtcaggttgttttattgtaactacataatcattcccgtctagcaagaataacgttttgcatttggagttcgtctttcttaggtagagatgttgtcttacaaatccttactggaaagaggtctgggtcttctccttcacctcaattcggattctttgtggccaagaaattcccaccttaccacttacagggaggccatcgggattacccctctgtcacccccccaccccgccccggccccgccgctctttttttgctgcctttcagcaacagcgactcagtttacactgtttataaaacatactctttaagaaaaggtcctgatgttaaaaaagggggggagggaatgtcacgaagtcattttcactatgtatgtgttctgtcttcttaattggatttgaagacctgaagttctctttttcttttctttttctttttttagtagccccaagtgccctgcatttgctcttctaacaaagttctgtttgttgacggactgaccggcttaccgacacaaagatgggaagcaaatggagagacggatcaaggcccttcctcggcatctggaggaagcttgggcgagtgtcttggtcgccaggtaaacccattctccagccctcaaggctgccttgcacagctccagtcttttcacttaccctgtcccaacacaaaccccggtagcatccacaccccacacatcttcgctgcactttctcactttgcttgccagattgtgggccctgcctagtctccctctgataaaaggcgggatctgtcggcaccctaaagccttactgcaaaccgcgtgtgaaatacactctcaagttctcttggtgtttgcctgggatgaaaaaaaatgtttctgcgaaaactaagtggtggagaatgagcgactctaggctttcgaattgcatgttactaatttgaacccctgacccaccctccccgtcagccccggcttggctcgggagcaggtctggcaacagcggcagcttctccgctgcaggctccggatccgggaggtgtggatccgccctccatctattggatggctcccaggccaattgttagaaagaggcatatgttcatctcggcttctggagtgtctccggagcagttgctcaacagccagccccctcccccatccggaccattgaagggcagaaaaaggagcgccctccaccacatttctctgtgcccacatgccagaaagggtctcccccctggtgacttcctgtcatctccactgcttacctcctggggagcaggaacgagaggggcttcaagcactcagctttgaagcacaaaagccacccctttcctttttggggagatgggagaggaggttagttgcagaggctgagagggagcaaaggagacatttgcatttctcggcaaaaatgctctgatcactgacttccccgttggctccagcagagctcagagctctccgctgaactcttatctccaacttggcaactagaccgcgagcttgcgaagcaaggagaggacagggatggtcacctaccgagaacctctgtgctccagcgctgggcctggcatgttccccatccatcatctcatttaattcccaggacagccctttgaggtagggtttaccaaaggtgaatgaaacagagcctcgggaaattgcccaagttcacatagccacgtggctgagtgtttgaatctggatcaggctgtctgcaaagtttttaccctcagccctaatccccgctgcctaggagggtaaggaggctgtctagagtgcaggttcaggggtcagtaggcctgggtttaaattcctactttgccatttgttagcggtgaagtcttaggccaatggcttcatgctttggtcttcaattttcccatctgttaaatggggataacaatggtacctaatctgtgggggttgcttagcctgattggtgcccgcagtgtagtaaatggccaataaatgctgttatcgtactggaccttctgattattttccttttgcctcccgtccctgcctcagctcacacacttcagattcagtaatacttgctgaatgattaattttaaaaccagactgagaggggatgaaggaggtctataaactcagggaggagagagagagagaaaaatgcagatttcttcttaaaatcccaccctccagaaccaaggactgcctgagccatatgacaggagtaaatttgggaccaaaaaaaggtgaccactttttacaggtcagcctataaacttacagagtggtctccagaaacatatactcaatacgtgtgtagaaaaaactttaaaagcacaagtttttattcaagaatatttacagcagaattgttgataatagtggaaaatgaaaaggaacctaaatgtctatggtaagggtgtgtcccttggtaccttgacacacacacacacacacacacacacacacacacaatcctgactttgaaaactcttattcataggaaaatattcataacaaaatatgaaataaaaaatgctgggtacaaagttgcataaatatgatgccaagctgcaaagggcacaaagggaacaaaattaaatactcactatgtttccaatcatgtatgaatatgtacagaaagcgacagtctggaaaataccaaaatgataacagtgccagtagagtggtaggattatgagtgattttcttctcttttccccatattatgcaatattattcttataagtaaatatgagtttatagttaataaactccataaatattatgttcccacttttgttaaaatatatgtgcatagaaaaaatatccataatctcactactcaattataatcactgttaacaccaaaaattgttaacggtgattataattgagtagtgggattatggataatatttttattttgcttttctttttctgcagtatgattatattactttcttacaattaaaacagattcataatttgaaaagtacataatcagagggatcccacttgggttaagagtatgaatgtaaattgaaaaaaatgagaaggaagaatactaaaatattaagagttttatattaggtggtaaggaattatgggtaatttcctctctattttctgtaatctgcttttattatttttacaattaaaataaaatgtacctaaaaataacatatacaatatgatcccacttttgttaaaaacgaatatgtatatagaaaaaaataataaactactccaaaatgtagtagtctctgggtggtgagtttattagtgatttttgttttctctttcatacatgatttcttcatatgccaaattttctacagtcatcatgtattaatttttttaaaaagtgtaaagtacttcggtaatgaagtttttatggaaaaaagagcatgtctgggatttgctttaaaacattccagttgagggtggggggaaagtggacaggggatatagattaaataagatgataattgttgaagatggcttcattataatgtgtttttgtttatttgtttgtttgttttgagacagggtctcactctggcacccaggctggagtgtagaggcgcgatcttggctcactgccacctccacctcctgggctcaaacaattctcccaccttagcctccagagtagctgggactacatgcgcgtgccaccatgcccagctaattgtttgtgtttttgcattttttgtatttttttttgtagagatggggtttcatgatgttgcccagttcttgaactcctgagctccagtgatcagtctgcctcggctgcccaaagtgctgcgattacaagtgtgagccaccgcgctggcctataatgtgttctttactcatgtatatgttttttaatttccataataaattttttacaactatttttcatatacattatctcttttaatcttatgctacccctgtggggtcagttatctccattttatagaaaattgagattcaaagaggtgaagtcactggacctgtaacacaactgggaggcgagactgggtctccatactccagttccaattccaagagcccagggctcttctacatatcccagttgctgctgctctttaaaataattaaaaataattaacactttgtctgaccataaatgtaattgttcactgcacagaatttgcaggtaacagaaaagcactaggaggaaaacataataatcaacccaactgcatcctagttaaccctctggtgtctggcggtgcaaacttcatctcagttgcctcttactccagaggtattgtgtgctgcaaattgtcagtaagagtggctagtctttcctgatgggccaccgagtgaagctgcaactctttggggcccctgtcacgtgtgggttcctgggagatggtgggtcctaactgcccccccgaccccccttatttcccagtgtcccctttagatacttcagccaggaccacggttttaggggaagtcctggtggcccttttcctcttgctccatgtggagactctgcccagaagcccccttaggattctgtgagtttgcaaccactgtgaatatgcctgtgcctccatttccccatctggaagatgctagtgagaatagcagatgggtcagcctctgccagggagtgatgagctaacgtctgtagtgctttccagcccctcggagcaaggtgctggatccttcccggctctgcgcctgcccctgccagcctgagtgagcgcctgggcggctctgcgcctgcccctgccagcctgagtgagcgcctgggcctggccgctctgcgtggagggagtggccgcattcctctgacccaggccaacaggcttggacaggcactcacttttgcttctgtgtttaaaaaaaaagggaagaagaagaaaagaagagaagagaagatgaattgaagaagaaggggaacaagatcagttactaggggaatgggcctggagaaatagaaaattgagaagagagcagagcgatcacagggcatccttgggcaccccaatcagcttcgtagattctagccctggtttcctgtttacacatggggtgggggaagtttggaaagggccaagaattgggtctagttgaattgattccctacttgatttcctgttatttatgcataatgggaaaaccgcaaatatacaaacagctcaggccacccggcctcttgaatccttaggggccatcttcacagctctgtccaccccagccttcagagatgtcattccagtgtatgtcccttctctgtgcccccttctggcattcaacttcataagaaccctagccagtcaacgctatcatccccattttaggaagaagggcatcgaggcacagagaggggaaacaagcctaagatgacacaaagggttaagtggcagagctgggattcacagccgggtctggctcactcctgaggccaaacaccccccgctaggctaccttgttatcggtgtccccctgttattggtgtctatgcttttctttcttctagaatggatggttcaccacactcattgcagtaaatagtcaacgcgtatggccagaatggatgcgtggcccagatctagggagaactcttgagg

SEQ ID NO: 8358 - DNA, 824 bp, artificial
  synthetic oligonucleotide
gagagagggagttacttggccaaggtcacacagctagtaagtgaagggagaggcttaaactcaggcagtctgaggctgaagtgtgttatgttgcatgccaaggcactaccggtcagctttgggcccagcactgagcaggaggtttggggatctgcccctggcaaatgcagagaaggaggagctgcaggagctttctgtataggggcttagagatgtcaaaacacacttgtttacgtggttgttttctttcattcttctgcttttctcttcctccttcttttccttctcctcttcctctttttccttttttttttgttgaatgacaatatttgattttcttataaagaagtctttctgccttagagtcttttaaatatataattggaaatatactactgctgtctctgtgacagctaacattgaatgcagcagaggcagatccaccctccccaaaggaaaactggtgggaattttccattgacttaaaaacaaatgttatgtattaacttttttgggaccaggtaatacattcacatggttcaaaaatcaaaaggtacaaaaaggaactgagtgcaggtcgccctcactctgccacttgccatctggttcccttgcccagaggcaactgaggtgtcccagttccttgtgtattttcccaaaggtgttttatgcacatatatgcatatccaatatcgatattcctttttaagtggttattttcttaccccttgagttggagacatagtctacacttctttcttggtctctttggcccttgtgagtgccctggagacagagggggctggtgggtttcctataagcac

SEQ ID NO: 8359 - DNA, 2530 bp, artificial
  synthetic oligonucleotide
tggccacttctctgaaacagaaacaatgctccctgagggcagggcctggctgtcttacttttggttgatttccaaagtcttgcacagtgcctcactcatagtaggtgctcagtaaatggctgaatgaatggacgaatgaaaggaaggaaggaaagaagaaacaagtcagaaacaaactacttgcctatctttttttttttttttttttttttgagatggagttttgctcttgttgcccaggctgtcgtacaatggcgcggtctcggctcactgcaatctcccgggttcaagcaattctcctgcctcagcctcccgagtaactatgactacaggtgtgtgccaccatgcccagctaatttttgtatttttagtagagatggggtttcaccatgctggccaggatggtctcgatctcttgatctcgtgatccacccgactcggcctcccaaagtgctgggattacaggtatgcccggccttgcctatctacttttattttaaattttattctgcagtaaaattgacatttgtgcatgtgcagatctgattttaaacatatgtatagattcatgacagagaggagttccataacccctcaaatctccttgtgctatccttttgcaatcacatcttcctttctcccccacacctagcaagcactgatctgttctccatcactgtagtgttgtctttttgagaatgccatataaatgcaatcaaacagtctgtaaccttttaagataggctattttatttttttactcagcataatgcctttgaggttcatgcagatttgtgcatgtatcaatagaagttcattccttttttgtactgagctcttacttttaaaataattatagaataacaggaagctgcaaaaaaaaaatagtgcagagaggttctacacacccttccccaggtttccccacatgttaacatcttacataattactgttcaatatccaagtcaggaaattgacattggtacaattcacagatcttattaatatgtcactagttttacaagcactcatttgtgtgtgtataagtgtataattctaggccatttaatcgcaagtgtagattcatgtaacctcaaccacaatcaagatgcgaaactattttatcaccacaaagatttccctcctctacctcctttacagtcattcccatccctcctccttcaccatccctaagtcccaacaaccattcatctgttatccttctctaaaatttggtcattttgagaatgttatagaaatggaaccatacagtatataaacttttgagatagataggcttttttcactcagcatactgctcttaagatccatccaagttgtggtgtgtatcaagtttgttgcttctttttgctgagtagtactccacagtatggatgtagcacaatctgtttaactacttatctgctgaaggacacctgagtcatttccagtttttggctatagaatcaagccactatgaacattcacatacaggtttttgtgtgaacatagttttcatttttctgggacaaatgctcaacagaataattgctgggaggtatggtagtagcatgtttagctttataagaaattgccaaactgttttccagactggtggtaccattttactttccctccagcaatgtttgagtcatctggtttctcagcattcttgctggcatctggtgttggtttttattttggccattctgatagatgtatagtgatatcacattgtgatctcaatttgcattttcccaatggctaatgatgttgaacatcttttcatgtgctcatttgctgactgtatatccttttcatgtcttgtcttttgcctacttcctaattgtttttttttttttctgttgagtttggaaagttctttatatatattttttatttttattttttgagacacagtctcactctgtcacccaggctggagtgcagtggtgcgatctcggctcactgcaaactccgcctcctgggttcaagcgattctcctacctcagcctccctagtagctgggattacaggcatgtgccaccatgctcgactaatttttgtatttttagtagagaggggatctcaccatgttggccaagctggtctcaaactcctgacctcaaataatccacccgcctcagcctcccaaagtgctgggattacaggtgtgagccactgcacccagccctttatatattttagatacaaatctgttgtgggatatatgatttgcaaatatcttatctcagtatgtaacttatcttttcattcccttaacagggtcttttgtaaagcaaaagttgattttgatgagctccaattccttatcaattttttttctttttttggatcatgcttttggtatttcaaccccctaacctcaaaaaaatctctggataatctttgatccttaatttcttagttcacgccttctccacatcttatgagttgtgaagcctaacctcaagatgtctctccaatctatccccttctttctgttccactgtctctgctttagtcaca

SEQ ID NO: 8360 - DNA, 1544 bp, artificial
  synthetic oligonucleotide
cttaaaaacttttctctggctaaatgagctcaggacatgaagactttgctgctgtcatttactgggctctgctagtggataggggcattaatgtaactcacagcaaagactctccgagtgtagtgtttcctcagactaactccagcatagaacaggcctcctttttgtgttggattatattccagcgagggactcaaaggtaggagaactggtgctatcttggtcattttatgaataaacatgagaatttccctgtccaggttaggcaaaaagatacccttggcctcttaactctggcaaataattaggatctaaaaaatacacatatgtatatgtacatttaattaaacaggaaaatgggtgccaaaaatacgtaatgcgaatggtggataaagtgagttgtgaagaagcagctggagttcagagggggcgctactagaatgctgaggacagtgaccccaaacagccagtggacagtgggatcaggagggaaatgccctgatggctgccacttcccctctaccccgaggccagaatgattccaggccagccttggggaagggaaggaggctaggccgggaaggaggctaggccagcaaggaggctaggccagcagcccatctgcagcactctggctgagtccaggtaacccactcccagggcatcagaatccctgactactcattgtagttccacattctttcaaggctctactggatcaaggactcatacatactggaagagaatgcctgtgagccccctccccacccctgctaagtctgaattgacttgaattttcctcttttttttttttgggacagggtctcgcccaggctggaatgcagtggtgtgggcatggctcactgcagcctcaacctcttgggctcaagggatcctcctgcctcagcctctcaagtatttgggaccacaggcatatgccactatgcctggctaatttttaaattttctgtagagatggaatctcgctgtgttgctcaggttggttttgaactcctgggctcaagcaatcctcccgcctcagccacccaaagtgctgggatgacaggcgtaagccacggtgcccggccaacttttctcatcttaaagagtgctttactattggccttttgaaagaaaaagggtctcagggaacactttagagctgattttcccctggcagtgccaaaagctgaaccctttgtccttctgaggtgacattagccagccaaatgacaatcccaaccagagtggccagtgtagaattccagctacaagctgtcaggccaagaagaggtttcctttccaagtcagtgaaatgattagcttaccaaaaggcaaatggtatttaaggaagcccccactgatgggccaccacaaactgggtggaacaaggagggcaggcctcgaggggcggtgctcacctttgatgtagttgaggatttgttggattcggtggggctcattgcggtctggccggcagcttggcgtgatttccagcacataatcaggaccatatgctgtgaaaaactgtaaggaaaagggaa

SEQ ID NO: 8361 - DNA, 2416 bp, artificial
  synthetic oligonucleotide
catgttctagggacaaaagttcttggctttctttagggagacaggaagctgccaccctaatatttaagtaatataagaacagtcggaatcagattttcaaaagggaccatgatcccaaaggagattatgagctattttaccaggctgagggtaccatggggggcagggatgtggatgccttattttttattatttttttagttgacaataactatacatatttatgggtacagtgtgatatttcttttttcccttaattttttttaatttttaatttttgtgggtatatagcacatacacatatttgtggagtacatgagatattttgatacaggcatacatgtgtaatatcacattagggtaaatggggtatccatcacctcaaacattcatcatgtctttgtgttatgaacattccagttgtactccctcagttgttctaaaatgtacaacaaatcattgctgactatagtcaccctgttggctaatttgatagccagatcttattcattgcctctaactatatttttgtacccattaacagtgtgatattttgatacatgtatataatgtataaagatcaaatcaggataattagcatatccatcatatcaaacatttattatatttctttctgttgggaacattcaaaattcactcttctagctatttgaaaatatataagaaattgttgttaattatagtcaccctatagtgtatagctattttatttacttcaggcacactgaacctagcattgtgcttggctcaaggaagcactcaatgactatttgtggaatgataatttcacagtgtagctcagaggatgaaagacattacattctgtggcctggtatagtggccaccagaaaagtgtagctatagagattaggcctgaaagagccagtcacatagctgccaagatttggaactgaagaagtatatctttaatatgttttagagtcacaatgaaacaagattccctgatgggaattttcccaaagactggatccagacacccaataaaagggttacaagtgtacttgcatataatttgcaaatggtttatgtctaactgcattctctgtcatctattccctggtgattttcaaggcaaaaatttatcgttaccctaaaggttattgcataatttataaaaataataaaagtttatcttctcttccttaaaaaaacagaacaggcagtaccatattttgctgtcaaggctgttcagcacagacaactcatatctttattattgccatagaaaatgtttgatcaatcacatttaggctgtactataaaatttaaaatgtgaggtgtacctgtattagccagtatcactaaagttccttggacatcaactcctatgtcatcaacatgaggactgtcccattcaaatggcacttatctgggtttcagtgatgtagaggccctccatgtaggaatctgtgttactgaggactcaaagcaagagcagttttccccacttctcagaaacacagttaaggcccagtggcagagtcactcttcacaagagtaggggaggctggggtgacagaaagcagaactgtgaatacccattcctaactcacaggcagaagttttgctttgtaagctgatccttgacagtgcagtaatttataaatggaaagagatagggaactcatcattcagtaagcatttattgagggcctgctatatgtgcaaggcactaactagataaagcatcacagcttaataaggagagctttcaaatgtatcaggccttttcttgtcattgccttaaaatatcatgtcctgtatttaaaaatggcaatgtaatcatgaggaaaaaatccaaactcaacattagtacaacttatatttgccctctcaagtgatggtaaaaagaactctctaaatgctttaatgagcttttgcacacactgttccctctgcttggaattctcttccccctctcctgtctgcctggtgaaattctaccctctctttaagaaacagctcaaatatcatctcctttgtgaacccttctgacacctcctgagcgaattaatcattcccctctatacattcgcaaagctctttgcaaggaacctctactctcacactgtaccataattttttctttctcacactttaccctgagctccataaatcagggcacacctctgattcatattggtatccccagcacaatgcctgcatatagcggtagtcagtaaatgattgctgaaattccctgaccactttgaaaaagaaatctattaatacattacagagaacttcacagaaacttaacaaggctttgcacatagtatgtgcttaataaagggctgctgactctgaatgtagtaaaaatggtacatctcttaggtcaagtctatatatagcaattcttgctagtcccttcatg

SEQ ID NO: 8362 - DNA, 2174 bp, artificial
  synthetic oligonucleotide
aaaggtttggacaaatttatgaatgacatagtcataaatgtctgggtataagaagtgagcagcatgcaaagaagaaggagataacttgcatttttttttcttttttttgagacggagtgtcacactgtcacctaggctggagtgcaatggcatgatcttggctctctgcaacctccaccttccgggttcaagcaattcgcttgcctcagcctcccgagtagctgggattacaggcgtgcaccaccacgcccagctaattttttgtatctttagtagagatgggctttcaccatgttggccaggctggtctcaaactcctgacctcaagtgatctgcctgccttgacctcccaaagtgctgggattacagctgtaagccaccatgcccggccgagaacttgcatttttaaagtgcctattagattccagggaactacgtgttaggcacttgacatacattatatctcatttaatcttacagaatatttcagtataaagacagaacacctatttatgaggcccagcttacacccattcaggcccacagcttctccatgtaccagaggcgatattcatctttattaaaattttatcaatcttttaacacagatgaaactttggatttgcttttgcttctcaggaatagagcattcattctcagttcaggcttctacagcttaaaacttgtttctgacataacttgatcagtttataaagtcccagagctttaaattacaatgcaatctgagatattcccacagcaataacagcgattacatttgttcacagcacttacctttatatttcattaagcttccaaatactgaataaaggtaagacaaaccaagaaaagagacttctattaaccctgacatcagcaaattgtctcaaattatagtgtaccttctatttgtattctagacatattgaatggtttttgtgagatacatattgtacctcacctgaggttaggagaaaattggaaggaaattagtttaagttgtttctaatttttaaaaaataatagcaactttaaaaagcatcatgctcccaagtgtacagctactgtatctggcagaaatcataacattaaaaccaaagcagcatccctaatccttgggaaatagcttgagaaggtggggctgcatgtactggtttgttattttaagtcatctagtctaaggtccgtagttatacatcttgatctataacatggttcctacttgcaggggaactggggtgataggtaggaacaaaggtatgcctttggattagggattatcagcacactcacaggtcccagacagctttccatgaacttgttttgggaaaactagaacagacatctttgctttggaaaacataaagcccatcttgtatgactaaagaaaatggcaagggctcaaatgacgtttcacattttggatggtcctattccagcctctgtgtgccactaattgctagaaaaacatcagcaatggtctttgtagtgcttgtgggtttcttgaattttacattagtcaaagaaaattgagagatcaggactaccaccaaagaacatgtgccacgtaccacctatgaaacttcttaaaaaaaagatgagaatccagcttacacattttaaaaatagccccttcctttttgaggctaggggataaaaatatgcacatattccaaagaattctttgtgtgaacaggtgaccccttcccacagtctctgtaattaattgagaaattaaagttggttggcctttgagatctcttgtaaaaaaacaaaaaggcagaaggtcttggatattttggaacaagagtccactattctgccaagacagtgtgttattgttattgaagtgtctctcaacaaaacggtattgagtggtgaggacgtgattttgattaggtggaatgactcagctcttccccttaaagaagagaggacttgtcagagccttacttacctcatgatctgggatctcagaggatagtgttttccctaggatgaccccggtcaagtatgtccagcatcgagccgtgttggcaaggttatagcctcctgtctccatcaagaattgtgaagttaggaaagaatagtcataaaacagcaggagagggaaggggggtaaggaaagagagaaaaatgttttaagaaaagacaacctcaaattgcagaatttc

SEQ ID NO: 8363 - DNA, 2075 bp, artificial
  synthetic oligonucleotide
gaaatttcatcgtgtcactgcccggttatacctgttctgggaatacagtaattcattttccagtgctgtcaatctattacctttcaccaaacacaaaattcgctttaagaagggacagaaacacaagtgcctttctgttatatagaggttgggagaatatattattaaaattgaaaccgacttctctgatttcttaggcaaaaaatcagattggaagccaaacagctatttggcctttgcagaccctggatagcgatgcccttgggggaaaggggagtgttggagtcattccaaactatagttagaacatttacgtgtatatttactgcttgtgcttatgctctctgccttagtttttactctctaagccttgaagaattcacaatttacctagagcacagtttaatacatacgggtgggaataaaggcctatatctctgtttctcatttcctaatcacattttctaccttccttatataactgatacctcttcttttccaattcaattgctcacttttcaagcttaggtgaacaatagtgatttgttaacaataaacatgctcctagcccttccctcactcttctttacccctgagggcctccctaagattcaaagccgaaattctgccatatagttagcacctggtgcagctcatcaaaatataatatcctttcccagatgattggaaatctctgcaatgccgtcatacaatgaggtgtgcaagaaagagtttggggattgattttcatcattaacttgacattgcatggtttttgtgggacttaaaaagaaatgcatttttattacttttaagtactgcacatagaataactccaactcatcatattttaacagttatttttctagggcaggatgtatgttaaacatgcctatgttagagtgtctggtggatcatttaggatcagtgtcctgttgcttgatgaaatccagatcacttcaatgaaatccagatggggaaactggatctctggcaatggctgccagatcttctccatatgaaatctctctagtctgtatgcaaattcaaaactccatgtcctggaaatcccaaaccaatcaagtggcgctccgcttcttagttactggactaaacacagggaagcgattcattcttccctgaggaaataagcatttcttacatacatctatcttggcacaaaaagggctggctaagcaaattaatagtgtaaacaggactgcacgggggaatgtttgtcctacttaggagaataaactttttatgcactttgtgcatatccacttacatacaaataattgatatgctaattacaaatgattcttaaagccccttccctgaggtgctgtactatgctgttagtctagtttgaattactagcatgtccagtgcttgaaagtaataaaaatgcatttaaaaatatcccatgattcagactggctttcctctaattaggctgagttagtgaggcttgcctgtatttaaataggatagatatttttccacttcacccctaacacgtttaagatggtctccctcccctctctattcctccatccccctcaacacggagctggcgcacacaaaccccttagcttctggctcactatgcaatggcacttgcatcacctccaggcaaacacattgcttttagcccctggcacacacacgtgcccttttgcttattaacttgttagctggttatttgatatagctttttttgaggagttctttcctttagtccttttttttttttttttttgacggagtcttgctctgttacctaggctggagtgcagtggcgtgatctcggctcactgtaacctccgcctcctgggttttcaagcgattcaatctgcctcagcctcccaagtagctgggactacaggcacgcaccaccaagcccagctaatttttgtatttttagtagagacggggtttcaccagattggccaggctggttttgaactcctgacttcaagtgatctgcccgcctcagcctcccaaaatgctgggattaccggtgtgagccactgtgctcggccctttagttcttctttaagtaccaatggaca

SEQ ID NO: 8364 - DNA, 1328 bp, artificial
  synthetic oligonucleotide
ctccttttacatagaactgcaggatatctttattggtaaagttacataagcagctctgatctgcacatctcaaggacagaagagagcttaaggggaacaaagaagggcaattaaaccattgatggcaggctccaaaaaaaaaaaaaaaaagttttttcagcatgataatacagaggtagccaggagacatgatcaaaattatgaagaggcttatgctgctgaataactgaatgatgacttggctcaccaaatctcttgagctaagaagcacttttgaagcataaagtttttattttttaatagttctgctttgtttatacaactgccagtgatgatggccagtgcaggcaggcttctttgggaagaacctccaccagaggttgggagaaatacgagctaagttggggagggatcaagagtacctcaatccccgttacttaccttcagtaatgttgactggctgacttctattcggatttgctttctctgccaccacttgtgcctgaccaatctcaatttttatgaatatgagtttaacacaaccccccacccccattccataaggcttttcaactctagtggtccacacattggcaccaatctgtctgtctacgattgtctgtaacttaatccttagccatggtgtagaaagaacaggtatctgactccaattttaacacagtggatagaaggtaagaatgcatgatgaataataatagtcaattctctaatatttacaccagtagaagaaagcacaggtctccataatgaaccctgacaactgaaatgaaccctgccaggttaatgaaataagacacatgtaggtttatttagctaagaaagtagcaaataagggattcttcaggatagcaaaaaaagctctgctcttgggatgggcttaatcatattgagtaagatccaacctggagcatggctctggtccaactgcttggctctgccatacagcggatagctactgatcaaataagcataatgaccagtatacaaaagctttataggtatatagatgttttcttttttacattgttcttgtttacattgtgagatgggggccatttcatcctacagaactgcaatccacttattactggctagtgttactgccatacctttcacagatctggtaatatttttcatcttgtatgccatcctgaatgggcacatttacactgtagtaccgtcccttccctaggccaacatcagacacgtcacctgttcctataaaagagaagagcactatgatcagttattaggaacatgagaacccagaaaacttaaaggatttcctgatagggaaatttctaggg

SEQ ID NO: 8365 - DNA, 2761 bp, artificial
  synthetic oligonucleotide
gatgagtgtctcaagagccaaagactttatgtgcttgcatccccaaactatgtaatagaccccattaaattggctggagtttatattaggtgtggataggaggaaatgccattgtgttcagtggactgatcacaatctctgtcaagtcaggagagagagaagagtgtttgctttaaaatgcagggaaagctttcagattttctggctttggttgatgaaaatctagagtaatttttgacacacaacaaaaacacatggatgctcttcaaatatccttttggcccctctataacgtttgaccacatattactgaaatggttcaaaacttggatttcaaacatctagggtgttgtcatgttatagctacattaattacaacactaagtagacagatataaaattttaagcattctttctagactttttctgtaaacaagtagctaaattctgaaagattgttcataataataatatgcacatattctactcaatatctttcatctgtaggctgcgacttcttagcaaaatggtgattatactttatagaaagggaaattctatgaatttacctcttgtatttacagaggagtgtcatgctaaaggcaggaagtaaaggggccttgcctggtcctcataggcctggtcaaacaaagcatggaatatttttggccactcctagataatgaaccttgaaatataacattgccactagtcccaaataatactgtggccttcctgtgatgcttcagtctcaggtggtctgcctgagaggggacactctatgcaattaaccttctgataggtgctgaggactcattcagtgctctccctttgtgctaggggttgtggtcaacacaagatttctggatcctgcccttgagttcacaactgagttgaatcaagctataagactaatacacatttttaaaaatgcataaaatgtgcacgagtatgagttcaattatatcgtgcagcctgtgcttgtctccaccttcaaccatctagtccaaacctcgaagctgtcttctaagaggctcagaggacttatgatctcatgtagtctcattagctctatgtgaagtaggggaagaaaaggctattcctcttttacaattgagaaacaaataggaaatctaccccagagcacttaaggagttggccaaacgttgcagagcgttgcagagcctctggcagtcccgtactcctcctgctgtctgtcccctcctgggtcgcacactttacactgctaattagaccttcctaaagcacaaccctgacaatatcactaccctgcttgaaagcctctcagtaggtccccatgcccacaggaagaaagatcctttcttttgcgtagtatgcaaggcccttcataattttgtccctgcctacttctcagtcctcttatctcactattgccctcaagtactcaaagcttaaccacaccaaacttttctctcactttctaaacataaaatgttcttcaagcctctgggcctttgtacatgcatagttttggacttgtagaatgacttccatctcctctgatgaactcctactcatcctttaagatacagctgtgaagacatctctgaagttccagcttcctttcccaggcaaagaaagttgatccctctttttgtgctccagcagtttattcaaacctctaccatagtacttctcaaactagtttgcaatgattacttcttgtacttgtcttctccactagactacatactcttggagagcaaagactgtatattattcacctttggtacctagcacagtgcttagcacatgctatgctttaaactttttctaattactttttttttttttttgagactgagtctctctctgtcatccaggctggagtgcagtggcatgatctcagctcactgcaacctctgcctcctgggttcaagtgattcttctgcctcagccacctgagtagctggaaccacaggcgtgtaccaccacacctaactaatttttttgtatttttagcagagccagggttctgccatgttggccaggctggtctcaaactcctgatttcaggtgatctgcctgccttagcctcccaaaatgctgggattacagacatgagccactgcgcctggccaagtttttttttaattttaaagattttataggaattgtaaaatgcctagagaatgaagaagaatatttgtattatttatcttgaataaaagagaaaaataacctccagattatacatttacaaattaaaatgtaataaactagagaaacactggaacagattattttaaaaatgtactggtcagtaccaaaatcaggaagctttaagggcctgtgacccattgttcaactgtccccagtcataaacaaaaagagaaacaaagcatggatttatgtagaggctgatcctgggtcaagagtcacaccattaaccattttcttttaagtgatagatgagaaacttttcattaaataggtccaaaaataaagttagatgtggtagtattgtttggtaaacacacttaaaatggaaatgacttgaatcagttggcaaagtgggtggctatcaccagcgtgaaatttaatactgaaactcagaaggtaattcactgatgtgaaacagatcaggagggtggaagatatgatgtaaggtcatatttgaagtggttctgagtactgcaggatagcaatataggctgcacagaccatctagcatcaagatgaatctatgaaatagtttctttaacttacggatgctgcc

SEQ ID NO: 8366 - DNA, 2418 bp, artificial
  synthetic oligonucleotide
taaaaaacacttactgaaaacctccctatttaacagtaagcaaactggacagttttgctttgctttgatatcttgtttgtcataaaataattttttgaaatgttaaataactttaatggaaggcatatagttactatgttaaccaaaccatatgggttaaaaaatggcttaaaatgggtgtggtgacacgtgcctgtagtcccagctactcgggaggctgaggcaggagaatcgcttgaacctgggaggcggaggttgcaatgagccgagatcgcgccactgcactccagcctgcgcgacaaagcaagactccatcaaaaaaaaaaaaaaaaggcttaaaaattccctttaaaaggtacaaaatgattttgttaataataaggataaaatctgaaagcctattattacactaccttctgggagataaatgaagcatagcacactagttggtatgagcactcacctatttggccagaaattgtcataagtaatcctatatgtggcagggttatatttgctcttataacgacatcaaatacagaaatggcaataaacagcaagttcatgtttttggaagaaacagttagctctctcttgagttctggcgcagtcttggcagttttctttggtcttttttgtttgtttgttttttgagacggagtctcactctgtcacccaggctggggtgcagtggcgcaatctcggctcactgcaagctccgcctctcgggttcacaccattctcctgcctcagcctcccgagtagctgggactacaggcgcctgccaccacgcccggctaattttttgtatttttagtagagacggggtttcaccgtgttagccaggatggtcttgatctcctgagctcatgatccgcctgcctcagcctcccaaagtactaggattacaggcgtgagccaccacgcccggccttctttggtcttgatctgtctccagcctcacccattaaagtttggtgctggtggtgggttgtctaaaagtcttaggttgaactcacaccctcaaatctggcttagaatgaaacgaaatcaaaagaaaaatggaacacctcctagctgaacacctttttgtatgagacaggttttaatacccaaatgtactcaaaatctccacaatgcactgcacctacccctgggatacttaaccaagcaatcgagctgtatttctaatgaaccttaactgcttcctgcactttccactcccctgtcccaagttttcttttctttttctttctttctttcttttttttttttttttttttttttttttttgagacggagtttcactcttgttgcccaggctgcagtgcaatggtgcaatctcggctcactgcaaccttcacctccggggttcaagcgattctcctgcctcagcctcccgagtagctgggattacaggcgcccgctaccacgtccggctaatttttttgtatttttagtagagacggggttttgccatgttgggcaggctggtctcaaattactgacctcaggcgatccacccacctaggcctcccaaagtgctgggattacaggcgtgagccatgctctcggccccccaagttttcttaattcttcaagagctttcttgggattacaggcagattacaaacactgtgaatactttcacagaaagctaaaataattttttcaaaagaccattcttttccttgccccactgtgaagcaggatattaaggctacgaacacctagcttcagggctatgttcaagaaagacaacttacctcatctgcttatgcagtgcatatgcttcaatcaaagaatgcaccatactggcctaaaaacatcagcgtaaaaaaaaaaaaagaaaagcagaaatagtctctttaaagtttaattcagcaaaatccccgtcaatctcaccatcctgaacaaaggaacggattaattttgtttcaactggcttcccttctgttaacagttacaatacactttagacaatacagatacaaagtatcaaaatcactaaggtgaaagctaccgggccttaggcaggtgatggaacaccttccccctgcagcttgttttcccacgacttcagcggtcccctatgagtggaaactgcgtcctctcccctcctccgtaccccctcccccactcctacctgtccattggacgtcccgaagagacatgctgcgctctcagaaacgatatgagaacacttccttctgatacagctttaggtatctgatacagctactcgaaatttctgaagatttcccccagcccagtgtcctctccgcttcctaacgctctttcgtccaccgcccccacccccacccccaaagcccatggtctttcatcccgacttcccttacccgtttggggatcttggccagggagtcacacatactgacatactcgggactatagata

SEQ ID NO: 8367 - DNA, 1317 bp, artificial
  synthetic oligonucleotide
gtgttttggtgatgtgctctgtaactagaatgtaagatcttatgtttctttaatttatgtcttcccatagtaactagttaaaagctctgcagtcattcattcatcaaacatttatctgatattaagtgtacagtacagctgaggattcaaaggtaaattatgatgtgatctctgctctcaaggaatttgcattctttttttttttttttttttttttgagacagaggagtcttgctctgtcgcccaggctggagtgccgtggcgcgatctcctctcgctgcaagctccgcctcccgggttcatgccattctcctgcctcagcctgtccaagtagctgggactacaggcgcccgccaccacgcccagctaatttttttatttttagtagagacggggtttcaccgtggtctctatctcctgacctcgtgatccgcccgcctcggcctcccaaagtgctgggattacaagtgtgagccaccgcgcccagccagaatttgcattcttatacagaagatggggcaagtacacaagaaaccaaaggcaatgcagagtcaatgaatgtaggatgcttagcctacttaataaataagcattaagtactaaataactggcatttaataaatggtaactagaattcatctttgatggcatttgagagggtcttaggaggtgggcaagattttgcttggtgaagatgggagccaggagagggcatgctgactagaatgaacagcataaacagtaacacaaaagggaaaatttctagtcgagtttagctaaaagggccagatcatgaagaacattgaataccaggctaaagagaatagactacattctgtgggaaatgggaaaacatatttagacagaaatagtaaggaaaaaagatttctatagcagcagtgtgtaggaaagattagtcattaaaaggctaggggcagttagagtgccacaatggtccaaataagaagtgataatgattttaaactagggtgggggcaatgggaacaaaggagaaataatgtacagggtaggttcaacaggacttttttattacttggatattggtgagagggaggaagatggaaaagggttgctgaaaactcttaaatgtaaactctgggtaaagaaaagactagaggtagcaatataagaaagagggcaatcgggaggaagaactcatacagtagggcagaatagacatagattctgattttaaaagtgttgaaaagtgtttcagaaattagtgggttaaacaattgcagtgatacacacacacacacttttccatataaagaggagaaaactgaagtcataaga

SEQ ID NO: 8368 - DNA, 329 bp, artificial
  synthetic oligonucleotide
cagcaccaatctcgtggatagaaatagcaggactgacatttgaatcagtgggacgaactatgtagtatgagagattacagagaaagagagaggataataaggttcaatttcttccccatcacatttaaaaaaaactttcatatatatccttatttttaacttaatttaaaaactataaccttgctatttgaaatgtggtccatggaccaacagcatcagtaccacctacaagtttgttagtagaatctcaggtcccaccccagatctactgaatcaaaatgtgcattttagcaagatacccttcttgaaacgcactgcttttcaacttt

SEQ ID NO: 8369 - DNA, 1176 bp, artificial
  synthetic oligonucleotide
gggagaaaaatccatcatgagatttggtatagctttggtaaaaactgattccccgagttcttttgtatcagtaaacctaaggtcagagccaggtatgtgggggtaataaagaacaccctaatgacaagagttgcctatagctagagaatgatagaaggcatggtgaattggggataacaatttgagtcatcaacatatagaaggtattatagttgaaactgtgtgttttttaggcagcaggtagcgggtgctggggagagatgggggatgaaacttctctagattcagagcctgacaagcctggacagctctcttttcttcctcttatactcctgtcactgaagtaggaagcccaactacaagagaggaggctaggccagcttcctgattcttttttcactttcgctatatggaacagacacctggctgggggccagtaatccaattgaggctttagctgtcttgacactaagcaactgtggcaaatgtgccctctactcctgctcctctagtgctggtagatgtgatggattgttcacaggaaaaagaatgcactgcttggcttaccattattttctacattgagtttttgaagcaaaggcttagttaacaaagtgctactttgccttcctttgccattatcctttgtgtatttttctatcttgggaacctcatgctaatgggctgctgttgtctgggccaggatagcaggatatgttgatcacagagtcccctggacataacaccatcttgattacttctaactgaaaacatgaaaataaaagagattcttcagggaaaaatatgcagaggaagaatgatagggggctgaggacagtccaggaaaaaacatttggcaattcattcattcattagtaaacatttattaagtacctcaatggatgaggtgctatgctagtcactagggatacagaaatggataaattagtctttccctcaaggagctcacagtgtaaccgaagtggcatacacatggattgtaaaatgacctgctaggtaaatagagataagtgcacaaaactttatgagaccatccaggagtgacacctaggtagtgtggggttgggaggagtagtatcaggaaaggcttctgcaaagtgttgatgcctaaactgagtttgaaataatgaataagttagctaggagaaacaaggg

SEQ ID NO: 8370 - DNA, 3579 bp, artificial
  synthetic oligonucleotide
cccctgcagttacctgatggcacaggatggtctgttgcaccagtcgagcgtagccgtccagccggaccccggagttactccggctcctcatggcgacacgttactaattgtcctctgagaaatagcccgggtgccaccggagccttcggtccctaaggaacaagtatccaacgctgctccaccctcgtggtgggacgcctgaacaccaggccccgcagagccctcccaccgctcaggcctggcgccgcggattccgcgtacctctccggactccggcggcctcaggggcccaccacgcgccagcgctagcactggcttcccgcggtctagagccccgccgcagcgccccaggcgccgctcctgcccccttagtccagtccggcctccgcgtgtgactcctgcatcctcccctcaaccccgggagaccgccgcggcccacagcctcccgcccggccgccgccaacaggtcaacgaccgctgcgccgcctccaccttgcgggagacgcgagcgggaggcggggcgggcgcgactggttctggcagctgcgcgctgcgaccccggggctcgcccgccccggggccgagaatgtgtcaccgtaggcaatgtgctttccgaggtttattttcgaaacacctcagatcactatttcagttttccacacttgctgtgcacacaggatgttggggaggctctccttcgttctacaggactagttttataaaggaacctacagtgaacttcaaaactgaaagacacgcttgtgttccaggtctgaagacttggatttctgggtctttattgtattttagattttgactttaaaagctcagattacacgcctcacttccagccagaccaaccaaacaggaactccctagggtactttactccttagtaactggcgagtctgcgggcttgggagggaggaggcagtggtgcactctgaggaagccagtgcggggaacagctgggagctggcagccccagaaggcggcgttggcaggactcgagctggaagagatcctataactgctttggatggctccctcgtgcgcacgtaggtcacaaggctgaggcaacaaatattcagctgaaaataaagtggagaaggaaggctgcgtaagaagcttggaggccgggcgcggtggctcactcctgtaatcccagcactttgggaggctgaggagggcagatcacctgaagtcaagagtccgagaccagcctggccaacatggcggaaccccatctctactaaaaatacaaaattagcccggcatggtggcgcgcgcctgtaatcccagctactcgggaggctgaggcgggaaaatcgcttgaacccaggaggcagaggttgcagtgagccaagatcgtgccactgcactctagcccaggcgacagagtaagactccgtctcaaaaaaaataaaataaaaataaaataataaaagcagcttgtagtggccgggtgcggtggctcacgcctgtaatcccagcactttgggagcctgaagtgggcggatcacttgaggtcaggagttcaagaccagcctggccaacatggaggaaacccccccccccgcttcccccgccgccgatacaaatacaaaaattagccgggcgtggtggggcgctcctgtagtcccagctactcgggaagctgaggcaggataatcgcttgaaccctggaagtggaggttgcagtgagccaagatcgcgtcactgcactccagcctgggagacaagagcgaaactccgtttcaaaaaaagaaaaaaaaaaggcagcagcttgcagataacgctgcttactggcctcgtggaatcagtctgcaacccttggggcggcccggcttggaccccagtgcctttgctccgttcatctccggctcctccctccatcccccacctgttgctctctgcttattcaaaccttgcaaacctttcaaggctctgcttaagtaccacctattccctgaatcgcgggataagaaaattagaccgattgacttcaagttctaaaccttccttagccacctcatccaggccacggtgactttgcattttcgtttatctttttatttctctcctcataagctccctccattccaccccaaaacctccgcccaatttagcatagaggcaggcacctaggagatgactagtaatttggtaatgatgatgaggaaggagggaatgtttaagaactcaaatatgggactttcaggttcaacagccagtgatatagttagatatcgtgacacacttagagttctcaaggagatgctttccattgcagtgattcgccacgcaaatgcaatgactggcaaataacaagccacttcaaaatctaggtgcacagtggaagaaaaagtctctccatggaaagcaagtgcatcttggacttgcatctttttttatttttattttttgaggcggagtctcgctctgtcggtcaggctggagtgcagtgacgcgatctccgctcactgcaacatccacttcccgggttcaaactattctctcctgcctcagcctcccgaatagctgggattacaggcgcctgccaccactcccggctaatttttgtatttttagtagagacggggtttcaccatgttggccaggctggtctcgaacttgaactagcatctggatcatccctgctctgcccctaactcgctgacatcttcccctcagctgtagcctcagaagccgtttctccacccttgtgcctccttcaagctagagcctctctttttcttcgcttcaccatgatttaaacatgtttatgaaacattaaatatttatatttatgttaaatcttaaatatatttatattaaatattaaagtaatacacactaaataaaacatggaaagtatagaaaagtaaaacaaagaaaatactaaaatcacccataattccttcgcacaaacacctgttaatattttaatttatttttccagctcttttatttcttctgcatagatcttccccactccccttcaagctatttagaagtttgagtagattaggtatggcaaaggtagggtgtcactacaaaagactactggctggctatcaagaggtcttgctggatggcattgccttggtgctttttcaacctcggtccaggctggactttgagtcttgcagtctcggaaactggatctgttcagtgtcccagaaccagtcagagtcaggaggctgactcgtgctgattacctcacgggagcctgatgtatgaaaaccaggatgctgtttgataatgagaaatagaactatgacaccgtttatattggcctgaccaccacattccctccctttaataatgtgcagcctcactacataccaggtgctgtttgctttgtacactaactctatgaagtaggcactattgctaatcccattggaaagatggagaaactgacaagtctgctgtgtccatgttggcctcactgattctctcttttctccacttccatggcttactggcacattctttccttacatatgtcaaaatcatcaaacgacttatagacaagacttgccagtggaaggcattatgtttcatgaaggtgat

SEQ ID NO: 8371 - DNA, 655 bp, artificial
  synthetic oligonucleotide
gacacagtttcccctactcaatgccaggctaccaaggcagtattgcacccacagtgtcatctctatccgtagtgtacaactagtcctctgcaaaaccattgactaggcatatgaacagtatccagaccagccatcaggatgaataaaaaataatgtggtcctacactggttgtgctccctggagctacctttagcgtagttatgatgatagactttctgaccttgacctgtgcctccaagtcctggatttggctcaagagtcatactggccctgggaggccatcgccacatcctggatgatgactacagcccagccaaccaaagtatctcaaaggatgaccacagtccaaacaaccaccaccttctagactcctgggttataaccctctccttccccatcctcctcattgtgtgcataaaaccacacttttaagaccagcctcactagagtttccatacccaccctaggagaacaaagcccatttccactaaggctaaaaccttgtccccgtgtgcctcctgaggcaaggctactgcttgaggctacctaccccctgtgataatctgtgtgtatacatagctgaagttacatcccaaaggctggacctcacacaatgccaggcctgcttcctgcccccaggaacagacccccccc

SEQ ID NO: 8372 - DNA, 1709 bp, artificial
  synthetic oligonucleotide
agagataagtctagactagcctggagcgaagccaggaagagccttgatggctcaaacctgatttggctggcccaggaagctatggaggtttcctgagcagggaaggatctgatgaaggccaaaccctaccaaaattacagtggccagcaccagcgtggttttcaaaggaccagtattctccatgccttagaatggtcctggtgggtatagtgatcataataactagcctaaaattatcttcagttcttagagattgacatgcatgttttacatccctgcccgttggccttgcaaagcctttttgtgcccttcgtcacaaacactgtgggatcctggcaccagttctctcagggcctaccctaggatatgtaggatccagagaatattacactgtaacccctcacttgcattcctctgctggcgtcagggaaaggctggaggtggtggtggtggtggggtggtgcagtgggggtgggggtatcataatgtgaaaacatgcaatctgaggtgaatggggaaagggttttggaagggctctgtcttagtttggggtggggatagttggagctgattatgtgtacctcaatctgaggcctttcctcaaaatcccgagccgcctgctctccatttgaagccaataaacattgtcagttatgaagggtatatgcatttgggcagggagagatgatattttttctgcattgttacactgaattgccctcctcaaggccatagcaagatacctgtggaaaaagcattgtctataggtcacagtcctaacaggtacttaggaagaagcaatgctgtcccatgactataaccacatacatgagtccagatacgtatgtatgtcttaagctcctctccatctccaacagccaaccctatcccgattaaatatctttctcaagaggtgtaaaaagatattgacccataaaaccaccaaacacttccagatttatttcagtcttaatgagagagaagcaagagaatgtgccagcagggaggatgggtcagcctcctgtgggagtgggtcctcgagagtgttgctgtcccctgggcatgctgagacactagagctgcccagcctgcaaagctgaggaccccactctgggagcacccgtgggactcagctcctcattcagaaagtgaacagatcaatgtaatttgacgtgggcctctgtgaggtcctcccacccattactgtgtgtctgaaaggcccgccgtctctccattgaccttggtgattgcttgtgttgcaatttctaacaggttaaaggaacaagtatgctccaaccccctttgtagaattctcctgctgatactgtgttgcagcacatatcaaggtcacctcaggaaggcaaaagaaagaaaaaatgaagccctcctcttatgaaaacgagcaacgcgtaggtggagacgaggtcgtctgttggaagggctctctctcttgcggtggggtaggggggcctgggggctctttgtcagtttaggggttaatgccttttctgagatccacagattcttcctccacatgaccctcccgcctctgcatataaacactgcccagttttcctccgatatgaagaccgtgcgcattgctgggggaagagagatgttattccgtcgtcattcctgcatgtaagtgcctcaccagggtccgagctgccagctgtggaaaactcaccattgattggccacagcccatc

SEQ ID NO: 8373 - DNA, 1771 bp, artificial
  synthetic oligonucleotide
catagtgttctaagtgatatgccataattctttaactacttccatacacaaggaccttcacatttttttcctcaacttttaaagttctcaaaagtttttccaatatctttgtttgcagaggatgtgtcgctctagaagagatacacataaatagaattttggcacaaaaccctacaaatatttcaacactgagtagccgttgataaatggatctgaaaagaggtggcagcaatttattctctcaggagcagtgtaggatagtgttcattgtccttcaccgtcgctcttgatgttattcatccctttaactatttgctaatctggtggttgatatataaaaggttttgagacaaagccttccttacagaatctgtgaaggtccagggctggtcatgcctgcaagcccatactcagatgtcgcctccagtgggctgggtggggagaggctgagaaaggcacaacagagtacaacagagagtgacaggaggaagtttcggggtccatgagaaggctcagacagggcacccactcagccttggggatgttaatggagtcagtggaggtttcccagaggattaggtgcctgaaaggcgtgaggaaagaaattagacagggaaagggagaggaggaacagcacttgaagcacaaagaccaggccactgaggtgattttggaaactgcaaataagcagacccagtttctattctgtgcacttgtagcagtcaaggttggctaccatgaaacggtgctggatcagaaacgtgtgtcccagtggagactctgagttcctctgctgcagttctctagaatgagggtgctcaatcaggggctagcctgagttccaaggtccagcccttgaggatcttctgggttgcatccaggccctggcctagagtttctgaagtctgtcatgggacataagatagtgatacatatatatatagtctcctaaggacctagcctgggagactctagtcagctgcccacccattctgtagctctggggtatgaaaagaagcaattttaggcagggtgagatgccaatggtgtcatgcagtatcttagggggtagtgagggtatccttagaggatactgaaaatacttgcaatggggctcatgggaggcataatagcccccagggcagcagtgccatcaggggacttgcaactaggcagctggctgacacagcaggtagctgtgaatgtagtagtcccctaagccacggggtcactaaatgtgtgagaagaacaagaatttggaggtcatttagccaaagatttcagtatgtcaatagggcaatggaagctcaagaaggtatagcaacttgctcaacacagagagaaaatgtatcactatggtgagacagtgaagggaggacactgtgactaacactgacagatgaaacctgtcttcccctgaacctgagaggttctagaaatcaagagcctgtgcaaatgggtcatcacagcaaacagcttgaggaggttcatggcagccaggtcccaatcagcagcagtgttgtgcctctgaggatataatgtgtgaggctgtgttggtgtgtgaatcagcctctggtgggtggtgaacagggggctccaggctggcgttcgctctctctctctctctctttctctctctctctctctctctctgtctctctctctctctctctctctctgtgtgtgtgtgtgtgtgtgtgtgtgtgtgtgtgtgttttagaggtgaggtccccttgacaccaagccctgctctattaaatcccctatgact

SEQ ID NO: 8374 - DNA, 4701 bp, artificial
  synthetic oligonucleotide
tggccccctccaagaatgcgcattcccacataaatggttttgactgtttattccgctcaatatttgtcccaggtctttccattttttaatttaaaaataatactttcccatacattttaggctgttcttgatcagaaaccagcagtagcagccctttatggccctgcagtgttagcggaacctactttggaaaagctgtctttctgggcaagggttgaaagtggcggagtgctggagctggctcttaccagaacataagagccaaccataagattttcaagaattttgtgagccagttgttaaatacagccattattaaaaactacattatataaactaacaatcacatcaattatattgaaaacaaacataatatatgctaaaaaatatcaatccctaattatttttctacgttgtactgttatctgtgttcttgtggttatttacatttatggtatccgaatggtaaaaatacatctcttcccaactctgcgttcactgacatcactttgatatcttgcattcggcaaatgcaacaacccagggcatttcccccaaccttcctttcccctgagagccagttgctaaacctgtacctgcacactaatggttgaaattgatccactctacagaagctctgatgtgatgggtatgctcagatctaaccaatgctgttatgtgacatacacgagtcaagacataactcacagtgctctacacagccatgttttaaatctatgaacaggggtagtacacggctaagggaagtacacgaaaaaggtttgatatttaacattcacaaagatgtcctaagatgccaaaaatacaccattatgagactttagaaaaagtgtgtgtgtgtatggggggaggggggcatcaggaaaataaaaggggacagggaaaagggcctcactgcttcccccaatgcccatcactttatttctgtttttcctccctcttctcatgccacatcctttaaccaaaatatgcctcctctttcacccaagtcaactgtgggactgtggtgtgcctaggacacgatttcatagcaggatcttagtcctcttccaggtactaccgcttcattcctccagaaatatgtggacttgttcatccatcactaggaaaggaggggctttgggatcatttgttcgagtaacaaatcagggaagaaggaaggtgtgagctggacttcagtctagtcttgctccgagtctgagtgactttgcacgtttgtttctctgccatcagatcaagaatataagaatcctgacttctcggggtctcaaaaaagaaaggacaagttgtaattggatgtcatccgaatcaattgtcttgggtaaagtactgggagggaagaaaggagggagataatagcatggaaaagggcccatatccaggcatgtccaattgagctttctttctgcctggtggggggtctccaggtcttcatttgtttagaatatcagcagaggactgggaaaccagtgcaggtaagaaagatctgatcgattactacatattgttgttaccttgagtaagaaataaagggactattttggaaaaaccctctgactgatgtttgttgctttgagttttgaaccttttattcaatgctttatttaaaaatcgaattattcgctgatttagggcctgataaagacaagggagtgttcgctgatctttggcttaaaatttcccccaaaccacttctgcaagtcactttcattctttgagtgtgtttcctcataggcaaaatggcaataataatgcttagcttgcaaagttgccgtgaggctgtatgtgcttagtgcggtgtgcacagaataaataaaaggtagtgatgcttcctcatatttcatgggtccttcaaaaacagggtctgagtctaactcatttctcctgtttgattcttcttgtcctgattggcctcagtttcccccactgtaaaattcacattggtctagaacaaaactggcatttcccttggccaaaactgtccttcaaggaagtttggtttggcccagatatagggcttaaagaagaaacccgagccaacgtttaaagttgagtgattttatgtagaaatctagaattccatcttctcttgaaaaaacagtcaatttggccaccatgagtcgctatccctgcatggcaacaattgcctggagccaagcagcagctgcccacttacgcagagcatacactgtcagtttggccagaggccatcgggcctgctctactcatttacatgatctgcttgatcctacaggcattgccacttacggccctctgggcaactggaaacagtctatgccaggcagagggtaggtacttccttgctcaatgaatacataccctactctttttcctctaccattttcttatctagccatgttaggaaatcccagttattggataaggtgattctcactttgaaacatgaattgaacaaatcggttagagtcgcgatagtctgggttatactgtggtaacaaacaacccgtatatcacagtgccttataacaacaacggtttattatttgttcacgtacataaacctagacacaaagtgaaaacatcttcatgtttccacatgcaggggtatacacatgagtgcacaggtatgtcagcaatcacaagacgaataaaaactctggcatatgaactcacacagaaccccactgagagactgatcaacttagattgcacaatcctgtctttatgagacagaaaaaggccccagcatccaaaagagtaagggacagaggtacaagaatatccaccctcagccaaggagttgccccatataataaaaagcttataaaacacctgaaggctttaaaaaaagacgttaagcgttttggacgttaaccattttgcacattcagaaactggataccaaataggcagtgctctattgaggcctcctcctctgggttcctagctcaagagggagatgcatcccagatgtccaataggcagcgagatggagctggctggcctggggcggagagaggggctgggaggctggaatcctttatctccagcaggagctgtggacagaaaggaaggggccagagccaggtcacatccacatccccttccagatctactctttttatgcgtcccgcccaaccaaagatttgtcacctggactgttgcatagacctcttcctctctgatttccccatctcccatcttgcctcccccaatccttccatcaaagccaccacaactctttttgtcaagctcagggtctctgaaattgttctccctagctcagaaaacgttccctggctcctcactacccacagttgctggtccagcctcctaagcctgacctgtcagacctctgtgattggtatcctctccagcctcatccctttctgttccagcagtccctccaggggtgtttcttcactgacacaccatgctccattcaccatttggatctgggaatgcctagccttccctcccagcctccccagttgtttatcccccctcggagctcctccagcccctcctctctgggcacatcgttaaaatttggccacaaaacacagcttgcaagggcatccaggctccacatctagactggaagctcccggaaggcagagaccagacctccttccagaccaagccctttatcacctctgtatgtcctccccagaccacagtaggccacaggcggctgagcatagaccctgggctgaaagtcaagagggccggttcttccacttgatatgctgcatgcatatcagagagggcaagtccctgccactctcagggcctcagcttccttctttcttgacatcagggcactgaacgcttgctgttgcacacaaagctcaataaaccgaagattcaataaacagccctcaactaccatctcgggagtcatactgaggagcttgggtgcctggccccaaggagattcaacttactgactctgatttttcagttagaacctgcttaccacaacgacccccattccccagctattcccaccctgtattctcctttcagggagcaggctacctggtgggttgcaaggctggtgcagggagatggagtcaggaggggcctgggcagagtttctcagagtcagcagagcctcagcggcctccagcttccgctgccactctgagtgggcagaaaccaaagcctggtcagagactttggggacctggaaaggaaagtgcatgagagaataggcactgggaaactacacctcttcccaatacgacaagtgccccttcagccccctgttccctcaacctcctcccccacccccaccaaggccttctgctcttcccatccactaaactccgcccctcccagggttctggaccccactactttcccaggacctgtggctgcagtagaagagggtcaagggtggcacagggctggaggatcagagttgagcatctagaaacaaggaaaggagaggccaggggattaaatccgctggcggacacatactaccagtagacagaaagaggggcaggattttgcagtatctggatgtgagaatcccaatgcctgctggaccattagtcattgtggctggggcaagtcccttctcccgcttggccaggtttcttttccatacctctttttcctgacagggacgcttattcctaccagctctttcctcccagggcaatggtgaaaatcatgggaaattacagg

SEQ ID NO: 8375 - DNA, 2671 bp, artificial
  synthetic oligonucleotide
aggttcattggtcgccagccacagcggcgggaggtcgaaggcagcgcaagagctcattggcctttgtggcaagagcgggaagggaagcagaagctggatcttccctcagaccgtctgactggttctgacttgccggaggctgaggcaaccacaggctgacatcagaattaggtcctcgttctccacgcctcttatttcctcccaccctcctgagccagattcccaaccccttcccctctctgctacctcagcagggaacccccaactgctcctgatgtcccatcgcgccctcagctctcccggaatccctttcgggaggactccttgctccagccccctgagccctggcctttggccaatgaggcagggctcatgggattgcttttgattcggaggtccgggagggagtggatgattgggcttcctgaggaagtggtgcgctccagggtggtgggactgcgtgtgtggggtggggtgggggtggggggaaatggtgtgctcaagcacaattgttgaagtgtggagaggattatggaagattttggggaggctgtggagggaatgtgtgggttttcatgaaagcagaaaaggtgtgtgagtccaagagaaacactactgcactgaggagttccctactggctagatcagaacctgacacttcataggaggctcaacaggtacctgctgaatgaagaatcaagggaatcggccgggcccggtggctcacgcctgtaatcccagcaccttgggaggccgaggcaggtggatcagcctggccaacatgtgaaaccccgtctctattaaaaaatacaaaaaatggcggggcgcggtggctcacgcctgtaatcccagcactttgggaggccgaggcgggcggatcacgaggtcaggagatcgagaccatcctggctaacacggcgaaaccccgtctctactaaaagtacaaaaaaattagccgggcgtgatggcgggcgcctgtagtcccagctacgcgggaggctgaggcaggagaatggcgtgaacccgggaggcggagcttgcagtgagccgagattgcgccactgcactcccgcctgggcgacagagcgagactccgtctaaaaaaaaaaaaaatacaaaaaattagccaggcgtggtggcaggcacctgtaatcccagctactcgtgaggatgaggcaggagaatcacttgaacccgggaggcagaggttgcagtgagccgagatcacaccattgccctccagcctgggtaacgagtgaaactccgtctcaaaaaaaaaaaaaaaaaaaaaggccgggggggatgcatgaagggatgaatgaaattagtaactgaaagagggccagggatccaggagaacaatatgatttcatgggatacaagagggaaatcagctcaaagggggagcaagggaataattaagtgtaaggtggagtacaagaaaaaaatcagcatgaaccagcatgaaatgtgaggggaaaattgaatatagggcatagaagagactgacaatggaattgagtgctggtggcacaaaatcctgtgcggggagtgaatgaatgcaggaggttctgaagagaattggtgaagtggatgccaggaataatacttgggtttggcagagtgcaggatgatacacaagaagggcgtgtagtaatggtggaagagggcaggggagtgcatgtgcatgcctgaaagtggggtctatggtgaagtgacggtaagcaaggagaataatgactgcattgaatgggtatgggatccattccaagagtttcttgggagggggctatgtgtgagtggggcttctgggaaggaggcaacatcagcaagggggttgcagtgaaggttggcgaaaaccatgggagaagaaggggagggaaggcaatctgattccagcggtgagaaggatggagaaggagcattgagccacctcagatagggttttccaagggcagaggaagtacgttgggggtaggggatcacgtggccattctgacctccgctcctgaccctagaagcatggatcccgtgtgtctgaacctccatttccctatggatgtactgaggacaaataaatacccgctgcaccctgctgcccctctgactctgaatgcaccacagggcgtcagactggagccccatgggggactgaacttggccccagaagagctataggttgctgtgaccgctgccacaaccatttgggtatcactgcccaaatcaggggccacaagcatttctgcctcttccaggcctgcgagtgtcacaattgtgccctcttctcatgagtatggtgtctgagatgcggaggggccagacctcctctaaatgggactaatcttagccctgctatcctttgcttcagagaacgcctcagggtcttgcctgctgtgagtgccttgaagagggagcagcgggcacgatcaaagagacacctggctcaaggaccaataaggagtatggctgcccctcccaaagctcccatccgtgtcaggaatttgaccatcagagcaggagccctcagtgagtgtttctggcaagggagggagccagagtttgggtggaggaagcatgagtggttctgtcaccagtcctgtcacagaattgcagtgcgacctggggcaaattgctccctggaccttagtgtgcccaggtgcaaaatgtcacc

SEQ ID NO: 8376 - DNA, 1487 bp, artificial
  synthetic oligonucleotide
gctccacatctagactggaagctcccggaaggcagagaccagacctccttccagaccaagccctttatcacctctgtatgtcctccccagaccacagtaggccacaggcggctgagcatagaccctgggctgaaagtcaagagggccggttcttccacttgatatgctgcatgcatatcagagagggcaagtccctgccactctcagggcctcagcttccttctttcttgacatcagggcactgaacgcttgctgttgcacacaaagctcaataaaccgaagattcaataaacagccctcaactaccatctcgggagtcatactgaggagcttgggtgcctggccccaaggagattcaacttactgactctgatttttcagttagaacctgcttaccacaacgacccccattccccagctattcccaccctgtattctcctttcagggagcaggctacctggtgggttgcaaggctggtgcagggagatggagtcaggaggggcctgggcagagtttctcagagtcagcagagcctcagcggcctccagcttccgctgccactctgagtgggcagaaaccaaagcctggtcagagactttggggacctggaaaggaaagtgcatgagagaataggcactgggaaactacacctcttcccaatacgacaagtgccccttcagccccctgttccctcaacctcctcccccacccccaccaaggccttctgctcttcccatccactaaactccgcccctcccagggttctggaccccactactttcccaggacctgtggctgcagtagaagagggtcaagggtggcacagggctggaggatcagagttgagcatctagaaacaaggaaaggagaggccaggggattaaatccgctggcggacacatactaccagtagacagaaagaggggcaggattttgcagtatctggatgtgagaatcccaatgcctgctggaccattagtcattgtggctggggcaagtcccttctcccgcttggccaggtttcttttccatacctctttttcctgacagggacgcttattcctaccagctctttcctcccagggcaatggtgaaaatcatgggaaattacaggtgtccgtgctttaatttgcaaaacacctggagagatgtgattactgtccctcttcagggactggttctcacttccatattgcccagtccccatgggtcttgaagggtctccaggaagctttctctaatggcctctgggctttgccctgggcctctgtggccctcgccagcacggaccccacctttcagcaggaccttctatcccatccacctgtttcatgtggcataacaacccccatttgttgaagccctactatgtggcaggccttgtgcccgttcccttttcaatgctatgggtatagaatattgtcctcagtacatccatagggaaatggaggttcagacacataaagtcacttgtccaaagtctcac

SEQ ID NO: 8377 - DNA, 1627 bp, artificial
  synthetic oligonucleotide
acggaataacatctctcttcccccagcaatgcgcacggtcttcatatcggaggaaaactgggcagtgtttatatgcagaggcgggagggtcatgtggaggaagaatctgtggatctcagaaaaggcattaacccctaaactgacaaagagctcccaggcccccctaccccaccgcaagagagagagcccttccaacagacgacctcgtctccacctacgcgttgctcgttttcataagaggagggcttcattttttctttcttttgccttcctgaggtgaccttgatatgtgctgcaacacagtatcagcaggagaattctacaaagggggttggagcatacttgttcctttaacctgttagaaattgcaacacaagcaatcaccaaggtcaatggagagacggcgggcctttcagacacacagtaatgggtgggaggacctcacagaggcccacgtcaaattacattgatctgttcactttctgaatgaggagctgagtcccacgggtgctcccagagtggggtcctcagctttgcaggctgggcagctctagtgtctcagcatgcccaggggacagcaacactctcgaggacccactcccacaggaggctgacccatcctccctgctggcacattctcttgcttctctctcattaagactgaaataaatctggaagtgtttggtggttttatgggtcaatatctttttacacctcttgagaaagatatttaatcgggatagggttggctgttggagatggagaggagcttaagacatacatacgtatctggactcatgtatgtggttatagtcatgggacagcattgcttcttcctaagtacctgttaggactgtgacctatagacaatgctttttccacaggtatcttgctatggccttgaggagggcaattcagtgtaacaatgcagaaaaaatatcatctctccctgcccaaatgcatatacccttcataactgacaatgtttattggcttcaaatggagagcaggcggctcgggattttgaggaaaggcctcagattgaggtacacataatcagctccaactatccccaccccaaactaagacagagcccttccaaaaccctttccccattcacctcagattgcatgttttcacattatgatacccccacccccactgcaccaccccaccaccaccaccacctccagcctttccttgacgccagcagaggaatgcaagtgaggggttacagtgtaatattctctggatcctacatatcctagggtaggccctgagagaactggtgccaggatcccacagtgtttgtgacgaagggcacaaaaaggctttgcaaggccaacgggcagggatgtaaaacatgcatgtcaatctctaagaactgaagataattttaggctagttattatgatcactatacccaccaggaccattctaaggcatggagaatactggtcctttgaaaaccacgctggtgctggccactgtaattttggtagggtttggccttcatcagatccttccctgctcaggaaacctccatagcttcctgggccagccaaatcaggtttgagccatcaaggctcttcctggcttcgctccaggctagtctagacttatctct

SEQ ID NO: 8378 - DNA, 1312 bp, artificial
  synthetic oligonucleotide
ctatttttaattttttcaggaaactacatactgttttccataatggttgcactcactttcattcttaccaacaatgtgtaaggattcccttttatccacatccttgccaacatttgctatcttttccctttttgaaaatagacatcctaaaggtgtgaggtgttatctcattgtgaatttgacttgcatctccctgatgctgatgattagtggtgttgagcatctttacatgtacttgttggtgatttataagtcttccttggaaaaatgtccatttaggtcttttgcccatttttaattcaggttgttttgtttcattttgttttgttttttatgctattgaattgtgtgagttccttatatattttggatattaactccatattggatatatgttttccaaatttttttcattccttaggttgccttttcgtttttttttattttatgctgcatagaaacttattaatgtgaagtattcccacttgtttatttttgcttttattgtctatgctttaggtgtcatgtccatgaaatcattgccaagaccaaagcagtttccctctatgttttcttctgagagttttatggattcaggtcttatgtttaaatctttagtctattttgagttgatttttctgtatggtgtaacataagcatccaagatttttgcattcacatatccagttttcccaacaccatttattgaagaggctatcctttttctgttgtgtattctttgtgcctttattgatgattagttgaccatatatgcctaggtttttttttctgtctattctgttccactggtctatgtgtctgtttctatgccagtatcatactgttttgattactatagctttgtaataacatgattttatatagaaaatcctagaaaattcagcaaatatatattagaactaataaatgacttcagcaatgttgcaagatacaaggtcaatatacagaaatctattatacttctgtacagtagcaatgagcaaaccaaaactgaaattaagaaatcaattctttttacaatagcatcaaaagagttaaatacttaaaaaatttaacccagtaattgcgaactgctactctgaaaactacaaatcgttgttgaaagaaaaatgttctatacaaagacaatccatgttcataagttggaaaacagtatttttaagatgataatagtacacaaatcgatctatatatttcacacaatcctcatcagaattccagctgtcttctttgtagaaattgacagactgatttgcctgtctctcttgcattactcttagcttattttccc

SEQ ID NO: 8379 - DNA, 608 bp, artificial
  synthetic oligonucleotide
ctgtaaaataaggctgatcctatctactccctttgattatagttagcctgatgggagtttgcacaagcaaggacccagcacaggctctagcctaaagtgcctgctctgtgaactagacttctggttttctttctccaagcagacagccaggacttgtacttatctttttattttagagagagaattggcctccttcatcctctcagactgttagtttgagactctcctaccatggctagagtgttgagtttgcacggttcccccattcttcattggcctatctttcttttctctctctcttctgcaaaatccctcccctacacatccctttcaagtctgggttctcggcattagtcattgagccctacctgcctcctcatatacacctctttcccagagttgagccatccttggatgccaaagaagcctgtttcttcacggctttgtcctttggtcttcatctcagagccctgggcctttctcattctttttaccctaatccagaaccaggcagctagatccgatgacagggtgggtatagagccccggtcctccaccactccagttggtacttgcccttactactcatgttcccacaaaagaatctt

SEQ ID NO: 8380 - DNA, 4839 bp, artificial
  synthetic oligonucleotide
ttttacaaagaaaacttttttagtttgctgcagctgccatggatttgagactgcaagagttctggccccttgaggcactggatttcagacagaagccatacctggcagaaggagacacctgagagtagtggattgacatgaaaataggaaagtttattatccacatggttctctctctctcctaccattttgcataacctacgttactcatctttctttaatttgtgcatatttgtaaacaacgttctattaattcagcctgccatccactacagtgtaatcttaggaaggcagagcaagaatttttgtcttttattcactgctgtatccccatgcctacacagtacctggcacacagtagacgctcaacagagagttgtgaaatgaatctttgcccttggaaacaaaggcgtcctcttgatggagggagtaaggagagtaagggaaagctcttttcattggcatcctgggccagtgccatgcagtaaacccctgcgagggaattgggcagaaggagactgcagatgcaggttggacgcgggaagatcggtgaaagggaggaggccgcggtgtaaggactgaatcctagagagcggaactttgcccggtttctgcaggtctctatctgactttgaggggagctggtcagaaatccctggaggagttcctgtccccaaaagcacaatactgacgctatggggaccagatggacagaatcaagaaagatgagacagaaaggcctgggagcttggggagtgggtgaacaagttcctgtgaaagtgaaatggcccttcatttgaatgcaaatgctatgtaaaagcctgaagccccttgacgtcagcccagccattggtggcctatctatacagggctgctagtcacctggataccctcgtaagaaacgtgggatggagtagcctgaggggtgcaaaagagcttgcggcacaactacgtactgataagtttattctctgctgcttctcaaagtcgagttggggccttacagggacttcaggatggcttagggagcgccttctacccaagacacgatgtacggaagctgtcttttggagaaagaagcaggcatgtacccgggcactctcatgagccctgggggcgacggcacagctgggacaggcggcacagggggcggtgggagtccgatgccagcctccaatttcgctgcggcaccggctttctcgcactatatggggtatcctcatatgcccagcatggatcctcactggccgtctctgggagtctggggctcaccctacagtcccccgcgagaagactggagcgtgtatcctgggccgtctagtacaatgggcacagtgccggtgaacgacgtgacctctagccccgccgctttctgctcgaccgactacagcaacttgggccctgtgggcggtggaactagcggcagcagcctaccaggccaggctggcgggtcgcttgtcccgacggacgcaggcgccgccaaggccagttcccccagcaggagccgccacagcccctatgcatggatgcgcaagacggtgcaggtgacgggtgagtaatcaattccaatgcccacacacttttccttccttcccttctccgctacttctcttggtcggcctgccctcgtacttctcaggcctctcccaagagggcttagctgaggcgacccctatatggctggctggcctattaggcatctccctcgcattcgcctgggctcaaaactcactcactgagtgcagcgattgggactaaacctaccctagaggtgattttcgcctttcgctgctccatgaagaaagcgagtgagtggacaatgggtatgttaagccacaaggatcaggatgcaaccctgtagttgcccacatgggaaaagagatgcatgagaaagctcaacgggtgaatgaagcgagagggcagctgtagtgtcccgttgttcaggcactgctgcttgactgttccatttccaaacccttacccatctgagcgggctgtctcccccctccccgcccccaaagctggtgatgctcaatttaggttcacagtgcttggctggcaacggaccctccagtttagccactaagtccccgacggcaaagcaacctcttcaccctggcctctcagggaagctccagcttccttcctacaagttggcagaggcaaattggcctaaaatccattgccatcttacaacgtcctttcttctaacccaagtgttgaggcaggcgagaaggctacagcactgacctggtacataatacggtacctaaccctcacacccgcccgacacgcaaacgaatcagctccagcactaataaatggctaaagccctcataactatcaaagcaggcgtctctcaggcgtgggggctgaatgcaggtctgcggcagcgcgagagaagtcaaagcgatcgcgatcacagcctaaccagcaagccagtgggcgactgctgggagccagggcgagggaagtggccgttccactttaatcttaaccggggctgggggaggaatgtttgttttcaactgttgttcttttattacattcttattattccaaccctcgctccctgtcattagagaaaattagtaaaaatcgactctgagtattttcatccctctggggaggaaatggcatttcaatagcatttgtccgcaatgattatgctcctgttctcagttctgcactttgtctttcctccaaaaagcaaagacaggagggtgggaagtgacccatttttaccattaggagaacttttagccaggaagaggaagttctgtgtattagaacctcactagagtagcgatcccaaggtaaaagtagagttgaaatacttggctttaaagcgtttgcaagtaaatctgcattttaaaaaaatatgagtgagtctgtcgactaagtagaatagaaaaagaggttagggtggggcactcccagagtttttattacatctaatctcggggttgtaattaacatccactcactaaaccctaacaatcagcaaaagacacaaaagctagaaaagtagttgctcgcagtctaggattatgttttgaaacacattaagaggaaagtcactggcgtgctgtttgcaatagagaacaagagaggaaatggatgagataaaagaaattatctccagccttgaattttctatttatgaggaaaaatatgacagttttatctgcttaaaggtcttccgtttacatttgcttttattagcctgagtctctctcttgggcaattctaatgccaggaaaggtttcgaaacgggctccttagtctcttgcatctttgagctaaaccctcaaacctgactttacaatggcaccgtcacaagattttctatccaatttctatgagaagtttaaaatggaatgatattggaaccatttcgatttttggcagcctattctatagatgaggcttcattaaattaaaacttcgtttcattttaatgtcttataaatgaaaataacccttttgctgtattcttatagtctaaggtgcatatttagcagcaatttaagaatatgatgaaaaactttggttatctccctagaaaaaatgcacaaaggcacagcagcacacacacaaacacaagtaatttgttacataattttaggagattcatggatccattgaagccctttcaagggacatcaggttataaaccccacgaaaaaaattaagctgatcacctcactaggccacccactcaggaccaaaatgcacccatttatatgcttagtacatagtgggtcttaaatatttgtttaatgaatgaatgagtcagatcctcctaaattttccacttcactctgtagtactgtgggataacatatggtttatgactgagaggaaaagatgaacttcaatatggaagtaacccttgattaaggtagtcagatgaaagttctttccattactgaaaaatgtcttaaataaatgtaaaaaaggaaaaaatgcatgtattagtggacaatcagaaaacatttcatagcgaccattatagcatgttattttctaatgagagcaaggaggctgacagatagagtaaatgactgttccctaagtgacctgatttaaaaagaaggcatgtttatttccacttagttctctaagtggtctatttctatacatatctaactttaaatattatgcaaaaaggaatatgacagaaaagtttctatggaaaatttaatattttcatgcactttcacattttaaacattggcaaggtgataacctaagcaggctggagagaggcttttctgttagaagtggaaaagagggggagagcaggaagtaattgtgattgattctgattctgattgattgttttaagccactggacaacatgaaggaatttatgcttgaaaggcattattcaataaggacacttcataaaattagttgcttaataattcttgagagttatcattgtcccttggttttgctcatttcatgggacaactttttaaaaatgaatttggatgcaatttttagctaaaaacagtgaaatattaccataagatgaaaagtcctcacagtggagtccattagacagtactccctacataagaatattcattttcataatctttacattcactcccatcatcatcacctctatgtttggagagtgactttctgcctagcagcacttttgcagccagtctttcaaatgaacaccattttaattttatttagggtgataagttatcatatattatgacatttgcttgtgaattctggggagataatgtggttgggaggatgggaaggactccatccatctttaactacagaagtttttctgactctttgaggaga

SEQ ID NO: 8381 - DNA, 2245 bp, artificial
  synthetic oligonucleotide
atttttgatccaacctcttggaattatattcttcaaaacacatttataaggagggtatcaattgccctattttactgatagggaaactgagatgtgtgcaatcaactcactttccaaagatacatagcaaggatattgtggatgctgatgtgaacccctagctacttaggatgatcttccttggtctctagtgataggtctaaactcaaagcatccctttctttgcattttgtatctgattatgctactgcaggtgcatacagctccctaaacaccagtcagtgggtaatgaccacctaggaatgcagcctaatttttcttgttttccagctcccttacccttctgattagtgagtttgaagcttctactaataatcttaataatgccctatatatgtgtaatatttttatatatttcaatgcaattttacacctgttattttattagatccaatatcctcacaagatatgaaagaattgctacccctattttgtagtttgagaagctagagaccagaaacgcttatgaatctttgataaactaatttacttctcttagcccacatctacatattggtggatggtgataaggatagatcaatttaaattctttcctcttcaaaaagttactgacttttttcggtaagttgttggcaaaatctaaaactagatctcaggtctgctgattcagtgaatatttattgagtgcctactctaccaggcactatgctagggtttcttgactcccagaaaaacacatattctactccactcaccgcctccagtaaatttgaggtgaactacacagcatgctaattgattggcaggccatctgtagtgcagaacatagaaaatcagcattgaaatgggtccttccaatctagtggagagatgagaagtgttacttgtctatgtacactcagaacttaattttgtcatcctagtgcccactccacaaaaggtataactttggctatatcagttggattttctcaggagtttctctttcctgctgcaaacaatttttctcccaaagaaaaaaacattttcctatttgtatagattctgattctctagaatctgcaaatagaaccaaaatggagcttttgttttgactagcatattgcggccactccctctaagaatacatgttaattcattctctgagacctaagaaaagtatacgaccacaagcttttatttctagcttatggtggtttatgctggaggtatgtagagaaaagaaatataaacactgaagctcaaaagttgcattcaaagtatttaataaaggcttttttcttttttacggggaaagcggcaagaatgaaaacataccaaatgactgacagtgttcacttagggtagtgggattatgagggattttcttcttttattatcactaaaatttattctgttttataatagggaaacaatgtttccttcccaaatatttcttcagttcatcctcaagtaatttgcagactttagaatcctctttgcaacttattcaagtattccaatttcccagtaactttcttaaggcccttggagttgtttgtgtggagttgcaaagaaaggtctttgggaggatctggcttcttttcaaagaaggaaggaagcaaggcccaaggaaagttttccactcttggctcagatccagagaatctggctgcttttctgagttggaacattttaatactactgtattacatcaagaagagaatgaggggccagcaagggaggagggtggtagaagggagagatgtatttataacagggaacaaggaacattttgggggtgatggatttattatcaattctgctgacagttttatgagtgtatacatatgtcaaaactcatcaacttttatacttgtagtttcttgtatgtcaattatgtctaagaaagctgcaaaaaacaacagagttgttgcaaccctggtgacaaaaaagaagggagggaatcgctagactgtttagtctatagtcactttatataacttaggttcagccccaccttcccaggtagagatcacttgcttgtatgttcatgtctaaatgtgctactgaggaaggacaccaacaattgataatcactgggtctctcatatcatgggaatgagtttggaagacagagggagaccaggttatgtaaggattgaattttcaaagtgaaaaaatgcaaagcaaagaagtcccttactgcagtgccttcaggaacaatattatgagttgttagtaa

SEQ ID NO: 8382 - DNA, 2050 bp, artificial
  synthetic oligonucleotide
gggcctctttctattttaacagattttccccatccctttccttccttctcattcttcaaggccataatttctccacttttaccatagttccaatatcttacttgcactcattacaaagtccaccccctactcctttcccttcctgtacttcaaatagcctttcctagcctaatcttgagtgtgaggagaaactaccatttaagcagtagtcagtgaaatacttttccctctagacacagacttagtggaccttcgtggataagatatttggaaaaattttaaatgtcatttacagttttttttttttgcctcttgaaagagaagaactgttgcaaagtattaattttgatcttaactctgacacatttattaacaccccaaaaaagcaaagatatatatgtcttgccagaaggctatacaaaatattttaaggttctatcttctataattcctggctagtagatacagttatctaaactacaaaaagttataatttgttgcttattgataatgttatgacttttttttttttttttttgagacggagtctcgctctgtcgcccaggcgggactgcggactgcagtggcgcaatctcggctcactgcaagctccgcttcccgggttcacgccattctcctgcctcagcctcccgagtagctgggactacaggcgcccgccaccgcgcccggctaattttttttgtatttttagtagagacggggtttcaccttgttagccaggatggtctcgatctccgacttatttttaaagttccctaaataaaccaacttttgaataaaaatgggcttttcattttaataacacatactccttgatgataatggtttgattcatttctcttacagaactaatttcttcctacttcacacacattaaatgctttgtttatactgataatgtcgtgctcatcctaaattaaagtttgactatgtctgtttccccagagacacaccatctgattgggatgcagccgtagagtagcagaaagagcagtgaagctggtattagaatgcctggattacagtgtttgttctgttacttagcagctgtgtgactttactgtcttaatgatatggatttttgtgctgctgccaagtatgaaacagtttggcacactatttagatacgcaaaatatgtgatccccacaacattttagtgagtgtaaagaagataggatagaccatttaaaatggaaaattttgaacaaaaggtcaccatagacttgaataaattacttaaacttctgagacccacttttgtcatgtaataaaatagatataatgatacttacctctcaggattaagggttaactgaaatattgtatgtgagggtctagctcagtgtctggaaaatggatgatgttaattaaggtttccttaggttggaatgctcctttcaccccctccatccgccccctcccccaaaaaacactccaaaattcaaacatgcatattctgattcatcttttaaggaagagcccaagaggcaccattctacaaaatctttccaaacaacttcaggcagtacagccctttggttaagagtactgggcttctggaatcagaagagaccaccaaatttaaaaccaggtctcccatttagtagctccctgacactggacaaattacttattttctctgcacctagatttcccatctgtaatataaaatcatcatgatacatacctcatagggttgcagaggattaaatgagatatacatacagagcacttagcacagtccctgagttaataagtcctccgttaagtattacataggagaagtagtaaaaagtttcctcttaagtaaaatgctaataaaagtgcttaccctgcctcccaagattgtggcaaagttatgacgcaaggcttttaaactgtaatgctgaacaaacgtaagggattggtatataccttgagatattttggacaaagttctaaccttacttttatacaatatgctttctctcacccgcctgcagttgggttaataatgcccagcattaattaataagcaataaaatcaga

SEQ ID NO: 8383 - DNA, 2143 bp, artificial
  synthetic oligonucleotide
ttaacaagactatactttcttagcttgctttgcactggaagttgactaagaggaaatgtgaaactagcaatatgatggagtatgtaagtatgaggttgtttttaattatttttttattcattctaaatgtaccattttcctgtgtttatcatttgtcaactattccttcttttttctcctcagccagaacttttgtccattgaaatatagaggttttcttctatcttctttagatttgtagccaacctaaaatatcttgaaagctaacaatcatttggatcttagaaaagtttcagttagtatgctaaaatgaaaacattgtacaaccttaatcatttaacataggcacaaaccatagcatgtggtggtggggaaagctgctgttgaacaaatatttctaaatgtaatcttgtcaaaacttgcataaaataggagttgatatctgcattctggattcctattactggcttttttttttttttttggctgacatttaacttttagtgaagaaactgtaggttctaatttttgttttaactgaaagctatacaatcttagtcataagacataaattcacatatagccaatgtgatcaatttagcataattaacattgaaaatattacatttatccaaacttccaatatgtagtacatatttaataataaacattccatgtgtgtttcataagtaaggattattatggtatctctctacactttgaataattttggggaaaatatgcatatgaccacaagtctaaaattcattatagataaaacattcaaaaatatccgagttttttaaaattatgttttcaaaccttttgtaattaatatgttttactcaatccatttgggcacattaatttttcacaacttgtgaacgatagtaatctccaactaatatcagtttctttaattgaaaaatatataaatctaatataaaggcattttttaatctgtatagcatttttttaatctctactttgctaacaaagagataggggtgtgggggaaaaacataatataatttaatggagtttgctcctgttaacctagacaaatagttattgtaaatcagatagtaaaatctgttagctacaataagtagttttgtttgccagcttaatttttaaattgccaatctaataacaacttgtggtttaagttctttacatatttttttcatgtatttcacttactttatatggttcaggattgaaatattgtcctatgaaaaatgattatagactttctgggttatttataagttatattaaatgaaaaatattttgtaaatatattcttgtttttattttgcaggtaatactaatagaattcttaccaaaatatcccatattccgacctgactgaggagttttatccagtcacttctgtgttacctgtcatttcctacccttagtgccttgtagatttggaatgaagatggtctcctttgctgtgttcaacttattctttataatggtagaatattcttctcgctcttttgtgttggtttatgaagaaaatttgcacatcttttttgtctttcaatgaggcttgtgttttgcactctcaattttaaatacacacacatgcgtgtgtgcatatacatatatagatagttgccattaaagataaatcatcagtgttggtgtttaaaaaacaaaaacttgttctgagcatgctgccttataattttcatactcattgtttctaaactcgcatcatttttctaggctacttgatgctctgtaatcccttactggacaaacttaaataagcttttggtagcttttagaaatggttttactctgcttttaaaggacatgcttttaaaggacatgcaattaatggcactggttttgtcctgcactttgctttatcacttatgttagtggataaaatatttaaactcctaaagacttgtaaatattgcctctttgcataatgtaaaatgtggtatgccatggtttacataatgtaacattactcttattgtattgccaacaattttacatagattttaatatgaatgaagtttgcaagcatccctttgaatgtagaaactgctaacatgctgttttatggcaaggccataatgagtatgttaagaatttcaggtgtagggcaaggttgccc

SEQ ID NO: 8384 - DNA, 1086 bp, artificial
  synthetic oligonucleotide
ctagcagttcacctcaatgagttctccaaccacttatctttcctttgcttcttcttttggtttgagttcttatattagcttttaaaataaacttatagatcataatatccgtcggcagaaggatagattattattggagggtaagttatgaaaacttgtattcacgttaattgtcatctttgtggtgacagctgtattgaattaaaatgaacaacaagcactaaactatcttgttacatactggggtgaagcatacataaggtgtaccccttcctgggacattttggagtaatagctaggaatttatcacacttcatttgttaaaagaaataaacctttgctctctctactcactgacattggtaacttcttctgactcaaaagagtactactggaacaagcctccaaaaaaaggtgtctttggggtcttgattactcatgttgttcttccagccttttttatggaagttggtcggtgccagcttctgttttgtactcagttttcagcctgggatcctcccaagactaaatggactgagattgctaataactctaaagaatgaagtacaatgccttagaaatctggtaaactgaactaccaggaacactagcagaaaataagattttagatttagagttttcttagagcttatttatttaataatgagagcaggggataggagactcaaagtgcaaccattcccttttgcagaagcacaacctcaattgcctagacaagcatgttttccactgtgaatggctcagaattatcattgcaacataggtaaaacactttgttatcactggtaaacctacttttattaataatattggaaatcgaaacttaatacctgtgacttgagccaaaaacaggaaaaaactggaaattccaaactgaagcattttttaaaaagtaatcagtaaccaaaacaaagacatcaagtgaacttgctttaactatcataaatactttgaagcaaaatatctattcagctcaacaaactaaagcatctggctatagaattatgagaaaatgaattcatctccctgggctttcatttcctcatctgtaaaataaagaatttg

SEQ ID NO: 8385 - DNA, 17421 bp, artificial
  synthetic oligonucleotide
cacagattagctgaagccaaaaagcactggcagcatttgaaataactgagaacatattatacttaacactttattatctaagagaggcacttgaagttgagacctagaaatttgattctgggttctttgtttctaaggggcagggtgaacccagctatagcattcacagatgctatagaattatatatattctatatataattatatatattacattcatattaatatatgttaatatattctatattattcatatagaattcacagataatccaagtgcttttttaatacattgataccaaatctctcctgctctcaaaaaaaaaagcccaaggcaaaaatttttgattagcctgtatccgcaaattcatagtgcatggcatgatgggtactctacatccctcctcctattgcactcactgtgcccagatgaacctaaagtcaccagtaatagtgctaatgtagtaatgggcccaagcttcaaaagaaggaaaattagtattcagtatttaaatgtgggaaagaggaagaatatggaaattatcaattttataatacctatacatattcttacctgcattaatgtgaatagacatcaatgataaacagaataatgccccataaagatgtctacactgtaatctccaaaacttataactatactatatcacatggcaagagggaattaaggttactaatcagctgaccttgagatgggagattctcctggtttgtatgggtgggcccaatgtaatcacagggtccttataaatggaaaaggcagacaggagattcagtgtcagactgatacaatgagggaaagactaccagcagttgatggctttgaagatagaagaagggggccatgagccaagaaatgtgagtagcctctagaagctgaaaaaggcaagaaaacggattcttccctagaatctccagaaatgcagccctgccaacatggtgattttaactcaatgagatgcattttagacttctgacatctagaattgtgttattttcagccctcaagtttgtggtaatttgttacagcagcattaagaaaatgtacaatgaccatgtgcagtgcctcatgcttgtaatcccagcactttgggaggccaaggtgggtggatcgcttgagtccaagagttcgagaccagcctgggaaacatggtgaaaccttgtctctacaaaaacacaaaaattagcctggtgtggttgtgtggacctgtagtcccagctactctggaggctgaggtgggaggatggcttaaacccataaggtggagattacaatgagccaagatcatgccactgcactccagcctggacagtagagccagaacttctctcaaaaaaataaaaaagaaagaaactatacaatgctcctgtgattctagtgctatgtacatatatcctttatagggaattaaggaggttatagacacaaccagaagaggaggcatggaatagactaatgtataatggataggaaagtgtatcttttacaacttctctgtaaaaacaccttcacctactttatgagtttgcctcagctgccataacaaaatatcagaccaagtggcttaaataacaatttattttctcacagttctggaggctagaagtctaagatgaaagtgccagcaagtttgatttctggtgaagtctctcttccttgcttgccaatggccgctttctcactgtgtcttcaaatgtccttcctctgagtatgtgaggagagagaggtttgatgcctcttcaccttcttataaggacaccagtcctactggattagggctccacccttatgacctcatttaaccttaattacctccttaaaggttctatctccaaatacagtcacatttggagtcagacctacaacatatgaattttgagaggacacaattcagtctataacacctagatggaaggcaatttcatataaagatgatatgcagtctatgacagcaaagtagctagtggaaatcacaacccctaattctatttttatgtcattccctaagtccaggtcccatgtggatatagcattgttcagggctatctctttgctgttctttttttttttttagactcacacaagcaatgtggagaaggaacatgaaaacatctttgagatagagcttaatacagatgtcaatctctttgtaaataagcaattaaaagtggaaccactgtccaccatgtgagaagagtgactggctatggctggatatttttaaatacacataaaatgtggtataaatggtagaatgccagggatagaaggagtatcttataagttacctagtcaacgttctggcttctgggcagaaaactatctaaactcagccagataatcagtttcaactaaatcaggaaaacatggaatcatctttatctaggtagtgttatagttacattgcctcatttatctacacatcaataaattctttctcattgctaatatttatcattcttatcatagtataagcaaatgttttaattctattatggtaaagataaagcttctgtaattaaaacactttaatctggaaagacagcagtaaacccttcaagcaaaagcccaagtaggttcaaaaataatagccagagaggttaaaggtaaaccaatagagtgatatgttacagcaactaagggagagaggcaggagttttttaaaagagagaagaggaattataacaacagaaacaggttagccagctgccagtttagatgagcataatgagtcccttagatagatcattggtgatttttatcaaaacactatcggtggagttgtgggagtggtaggctgactatagtggattggggaattaaatagtgatgaacccaaaacagaaagtctgaagaaattccctttgagccaaaaaaaaaaaaggccgggtgcagtggctcacacccataatcccagcactttgggaggccgaggtgggaggatcacctgaggtcaggagttcaagacaagcctggccaacatggtgactctactaaacattgtctctactaaaagatacaaaaattagccggaagtggtggcaggcaacttaatcccagctacttgggaggcagaggcaggagaattgtttgaacccgggaggtggaggttgcactgagctgagatcgagccattgcactcaaacctgggggacaagagggagacttctctaaaaaaaaaaaattccctttgagcatctctactgtagagatgaaataagagagaagtggattctttagtatagagatggaaaggtatggagctagaacatgtgggttgtgaacagtggctaactaaaccaggaccagtaacctagatatcacattgggcttaattgctgggttattcattcattcaggcaacatgtatttgttgagagcctgaatgtgccaggtaatagaaacacaaaggtggttaaaatagaccttggcctctgtcttcaggaagcttccagtctgaagagggatgaagacatatattaatcaaacaatcccacaaatgcaggtataatctgcataaactgacaaatatatctactttggagtcaagaaattaagagaaatcactgatgtgatcagtgaacaagtaagatttattaggaagatggaaggatgacattacttcaaatatattacaggaaaccccaaccatggtaacaacatcaggcctatctttacatatgtttaataatgcttaacttcacttttgctcctatcctccccaaagcaatcttcaagttcttctgtatctttgttttattttctttgttcttttttgtctcatttcctatactgtttttattccatactttgacagttcagtgaactcctttgatagatcccaagtcctcctttttcaatatttacacttataatcatttttgatcactccaaaactgagaactttgagtgtagattttctaggcttcttattttatttttagacattatatagaaaaattagagggaagggaaaagaaggatggcaacatggtaactgggacagtgttcaaaaggtctaagtcctacttctcactccatacaaattatctgcaatttttttatttttgagacaggctcttatctctcacctgggctagagtgcagtggcacaatcatagctcactataaccttgaactccagggctcaagggatccttccatttcggcctcccgagtagttaggactacaggtgtgtgccactacacacagctagtttttaatttttttttattttcatagacacagggtctcactatgttgctcaaactggtcttgaactcctggccccaagcaatcctcctgccttggcctcccaaagttctagaattgttacaggaaagaggtcccaatccaggcccaaagagattttatttatgtactagtgtggagcctagcctaggacacatcaagcagaagtgcagataaggtctgactctttccagtacagctagggtgcctggctctccacatgtccccagaccttatctagaatctaatgtctccaaggtaggtacattgaataattttcaaaagtcaaggaagcagtttatgaccttaaagtagttagcaaacttaatatctgacctgactaatttagaccaaatgtttacatttttgaagatatttttattttatcagtaatctttaaaactattttctattttccaaagattacttaagtcaaatgaactaaaaggcattatacattttagttttctgatgaaatatctgatttaagcacttattatttttgaaccaattaaagcttttttatatcacacacacaacacatataaatacacagacaggctgggtgcagtggctcacacttgtaatcccagcactttgggtggccaaggcaggcggatcacgtgaggtcaggagtttgagagcagcctggtcaatgtggtaaaaccccatctccactaaaaatacaaaaattagctgggcatggtggaggatgcctgtaatcccagctactcaggaggctgaggcaggaggatagcttgaacccaggaggtagaggttgcagtgagccaagattgtgccactgcactccaggctgggtgacagagggagaccctgtctcaaaaaattaataaataaatacacagaagaagataaaggacttatcccctaaggcaggaatcaaaccctgaacacaggccaccattgtgaaaagaaaaagcacagccacatggttacaaggtcaagctcccaaggacatacaaaacaagaaggaaacctcatccagttttttcagggacctgcagcaaagtttgtacctgataaatttactgggccatcttgaacagcaggtttacaggtgtcctaagctcatgttctatcctaagatacccctctttatgacagaacaatacagaaagacacacaacagatttgctacaacttaagactagcctcataaatccattttttcactaatcaaaactttacagaggaaatgaacagtgatttttgccatccattcaaccagttttatagagagagagagaggaaagcattgcctgaggcagggtggggaaggcccggcactccgagtgccagagaaagccccacccattgcagcaacactgaaaagttcatgcagctgcttgtcagtcatgaacggattttttccagcagtcccatcagctctcatttccctttttaggagggaaaagctccccatgttctacaatcctctacatgcctaattctgtcaaccatagccatcagcaaagagtgcaaggcagatcaatccaaagagaatagcggttaacatcctataatgccaaacctgttcttagccgaaagggactttaaggagagggactttactgagagggacctctaaccccctaaatcttaaaagggactctaatcctcctaagttgggcctctaacccagtgtcagtcaagcatccttgccttttattgagaggaagctttaaccctctcttacgagagactctaactcccctaagttgagctataaccaatcccatcctttgcctgagtaccccaccacttacccaaagttgtccaattagtaatgctgcagtctatttcctttgtgctgggggtctcctcagtatcatcccttcgagtttcaccagaaagatgttatcaggccccaccacttacccaaagttagcctttggattgggggtttctgcattatagtcacttcagtggttgccaaaaagatgttataggacccccaacacttacccaaaattaacctttgggtcaggtatttctgcactatagtcccttctgtgataatcagaaagatgttataggaaaaggatcctgatccaggcccccaggagagggttcttggatcttgtgcaagaaagaattcagggcgagtccgcagtgcaaagcaaaaccaagtttattaggaaagtaaaggagtaacagaatggctactccatagacagagtaaccccaagggctgctggttgcccatttttgtgtttttttcttgatgatatactaaacaaggggtggattgttcatgccttcccattttagaccatatagggtaacttcctgacattgccatggcatttgtaaactgtcatggtgctgatgggaatgtagcagtgaggatggccacactaatgtgttttaagccttttcctcagccaaactacaaaaaagcaaaaattactttgtttcaatattacccctactggctaacacactagcaggtcatcagaatatttgccattcctacaaaattccaagattctgtgatgatcctttgagtataagaatcacagagatacacacaattgttacatgctctatttaagttttctatgttatattttctctttataccccccaccccatttcctgactctttctttttaaagggtctttgggatcatgaaagcaaaatgcagcatcctcagtgtcacacacgtccatgtgaagagaccaccaaacaggctttgtgtgagcaataaagctttttaataacctgggtgcgggcaggctgagtctgaaaagagagtcagcaaagggagataggggtggggcagttttataggatttgggtaggtagtggaaaattactgtcaaagggggttgttctctggcgggcaggggtggaggacacaaggtgctcagtgggggagcttctgagccaggagaatgaatttcacaaatgtcatcagctaaggcaggaaccagccattttcacttattttgtgattcttcagttgcttcaggccatctggatgtatacatgcaggcttgggctcagaggcctgacattcctgtctttttatattaataagaaaaataaaacaaaatagtgttgaagtgttggggcggtgaaaaattttttggggggtggtatggagagttactgggtgatgtttcttagggttgctttgagtgggattaggggtggcgtgggaacctagagtgggagagataaagctgaaggaagattttgtggtaaggggtgatattgtggatttgttagaaggaatatttgtcacatagaatgattggtgatggcctggatacagttttgtatgaattgagaaactaaacagaagacacaaggtcccaataacagaaggagaaaaacaggtattaaaggactaagaattgggaggactcaggacatccaatcagagtgcctaagggggttcagcgtgattattttcttggttgatgagtttttgggctctatccttgagtttttttatgttgtcatataccaagccagattgatttaggtaaaaacaacacttttcatttaaaaatacacacagtcccctttttttgagcagtaagtcaaggcctcagtgattttggaggaaagagaaatgcaaagccagcaatcattttttaaagaaggattagaaacagctaggagagagtgaatgagattgatagtgtggtggagatagctggggagaggtagagggtcgcataagaacaggaatgagaataagagtgaatataaaggtaaagaataggactttattagggtgaaagtattggagtgtaccttgtcactgaagatcttctatccacttcaagagagacttaaggaaggtggtttgaggtaaaaccaggagatatgagttatgatggtttggaggaaaagtgtaaactggcagtgtaaacaagggcagggcatttacgagtagttgagaatggtgaataggagtatgactagacagaagatagtagggatgacaagttttggggttgcagtccaagtagtgggggtgactgcataaagccttgttgcaataagtagggtaataaacttaatagaatgaaaggatgttttaggctcataagggttactactgttcttcagaaatgtgagtgagtttaagggaagtagggttgagtacttgcaacttctaggaggaagaggagagattaggctggctgtccaatggacacagctttattctggaatggtgagcctaatagggagggtcttacaggcggatggcagttggggtattatagatgactaagtagggtccggtctatcaaggttatagagtttgaggggtcagattcttaacaagaactgatcgtccatctagggtgtctttatatggctgggaatatggagtaggcaagaaaagattagcagcttggcaaatttcctgtcttgcctgctggaggaccagcagatagattcctagaggactggtgtctgagacgaggttggggccaagcaagaaagtgtgtctatataaaagtttaaatggactgtaccctctagcatctcaaggacaggctctaattctgagaaaggcaagaggtaaaagtactgtccaatcttttttaagttggaggctgagcttggtgagatgtgtctttaaaagaccattagtccattctacctctcctgaagattgagaatggtaaggggtatgaaggttccactgaataccaagagcctgagaaactgcttgggtgatttgactaataaaggccggtccattatcagactgtatagaggtgggaaggccaagcctaggaattatgtctgaaagaagggaagaaatgactatggtggccttctcagaccctgtgggaaagtcctctacccatccaatgaaagtgtctacccagaccaagaggtattttagtttcctgactcggggcatgtgagtaaagtcaatttgccagtcctgggcagggcaaattctcgagcttgatgtgtagggaagggagggggcctgaggaattcctgagtagtagtagtatagcagatgggacagagaagtgatttttttaggatagatttttacaaaggaaaggaaatgagaggttttaagaggcaggatagcagcttgcaacttacatggaaggggttacaaaatgacaacagaatagaataggcctgtgaggctggaaggagatattttccttgttccaagaaccatttgccttgtgtggaaagagattgataggtggaagtttcagtgggagagtaggtgggagtgacagatgagaaggagaaaaactggccatgagggacagaagttgggacactagctgcttctttagctaccttatcagcataagcactgtcctgagtgatgggatctgatgccttttgatggcccttggagtgaatgactccagcttcctttggaagtaaagtggccttgagaagagtttttattaaagaggcattaatgatggaggacacttgcatagcgaggaaacctcttttagcctacataacagcatggtggtgcaggatatggaaggcatatttagagtcagtataaatattgatgtgtagtccctttgcaagagtgagagcctgagttaaggcaatgagtttggcttgctgacaggtagtggaggtggacagagtggtaacatcaaggatagatgtggaagatactatagcatagcctgcctttgctaatgagtgacaattaggcctgatggaactgccatcaataaaccaagtgtgatcagggtgaggaacaggaaagaatgaaatatgggtaaatggagtgaatgtcaggtagatcagaaagatacagtcatgggggtcaggtgtggtatcaggaataatgtgggagccagcctaaaacagtaagatcaagttgcttggacagaaaggctacaggtcatggtcctggctcttgtgtaagaattctgaccgcacagccctgcacttcagctgtgtgtaatgaaaaagggttcagatgagttagggagagctagtgtgggagcagcttccagggctgttttaagaaatggaaaaaggagtggggaaaggatttaggatctatggggtcagctaggttttcttttgtgagtttatataatggtttagtcaggacagtaaagctaggtatttaaaggcaaaagtactgaaccatgctcaggaaagaaaggagttgttgctttgtcaagggggttggggtttgggagattagccagacacgatcagcagggagagcatgtgtgtttttatgaagaattatgtcaagatatataacggatgaggaagaaatttgggctttggaggcagatgtgcaatgtccttttgagaatagattgttggagcagcaggagggtgtcctgttgggaagatttgtaggaggggctataaagtagaaggtcatcaaaatatttaataaggtgagatgtagatggatggaaagagagtaaatcatgagaaagggcctgactgaagtaataggagctgtccctgaagccttgcagcagtacagcccaggtaagttgctgagactgatgggtgtcagggtcagtccaggtaaaagtaaagagggccttggaggaagggtgcaaaggaatagtaaagaaagcatatttgagatccagaacataataatgggttgtggaggggttgtgaagggaggtattaagaataagagagtatatgggtttggcaccatggggtggataggcaaacaatttggttgataaggtgcagatcctgaactaacctgtaagacttgtccggtttttggacaggtaaaatgggagaattgtaaggagagtttataggcttcagaagctcatgctgcagcaggcgagtgataacaggctttaacctttttaaagcatgttgtgggatgggatattggcattgagcggggtaagggtgattgtgttttaatgggatgctaaggggtgcatgatcggtccccaaggagggagtaaaggtgtcctatacttgtggattaaggtggggagatacaaggggaggatgcgaaggaggctttgaactggggaaaaggcggcaatgaggtgtggctgtagtccaggaatagccagggaagtagataatttggttaaaatgtcttggcctaataagagaactgggcaggtgggaataactgaaaaagagtgcataaaagaatgttgtccaagttggcaccagagtgggagagttttaaggggttttgaagcttggccgtcaatacccacaaccgttatgggggcaagggaaacaggcccttgaaaggaaggtaatgtggagtgggtagcctccatattgattaagaaggggatggacttaccttccactgtaagagttacctaaagtgtctgtgatggtccaggaggcttctgaggtgatcaggcagcgtcagtctccagctgctaagccaagcagatctgggaaagtgtcagtcagagagccttggaccagagctttaggggctgtaggagtagctgccaggtgagttggacaatcctatttccagtggggtcctgcatagatgggacatggcttacgaggaatcccaggctgcagcattccttggcccagtggccagatttccagcgtgtgaagcaagatcctgggggaggaggtctggaaggaatgcctgactgctgtggcttaggtgctatgaagttcttgtgtgctggagatgtggctggggtttctctcacagtggaggcaagtaattgcaactcttctctattattgtacaccttgcaggtgaggttgattaattcctgttgtggggtttgagggctggagtctaatttttggagctttttctaatgtcaggagctgactgggtgataaaatgcatattgagaatgagacggccttctgacccttctgggtctagctagggtggtaaagtgtctaagggttgttgccaaatgggccatgaactgggctgggtttttatatatgatgaaaaagagcctaaacactaactgatttgggagaggtcagctaaagaaaaaggagcattaaccttgactatgccttcagcttcagccacctctgtaagaggaaactgttgggtagatgggggagggctagccacagaacgcaactgtaagctggaccaggtgtgaggaggggaggtgatagaaggattatagggtgggagagcagaggctgaggaaaaattgggacctggctcagcctggtgaggagcagcctggggaggaggggagaggtcagatgggtctgtagaaaaggaggattcaaaggactcagagcttggggtggagactgaaggaagagacaggagagaaagaagaaagatttgggatgagtcacattgggagcagagattaggaaaagacttgttgcaggaagtcagggaccccaaatggagggaccggctgaagccatggcagaagaatgtggattgtgaagattttatggacatttattagttccccaaattaatacttttgtaatttcttatgcctgtctttattgcaatctctaaacataaattgtaaagatttcatggacacttatcacttccccaatcaatacccttgtgatttcctatgcctgtctttaatttaatctcaatcttgtcagttgaggaggatgtatattgtctcaggaccctgtaataattgcattaactacacaaattgtacagcatgtgtgtttgagcaatatgaaatgtgggcaccctgaaaaatgaacaggataacagcaattgttcagggaataagacagataaccttaaactctgactgccggtgagctgggcagaacagagccatacttctcttctttcaaaagcaaatgggagaaatatcgctgaattctttttctcagcatgggatatccctgagaaagagaatgcgcacctaggggtaggtctctgaactggcccccctggggcgtacctgtctcttatggttgagactgcaggggtgaaataaactccagtctcccatagcgctcccaggcttattagaaaaaggaaattcccacctaataaattttggtcagaccggttgatctcaaaaccctgtctcctgataagatattatcaatgacagtggtgccctaaacttcgttagcaattttaatttcaccttggtcctgtggtcctgtgatctcaccctgcctccacttgccttgtgatattctattaccctgttaagtacttgatgtctgtcacccacacctattcgcacactccctccccttctgaaaatccctaataaaaacttgctggtttttgtggcttgtggggcatcacagatcctaccgatgtgtgatgtctcccccagatgcccagctttaaaatttatctcttttgtactctgtccttttatttctcaagccagtcaatgcttagggaaatagaaaagaacctacgtgattatcagggcaggtcccccgatagggactgatgtgcaaaagaattcctggatatcaggcacctcagaccatttgcccattttacgacaagaattatctagatcttgtaggatggagaaatcgaaagtgctgttttctggctatttggaaccattgtcaagtttgtattggggtcaagtggtattgcagaagaaaataagatgtttaggttttaggtcaggtgtgagttgaagaggttttaagttattgagaacacagtctaagggtgaagatggaggaatggagggtggaagtttgcctatagtgaaggaggcaagccctgagaaaagagagggtagagacacggagagaaggggtggggggtacttgcctcccggggaggtggtgcttgccaccaaggtgaaggatcaaggcaggcatccccatggtgatcagacacctctgaaatgtgggtgaataatcaggcaggcatccccgcagtgattaaacactgagggaagactgtcttcccgagaccatgaccatcgtcagagttttgggttcacacataaaacatgtctcctctgtctctaccagaaaaggaaaggcactgaaattaagggaagggagagattgaagggtagcacagaaattgaaaggagaaagaggttgagggatagtgaaagaagttggagaagagagcaaaaagaggctgcttaccagatttaaaattggtgagatgttccttgggctggttggtctgaggaccagaggtcataggtggatctttctcacggagcaaagaacaggaggacaggggattgatctcccaagggaagtcccctgatctgagttatggcaccaaatgtcacgtgcatccgtgggaagagaccaccaaacaggctttgtgtgagcaataaagctttttaatcacctgggtgcaggcgggctgagtctgaaaagaaagtcagcaaagggagatagggatggggcagttttataggatttgggtaggtagtggaaaattacaatcaaagggagttgttctctggcaggcaggggtagtggtcacaaggtgctcagtgggggagcttctgagccaggagaaggaatttcacaaggtaatgtcatcagttaaggcaggaatcggccattttcacttcttttgtgattcttcagttgcttcaggccatctggatgtatatgtgcaggcttgggctcagaggcctgacactcagcagctactaccaccattggcaccactggcaccactgccaccaccccactgcaccccagttgcttcactctccatcacagaagccttttcagcaacagccaacatttgtaccctcaccaagccctctgattttcccaatcacaaggccttcactacaatattttcttcattcacaagtgtcacctattctccatccccaaggtaagtcaattctaattttcttgcaagggttgacagaggtaaaacctgtccagataccccaaaggtgtttcatcttggcaattcttgactctttcaaggaaataagaatagtcaaatataactaagtaaaataaataagaatatataaggtctgtaaaccaaaaatgaaattctaagccccccaaccaactgaatggacccctcctctcagccaagggcattctaaagttaacctgaaagactaattcaggccatgatggaagtgggtggtcaggcatgcctcattatatcctcctccctttggaatttagacacaaatgaccaacattaacattaaaacagagaccttaagattgacaaagtagactctttgtagcaataagatatgaacacaacagatagcaggccccaaaatatatttattcaacatatttttaaatggccctgcaaagctgtctcttgtggggaaacctacattctgtagagaatgcccttccctttccagatcttttcgcttatccaggagagaattaactaagagtctggtacctttttaagtctgataagaaacatttacaatctattctctctgaagcctcctacctggaggcttcatctgcataagagccttagtctcagaagccccttatgttaatgcagatactcccttctattgatttcaagactttaatcagaaaacctctgagtcttcctatgacctggaagcccccacttagagttgtcccacattttcagacccaaccaatgtacatcttacatgcattgattgatgtcttatgtttccctaaaatgtataaaaccaagctgtagcctgactactttgggtacatgttctcaggtctcttggagctgtgtcatgagctattggtcactcatatttacttggctcagaataaatctcttcaaatattttatagagtttgactctctgttgacaagtcctagttttaaaacagtttttatttcatttatttattttgagatggggtcttccctctgtcacccatgttggagtgcagtggcacaatctcagctcactgtaacctctgcctcccaggctcaggtcatcctgccacctcagtctcccaagtagttagaaccacatacgtgtgccaccatgtccagctaattttttgtatttttgatagagatggggtttctccattttgcccaggctggtctcaaactctctaagctcaggcaatccacctgcctcagcctcccaaaatgctgggactacaggcatgacccacagcgcccaaccaaaatgacttgtttttagacaagaggttagaaattttttttcctcaaagggccagacaataagtagattaggccagggtttctcaacctcaacagtattcacattttgggccagataattctttgttgtggagtgctttccttttcactgtagggtatttaactgcatccctgacttctactccctaggtgccaataacatcttattctcagttgtgacaataaaaacattttccagacatttctagatgtcccataggaggtaaaattgccctgaggtgagaataactggtatagactttgcattccatatgctatctgtcacaactactcagcagtgccattatagcacaaaagcagccatagacaatatgaaaatgaatggacatggtactttcccaataagtactatggaaactgaaatttaaatttcatataattttcacatgtaataaaatattcctttaaaaatttaagcatttagagatggaaaacccattgttagcttgtgggacaaacaaaaacaggtggtaagccatagctttccaactcctatttgttttatttttgaaagtttaataatatatgtaatttaaactactgtatccaaataatattattttaacatgtggtaattataaaaatcaattcataaattcagtatgtattttacatttataatacatctcaatttgtactagccacattttaagtactcaatagtcatatatggctagtagctaccatattgggccatgatgccctagagtatttgcttttaattattaggcatacttcctctcaagaggccctagtcattgggaacatgaggtcactttctctttgaaggtaaaagcctctaagtcctgttattgatctaaactcacacaaaaaaaaaaaaaactgaaagtaaggtttaaaagaccaccatgacaatatttatccaatttgtgactgtatttctgattggcaattcaaaattttgtttggcttagtaatttttcttgctatcttgaatagaattaatcccagaaggtctggtagacaatgag

SEQ ID NO: 8386 - DNA, 1961 bp, artificial
  synthetic oligonucleotide
cctaggtatgtaaccctgtagtctgcacagtcagaaacagaaaacaggtcttctttctcaaatggttttggttagttacaaacaaattttgaaatcataaaagaaggttcctttaaattcgccccctctttttagggaataaagcataatgcttaaaagcacatgcttctggagccatcccacctggataaaaacccagtctcagccattcaactggctgtaaagccttgaacaaattagtctcgtgtccctcaaatttctcatttgtataaacttaataacagtactgtgtttcgtaagattgtcgagagtaccaaatgagttacggcctatgtaaaagcacgcagaccagaacctcgaacgtagtaagtgctattgacgtttaatcattattacagatagagaaataggcccagcagccgggcgtggtggctcacgcttgtaatcccagcactttgggaggccaaggcgggcggatcacatgaggccgggagttcgagaccagcctggccaacatggcaaaaccccgtctctactaaaaacacaaaaattagccgggcgtgcgcgcacctgtaaccccagctactacttgggaggctgagatatcagaatcgcttgaacccgggaggcggaggttgtagtgaattgagatcgcgccaccgcactccagcctgggcgacggagcaagactctgtctaaaagtaaataaataaatgagcgagagagagaaataggcccagagaaggaaaaggaccaccatgaaataatagctaggattactgggaaaagatgtttttttcagtttttaatcctgtgctccttctaactatgtctgtatctaagtgctaacttactagttttagcgattaacagcaagtcttcagagagtcatgacagtacatctgcctttaaaatagaaactctaatcttctcccttgacaaaaccgtgctgaaagttctacagaagaaaaaataaaggaaagggtgaaagcccaggttaccttcataccaccactgccattaactacttttcaatctttctccacgacagtatgagtcccaggcagccataggtccaaattccaggtttacggcaaagagtaacaagcatttggaaacacatccaaatcctcacgcctatgttctcagggaagaaaatcaagagctttcggccaacattaacattggattctcacactacaaccacagtgttttgctactctgatggggtgactgtattcagagccaagtacagcgacccaagatcggaaagccagagagccctccgaatgcgtactgcccaaatgtggcctgtctccaagtgctccctttttacgcatttcctacgcaccgccagctgccgcaaccttttgcagagtcatcatcgcctcctcatttttgtacccacttaccgataggccactgagaggctaagattctgggttaatttctagtggatctggccacagcataggagaactccaactcaggttgatcccttcactcagctaaaaaggtagttctctgcaaggcctgctagcccaagatggccaagcaaagacagcttacctcccccctcgccattttgcaaccttaattacccgaatgctgagcgcctcccctccccggcactccgtctgaaatacgcatgcgcgccgcttcctccttaccgttctccccaaccatccagatgttgtctcaaatatgcatgagcgccacctctacctcccaaacgctggtaccaactcctagcaactttgcgttgttaaatatgcctgcgagtccttcacttcccgaccttccaaccctccaaccccgacgccattcaagccttgcgcatgcgtgcctccctctccccacccccgccccactggagcccgtccccttaactcaggtcttctcaaatactgtaagcttgagcgccgcccctcggcgccgcgcctcctcatccagcctctcaa

SEQ ID NO: 8387 - DNA, 5312 bp, artificial
  synthetic oligonucleotide
agcctctctcctcactctgcctctttgtgtctctttttctcctctctgagcctttgtctattgtgttcctgtcacccaccctttcatcatctttttgccaggcattcctggctgtcacttggagccaacagtaacttgccaccttaaggcagggtcatccccgggccaggaggatgaggttgtcctgaggggctccaaagaagacaatagttcccactcatgattttccgttacaaacaggcagctggggcatggttggcctccaatgatttcattcaaggccaaagtcctgagccccctccgctggtcccagtccagctcttatcaactccccaaaggaaaacccactggttcttagctctgtgggtaggaaggggccctagaaagggcctagttactatcctgtcagttctaacagtagtggaacaggagaatctgggccctaggagccctgtaactcccaggagagaccactgaaaatactggagcaacaatgcccctgcttccatttctccccacctcactctcaccaagtcaccagagggtggttctgtaggacctcttttgttgcttaagatgcagatggctcttaagaatcaggcagtcgcccacttctctccagatgaagggaagacattcataggtcccaaatctgcccattcagatgtcacataatatggtgggatatcaatttacttcttccacacatgtggttgtgcacatgtgagcttgtgtgcttttggagagaatgttgattggcaaaagcagcacagtattaatatttagagtaggatgcagcctcttatgcaccacagttaaatctagaacgaacaaaatttcagagctcaagacatgggacatttaaatcctcaaggagtttggaacaaaataaacagatctaaaaatttggtttgggtatgtatgttgcctacaaggaagaaatagtcttaacctgattaatagcagaaagtttgacttcagagctgaagtctcctttcaaatcaaatttctgccaggttctatgctctctgtgagagcagacattagaaaaagagctatataggggtttggagttggttgactatttgagattggatttttaaacaagctctgaagtggaaaagtggttacttcacaaaatgagaatgtggttacttgctgagttggaatggaggccccaccaaggccacagccttgctacaaatgtgccatattgaaaactggcattaataataatccaattcagctctccttccctctcccttatgttattgatggggaacctaaagggacttatatggctggctgacacagcctggcagtgacagagcctggaattaaggatgatgcaggagacagacctataagaatgacaaagctgagagtaaccttagagtctcccttgtccatcctgtgcattgaatttaagtggagagactgaggcctagaggtaggaagagactgcagtaggttcacacagttcatcagtgacagagcaagatgagacttgaactcatgtcattgacttccagtacagtttacacccctggttttacagatgaagaaactggccctaggagggataaatgacttgcccacttcattcaacaactgtgtaccaaacccatttccataagtgtgtcagcaggaccagctctgagcaaaaatgaaagtttagcaaagtttaacttttagcataccccatgtcttcatgattactctcacccgcaactgacacatacttttggtattctgtctcccagtcactccagaccatgcaatcttggcttggagacctggtttcacctactgtccctccacccccagcaactcaagaggtacaaaaaaaatccatctccaaatggccacatactgggcagggcaggggcaaagagaagtgactggtttccggttggaagaaggtggtttaccacccagctcttggctattgtttctcctcagactcagtgtagacaccctcaggctggcttcctcatctcctcccactgaggctaattactctgtcccattgcagggccccaggctctcccacctaaggtctgccccgctcccctagccccttccccagcagccccaagggtccagtctgtgtttgatcacccaggattattagatttcaaagctgtggaatcccataatttttacgagcatatgctctcctctagggtcttttcacgtctgaaaaggcggccagcagctccctgccacttctccacagtagcagtgcaggccagctgacaaggattacaaatccctagtgtctcatagctggcgcctagatagtgtgggtgacgggtagaataagagcccttgaagcaagttcagaaattctaataagctgaaatgcagcagagactgcagaggcacaaggaaagggattagatacccaaatcctgcaggggttcaggaggctatgcttcaaagcccctttgattcctgcctttcagctctctctagcggtcaccaagcgcaaagttctatgcctggttttcaagtcatttaagcagtcttttctagagacctgctgcgtgtcagacactctgctagaatccgggaacttcaggaatgaaaggaacataagtagaaaaaaaccagaagaacacaaagagtttgtactacctaacttccaagatacccttttcttctctgggcgccagtacccagagagtaccgaccttagcgccaaaattcggtcctctctgaggcagatcaggagccaccacgcccccagtgaaatggaggcggcaggaatcccacccccaacccctcttcctctccccacgactatcctcccgggggcgagagtcgcccggaagaactacccgcgcctcggcattggtttcctgctgagccccagccggataaaattagtcgattgctcacactaacaagtgtcagagtccgcgtccagctgagtgggtggggagagcagtactgggccgggccgcattcccgcccgggcctgtcagagcagcggacagacagcacctgtcgtgggcctcctcgttccctcactcctgccagagcctgtggcccccccgcggagaccggggactacacttgggagcatctttccccaactctcgtcaccgcagagaccgcgccgagcccacctgccaaatgttaatacactggaatgccaggggaggggaaaagaaggttgcacttctactctcctttcccaccacacacccacccttcactgacctcgccacgactgggccctggcatccgggcctgggggtgctaatcgacactatttcccgccaggtccccatgcccactccacactctgggactgcctgggggtggatttggccctggcggtcgctcctggtcctgccgctggcctccggccaccttgggcggggacgcggagagtggggttggctcctcccccgccgcgggtctccatccatttccccatttgggaggggtaataacccgggagccgcgccacggaaatgcatcttcccctgctattcagacgggaatccgcccacccatgacaaccgcccttcccgcctagggaaagggggcgggaagacctagcctcgggccctgccaactgccagcaagccagacggatagacagcagctgctgcgtgtccgagctcagctcctcctcgatcccccgccctctacctccctgctcgctccaccgacaccaggggccgtagcggcgacggcgccccacccccagcgctcggtccggagccctcgaggtgatccgggctgggcctgtcgaggatcttttacaatcggcggccccctattctctcccgaccggcctcgtccctagcgtcccaagagcgggatcaggcggctgctagcgaaagacctacaggagcccagactcgaggcccgccaggatgcggagactgagggcgggttcggccgccaggaagcgctcccgcccggggcagcaatcctcctccgccctcctctgcaacctccaacccgggagggccctacggggcctcctcctccacacagtgggtcagcccagtggggctgctttctgccaaagacttggcccacccttcaagcgccccttcccccagtctccataaaaactctttcagaactccggggaatcaaccatgctggtgggagctcccagctcaggcctactcccccatctcacagttcccgatcacacaggggagcacgcgggatttcctaggcttgagaaccctcctccaagcctggacggagcctcaagagtggtgagaaggaccagattgactcgaagagccgccctcctcagtttgctcctctcctacactcctctaccctagtctccaccgacctgcttccttctgcgcttgcctagtggggggtgaaggagaggacaactaccttcacttctccccccaactttcacatacaccctccgtcccttaaggtggagtctcctgggaggcgggcagcctcgcagatccttctgccttaaggccttgcaaaggcagagtttcctcctgtcagtctggggtcttccagctccctgccgcatttgccacctcctcccacactcctttcatccttccccgcagcatatctggacatagaccacccctcgaccccgcaaaaaacaaaacaaaacaaaacaaaacaaagccttgagaaatctccaaacacctgtgcgtggacgaattacagttcacagttgctcctatatccctcatcacaattggccctccccccaaccgtgggaggcaactgctcttaagccgggttatagttgggggaattgaggaccggggggaactgaatgtgggttttgaacgcttctgcaaggccctttccaccccacttcacagaaagtagggaagtgagcaaatctctcattttccctgacttcagaaagcctgcttgctgctcctggagtcagcacctgctcctcccttgtccactctatcccccaatgaaggcactatttgggagtggcactacagccccaagatggaggcatggagggcagcagaagccgagccacagtccttgtgcaccccctggacttccccaaggagggcatgtggaagagaaagtctgcctttctctgggagtatgggtcattgtcttctaggttcctctcccccttaacatggaggaaaaactccaaaataagcttgcgtgtgctccactccctcagtccttctctcatgattcaataaaattatcatcactgagggctaatttccagggctttgcttgatgcccacaggccacaaaaggaagaattctttgggctggttatttggggacgggagggtgaggagcagctcatg

SEQ ID NO: 8388 - DNA, 2004 bp, artificial
  synthetic oligonucleotide
aagcagaagttttcaagtttgatcaagtctaatatatcaaatcttttcttttatggatcatacgatttgtgaatatctgcaaaatctttgcctaaccaaaggccaggaagatttgtctcctatatgttcttctagaagttttatagttttaagttttacattaagtctatgatccattttgcattgatttttaaacatgatgtgattattgatatttacaaagttctcttcttatacatataattttatctgattttttttttttctttagatggagtctcactctgtcacccagcctggagcgcagtggtgagatctcggctcactgcaagctccgcctcttgggttcaagcgattctcctgcctcagcctcgctagtagctggaactacaggcgcccgcccccacacccagctaattttttgtattttgagtagagacggggtttcactgtgttagccaggatggtctctatctcctgacctcgtgatctgcctgccctggcctcccaaagtgctgggattacaggcgtgagccaccacgcctggccctgatcatcagcggatcacaaggtcaggagatcgagaccatcctggctaacacagtgaaaccccgtctctactaaaaacacacaaaaaaattagccgggcgtggtggcaggcacctgtagtcccagctactcaggaggctgaggcaggagaatggtgtgaacccaggaggcggagcttgcagtgaggcaagatcgggccattgcattccagcctgggtgacaaagcaagactgtgtctcaaaaaaaaaaaaaaacaaaaaaaaaacgaaagaaagaaaaagaaaaagaaatgtttgaggcaggcacaagcagaaattttaatctccatttcacagatgagaaaactgaggattagagaaatgctgtgtgacttctcaagatctcacagctgataggagatgaaatggcaaggtaagaggtgaaattgtgataaaaagttaaggtctcctgctgtcccaggctagtacttttgaagccaggcagagagggctcagggtaaggctccaacaaagtaaagattcccaatggggagctgagcaacctatttggcactgaggtaagagacacagccagttgactagccccagactgagctcctttggcccattggggctccacaattggagagagccagaagttggcccagtgcctagctcatgtgtcactctttgatgatgatgatgaagagctggaagtgttcaaaggagagttctgaaattaatttcagagttagaaattaaagctaagaggaaaagttaaggaaacgaagattatttggcggagaaaagagaggctcaagatgaaacttgataacagccttcagacgaaataaaaaaaaaagcttgaactttccttctgagggctgagcaaagggaaacagtctggaagaatctaaataaaagggcaagttccttcctccttagtgaggattgttatagacacttaagagcctttagaaacaggataatatctgcttgagtttgaagtcaggaatttgccaaacatgggctctgatgacggatttcagcatgagggttacatgactcttgcacagtgtccttagaaatctttaggtggcctatgaacttgccttgtatcctagtacaattccagggggcttttgtctgtggccttctctactccttagtcttatcgtcttcacagggttcttctaatgctggagacaagcctgaccttagctcctgaaagcttaaccccaatgttttttgcccctgaagccagtggcttagaacctaaggctatagatctggcttagcatccctggaaaggcctgaaatattgactagtccaaatcttaccgcagtgatagaatcccctgttttatatctagtctcttcttgcaaaactctctgaacatcagggactagcaagctggcaatgcagaccaatgcaatgccccctgtgaaaggccagagaagaagagctgagatacca

SEQ ID NO: 8389 - DNA, 5189 bp, artificial
  synthetic oligonucleotide
tttgatttttctaggtaaattataatgttgtctgtaaataaagacggttttacttcttcatttcctacctgtgtgtcttctatttctttttgctgtcttgtttgttcgtttttaacttttattttaggtttgggggtacatgtgaagatatgttacataggtaaacatgtgtcacgggggtttgttgtacatattattttatcacccaggtattaagcccagtacccagtaaatatcttttctgctactctccctcttcccaccctcccacgtcttcttactgtcttattgcattagctagaacctccaatggaatgttaaatagaattagtgagagcagacatcctttttgtatcctttttgtttgtttgtttgtttgtttgagacagggtctcactctgttgcccaggctggagtgcagtggtgcgatcacactcactgtagcctccacctccccaggctcaggtgatcctactgactcagcctcttgagtagctggaactccaggtgcgtgccaccaggcctagctaatttttgtattttttgtagagagtggggtctcactatgttgcccaggctggtcttgaactcctggactcaagtggtccacccgcctcggcctcccaaattgctgggattagaggtgtgacccactgcacctggcaccctattcctaaccgtagtgtggaaccattcagtctttcacaagatgatgttagctataggcttttcatggttgccctctatcaggttgtgaaagttcccttgtatttctggtttgctaagagtttttttaaaattttgaatggatactggattttgtcaaatgctttttctgcattggttgagatgattatatatacatttttaattttaagtctggtataactgcatattgcattgatcgatttttgaatgttgaactaaccttgcatttccaggataaatcacacttgatcatgatgttttttccccttttttttgagatggagtctcactctgttgcccaggctggagtgcagcggcgcaatctcggctcactgcaacctccacctcctgggttcaagcgattctccttcctcagcctcccgagtagctgggactacaggcacgtgccaccacgcccggctaatttttttgtatttttttagtagagacagaatttcaccatgttggccacgctggcttgaactcctgacctcaagtgatccacccacctcgaccacccaaagtgctgggattacaggcgtgggccaccgctcccagcctatcctttttagatattgtgggattcaatttgctaaaatgttaagagtttgaaactgtgttcaggatggatcttcatctgtcattttcttttcttgtgatgttttttatctggttttggtgtcagggtaatactggccttatagaatgagctgagaagtgtttcctccaattttttggaagagtttgtgtagaactggtattatctcttccttaaatgtttggaattcacaattgaagccaacttggtcagcccctctatgattcatatgggccctttcatttttaacatcttgcagttctaataagaccctgtcatcaatctttttatgttagatatgtgtgtctcttctctgtctccttatttcttgtctgtctttgcctttggcctgtttcccatactttccattaggtgaatgtctgacaatctgagtctgtaggtgctgggccagccttctcagagaaagatgaggaaactgtttcaagtcatagtttctcccaacactggtgtgttttagtaaaaaaaaaaaacaaaacaaaacacctgtaatctgccttagctactaaagtagataactgaccattgtccaaaaccagtgggttcaaatcagtggccataggccattaagtagagcccagttacccttgaaggactgggacaagagttaaaatgtctcattttcagacttggcatgggcactcttaagtgtaggtctctctgtttgactctgtctcagtttgactctctgtaaaattagtaactgaacccctaaatcttctaactccaaaactgaaagtaaataaacaatagctgcagagggaagcaggccaaataacctaatatggaggtaataagacaacttatattttcagtgaatatttgactttaaaacctttgaaacttgggctgggcatagtggctcatacctgtaatctcagagctttgggaggctaaggagggaggacggcttgacaccaggagtttgagaccagcctaggcaacatagcaagatcccatcgcttcaaaaacttaaaaaaaaaaaaaaaatagccgggtgtggtggtgcattggtgcgtgcctgtagtactagctaccctcaggagactgaggtgggatgatagcttaagcatgggagcttgaggctgcagtgagccatgattgtgccactgcactccagcctgggtgacagagcaagaccctgtctctaaaaagaaaacaaagttttgaaattcaaattaggtagcccacgaaaattggcatgtcttgagacaaaatgtggagagataaaaatgagattcgtggttttttttattttatttattttatttttttttgagacggagtctcgctctgtcgcccaggctggagtgcagtggcccgatctcggctcactgaaagctccgcctcccaggttcgcgccattctcctgcctcagcctcctgagtagctgggactataggcacccgccaccgtgcccggctaattttttgtatttttagaagagacgggatttcaccgtgttagctatgatggtctctatctcctgacttcgtgatcctcacgcctcggcctcccaaagtgctgggattacaggcgtgagccaccgcacccggccgcgatttgtttagatatggaatgcttggaaagtaatgtttcctagtattgctgtgccacccccagaaaaacaccatcacattataatgaagaaaaaagtaagatactgagaggacccaatgccaggacaaatatgaaagtacttttggacttttaaaataaagatttgctagaaatatgaagtagaattctagacacaatggatggatggtgagtagctaccaaagtaaatgggcttagagtgtctgagtgctggaagaaagagcttttcaacacagtgtttgtcagaaaatggaaaaaggtttgaaagaagcttctctgagcaagagtgtttcatctattcactggacagacagttatgtagcacttaactctgggccctgcacaaggccagggaaataattaataaatgacgctcagctggaggtcactcttctggtgagccgcagagataagggctcctgttatctcagtccccaaagaagaacagagtcttgcatttcttccctctggagctccccagctgacccctgaagtgccttcacctacatcctccttttaaatatgtttcaccaattctttcagtcatctcactaatgcgtgcccaccacctggctggatgtgccggcataagtcatcacagtcctaagctgcctgctacctaccacacactgtccccatgccaaaccaataccattccaactatcccatttattcaaactagatgtagacacatcaccatgttctgggaactctgaagaggtgtggtgatggggcagaagcaagtgaatatttccggcaacacagaatccaattcatggtgccattctctccacttagcactgggtatagcagttggatagcttagccttagaacctgtcctcttaatcctatttgctattctctcactgtactgtgcatcttgtcaggaagtaggggctcttgaatagagccatctctgcccctgtgtcagccaccttatctctcttcctatctacccttgacctatctttgacctttatttgactttgcaccgtcattccctcatttgagcttttgttagttccccacaataaaaggaatttatgaaagcttgtgatgtatttggagagtttggctcttggagtaccccctctctctctttcaactcagagaggttggctttcagcagccaaggagtgaggaatctggtctcacacttgaattattttctgagcagtctcctgtacttcaaagacattagcctgagtgcctgggtaaggagccaaggcactaattgagtatttgagtaaaaagactttgaggatgaggaagcttgagggccaacagatccaggatggtgctggaaaagccagagttctggtgttgtgctgcccaggtccaacagaaatctagttagatatgggtgctttgaggaggaaagtaggggtgcctgctgaatacagacatatgttcacttaggtacaggccttttggggccaagtctcactccatgataccataggagaggggtaggccttgttaccgctgagaggggaaggttaaggttgaaaataactctgggaaccactgaggaaaagtgtgaatggtataataattataccattgaattatatgaattataatagttcatcctcaaaatccaaggatctgttgaacacaaaatttattagtcaggaatcagatacttgctcagcacttatgcactgtggattgaaaataatgctttctccctgatggaatgttacaaggttccacctctgatttttccaagtctgtttagaaagataggtctgtacattgcctgttaaaatccacccaactctcccacgaatctcagctgcttcactgaaatctctttctttgtcttccccatataagagcaggggtaattatggggaatgaaagaaactcctagctttgagtccaagaattgttagaattctagaaaacctctacctactctttgcattttccaaaatgggaaactgaatataagaaaggtaaaggataaccagtaacacccaataacacctatctattatcaataaggttataattgtcaccataattgttatcatgactattatttcttcttttttaatacagtcattgcttgattatttttctcttactaaaattttttgataacctatcccactaacagtcccttaagtcacttctcttatataacgctattcttcttcagtcacaatctagctattagattacctttctctccctttatagaaaattttctctcacttggagtttctgacttctctgaaaatctttaaatagaaaatt

SEQ ID NO: 8390 - DNA, 1935 bp, artificial
  synthetic oligonucleotide
ctttatgcagttggtgtgaaaattaaatgaaatagcatagctaatatatgtaaagaatttgacacggtgtctgtcacatagtaagtgctaagtaagtgttaactattgttactactagtagtactactacttctacttctactatgaagaaaagaaatatgtgaggaaggacatttgctgccctatttatcttacacagttgctgtgaagatctaatgagataagtgctgaaaaagggttttgggagataaaagaactctacagaggtgaggtgagattgacattaaattacaaaggtgttgggaccttcccccttactgccaggtcgctcttgagtccatcgactctggcttgatcagtgctggcatgagtggctattgccttcccttcccacccacccatcttgcctcctggcatattgaattagaggaaggggttagaaactttgacctccaaccttctgctactctaccactcccacccctactacagaggcacctgtcacataagtagccagtacccaacccagacccagagttcactttgcatttgccctactgagggcctgggacatgtgctctcttcattagcagcctggagaagtgtctgtccacatctgccttccccaggactatatttaagtcatacaagccaggtctcttacattagctcacctaatcctcacagaacaatcatttagttggtacttttataagatccattttccggatgagaaaactgaggcttagagatgtgaaataagttgctcaaggtcaaatagaaagtgaggatgtagagcaatggctcacgcctgcagtcccagcattttgggaggccaaggtgggcagatgacttgagctcaggagttcgagaccagcctgggcaaaatggcagaaaccccaactctacaaaaaatacaaaaattagcggagtgtaatggcgcatctgtagacccagccacacgggaggctgaggtgagaagatcacttgagctttggaggttgaggctgcagtgaactgtaatcatgccactgcactccaacccgggtgacagagcaagatcctgtctcaaacaaacaaacaaacacacaaaaaacacaaatagcaggtacatacaccttgttcttaaatccatgtctgtctgactcagagcctgcacatttagcattatacaaacattatagaaagattaattcagcccatccctgatagtttagtggctaggaaaaaaaaattctaaaggaggaaaattcatctatcctagaaccttcctgtagtgacagaggtcccagccttatttcagagaggctaaggtgaggcttaaggaaatttcccagctgggaagcaggttgttaactagccaaccgatgtaatatcctctgtcctgaaggggcttttgatttccttcctctgctgtttcctcattttccccatctctctcagaaaacacttaacaaaaaggggcagtatcctggaaaaggcattttagattgaaaaatgagctctgtccatacttttgcagttcctctgccttcttttcccctacctcccttccttcagacaagtaattcaagggtgctagggattgtcagcctattcctgctcagaggcaggaacatggcctaagtggtctcttgagatttcctgcaggctttcatgcttcatgaagtcgtagcagcaggccccctgacggtggagccaacattagtgcttggctcagctctgaggatcaaagccatattaatcctggcagccagccttccctggattgattaccttgtcatctgccccagaccaaccatcccaggtttccttcctaatgttaaactacagtgtagggagagttgcttctggtaacagagtgataacctgtcccattggggtgcctgctggaagcagctgcccaaactggctgcctctttagctcaaaagtgg

SEQ ID NO: 8391 - DNA, 560 bp, artificial
  synthetic oligonucleotide
cagatagctctctgccagagagagaggtataaagccctttaagggcccgcccctcccctccatcttcctgcctttttctaccttgctgcacttcttctgcccatacaggctcagctccatctagagaaagctaagctggaaagtggtaaggggccttagatataatcttttcagaacccctcatgatatagacagagaaagcaagacccagaagagtaagaaacttgacctaggctacacagcagattagcagtagggtttggagttggggtctaaggctaagggggggcttctaaaacaaagagaatatcccaggttagtatgtgcattggggtggatgtgggaacatgtgaaaagccggtcaagaccaataacctagactttgtggccacatctaggattggtttgaaggttaccttgtaggcccctagcactcccgcccaaagtatgtctcagaaacagaaatggcacctctgggtaattcttttggagcttgaaggctgtgcacatttaattttccaaaaataaaatcctagtataggcaaagccttgtaggaaca

SEQ ID NO: 8392 - DNA, 669 bp, artificial
  synthetic oligonucleotide
aaggatgactcttcaggccatgaggagagtgtggcatgagattttgccgcagtatggaaaggagaagcctggaatggggaaccaagcacaaaaactttgtcctgggagttcctgcaggtgtccttgagaatgaactatggcagagaaaggcaggggcagaacccttcagagagcattgactcatcagctgctacaacctgatgagccgatcaggttcttgctgctcttgcccacccttcagactctttccctgagcctcaaagccagcttgaacaatatttcactcttctaggctgcctggggagttgggagtggtgctcagcccattttgtgggggttggagactgtttgtgcaccagggcagtccccactagaaggcaggaaagagctggagagggttggagagattcccagtaagaagcatgctgcaattttctttcacaaccaacccccatattggggtgacaattccagggaaatgggatgcattgttctctacttgctgctagcctctgggccatgaacaaagtagtaaattggccctgtgagggaggggacagaagggggaggtggtggaggatatggggaccagaagcccctggggctgactgatctgcttacaaacatcagaacttcccctccgtgaccctcccagcccccagggaatga

SEQ ID NO: 8393 - DNA, 5632 bp, artificial
  synthetic oligonucleotide
ctaaaggaaataatgctagctgagtcaggagacctggatcagccactaatccatcttgtgaccttgagcatgttcctctctttgggtctaagtctcttcctctgtagaattttgcactgaactcagtgatcttttaggggtcttccatttctgggagttcataattctgtgatccgtactcttgtaccaaataccacttgccgccaccacccctgctctgccccgccccacccaaagaagtaaaagaaacttccatctagtcatcagatagtattgggatcatgctgatagggaaaagaatataacttggggttttggaccaagccaatatcagagaagccactgcttcccattatgccaatggggattgctgattaggtctcactcctatgacacaaaggcacaacattcaaggtcctccgctccttgcctcctctgccttgtctttgatgtcccatgagaagtatgttgaccagacaatatccccttggctctggtagtggttggagtcagtaagctgttggagatctgggagtcctggtcattgcagaacaaaattcttgtccactgttataagcacataggtcttgattttaaaagtcttatgcagccataaaaatatacacagaccaacctgcctgggattaaagggaactaggcagaaaaccagaaaaggtagagtctctcttagtgggcctttccctttttgtctctctgaattgggtttccatggggatctgtgggtaaaacacatgaactttaaacactttttaaaaaaacttaaaatgacatttaagagacctccaatattggaaatcttttattctctgattcaaaatatgtaaccagtagaaaggtggtttgtttcgtatgtgttcttttagtgtgatgagtcaggctgaagctgggattgggcaatgactatgtgagtatgtggtgaatttcagaggggaagtgctgtttgaggaaaggcaaagcatatttatcagacaaagaatgtatgaagcctaaagcatgtgtttaatactttgagaagctggttactcatacctccctcctccttgacacatacagttaggctccatgatcaaacatcagatttaggctagacaatctttgaggtttgttccagttctgatgttttttctctgactgtgtgagattattcagacttgcaagtgcacttttccaatgaatcccctgtggttactttcaatgttttattccaggcaaggaacaaatgactgtaaagtggctaaacctcagtaggcttggccataaagtgacacggaaaattgatagttagtgatgggccatgaactatgaagtagggtgaaccctttggatcctcaggacccaatagctcaaaaatagatcaagaaggaagtgtgtacatgagggaaaattgcttatagtgatgtgcctatttgcattgaaatgtcatcccttggggggtccccccacctgtcatgggacaaatgtcttatagaagaatgtgacagcaaatgtgccacactgatcagatgcttttggcatacttgaaccttcctggtgttataaataggagggaatgagcctggacttaaatatgtcatgctgtcagaaacagaagggatgtgctaccattaataaggggcttagaggatcctatagttaagagccaaagaagccctctatttcgagaagggaaaagttcaatgactgtccgctatcagagcacaatacgagctaaattactagcagtaggttggtccttgacccctttggatcatagggaaatgatgataatagagttggcaagcccccaaggcgccctccagactggacatgcatggaggctgggtcagccagtttccaccacacttccaattgccagtgtactctcttccttggagcattaccaccacactctcagcagggtggatttgggaagtggcctggaatatggcaggccttccctctcatcctgctgggaatagtcttgtccgttcccgttctaggaaagagaagcagagagatgccaaaggctcaggtacctgttgaatcagagagtgagcagtgagcaacacagaagggtgaaggcctagagcatgtggggacctcaaaggttatctagtaaaatgttttccaaaatgtccattataacccatgaaattaatttagaaggtcacaataagcattttaaaaataatatgcactagaaaatttcagagtttgtcacgcagagtagggataattagttttgtgaaatttgcttgaggtatatataaagattatatatatagttttaaatatatatcagttatatatgtgtacattttacatcacgacacatatgtgatgtatacatatacattattgcatatatagctatacacagatatataaatatacacaggtcgtccttcactgacggtcactgacatagtttcaattgtcctcagcctacagttcactctcctctggacacagtcaagttggttctaaagtatggagccccagaacctcagcagcccttcaaggtatagcctactcagagcagaggaaaacatgactatctcctcatttgttctgaccaagtacattttgaacaattcagttcaagatttccaataaggtagaatctcacaacttggtactcattgaacttacagttgcctaaaactcctaggtatctctcacacatgtcactgctaagccctagctcccttactcccttatcctactgctgtgcaggttgcttttttttttttttagacagggtctcgctctgccacccaggctggagtgcagtggtacgatcttggctcacttccgcctcctgggttcaagctattctcccgcctcagcctcccgagtagctgggattacaggtgccacgcctggctaatttttaaatttttggtagagacggggtgtcgctatgttgaccaggctggtctcgaattcctgacctcaagtgatccacccacctcagcctcccaaagtgctgagattacgggcgtgagccaacatgcctggcagcaggttgctttttaatcctagtacagaaactgtcatttatctttgttagagtttacctttcaccttgactcacctttttaaaatgcatttacacatcccatccatgaccatctctatgcatatttaaatctggtttcattggctcagagggagctgcatttaaaccccacgtagctctctctcagaaggtcatatttattttttttcagactgttcctttaaaaaaactgttattttttatttatttatttatttagaaatagggtctcactatgtttcccatcttggagtgcagtggctattcataggcacaatcccattattgattagcatgggagttttgacctgctccatttctgacctgggcatgttcaccccaccttagacaacccagtggttccccactcctgggaggtcaccataatgattccaaacttagtgcagacacccagtcggcacgaggtgatcttctcgtgcttcccaagtaactgggaccacacgcgtgtgccactgtgcctggcttttaactatttttttattgatacataataattgtacatacttatggggtacttgtgatattttgatatatgcatacaatgtgtaatgatcaaatcagggtaattaggtatccatcacctcaaacatttatcatttcttcctgttggggacagaccattcctttcattgctcatctattatttttctgactaccatgatgcccctattctagccaagccagtgtcctcactgttttctttcctgtactcgagacataattctaccactgggcagactgtaaactagttcaaccattgtggaagtcagtgtggcaattcctcagggatcgagaactagaaataccatttgaccccaccatcccattactgggtatatacccaaaggattataaaacatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaatcatcattctcagcaaactatcgcaaggacaaaaaaccaaacatggcatgttctcactcataggtgggaattgaacaatgagaacacatggacacaggaaggggaacatcacacaccagggcctgttgtggggtgcggggaggggggagggatagcattaggagatatacctaatgttaaatgacgagttaatgggtgcagcacaccaacatggcacatgtatacatatatgacaaacctgcacgttgtgcacatgtaccctaaaacttaaaataaaaaaaaaaattctaccgctgggcttttgactacactaagccttcacttatgataccctctttgccataatgtctttcatggcccaacttaagtcattatatcctccatgattctttattcagtagctctagatcatattgatctatcctctgaatttgtaaatttcaactgtatttcttgtgtattgcttcacatttagttttgtataagtgtatgtattcttataaaaaatacatataaatgtcttattatctgcattgttggtgcatggctgactcacacaagtgggcactctaaagccagaatgcctgggttcaaattcagatgtacaattctataatttagtagttgcatgtacttgtgcaaattacttaatctctgtatgtctcagtttcttcaaaatcaggataacatagtatgtgttgcataggtttgcttagtgtttaaatgaattgatatatctgaagtacttgaaacagtccctgacacatataaacactcaataaatattaactataattatgattaaatactatacgctttcatatattttatctcggggaaagttagagcagggattgtcatccctgttttatggatgagtaactaaagtttgaaaggttaagtgacagtgtaagattatataagtgagctgtctcagggtcattaggggattaactataaagtagaaaatactaaaggccataagagagggaagcaaaagacccttaggaatttagaagctcttctggctggggtgggtaggaaaggcttgctgatgtccatgaagaagcaatgaagaatgtgcaggatagggtcagccttggtaagtgtccatccagccattttaggcagagagggctcaagtggagtaaggggtagtggaggaggtagggtgtggctcctcctacattttgcttccggtatagagggcatggtcagaggccagaggagaaaaaaatctgaagaggagacatctgggcatggcagccatgtggggagcagtcagtagtagttctgtggtatgtgcaggagtatagtgtgtgggagagagaggagagcctgcagtggcaagacaaggctttggacctgtgttccaaaatacctattcacaaagtccatgaatatttggctactgctctgggcccttagaatccttgattgattagctcaggcaactttatcagattaaccagctgacctctttgaatggcaccca

SEQ ID NO: 8394 - DNA, 1484 bp, artificial
  synthetic oligonucleotide
taaaggtgctttgtgtttgggtttgttttctgacatcattgttcttagcaaccaaggtcagatttttagcttttcctttgactgctaaccatgcccctctgcctaagaaatcccacaggaagcctccaagcttcactttgcctctagacacctggcaaatgactctcccacttccttgccctgtccacagactctgatgctagttgcgggtgccaagatttttttgccccctcctcttcccctgggaccaatcagatttctgagctccagggtagagccacactctcactgatcctctgtccaagtctagaattcccaaagcatggtctgcctcatctgtgctccaggtgcaactgggcaggataaatttctcacacattggtcctgtccttccctgggaagcctggctttcccactcccacttacctaagtcaattctctgctttaaggctgggcgcggttgctcacatgtgtaatcctaggactttgggaagctgagggttgagcccagtagtttgagaccagcctgggcaacatggcgaaaccccatctctgcaaaaaaatacaaaaattagccaggtgtggtggcacacgcctgtagttccacctacttaggaggctgaggtggaaagatctcttgagctgggagattgaggctgcagtgagccatgatcataccactgcactctagcctgggtgacagagtaagaccctgtttcaaaacaaacaaacaaacaaacaaacaaaacaaccaaacaaacaaaccaaaattctctgctttattccccttcatgagaaaagctggcaaggtgaacagactcctctcttgctagcccactgccatctttggataggtcaggcagatagaatcctgagttccagtagattctgccacataattatccagggttcaataatttaagcttacctacctcttatgcaaagaccagagtactgatgaggtaaacttgcagcagaagaaaattaagccaaaagaaagaacttctcaacttaggattctaaagcactgtgacagatacagttctccctaagcctttaggttcaacctcctgcctccagccatgccagacagatgaaggtctctattttcttactgtgggaagttcagattttggcctaaggcctgggtgaaggtgaggatgacagaatgacggagttacttgtttgcaacagagaatgcattcctccccaccctgtcctgccccaacatgtaattgaatatctttccttttgccacccctcaataggcttttgcccttctcttcctaaataaggttattaagttattgacttattcaaataaaagtttgtccaatattcaagagacattaagtatgttctttgggtctgaacacatggtcaatttcaatctttgtgagttttcacagaggcccactaactccctgtgtgaaaaaagtacccagacgtaagtcatatgaagggagttgcatgataaaaagctt

SEQ ID NO: 8395 - DNA, 1172 bp, artificial
  synthetic oligonucleotide
cctacttgtaaagtacaaattgtaggctaccatccaccttatcctccactttgcttttcatacttcgaactatatcttggtacattaagttcataaagtcttcattttttttaaatgattgcaccatattccattttatggccatatcacaatctatttaatcaacaccttacattcatactgctactaacctttgactatggggctttagtgtcaaacagtgctagattcagattactttccacatgacttgccttgacaaagttttaaaacttcttggagtctgagttttctcatacataaaataagtataataataccatctgttattgctggtgtggagattaaatgagatgaggcatgtaaaacatctagcatacagcctggcacgtactaagtgttcactaagtgtttgtgctctccctgctcaccagccctccctataccttccacctccaattcaattaatattggttgaattcaagtcaataggtctttgacctatgttagactggaccttggatgcaccagagaaggaaaagggtccctcaagaagtgtatgattcccttgagaagacataacacaccaaacaactacagttgtgctaagtagttaaaaaaaaagtgtgtatattacattgaatgcaattttcatgtggtgatgtagaaaaagagaaatgattgtgagggcaggaggaatcaaggccctgatagaattggaatttgaaatagggtttagctaagtggagaattgggcagtggcagagtgggggcagagaaatggacagttgggctgttgcttggattctgggtctttgccctctggcagcctagtgagtcactgttccccattaggccttacccagcaggtggggtggaggggcaggaggagaggaaaatactgaggacatttggggaaaaggacacggggagggggaatgtttgggcactgggccacagaatgaggtgcctacagatggtttgtggcacagcctactcagcccccaccacctgctcttccatgtcagccacccaagtgcatttctaagaggtccaaggaaaagaagagcataagtagcagcagctctcaacccctcactctgtgtcccaaacaggtcctcagatcccataagccctaggagagggaagaatattgaatgataaaaattccc

SEQ ID NO: 8396 - DNA, 4390 bp, artificial
  synthetic oligonucleotide
gtagaaaggtcttgccactcgcccgcccgctcgtggaagccgagtagcttggtaacgacaccacgacttcacgtttagtgcattagacgcgtagacccttaggggaggcagagcttcccggtatcgccgagcgggccctgagggctgaggctgggcacccctgcgcacccctgctgagtgcccggccaccagaaagacagatcccccacctttccttctccctgacccggcgcgcttcctggggaacaaactctcccttaccctcagtggggctggggcctcagtctgcgacatacagtgggactcccatgtctgcatgcctgaggtgggcggaagggggcggtgggtgctgggaagacatccgtccgcttgcagctccgctgagtctccagcacctgaaaagccgcggccgaggcctgagggaccagcccagccgagatatcgggggcggggcagcccaatcccaaactggcggctggacccgactccaactcgttcctcctaagtccgggacagattgtcgggaggagcttgaactgagcttcggctcccgactgggcctgggcccggcccccactggtgccacctccctcccttcctggcccggctcctggcccacactcggccctggcccggccctggcccggcccagacccggcccggccctggcccggcccagacccggccctctgaggctcctccgggctccaggttggcgcaaacaaagccctgattgactgcccggaggggcgggcctcgctgcatggccgcctcctcccctcccaggccgccagggatttgccgggaagagcgggggcagggggagactcccgggggtgcgcaggaccgcggggggccgagtcctcgggctcgagaagattgtgtccacccgctgtccgaggcccaggctgtcccctcaggtcgtcctcctcaagtccaaggagggacatgggagctcctgagggcagggtggggttcctcgcgggccagctgtcgtcctagggtccccggtgccacctcagttgcgggctgcttgtgaggaaggagggtatgggagcaaaaaataggaggggtcttcccgaggctcggggttgatcagtgtcggttctagagcctgcggggaaaagagggcaggagaacaggatagtttgtgcttccttttttccattttaacttttcctctaacgggcatccgggcaagaacagggttcagtagtttgggaagggagctgggggaggcagtggcggctggagtaggtaggcgagtaaaaggaggaggaagggctggggagaagagcgaggctgtagcggctgcctgttgagggaggaagaggtggggggtgtggaggagggggaggagagagagatgacatggggagaggaggaggggggttggacgtgggaggaggaggagagggctcgagggaccgtctgtcgcgggacgggctggccagctggggcgcggagcctggaggaggaggcagcggcagcggcagcagcagccctccgagcagcagcagctgcagcagcagaaacaagtaccagccacaaagcggctcctctggcccaagcagccacagtccccccgccgcgatggcgctgcaaagccaggcgagcgaggaagcaaaggggccctggcaggaggcagaccaggaacagcaggagccggtgggtagcccagagccggagtctgagccggagcctgagcccgagcccgagcccgtgccagtgcccccgcccgagccccagccggagccccagcccctaccggaccccgcacccctgccggagctggagttcgagtccgagcgggtgcacgaacccgagcccacgcctacggtagagacccgcggcaccgcgcgcggcttccagcctcccgaaggtggcttcggctgggtggtggtgttcgctgccacctggtgcaacggctccatcttcggcatccataactctgtcgggatcctctactccatgctgctagaggaggaaaaggaaaaaaatcgccaagtggagttccaagcaggtgagtggccccgcacgccccacttggcattttgggcaaggttggccgctcccgctgccaccgaccccatacctcccggtccgaggcgcccctccaacgcgcctctccgactcctccccttaccccttaccccttgccccttgcccctttccatggctctcctagggtgcgggttgcggggctttgggcagcttggactggggagactaggtgcaaggcgtcccgggggtacgaactgggacattcattgatccttggcaagcaatggacttttttttgccctgggacaaatctaaatgcacctttcaggtttaaggtacctttgcccctgtgtgctgggggaaaatatttgcaggactttttttttttttggaggtggggagaagtcatgaggagaggagagaattgagaggcggggcgggctctgagagaagcactgtaccgctgatctccgcagcagccccccggttcctttggggaaacggaggtgttttctgttaaaaacactttaggaatcctgatgactatgagcgaagagtcaaacacatggcaggcgtgcgtgtctgcaagagagaaagggagggagggagttcgagtcggggtgtgagtgcgtctctggccgccgccgttacggcccagctgggcccggcagtcctctgccgccccgcgggagtgaatggatctccgtgccctatgagccgagccccagagcgggcggggaggcggtctccgcagtctcctgccagagaggcgtgaggccgcaggcaggctgggccctgctgctcactccgcaccgcccccaacttcagccctgccttccccggcaacccgcgcctctctgctaccggtggggtgcctcgttcggcctacagcctgagtgccagacccgccattccagctttcccctggagctgacttgatctcagacagagttggggggcatagccctcgctttccaggccagtggacgcaagaccccaggcgtgtgcgctcttctcattgaggccgcctgtgagctgggagaagtcagaggaaccatctcgctttcccagcaaagccgctggcgaaatccctcagcagttctggtgagggattcagacgaagacgggggattgggatgccctctctggcaaggcttgctccctctcgtggctcctcaggacagctcgactcttgccaccagccccaagttcacaactcagaatatgtggcttttcgcagtgttgccctcggactgaggagttccatcctctcgccaacctccaacccccacatatttctactgccatttgaggggacctgggaattattaagtgaacatagaaaccttgaattctggagtgtccacctgtggattccctgggccctctccaggacttgtggttttagtttgcagctttgctggacttccctggcagaaggggctttggggatcttggtgcctcagaccttgtgatccattggcacagcagcggtgtgcaggccccgatgaagatagtgcgtcagtggttgtcaaaggaagtctcttgactacccaggcccactgtgatgctggaatggaggggtcctgggacagtgtagagcaacttctgcggggaagatggctgccacagtcacccctgggaccacctttttccctgctttgatgcagttcaggggctcctgggaaagcaggcagtgtagggactcatgctgttgcctaggttacctccaagggcacctgctgagcattgccctgtggttgaaggcaggctgttggccttcaggatcagtgagtggcaaagtctgagtgaaacttgatgagaagcagtagaggctaggctgaagctaggccctggcatttatatggtgtgaggaggcctagagctgtgatcttaggagtgtataataaaacttggaaaaaccactattttaccaggaagaggctcactgctggggaacagacttcaaagtaggtgatcataggggactcagggggagggctggctgggactttccggtcaagacctcacagtgcagctagagggtgggggtggtggtgggggtgcagttggctatgcagaggtgtggctagtgcatactctgacacagaccaggttcactgaggggctgaggtcactggtttaaattatagtgagtataggtcaggaagaaacagaaaggaatttggtatgtccctagggtctcagaatactttggcttgggtccttgctgtggtgtatcttgaactcactgacattattttttatactagaggttcttagggacaccacagtttttattttggaaaagtcaggaacaccctatcacatggagctcctagaaaatctcatcctcagtactacctttgctgagctcttcaacttt

SEQ ID NO: 8397 - DNA, 3201 bp, artificial
  synthetic oligonucleotide
ctgccaaatgttaatacactggaatgccaggggaggggaaaagaaggttgcacttctactctcctttcccaccacacacccacccttcactgacctcgccacgactgggccctggcatccgggcctgggggtgctaatcgacactatttcccgccaggtccccatgcccactccacactctgggactgcctgggggtggatttggccctggcggtcgctcctggtcctgccgctggcctccggccaccttgggcggggacgcggagagtggggttggctcctcccccgccgcgggtctccatccatttccccatttgggaggggtaataacccgggagccgcgccacggaaatgcatcttcccctgctattcagacgggaatccgcccacccatgacaaccgcccttcccgcctagggaaagggggcgggaagacctagcctcgggccctgccaactgccagcaagccagacggatagacagcagctgctgcgtgtccgagctcagctcctcctcgatcccccgccctctacctccctgctcgctccaccgacaccaggggccgtagcggcgacggcgccccacccccagcgctcggtccggagccctcgaggtgatccgggctgggcctgtcgaggatcttttacaatcggcggccccctattctctcccgaccggcctcgtccctagcgtcccaagagcgggatcaggcggctgctagcgaaagacctacaggagcccagactcgaggcccgccaggatgcggagactgagggcgggttcggccgccaggaagcgctcccgcccggggcagcaatcctcctccgccctcctctgcaacctccaacccgggagggccctacggggcctcctcctccacacagtgggtcagcccagtggggctgctttctgccaaagacttggcccacccttcaagcgccccttcccccagtctccataaaaactctttcagaactccggggaatcaaccatgctggtgggagctcccagctcaggcctactcccccatctcacagttcccgatcacacaggggagcacgcgggatttcctaggcttgagaaccctcctccaagcctggacggagcctcaagagtggtgagaaggaccagattgactcgaagagccgccctcctcagtttgctcctctcctacactcctctaccctagtctccaccgacctgcttccttctgcgcttgcctagtggggggtgaaggagaggacaactaccttcacttctccccccaactttcacatacaccctccgtcccttaaggtggagtctcctgggaggcgggcagcctcgcagatccttctgccttaaggccttgcaaaggcagagtttcctcctgtcagtctggggtcttccagctccctgccgcatttgccacctcctcccacactcctttcatccttccccgcagcatatctggacatagaccacccctcgaccccgcaaaaaacaaaacaaaacaaaacaaaacaaagccttgagaaatctccaaacacctgtgcgtggacgaattacagttcacagttgctcctatatccctcatcacaattggccctccccccaaccgtgggaggcaactgctcttaagccgggttatagttgggggaattgaggaccggggggaactgaatgtgggttttgaacgcttctgcaaggccctttccaccccacttcacagaaagtagggaagtgagcaaatctctcattttccctgacttcagaaagcctgcttgctgctcctggagtcagcacctgctcctcccttgtccactctatcccccaatgaaggcactatttgggagtggcactacagccccaagatggaggcatggagggcagcagaagccgagccacagtccttgtgcaccccctggacttccccaaggagggcatgtggaagagaaagtctgcctttctctgggagtatgggtcattgtcttctaggttcctctcccccttaacatggaggaaaaactccaaaataagcttgcgtgtgctccactccctcagtccttctctcatgattcaataaaattatcatcactgagggctaatttccagggctttgcttgatgcccacaggccacaaaaggaagaattctttgggctggttatttggggacgggagggtgaggagcagctcatgggaggctctgctttcgtgagaaaggatttgcatgtctaagaggtcaacacagctagtccagggcttcctctcttccagacttccagccctgcatcaggctacagagaggaaatggcaaagagcagcaaatattatgcaaaagggtaaaggagctcccaagctaggagctgggagctcctgggaaaagaaaagggaagaacatgtctaaacccctgcccacagctgggcgtggtggctcacgcctgaaatcccagcactttgggaggccgaggcaggcagatcacctgaggtcgagagttcgagaccagcctgaccaacaaggagaaaccccatctctactaaaaatacaaaaaataaattagccgggcgtggtggcacatgcctgtaattcaagctactcaggaagctgaggcaggagaatcgcttgaacctgggaggtggaggttgtggtgagccgagatcacaccattgcactctagcctgggcaacaagagcgaaactccatctcaaaaaataaataaataaataaacccctgcccacacacctcagtgaggtggacttgttctgtatgtgcctcccaactgtggcctttaccctccacctcaacttgcctgatcccagttgagagactcctcatatccacaggggagtttggtgttttctagcagcccctacccctcagtaccacatttttggtagtctctaactctccagatcccaataagttctagcctaagcctttccttcaggctgaatagcttcaagcatccaagcctggtccctccaagatgaagactcacctgtcatccacaaatggctgggcctagaaaacaggaggagctgtttcagggaaagtcaagttccatgcaaagctagttcctttcggtagttcagtaaatagttgtaaccgatgaaatccagaaacacttttaatatgttgacaaagcacaggagcttcaaaccaacataccttatttacctttttctatccaactgatttcttcacagtttttggttaatat

SEQ ID NO: 8398 - DNA, 1991 bp, artificial
  synthetic oligonucleotide
tatcatttgggtattttgggaactgaccgaaagtcatggctgatgcttcacccatttcatgtcatggacgcctgggaagcaggtagttaaatacaaagcatattatgtgataacccttcataaatataatttgagacactgacactaggagaggatacttggcacagaaaagacatgttatggggcgggggacacattacttgaggcaacacttacagccaatcagtttcctaatcttaaggtttggatgaattccaatcgtttttaaaaactgtgtgtgtacacacacatattttatttcctggtgctaaaggtcttataaactgtacaattacctacattccaacactaatgtgaacacttttctcaatccccacctccattaacaccattaaggtgtaactaacatgttcttttcagagcaaatattccaaattaacaaggtggctcatcttctatagtgttgatacaaagtcagcaaacttttaacttaacttgctcaattttgtttctaatagtactaataaacctcaactttggctggacatggtggctcacgcctgtaatcccagcattttcggaggccgaggcaggcacatcacttgaggtcaggagttcaagaccagcctggccaacacggtgaagtccccatctctactaaaaatataaaaactagccaggtgtggtggcatgcgcctgtaatcccagctactcgagaggctgagacaggagaattgcttgaacccaggaggcagaggttgcagtgagccgagatcgctccattgcacttcatcctgggcaaccaagtaagactctgtctcaaaaaaacaaaacaaaacaaaacaaaacaaaaaaacctcaactttgtcagctgctcagagttaaaacaattcaaatgtttcagactagaagtgagtttttaaaaacatctgaaatattcaagaaaatttgggttttggtacttttccttatgctctgaacaatgtgaactcccaacattgtttatccttgttcctcttactgcatgaagttcaaactaggtcttaaagacaacttttctgtacttaagaaaaagtgcaaagatagaaaatgaaatgtaaggtgttttgcaagaaatgctccctcgagaatggtgtttggatgtgggtggggggaaaacgatttttgttctccattgtaatctgacacctacgaatgaccttgtcttcaatgtccacaacactagtaagcatgtaataatcacggacatcgcaagattaaaaattaagtagcaaattccactaaaacacttgtattcattctatacaatcgaatggaaatccgtgagtgctactgaaaaaggtgttcacatgcacatgtccaatatgtgcattccactgaaggctaaaagcttaaaattctatttccagtgtttatgaatagcttcaatatctacattcatagccagcattctgcttgagttacctcttactttaatacttcacaaatgagtaagtacgtcttgggagattaggaaggtacctgttgtcaataactttctcttatgcttagaatgtgctgcaattgtttttaaactatttaaaatgaacacccctataataatgaaacactttatgccaagaagaaaattgatttgtttttagccaatcaagactaccctgcagatctgaaaactgtagattacatccttaggaaaggagaaaaggaggctcacaaatataaaggaatcctgacttttacacggacaaatttttaaaaagataaaatgtattacataagcgccataaacagtgaaatctgcttatattaaaaaaaataagtgaagctttgtttggacattatttccttgcaagagcagtacatatccttagtaaacaactaccatatttacaagttaatttccttgatacttagataggattgaaagccagaagaaatcatggaagagtgagctttgaaataatctttacagctaagttggtaacagtgaa

SEQ ID NO: 8399 - DNA, 3251 bp, artificial
  synthetic oligonucleotide
ttcctctttaaaaagatacacattttctttgaattagacacaacctaaaaaaaaaaatacagacacaccataacccaacctaattcaatattagtattagggcatttggggagagcaagaaggtcagaggggaccaggagttagataaaagatgtcttctaagactgagagacaatttacgttttattataagcttgcttaaaataagcctttccttatcagaccagtaattattttcagattctgatagtcactttcaaggacttatctggcacattacactagcctaaggtaggaactaaagtattaaaattcatcagaacatcatggactaaaaaaatctttgtaacatttttcagtaagtggagtgtgtcctaaaatcaagttttaaaaagtggattggtctttctagctacctaagctatatttctacagtttagaaaagtcatggggggggaggggttataattgtgccagtcctccagggaagatacaatgtacttaatggggtgataagtagttactctgtctataatcacgaagaatgaaagaaatgattagtagcagtaggtttattatttcttccccctttcaatcagtccaaaacactgcggttaattctgattcaggaaatgcgggctccttacttctggcaaaaaatcattgtggggtcttgcaaatggaagatgacaatctgatacaactgcttcctcttgccccaaaatgaaaaaaaaaatgacctcaataacaagactgctaggcctcagattcccagactaacctgtggaataagtatggtgaaactgtctagggaaggaacgtggctgtctcctccatcttgaaattaatcagcataagggaaaaagggaccgagtattcaggaagcagaagcccaaccggttaatactagttactaagctatggcatgcgtggcaggtaccgtctgcagaagcagagacccccctaggcttttttttttttttttaatgggggagggattgagttgttggtggattaaacacaaattaacttgaaaatttggcccaattccatcccttatccaggagaacacaacaaacacctaacggcttttccctctcttttgcggggggatccttccagtgatacctggcaaaggatatgccagggttattcgagcaagggagtaaaccacatttgcctcagatcctcagggaagatgtcatcgcggccccagggggcgcctaattggtaataccctgcagaagggctcaaaatgaggttttggaaatctaaaggcccaagagttgccagcatctcacttggggcagcctgattttttacttcccttttcccaaacccaagcccgccatggaaaacgcggggaggtcagggaagcctccagagaacagagaagaaaaagcctgagacgttctaagattctgacgcctgaggccaaaactcaaaaactgcctcccccgatttcctaaggctccggagggcctgggctgcagctcgcgcggccaccgagaggaagtactacccacctccttccccttcaaagagcctgtcgactataccactcaactaaaatggcagcggcgactacgccacggagccccccgcagcaacgggcctggggtccggaggcggcgctgagcctctgccacgacgcgtcactcgggccattttgagagaacgcggcagccgcggctccgctgtcttcctctcgctctacatcatttctcacaggattcccaagtcttcacttactaggttttagggtcaggatccgactcggttggttcggccgccgccgccgaggctgctccgcacctccctggccgccgctctcaagcccgcctccaatgagtagctggttgagacccgcctctagcccagcgcctgctcggagacgttgctcaggcagccattatcttccccattgttaccaagcagcgacaggaaacgactgcccacaacaggaagtgatgatgccgcgtcccggcaccgcagccccactcccagcctattagccaatcccagtcgattcctcgaaaaggctccgcgggaggaggagggggacggcagacgacgcggcaaggcgggcggcggtttggaaaaggaaagctgttatgacgcccaccatgtgacaggccccaccctcctccgccattttgaattgtggcgagaaatttgcgttctgagaattgtgggaaccttcgctttcccattttgaaaactgaaggacgtcacggtctgactgcttgaagacattttcagagagagagaaatgtgatattagtctaccctgacatcacatcagttcacacaatccgtgcagaccagttcaaaaagtagcctgcgttttattcaacatgtatttacacagtgccaactgcatgtcaagcaccattgtagctgcttaggaaattaaaatagaccaaaattaagaaagaaaacaggccacgttcggtggctcacgcctgtaatcccagcactttgggaagccgaagcgggcggatcacctgaggtcaggagttcgagaccagcctggccaacatggtgaaacccagtctctactaaaaatacgaaaattagccgggcgtggtggcgggcgcctgtaatctctgctaatcgggaggctgaggcaggagaatagctgaacccaggaggcgaagattgcagtgagccgggatctcgccactgcactctagcctgggtgacagagcaaggctgtgtctcaaaaaaaaaaaaaaaaaaaaaaagaaaacagatcaaaatcccagttctcttgagtctttataggggccagggacaataatttagaaaaaatcaaacataaatacatatcatgttagtgataaatgccaaggagaaaaatcaaggaagggggacagaagagttccttgtagggacaaacggattcgtgatgtttaaaagactgataactttgaggcattaactctaaagtattcgaaaaagggcggtgattgtaaaagggtgggaaaatctgataacgttgggatttgtaaaagggcagttaaagaaggcctttcttaggtagtaatgcctgaaagaattgagggaactcgccacacagcatgccactcccattgtcacagttaaaggaaaaccttacccaagtttttagattcttttccttttcccaatttttctgttttccaatagcatgccagctatgctggctttgttacggtttttccaacaaagctaacttcttcctacttcaactactttacctttgctgg

SEQ ID NO: 8400 - DNA, 833 bp, artificial
  synthetic oligonucleotide
actaggttgattatgcactgcctctgacaccaaacaactgcacaccaagtttctctttgccaaagacaaggtgactccatccctgcttcttatcttgattctcctcagtcaccataaaaaactcaagtccatctggtcccacacccacctaaacttccattttcatagaggtcagcttccactttcatctccacttacattgttccttaccctctcaccaatttccactgagccctctggaacagtgcattcaatactaatacattctccagctttcttagtcccttggtagagagcttctccttctcagcactttgactgaaaagtgccagcttccaaaaaacttcctctcccccaagaactcatctggtgcttaattaaaatatagattccaggccccattctaggattctgatttagacatttttgggtggaattcaggcatcttcattttaaataaactccccagaaaattcagatgcaggctatctgcagagaagtgtttggaagatggatatacttaaatcaataatagctaccatttatcatggccctactatgtgccagaaataggcacactatctcatttacttctcaccaataaaccttgtaagatgttatgaacattttataggtgaggaaaatgaagcctaaagcagtgagaaacaacaggaaaaaacaaaatttatctgcgatcacacaactagtaaataaaggagataggtttggactctaagtgcatgctgcatgtaacaacccaggtctcctagctcctaaccaggtctcaaatgaatcataaatctaaaaaatgttttcttaaagattatttaata

SEQ ID NO: 8401 - DNA, 250 bp, artificial
  synthetic oligonucleotide
agtatcttggatgcatatttttcagtgtatgtaaatggcatcgtgttgtatttctcatttctccccagtactgtgtttaaaagcttcatccatgttgctatgttcatatgtccaatctagctcattgctttcttctgctgcatggtactccacaatatgcatccactctcccagcatctccaactttccaccaccacaaaccatgctgcagtgaacatacctgtacctgaattcatgggagaatttctct

SEQ ID NO: 8402 - DNA, 193 bp, artificial
  synthetic oligonucleotide
ataccactttgtgtttagtggaattagtgcccactactctggcacagggttctctggtaaagctaggtttcagcacataacttaggctcaggatccaaaaagggcttcaccttttcccaccagtttccaatcttatcatagcttactcctgaattggtaagaaccagtaagtacttgagcaataaagtgaaag

SEQ ID NO: 8403 - DNA, 268 bp, artificial
  synthetic oligonucleotide
agccttccagtcacgtctgttctatgttcagcactataccacgccattggagaaatgctagataagtctaaggtatggctcatagcatcaatagtgtattcttgaaaaatgtttagagtgtgaatgttaagtgtttttaccacaaaatgataatcaaatgaggtaatgcatatgttaattagttagatttagccattccataacacatatatacttcaaaacatcatgttgtacacaataaatgcatataattttatctgtcaattaa

SEQ ID NO: 8404 - DNA, 1562 bp, artificial
  synthetic oligonucleotide
cataggagcaactgaaagaatatccattccaaaggacttatgatagcaagttctcacaaggaaattgtttccaacagtttcaggctgtcctaccccactcacaccccattctccaaagctgaactgataccgaaaaaaaactgggacaactgctcccatatttacttttataaaaacacattgtattaatggaacattttctttattttttcattaattgccaccttttcattacatagaaagcactccactcctctaagccagcaggtgactctgaggtctggagtcttggggatcacaatacaggcagagttggtgattccaagccaaaattcagctgcaaaacagaaaaatcaaaaacaaaaacaaaaacaaaacaaagaccagtttctagggactggccatagcatttagtacagctagctatcagaatagagaaatagaagaaggttttccagtttggttattttcccttttgaatggtagctatggggcaggagacatgtttcatctggtgcctttccactaagtaattttccagggctcactgcaaacagagcattaaagcctaggaatgggcctgtaccagcctcacagaatgctcctcacccactcatccccacagacacaagagactgacgctgggaacacacatgatcaagaacacaggcttgttcattttacgacccagctgtaaggaatagagcaggctggtgaaaggaatcatggaccgggaagtgtatatacttatatacatgacaggcttccttccatttctctctgactactttcaaatgttgcttctctgtttgtgaatacatttaggtggcattgactaggtaggttcatattttgcttaaaattttccttttgaaacatcttccctttttttgttaaatcccctttttcccttcccacttattctccaccctcccaccccagcctatatattcacaagttaataggttagtaacaatattaataagaatagtaacaacgacaacaactaacaatattaataatattaatcccctatatctgtatagcactttatgatctacaaagcgctctcacatccattatctcatctgtgccataatgcatcagtcatcagatgcacaggccttcaattgtgcaaagaaaagagatcaaatgttagaagtcaagtggtgaataaaagggaagaaaaagtagtagtgaggaatgttggggctgtgaaattttttttaaaaagtagggggagtactgaataaaaaatgtgatttaaaaatttgtacttaaaattgagatttaagtttagtgtgtggcatcaaatattggttatcctcagactaagggtatatggcccaaatcagttgttgccacaaattgttcatcttatctgatagtaaatgtactttactcataagaagaaaaatttggttgaactgggatgccttaacattttctttaaatgacattggcattgcaagattaaacactgaaagaacactaaagccatgatatgagtgcacttttgacaaaactggaataaaacatttaggaaactatttaaataaaag

SEQ ID NO: 8405 - DNA, 783 bp, artificial
  synthetic oligonucleotide
gaaagcttatctcaggagtaagaagcctttttatttatatttaagttttaataaatgctagacttcaaggataaaacatagggagatgtagggatgggggctttctagtggatttaccataagtaacatacaacattggtatgtaaattactgtgtagcctaatcttttgtcattcaagtagctttaactttaaaagctacacaatgtggtctaccataggtttgacagaaaaaagtaaaagtcaaagttacctaaactccagttaagagtaagagcactgaattgggagtaaaagcattaagaaacctgggttctaggccgggtgaggtggctcacgcttgtaatcccagctctttgggaggccgaggcgggtggactgcttgaggttaggagtcagggagtgagggaccagcctgagcaacatggcaaaaccctccctctacaaaaaaaaaaaaaaaggaaatctgtctgggttctagtcctagctctgacattgttacgtcaccttaagtaatccatttcctgtacgggcctcaggtttttcttgtgtacaatgatcttaacaacttcgaagaatcattctaaagatcaaatggaataatatgaatgaaggttaccaactgctgtacaaattgaaagtgacttaacgactaaacagagagcaacctcatttgtttcttctaaagctcaattaccaaactggaatcaaagggctgtaatgaggtccaaggattactcataatagctactattcactgagtacctacaacgctaggcactgg

SEQ ID NO: 8406 - DNA, 5235 bp, artificial
  synthetic oligonucleotide
ccaacacttagcacttttctcatcttctcccacctcctaaacacaggcaacaccacctcacctttagttctctctgctcaccaggtagcttacaggtaaccagaagattgtggaaaaaagaaaaagagggaaaagggacagacttgaagtaaaacagaaagtggcagtactgcagttgtttgactttggcaacagggtgttatgggtgtgtgtgtgtgtgtgtgtgtgtgtgtgtgtgaaaaagcactgatgcatcaaagatttattcactgaacaggttgatttatttaacagacttgacatatgtcaaattctgccatgtacttacataattgttaccaatttatcagagctgttatttaggcaaatatttgctttaaaaatattttcctttaaatgactttctctagcttactgcacaatcaatccgtggttcatttaaattatgttatgttaacaatagctatttggtgaaggtctctcaaatctaatcttcccggagccatttcatctctactcaaactctatccctcttttttcctagtaataaatttctggctaaaatcacaccatagggaaaactttaaatatatgtacaatgtatttttatgtcatggtattttacacttacgatttacaaaaaaaagcagtttatcagtatattgttaaaatcacagatctgaatgctgttaaccttaaaaactgtctaaaaggaaaaaagcatgtgtttttgtatgagtttatgtctgggggggccagttgggacagccaggtagagaattcatcagaataagagaaagtaaatagagaaatttcaagtcttacaaattttgttcaatcaccctaccccatgtgcaccaaaaaattatatttttttaactagcatgcatgcaatctatctagattttcggggaggtgaaatattggaaagtatttctaagagacaaaaatgtctaatcactagccaccagggctagtttcagttcctctattgtaaatacgctatttgcaaaaacaagaagctcatttttgacctcccaggttacgcagtgtggggactatgaaagacatggaggaagaaagggaaataccaccaccacacagtaaatttttgacctagtaagcaaatacgtttttgttgttactgctgggtaaaatgtatgtcttccagaaattagacactgtaataaaaatgtaccagcccaaatttaaattgctcactagacagatggttaattatattcacagccacatatttcactgggatagagtttcagacactcagccagttttatttgattagccggtttcccagttaatatgtaaaatgacagttacttaggacttttttgttcccttctaaaaatattttttcaataagtgtaaattctcctcagccataagaacgtcactgctgtaaataaaacgtttggtcatatgttacctcatgtgtaaaagatgtaagggagattcacccctccaaaacacaaatggtcgtaaggagttcagagaagaccattacagcaccttttctcaccaagcaaaatattccaggaactcctccaccaaaaacaaccaaggatatattcaaatcccgggattaaagtgctttagacatttttaaaaacagccctgccagccctacaacacaaatcatgtcttttcagataacagtctagaaaatgcaacattagaaaaaggccacatatctaaatgtagtgctgtgcacagcattcaacaatatgctgggagccaagatccagaagcaaaatatgagacccacttattccaaaatgcaaccagaagcttgataaaaatcaagagtgctgttgtcgaaatggggatgccaatttttttttaacttcgaaaaagacagaaaaccttgcgcgggtgattcggtccctcacgaatcagacagacagaagcagtcatgctgaaatcgctgaattcctcagcggaacggcgccaactcagcagcgcggtttccacactttcccggagcgggactccgctccccgcgccggctcacggccttcccgccctacagggtgtacaagacgcgagccgacgtgtgctgcggggcgcggcagagagaagcgccagaagccacacagaaaagcgtcaattcgaccgccaccgagagcgcgaaggggccacaagccaatttccgcaaaggagatgagctgggcgaggctcggtctggcctccaacttaaacctgtccgcagcctcggccgagtggcgcgtgtcctgggggcgctctgtggtcgccacggccgcccggcttcgcacctttgcggctttggtccgagcgcccggcctcggccgccgcgtgggttttcccgctctcgccgaagcgtgccatgcccatgccccattccctggccaggctctaccctgcaccagtccgaaaggaggcggcactctgccgagctgcgtgcgtgtaagcgcggcggctccggtccgctcgcttcccctccccccgcaacccccttcctacggcgcaagcacagaggcctttcctagattgcagtgcctgtcagggcgagccgggatctctcgccctagcggcctcgctccctcatacacagacacacacattcgcatacagacgtcctccgttccgttttcccttccttctcgtctagctcgacttaccccagttcattccaccccctgcggccgccaccccgagccagccggggagccggcgagaaggccaggaagctgtatggcagcgctcctactcacctcacaggccgactcccgaggcgcacgtcgctggcgggctcaggcagcaggcgctgtagctagcgcggtcgcagtcaaggctgggctgtcgccgtcgccgcagctgttcgagctgccttagccgccaccgccgctgctactgctgccgccgccgccgccgcctctgcctcagctccatacgctgggcccgccaggtggacgcgcctctctcctcgctcgctccctcaggctccgccgccgccgcgctagatggagtcagagctgtcgggctctggccctgaaactcagagcctccgcggctgcccggctgctccaagggtccgtgcttcgcttacactgtcgctcgccccggctggagctacctagcgagcgggctgcgcgctcggcgcctggagcccgctctgtgcggtggctgcggccgtccgcgagagggagagaggagggcggctgctactgtcgctatagctgttaaagctattgctaaatgctgctactgccgctaatgctactgctgtggcggcggtggtggcggcggcggctgctgctgctgctgctgatgctactggttttccttcccaggttcttcccctgcctcgtcccccctcctcccccttcctcctcctcctcctactcctcctcctccttctcttcctcctccctcttctcctccctctgccgcttttctcagagcctctgcaggcactgcctggtcccctcttctcccggagctgtctctgcccattcagaaaggtgcccagagtggggccgcctctgctgccaccatcgctgttgcccctgccattgtttcctccaacacggctgttcttgctggacgccttcccccctctacccttcttccccaccacagctctccctttccctcccgctctccttaccctctctatggtcccttccttatgtgcccccccaactctgtccgtctgtccttccctcccctcgggcgcccgggagcgcgcactgcgcggccacctgtcataaagggcgcgcaccccccttccccattcccaccccgccccccactcgcgttcctgctgcccttccagtccactacgccagtggtgcgttcttcccctggcagacacgcaaccggacaccactctcccatgccttttagggcagttgtgtgtgcggagaggggcactctgaagtttggggaagaatatttgaatggtttcatccaccaagcatctaaccattcaacctttacctactcttaacttaagggcctgggcccccaggaaggtgggtcctttttgaagggttggatgaaggcagacaattggggagtgacgtttggggaataaaggaaagaagggaagctgaatatggccaggaaggaaaacagatctgcctgatggctgtcattgaaaaatctcttaggtggtcattttccttcagacgtcctgggaactcaacaggaaacagcaaaacgattggagagcaactcaggagggaccatttagtacttctggagtcctgggtgcaaggttgaggcctgagcctcgggagatttgtcaccactaggagccaaggcaagagatgaaaaggttggtactagaacagaaggggtaaaagtagctactttgtgtgcacttgctccaacatcattgccaaagcacagcttctccagtcaggcagggcctcatttcagatttctttgctgccacagctacagcgtcattttgctacgagggctcaggctttgagatctgatgtgtgcaacttctcaccatcacctgtcacacaatccctccccagaaacagtgcagaggcgggggtatattttcttttccctggcaaagtacaggagataaatgttccagatatcccattgacaataaggtctgggtcactttaccaagtttgaggcgctctaccatgggtctttcattcctggacaataaactgtctgtatggcttttacaactccccatctctgtgcctttgtttctgtcatcccacttgcttgaaacactcttgttatttctccctctcattttatatctatgaaactcatccataaataatagctcatcctgaaataattatacttattgggtccttactatgtgccagacactgtgctaagcaatttacatgaattatttaatcttcacaacaaacacaattttactatctccattttacaaatgagaaaatcgagtcacaaggaagttaggtatatgtgtcctgaggatagggatgatatgttatttatcttgcatttgtgagacactgtgcaaatatatttgcatctttcaggcactggaataaataagaagacaaaatttggcctctgttctcaaaagcaaaaacaaacaaacaaaaaaggttaaacatgtaaaatgccacccatctattggctggatctcaatatccagaatgaattgctctttttccgttgtcggaaagcacattgttttcacctgtattaactacatatgctattcttcctttataaagt

SEQ ID NO: 8407 - DNA, 7051 bp, artificial
  synthetic oligonucleotide
actattatacccattttacagatgagaaaactggaacacagggaggttaacttgctcaaggtcacataattagagggtaatagaaactaaataatgcaaaaaaaatctctctggcatatttttccttctttttttatgtttcatgtctcttttatttattttatttttttttattattatactttaagttttagggtacatgtgcacaatgtgcaggttaattacaaatgtatacatctgccatgctggtgtgctgcacccattaactcgtcatttagcattaggtatatctcctaaagctatacctcccccctccccccaccccacaacagtccccacagtgtgatgttccccttcctgtgtccatgtgttctctttgttcaattcccacctatgagtgagaatatgtggtatctggttttttgttcttgcaatagtttactgagaatgatgatttccaatttcatccatgtccctacaaaggacatgaactcatcattttttatggctgcatagtattccatggtgtatatgtgcctcattttcttaatccagtttatcattgttggacatttgggttggttccgagtctttgctattgtgaatagtgctgcaataaacatacgtgtgcatgtgtctttatagcagcatgatttatagtcctttgggtatatacccagtaatgggatggctgggtcaaatggtatttctagttctagatacctgagaaatcaccacactgacttccacaagggttgaactagtttacagtcccaccaactgtgtaaaagtgttcctatttctccacatcctctccagcacctgttgtttcctgactttttaatgattgccattctaactggtgtgagacggtatctcattgtggttttgatttgcatttctctgatggccagtgatggtgaccatttttttcatgtgttttttgtctgcataaatgtcttcttttgagaagtgtctgttcatgtccttcgcccactttttgatggggttgtttgtttattcttgtaaatttgttagagttcattgtagattctggatattagccctttgtcagatgagtaggttgcaaaaattttctcccattctgtaggttgcctgttcactctgatggtagtttcttttgctgtgcagaagctctttagtttaattagatcccatttgtcaattttggcttttgatgccattgcttttggtgttttagacatgaagtccttgtccatgcctatgtcctgaatggaattgcctaggttttcttctagggtttttatggttttaggtctaacgtttaagtctttaatccatcttgaattaatatttgtataaggtgtaaggaagggatccagtttcagctttctacatctggctagccagtattcccagcaccatttattaaatagggaatcatttccccattgtttgtttttctcaggtttgtcaaagatcagatagttgtagatatgcagagttatttctgagggctctgctctgttccattggtctatatctctgttttggtaccagtaccatgctgttttggttactgtagccaccctgtgtgagcagaaacagggcgaggcattgccgcactcaggaagtgcaaggggtcagggagttccctttcctagtcaaagaaaggggtgacagacggcacctggaaaatcgggtcactcccacctgaatactgcacttttccgatgggcttaaaaaatggcacaccaggggattatatcccgcacctgactcggagggtcctacacccatggagtctcactgattgctagcacagcagtctgatatcaaactgcaaggtggcagcgaggctgggggaggggagcccaccattgcccaggcttgcttaggtaaacaaagcagctgggaaggtcgaactgggtgaagcccaccacagctcaaggaggcctgcctgcctctgtaggctccacctctgggggcagggcacagacaaacacaaagacagcagtaacctctgcagacttaaatgtccctgtttgacagctttgaagagagcagtggttctctcagcatgcagcttgagatctgagaatgggcagactgcctcctcaagtgggtccctgacccctgacccccgagcagcctaactgggaggcaccccccagtaggggcaaactgacacctcacacggccgggtactcctctgagacaaaacttacagaggaaccatcagacagcagcatttgtgttcatgaaaatcagctgttctgcagccaccgctgctggtacccaggcaaacagggtctggagtggacctctagcaaacaccaacagacctgcagctgagggtcctgtctgttacaaggaaaactaacaaacagaaaggacatccacaccaaaaacccatctgtacatcaccatcatcaaagaccaaaagtagataaaaccacaaaggtggggaaaaaacagagcagaaaaactggaaactctaaaaagcaaagcgcctctcctcctccaaaggaatgcagctcctcaccagcaatggaaaaaagctggacggagaatgactgacgagttgagagaagaaggcttcagacgatcaaactactctgagctacaggaggaaattcaaaccaaaggcaaagaagttgaaaactttgaaaaaaatttagaagaatgtataactagaataaccaatacagagaagtgcttaaaggacctgatggagctgaaagccaaggctcaagaactacgtgaagaatgcagaagcctcaggagccgacgtgatcaactggaagaaagcgtatcagtgatggaagatgaaatgaataaaatgaagcaagaagggaagtttagagaaaaaagaataaaaagaaatgaacaaagcctccaagaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactccttgagaagagcaactccaagacacataattgtcagattcaccaaagttgaaatggaggaaaaaatgttaagggcagccagcgagaaaggtcaggttacccacaaacggaagcccatcagactaacagcggatctctcggcagaaactctacaagccagaagagagtggggaccaatattcaacattcttaaagaaaagaattttcaacccagaatttcatatccagccacactaagcttcaaaagtgaaggagaaatcaaatactttacagacaagcaaatgctgagagattttgtcaccaccaggcctgccctaaaagagctcctgaaggaagcactaaacatggaaaggaacaaccggtaccagccactgcaaaatcatgccaaattgtaaagaccatcgaggctaggaagaaactgcatcaactaacgagcaaaataaccagctaacatcataatgacaggatcaaattcacacataacaatattaactttaatgtaaatggactaaatgctccaattaaaagacacagactggcaaattggataaagaatcaagacccattagtgtgctgtattcaggaaacccatctcacatgcagagacacacataggctcaaaataaaaggatggaggaggatctaccaagaaaatggaaaacaaacaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctcagtgacctacaaagagacttagactcccacacattaataatgggagactttaacaccccactgtcaacattagacagatcaacgagacagaaagttaacaaggatactcaggaattgaactcagctctgcaccaagtggacctaatagacaactacagaactctccaccccaaatcaacagaatatatatttttttcagcaccacaccacacctattccaaaattgaccacatatttggaagtaaagctctcctcagcaaatgtaaaagatcagaaattataacaaactatctctcagaccacagtgcaatcaaactagaactcaggattaagaaactcactcaaaaccgctcaacaacgtggaaactgaacaacctgttcctgagtgactactgggtacataacgaaatgaaggcagaaatacagatgttctttgaagccaatgagaacaaagacacaacataccagaatctctgggacacattcaaagcagtgtgtagagggaaatttatagcactgaaggcccacaagagaaagcaggaaagatccaaaattgacaccctaacatcacaattaaaagaactagaaaagcaagagcaaacacatttgaaagctagcagaaggcaagaaataactaaaatcagagcagaactgaaggaaatagagacacaaaaaacccttcaaaaaattaatgaatccaggagctggtgtttttaaaggatcaacaaaattgatagaccactagcaagactaataaagaagaaaagagagaagaatcaaatagacgcaagaaaaaatgataaaggggatatcacaaccgatcgcacagaaatataaactaccatcagagaatactacaaacacctctatgcaaataaactagaaaatctagaagaaatggataaattcctcgacacatacactctcccaagactaaaccaggaagaagttgactctctgaatagaccaataacaggctctgaaattgtggcaataatcaatagcttaccaaccaaaaagagtccaggagcagatggattcacagctgaattctaccagaggtacaaggaggaactggtaccattccttctgaaactattccaatcaatagaaaaagagggaatcctcccgaactcattttatgaggccagcatcatcctgataccaaagcctggcagagacacaacaaaaaaagagaattttagaccaatatccttgatgaacattgatgcaaaaatcctcagtaaaatactggcaaaccgaatccagcagcacatcaaaaagcttatccatcatgatcaagtgggcttcatccctgggatgcaaggctggttcaatatacgcaaatcaataaatgtaatccagcatataaacagagccaaagacaaaaaccacatgattatcttaatacatgcagaaaaggcctttgaccaaattcaacagcctttcatgctaaaaactctcaataaattaggtattgatgggacgtatctgaaaataataagagctatctatgacaaacccacagccaatatcagactgaatgggcaaaaactggaagcattccctttgaaaactggcacaagacagggatgccctctctcaccactccattcaacatagtgttggaagttctggccagggcaatgaggcaggagaaggaaataaagggtattcaattaggaaaagaggaagtcaaattgtccccgtttgcagatgacatgattgtatatctagaacaccccattgtctcagcccaaaatctccttaagctgataagcaacttcagcaaagtctcaggatacaaaatcaatgtacaaaaatcacaagcattcttatacaccaacaacagacaaacagagagccaaatcaggagtgaactcccattcacaatttcttcaaagagaataaaatacctaggaatccaacttacaagggacgtgaaggaactcttcaaggagaactacaaagaactgctcaatgaaataaaagaggatacaaacaaatggaagaccattccatgctcataggtaggaagaatcaatatcatgaaaatggccatactgcccaaggtaatttatagattcaatgccatccccatcaagctaccaatgactttcttcacagaattggaaaaaactactttaaagttcatatggaaccaaaaaagagaccacattgccaagtcaatcctaagccaaaagaacaaagctggaggcatcacgctacctgacttcaaactatactacaaggcatatttttccttctgaaaaccatactgcctactaaaagcaatttaaacttttaaatatgacatttaagaccttccatgatctgataccagcctatctctcagcgttgtttcttacaattcatattcatgtatcttgcactccagaaaacagtttgcctaatatgccacatgctttcctcatgtgttgccttggctgtgataccttctgtttctgctcttgccatctctacaagtccaaatgttgcccattctttaagatccagttcaaatgtcattctgttcacttagaagaatcttcaacctcctctgtgcatctgaagctcttcaaactgacctcctgcccaggaatggcttttattctggtttagctggggagaggggatggtaagagaacctatgcgcttgtcagtttcctagatccctgcctgccttataagcttgtcataaggatgcaatgagaaaatggatataaaagggtttttgaactgtagagcactgtaatggtcatcattgcatttggagtatctctttatttttccaggtttgggaaaccatagtcttttcagggtgtgcctattttaaggagggcaaagttccatttctgatctatatttttgaaaatgtcaaaagttgaataagaaaaagggcaagtaataaaaggtaacatggagaaatacaaatattgacttttattagatgatgagaatgtggacaattatggtattacatttctgttgcttttataatagaggaacatgaaaagatgagaaaagcaaggatagctgcttggaattaattgtgtatgctcatagcttttgttcgatttgcaaaatctgtgttcatttaaaagccctaagagcaggcttacgctctttactgatagaatga

SEQ ID NO: 8408 - DNA, 1670 bp, artificial
  synthetic oligonucleotide
tttatttcttatgtagtcttacacttaattctgttactttcaacctcatgcttatcgccacttttcatcatatctggtgcctttaattcctgagccttttcaggggtctacaacatgaatcaacttgcttttttttaaattgatgtctctctcttttgacacacaactttttagctctgctaatctgtctacttaccagtttcccccaatttgctggtatctcttgtccactgttactccttctcctattatctttgtccttacggctgtatacttattatgcttattttatttcttcactttcattttagtatggttaggggaagaagagataaacaaatgtatccaaccttccatgtttaactagaagttccctagatatgccgtcttaacattaacactactacaagaaattgctgacagaacacaggaggtgacagattattagtcaaagctaaggtcatattagtttcactagaaaatgaaaatctgttatcttcataatcagacaactatagaatcatcaaattatgaataataaagagattcttgtttagatacagttgctatgatcattaataaattaggtccaattataacccaaaacccaagtggcaatggtgtaaaataagtgtatagatactgtgaattacatggcatgaggcaggtaattacatggcatgaggcaggtaatcacatgcctgctaacgtattttaacaacttctatttgtaataaaaggctattactacttggctgcatagaatcagaaagcttataaaaaagtagcagattttatttaagattcttgaacatcaatgatataataaggtattatttacaaaatttcccatttaagacattctggtacaaccatactggaaaaatcagtttggtaatgaatataaatatttaagaacaaaccaacagaaaggcctagggtcacaagtatgtaagcaacttatgaaggtaatagtatacaaaccacaacactgaataccctataagaaatgttagtggagtgaaaaagtccctttaaatagctcaatatacagacagtacatgagaatgcttctctctaaactcttagtacacaggttttcaaaatgtgaccaggtgtgatggttcacgcctgtaatcccagcgcactttgggagtctaaggtgggcggatcacctgagctcaggagtttaagaccagcctgggcaacatggtgaaaccctatctctacaaaaaattagctaggtgtgtggcacatgcctgtatagtcccagctacttggggggctgaggtgggaggattgcttgagcccaggagttcgaggctgcagtgagccgagatcgcgccactgtactcctgggtgacaaagtaagaccctgcctcaaaaaggaaaaaaaaaaaccaaaatgataaagaattgaagatatatttattagaagggaaaaataattacagaaaaggctgaatgcagggtggaaaactgcataatgttagaaataatcaaatactagaggggtgtggggagaagaggtccttacagaaagaagaaaagaaaaattattgcaattttcaaatctacccatcacaatagtggtactctgatttgtctagacttttacagtatactcatatagtaattcccttagaagagataaagcaggctatcttttt

SEQ ID NO: 8409 - DNA, 777 bp, artificial
  synthetic oligonucleotide
atgaagtgatatttcattgtgattttgatttgcatttccctggtcattagtgatgttgaccaccttttcatacctattgacaatttgtatgtcttctttgaaaagtgtctattcaagtcctttgcccattttaaaattggggtgtgtgtgtgtgtgtgtgtgtgtgtgtgtgtgtaagttgtgtgagttccttctgtattttggatattaaccccttatcagatatgtgatttgcaaatattttctcccattccatgggttgctttatagttttgatgactgtttcctttgctgtacaaaagcttttcagtttgatttagacctacttgtttatttttgcttccactgacttgagcttttggtgtcatatccaaaaaatcattgccaagggtaatgtcaaggagcctttccctatgttttcttctaggagttttgagggtttaaggcttatgtgtaagcctcttatccattttgaggggttcttttgtatgaataagataatggtccagtttcattcttttgcatgtggatatcctgttttcccaacatgatttattgaaaagactatcttttccacattttgtacttttggcacccttgtagaagtttagttgaatgtatatggatgggtttatttctgggctctatattctgttccattggtctatgtgtctgtttttatgccagtaccatactgttttgattaatacagctttgtaatttgaaattaggaactgtgatgcctccaactttgttcctctctctcaagattgcttt

SEQ ID NO: 8410 - DNA, 234 bp, artificial
  synthetic oligonucleotide
cttcctaataatcttaataactagttaaaaccaatgtgtcaatgacttagagaatgttatttattcaactatatctgaaaaaagaatcccctgaattcctcttctcaagtcccagtgccactttccattccttaccatatacagcccatgtaaggtatatctttatttacaacttttatagcattactgttattcttcaccaccccttagaatctatttctaccatcccagatg

SEQ ID NO: 8411 - DNA, 550 bp, artificial
  synthetic oligonucleotide
aaggcataactgtatgtctctcttagtaccctatcatctagcacagggctatgtacaaggtagacgttaaatatttgtagatgaagaatcaaaatttaagaggttgtttctcatacaaaactgacaatattttaaagtgatagtgataaatacgtggtggcaattaaacctcttgtcaatacacagaaaataaaaagatatactttagtacagttaagtacaaataattttttaaaaaaccgttcctgagtgagaggtaataatggactcaaattttaggaggcactacaaccatagctacattcataagttaaggataagtagcctatggcttccaaaatgacctgtgcacagagaacatcactgtatttttcagatctaggacagtcatatttatacaagaatttagggcggtctatgttttggaaagatagttacggttttggcctatcaagaagcacgcctgtcagcaagggagttaactggcgccacctgtttatagatagcttgctgtcattacagtgctctccgaattgctaattccaactga

SEQ ID NO: 8412 - DNA, 626 bp, artificial
  synthetic oligonucleotide
ctgacataaattaaagagacagaggtatacacaataaaagctgctataaatagctgctacaaccacagatcacatgatagcactttatgtatgcaataattaaatgtgtatagtattttgtaacttacaatccgctttgtcataccttatttcatttagtcctcacatcgaccatggaagataggtattatttattaatatgcccatatttatgaggaaactgaggctaagaaaagttgtgactaggtcagaggccacagagctaatgggatggagaccaaacctaggttttatgactccaaacatagtgctcttttcacttaataacacctgaaatgtggaagaaacacttgagcaatttaagaaggccacagtggtcttctgtttctaaaaaataccagaacttattctcacctcaggacctttccacttgctttcccctctaccaggaatatctttcctgtagatttttaaatgactttttcttatctttcaggtctcaaaacaaatgtcacctgcttagagaagctttccaagagaaccttatctgaagaggccaccccctgtccccaccactctgtatcaccattgccttgtgttatttcccttaaaatcttgctattcca

SEQ ID NO: 8413 - DNA, 245 bp, artificial
  synthetic oligonucleotide
aaaatgaatgcaaagttttagttattttttaacttaataaaaatttagagattttggtaaactttaatgcttaacctccaggggaaaaaaaatcttttacaaatttgtaaatgagctggtttctttgcatatcatgcaaaataatatcttaatcctcatatataataataacagctattaattatcgagtgcttcatctgtaacagggagtagctactgctttacatacatgatcatataatcct

SEQ ID NO: 8414 - DNA, 14092 bp, artificial
  synthetic oligonucleotide
tcaatggatgcagtctgcacctgaagaaaaggatgcataatgttgaatagggcagatccctcagcctaggacaattcctaggaaaggaattagttacaccttgtaactcatgtctagtcaagctagacatgactgcctgagttcttcatggaggatgagggttgtacagtatccatcacatttcccttcatttagatttggccttccttgacttccccacaccagcatcatcaaatggtttatttcactccttccttgccttactctttgcattattatgcctatagcagtgttcagcagaattgcattctctttctctttggttttgaaatattgctttttcttctttttttatatatcctccagaagacttgcttggagggtgaaatatagcttttgttgataattgagttctataggcaagaagaagtagccataacctgggaaccataacagcttagtttttaatatattaatttaacaggttctcttttttatataccttttagacattgtactttcaagtaaactaacttcaaaaagttggcaatatgtatttgaaaatgattttaaaattttgaaatcctgccatttgtgaaaaatagatgaatctggagaacattatgctaaatgaaataagccagacacagaaaaaagatactgtgtcatatcacttatttgtggaatccaaaaaagtcaaactcatagaagctgagagtagaatgttggttgccagaggctgcataggaaggtggattggagatatgttggtaaaagcgtgcaaactttcagttctgaaatgaatacgttctgagggtctaatgtaccatatggttgactatagttaataatactgcgctgtagacttgaaatttgtgaattgagtagaccttaagtgttatcaccacacccaaacaaaatggtaactatatgcagtgatggatgtattaattagctttattgtggtaatcatatcatattggatatgtatgtcaaatcatcgtgtataccttgaatatatataactttatttgtcattatgcctcaggaaacctggaaaaaagcaaataaacaaacagtaacaggatcaggcattaaagaaaaaattttgaaagccaggaaagtaaatagtaaagaagatgagatatacatttaaaaaatacccaattcttgctccaagaactaccacaggaacataccaggaaaactgagagaattcgcagaccctttcaaagaagcagcttgccattgcaaacgctggtgagacagctgaaaaactgagttcccaaagtgtgagaggggaaaaagtcagcctctgaacatccatccctactggggaacctgaaaatccagatcatgggagaaggatttaaccttacctagagctgaaacagatttagggagctgagtgaaatataaaagtagaagaagcagtttgaagagccttgtaggcactcccagtcctcagcttgagccccagggaagccattcctggtcttatctcacagaagtcctgggggaagggatggcagccagcagaattggggaggggccacagggtgaaagaaggtcctagctgaacttctgtaataattttgactgagcacaaactttcctgagaagaatccagggttagggagaggtgaacaggaagtgcagatatgagtgcagaagccacagcagaagttgcaggcaggtggtgaggtgaagcctgaaagccctgcttgctttctcagcaaggaggcttgtggcctggggcaagatcacagccctcctctccagctgcctggatataaactctgctattggtggggcacagtgggagtgagactggccttgcaggctgcatgagagctaggtgaggtctgtcactgccggctttcctccactttcctggtgacctgtatgacacagcagaggcaaccatagtgcccctgggaacataactccattggcctgagaaccctctcacccccaacactcaaagtggccagagcaagctccactcagggagagtctgatctcagacctgcctaccctacagccacctgatgatttttctctacctgccctggtagcctaagacaaaagacataagctattgggagctgtatggccccacccatcaacaaaaaaccctagtactcatcctggccaacatagggcaagattatatcccccttctactactgcagctggtgccctcttgaaagcatcacctgctggctggatgccaaccaagccattacatcaactaataacagaaaaatcctgctccaaagaaggagaaaacaacagctctttttaccacttgcaacaccctggctagtcagagatcctgagtctgtccacatgacaacttgactgctagcataactagcatttgtggaaaccagtgcactaaacaaaactacaaccagggactcccacagagctcacttcaccccctgccacttccactggagcaggtcctagtatctgtggctgggagacctgaagatgaatcacatcccaggactctttgcagacataccccatcaccagcctaaatcccagtagccacactgggtggctagaccaaagaaggcaataacaatcagtgcagtctgactcttaggaagccctatccttagaggaagagggagagaaccacatcaatgaatcaccctatgggacaaaataatctgaacggcagcccttgagttccagaacattccactgaaacagtctacccaaataagaagaaaccagacaagtaattctggtaatatgacaaaacaaggatctataaaaccccaaaagatcacactagctctccagcagtggatccaaaccaagaagaactctctgaattgcagatacagaattcagaaggttgattattaagctactcaaggggcaccagacaaaggtgaaaaacaacttaaagaaatttttagaaaataacaaaatatggatgaaaaagtctccagagtaatagatatcataaagaaaagacaatcacagcttctggaagtgaaagcacacatagagaaatgcaaaatacattggaaactttcaacaataaaataaaacaattagaagaaaaaacttccacactcaaagaaaaggcttttgaattaacccaatccaacaaaagcaaaggaaaaagaattaaaaaatgaacaaagcttccaagaaatttgggattatgttagatgaccaaacataagaataattgttgttcctgaggaaaagagaaatctaaaagtttggaaaacttatttgagagaataatcaagaaaaatcttccctggtcttgctagagatataggcatccaaatataagaaactcaaagagcacccaggaaattcattgcaaaaagatcatcacctaggaacacagtcatcaggttatctaaagtcaagacaaagaaaagaatcttaagagctatgaagcaaaaggatcaggtaacatatgaagaaaaacctgtaagattaactgcagatttctcagcagaaaacctgcaagccagaagggatccaggtcttattgataaactccttaaacaaattatcagtaattttgtatccagtgaaattaagtttcataaatgaaggagagataaagtctttctcagacacacaaatgctaagagaatttgccacaaccaagccagcactaaaagaaatgctagaaagatggctgaataggaacagctctggtctacagctaccagcatgagcgacgcagaagccgggtgatttctgcatttccatctgaggtaccgggttcatctcactagggagtgccagacagtgggcgcaggtcagtgggtgaactcaccatgcatgagccgaagcagggcgaggcattgcctcacttgggaagggcaaggggtcagggagttccccttcctagtcaaagaaaggggtgacagacggcacctggaaaattgggtcactcccacccgaatactgcgcttttccgatgggcttaaaaaacggcgcacagggagattatatcccgcacatggctcggagggtcctatgcccacggagtcttgctgattgctagcacagcagtctgagatcaaactgcaaggcagcagcgaggctgggggaggggcgcctgccattgcccaggcttgcttaggtaaacaaagcagcctggaagctcgaactgggtggagcccaccacagctcaaggaggcctccctgcctctgtaggctccacctctgggggcagggcacaaacaaaaagacagcagtaacctctgcagacttaaatgtccctgtctgacagctttgaagagagcagtggttctcccagcacgcagctggagatctgagaatgggcagactgcctcctcaagtgggtccctgacccctgatccccaagcagcctaactgggagacactcgccagcaggggcagactgacacctcacacggccgggtactccaacagacctgcagctgagagtcctgtctgttagaaagaaaactaacaaacagaaaggaaatccacaccaaaaacccatctgtacatcaccatcatcaaagaccaaaagtagataaaaccacaaagatggggaaaaaacagagcagaaaaactggaaactctaaaaagcagagcgcctctcctcctccaaaggaacgcagttcctcaccagcaacagaacaaagctggacggagaatgattttgacgagctgagagaagaaggcttcagaagatcaaattactccgagctacgggaggacattcaaaccaaaggtaaagaagttgaaaactttgaaaaaaattaagaagaatgtataactagaataaccaatacagagaaatgcttaaaggagctgatggagctgagaaccaaggctggacaactacgtgaagaatgcagaagccccaggagccgatgcgatcaactggaagaaagggtatcagcaatggaagatgaaatgaatgaaatgaagcgagaagggaagtttagagaaaaaagaataaaaagaaatgagcaaagcctccaagaaatatgagactatgtgaaaagaccaaatctacgtctgattggtgtacctgaaagtgacggggagaatggaaccaagttggaaaacactctgcaggatattctccatgagaacttccccaatctcgcaaggcaggccaacattcagattcaggaaatacagagaatgccacagagatactccacgagaagagtaacaccaagacatataattgtcagattcaccaaagttgaaatgaaggaaaaaatgtgaagggcagccagagagaaaggtcgggttaccctcaaagggaagaccatcagactaacagcggatctctcagcagaaactctacaagccagaagagagtgggggccaatattcaacattcttaaagaaaagaattttaaacccagaatttcatatccagccaaacaaacttcataagagacggagaaataaaatcctttacagacaagcaaatgctgagagattttgtcaccaccaggcctgccctaaaagagctcctgaaggaagcactaaacatggaaaggaacaaccaataccagctgctgcaaaatcatgccaaaatgtaaagaccatcgagactaggaagaaactgcatcaactaatgagcaaaataaccagctaacatcataaagacaggatcaaattcacacataacaatattaactttaaatgtaagtggactaaatgctccaattaaaaggcacagactggcaaattggataaagaggcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattactcaatggtaaagggatcgattcaacaagaagagctaactatcctaaatatatatgcacccaatacaggagcacccagattcataaagcaagtcctgagtgacctacaaaaaggcttagactcccacacattaataatgggagactttaacaccccactgtcaacattagacagatcaatgagacagaaagtcaacaaggatacccaggaattgaactcagctctgtaccaagcagacctaagagacatctacagaacactctaccccaaatcaacagaatatacatttttttcagcaccacaccacacctattccaaaattgaccacatacttggaagtaaagctgtcctcagcaaatgtaaaagaacagaaattataacaaactatctctcagaccacattgcaatcaaactggaactcaggattaagaaactcactcaaaaccactcaactacatggaaactgaacaacctgctcctgaatgactactgggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagcaggaaagatccaaaactgacaccttaacatcacaattaaaagaactaggaaagcaagagcaaacacattcaaaagctagcagaaggcaagaaataactaagatcagagcagaactgaaggaaatagagacacaaaaaacccttcaaaaaatcaatgaatccaggagctggttttttgaaaagatcaacaaaattgatagactgctagcaagactaatacagaagaaaagagagaagaatcaaatagatgcaaaaaaaatgataaaggatatatcaccaccaatcccacagaaatacagactaccatcagagaatactataaacacatctatgcaaataaactagaaaaatctagaagaaatggataaattcctggacacatacaccctcccaagactaaaccaggaagaagttgaatccctgaatagagcaataacaggctctgacattgaggcaataatcaatagcttaccaaccaaaaagagtccaggaccagatggattcacagccgaattctaccagaggtagaaggaggaactggtaccattccttctgaaactattccaatcaatagaaaaagagggaatcctccctaactcattttatgaggccagcatcatactgataccaaagccgggcagggacacaaccaataaagagaattttagaccaatatccttgaatatccttgatgaacattgatgcaaaaatcctcaataaaatactggcaaaccgaatccagcagcacatcaaaaagcttatccaccatgatcaagtgggcttcatctctgggatgcaaggctggttcaatatacgcaaatcaataaatgtaatccagcatataaacagaaccaaagaccaaaaccacatgattatctcaatagatgcagaaaaggcctttgacaaaattcaacaacgcttcatcctaaaaactctcaataaattaggtattgctgggatgtatctcaaaataataagagctatctatgacaaactcacagccaatatcatactgaatgggcaaaaactggaagcattccctttgaaaactgccacaagacagggatgccctctctcaccactcctattcaacattgtgttggaagttctggccagggcaatgaggcaggagaaggaaataaagggtattcaattaggaaaagaggaagtcaaattgtccctgtttgcagaagacatgattgtatatctagtaaaccccattgtctgagcccaaaatctccttaagctgataagcaacttcagcaatgtctcgggatacaaaatcaatgtacaaaaatcacaagcattcttatacatcaacagcagagaaacagagagccaaatcatgattgaactcccattcacaattgcttcaaagagaataaaataccgaggaatccaacttacaagggatgtgaaggacctcttcaaggataactacaaaccactgctcaaggaaataaaagaggatacaaacaaatggaagaacattccatgctcatgggtaggaagaatgaatattgtgaaaatggccatactgcccaaggtaatttacagattcaatgccatccccatcaagctaccaatgactttcttcacagaattggaaaaaactactttaaagttcatatggaaccaaaaaggagcccgcattgccaagtcaatcctgagccaaaagaacaaagctggaggtatcgcactacctgacttcaaactatactacaaggctacagtaaccaaaacagtatgatactggtaccaaaaaaaagatatagatcaatggaacagaaccgagccctctgaaataatgctgcatatctacaactatctgatctttgacaaacctgagaaaaacaagcaatggggtaaggattccctatttaataaatggtgctgggaaaactggctagccagatgtagaaagctgaaactggatcccttccttacaccttatacaaaaatcaattcaagatggattaaagacttaaacgtttgacctaaaaccatagaaaccctagaagaaaacctaggcattaccattcaggacataggcatggcaaggacttcatgtctaaaacaccaaaagcaatggcaacaaaagccaaagttgacaaatgggatctaattcaactaaagagcttctgcacagcaaaagaaactaccatcagcgtgaacaggcaacctacaaaatgggagaaaattttctcaacctactcatctgacaaagggctaatattcagaatctacaatgaactcaaacaaatttacaaggaaaaaacaaacaaacccatcaaacagtgagtaaaggacatgaacagatacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgttggagaggatgtggagaaacaggaacacttttacactgttggtgggactgtaaactagttcaaccattgtggaagtcagtgtggggattcctcatggatctagaactagaaataccatttgacccagccatcccattactgggtatatacccaaaggactataaatcatgctgctataaaacacatgcacatgtatgtttattgcggcattattcacaatagcaaagacttggaaccaacccaaatgtccaacaatgatagactggattaagaaaatgtggcacatatacaccatggaatactatgcagccataaaaaatgatgaattcatgtcctttttagggacatggatgaaattggaaatcatccttctcagtaaactatcgcaagaacaaaaaaccaaacactgcatgttctcactcataggtgagaattgaacaatgagaacacatggacacaggaaggggaacatcacactctggggactgttgtggggtggggggaggggggagggatagcattgggagatatacctaatgctagatgacgagttagtgggtgcagcgcactagcatggcacatgtatacatatgtaactaacctgcacattgtgcacatgtaccctaaaagttaaagtataacaataataaaaaaaggaatgttaaaaagaatcctagatcttgaaacgaaaccttgaaatacaccaaaatagaaactccttaaagaataaatctcacagaacctataaaacaataatacaataagaaaaacaaggtatttgggtaacaactagcatgatgaatagagcagtacctcacatttcaatactaacattgaatgcaaatggccctaaatgctctgcttaaaagatgcagaatggcagagtggataaaaatccaccaaccaagtacctgctgtcttcaacagactcacctatcacataaggactcacataaacttaaggtaaagaggtagaaaaagatattccatacaaatagacacccacagcaagcaggagtagctattcttatatcagacaaaacagacattaaagcaacaacagttaaaacagataaagaggggcattatataatgacaaaagaattagaccaacaggaaaatatcacaatcataaatacatatgcacctaacactggagcttccaaatttataaaatatttactaccagacctaagaaatgaaataaatggcaatagtgggaaacttcagtactctactgacagcactagacaggtcatcaagacagaaagtcaacagagaaacaatggacttaaaagaagaaatggacttaacagatatatacagaacattctacccaacaactgcagaatatacattcttttcatcagcacatggaacattctccaagatagaccatatgataggccacaagaagtgactcaagaaatttaagaaaatcaaaattatatcaagtactcttgcagaccacagtggaataaaattagaaatcaacttcaataggaacccttaaaagtatacaaatacatgaaaattaaataatcttctgaatgatcctttggtcaacaacgaaatcaagatggaaattaaaaaatcatttgaactgaacaataatagtgacacagacagtcaaaacctctgggatacagcaaaagcagtgctacaagaaaagttcatagtattaaatgcctacatcaaaaagtctgaaagagcacaaacagacagctaagctcacacttcaatgaactagagaaacaagaacaaatcaaacccaaacccagcagaagaaaagcagtaacaaagatcagagcagaattaaataatattgaaagaaaaaaatacaaaagataaatgaaacaaaaagatggttcttttgaaagataaacaaaagtgatagaccattagcaagattaaccagaaaaaaaggaagaagaccctaataagctgaattagaaataaaatgggagatattacatcccatagcacagaaatacaaaggatctttcaaggttgctgtgaacaactttatgtgcgaaaattagaaaactagagaaggatacattccttgaaatatacaacccccctaaactatgaggaaatataacttttgaatataccaataataagtagcaagattgaaacagtaataaaaaaaattgccaacaacaaaaagtccaggagcagatgcattcacagctgaattctagcaagccttgaaagaagaattggtaccaatcctattataactattccaaaggatagagaaagagggaatcctccctaaatcattttatgaagccatgatcaccctaataccaaaaccaggaaaggatataacaaaaaaagaatactacagaccaatatcctgatgaacatagatgtaaatatccttgacaaaataccagctaaatgaattcaacacgataccacaaagataatacatcatgattaagtgggtttcataccagggatgcagagttggtttaacatatgcaagtcaataaatgagatacactacataaacataagtaaaagcaaaaatcataccatctcgatagatgcagaaaatcatttgacaaaatttagcatccctttatgattaaaactctcagcaaaactggcataaaagggacataccttaaggtaatagaagttatctatgataaatccacagacaacattatattaaatgggggaaaagttgaaagcatttcccttgagaactgaaacaagacaaagatgcctactttcaccacttctattcaacatagtaccagaagtcctagccagagcaatcagacaagtgaaagaaataaagggtatccacattggtaatgagaaaatcaaactattgctgtttggtgatgacatgatcatatatctgaaaaccctgaagactcacccaaaaagctcagagacccgataactgaattcagtaatgcttcaggatacaaaattaatgcactcaaatcagtagcactgctatacaccagcagtgcccaagcagagaatcaaatcaggaactcaaccccttatacaacagctgcaaaaaacaaaaacaaagcccttaggaatatacctaaccaaagaggtaaaatatctgtataagaaaaactacaaaacactgctgaaagaaattattgatgatacaaacaaatggaaacacatcccatgctcatggatggggagcacactgctgaaagcaaactataaattcaatgcaattcccatcaaaatgccaccatcattcttcacagagctagcaacaacaattctaaaatttatatggaacaaagaaagagcccgcataatcaaagcaagactaagcaaaaagaacaaatctggaggtatcacattacttgacttcaaagtatactacaaggctgtagttgccaaaacaacatggtatttgtttaaaaataggcacatagactaatgcagcataatagggaacccagaaataaagccaaatacttaacatcaactcatatttaacaaagcaaacaaaaactaaagtggggaaaggacaccctattcaacaaatggtgctggcataattggcaatccaaaactagaagaatgaaactgaattttcatctctcacctaatacaaaaatcaactcaagatagatcaaaaacttaaatctaagacctgacaccaaaaaattctagaagataacatcagaaaaactcttctaaacattggcctaggcaaaaaatttatgaccaagaacccaaaagcaaatggaacaaaaataaagatagatggaacttaattaaagtaaaaagcttctgcacagaaaaaaaaaaaatcagcagagttaacagacaacccacagagtgggagaaaatcttcacaagctatgcatccaacaaaggactaatatccagaatctccaaggagctcaaacaaatcagcaagaataaaatgaacaactccatcaaaaagtgggctaagaacatgactagacaattcccaaaagaagatatacaaatgtctagcaaacaggaaaaaaaatgctcaacatcactaatgatcagggaaatgcaaatctaaaccacaatgcaataccaccttactcctggaagaatggccataattaaaataaataaataatacatgttggcatggatgtggtgaaaagggaacacttttacactgctgttgggaatgtaaactagtataaccactatggaaaacagtatggagattccctaaagaactaaaagtagatctcccatttgatccagtaatctcactattgggtatctacccagagaaaaagaagtcattatataaaaaagacacttacacaggcatgtttatagcagcacaatttacaattgcaaaaatgtgaaaccagaataaatgcccatcaaccaacgagtggataaagaaaacgtgcatatatatcatggaattgttcctagccatgtaacggaatgaatcaatggcattcacagcaacctagatggagttggagaccattattctaagtgaagtaactcaggaatggaaatccaaacatcatatattctcacttataattgggaactacactatgaggatacaaaggcataagaatgatacaatggactctggggacttgagaggaagggtgggaaggggctgagggatttaagactacacactgggtacagtgtgcactgcttgggtgatggatgcaccaaaatctcagaaatcatacctaaagaatttatccatgtaaccaaacactacctgtttcccaaaaaggaatgaaataataataataaaaagcacaacaacaacataaaagaaaatatacccagtagacattttgagatctaagaaataaggtaagatagacatatgcaaggtgatacaaataatcatttggaataaatgtgaatcaacagtatttgttcagaacattggctatccttttagttaatagatttttgttcataagaaatttaaaattacagtgcagtggcttgagcatcaccaaagtcaacttcaattaagggattctgggagcttagtgcaaaaagatactgccaaa

SEQ ID NO: 8415 - DNA, 1649 bp, artificial
  synthetic oligonucleotide
ggcttagctacctgtgggaacccacgtagcaagggtgactcaaagggttaacaagcagtggcgccgcagagtggcggggagtgcagccaatagggtgtctaggcaggcagtacgtctggtgtgggcgggagtgagccaaagtgtgctaaaggaaaccaacagcggcctaggggtgaaaggacagccagggttagatgttctgaggaggcgggagcaaccgagagagcacgtgagcatctgtcctttctacccgttcctctttatctttagtgttcagtagcagcggggatagcccggggcccggtgtatggccacggagttacagtgtccggactccatgccctgtcacaaccagcaagtaaactctgcctcaaccccaagtcccgagcagctgcgacctggcgatctgatcctggaccacgcagggggaaacagagcctccagggccaaggtgattctcctcacggggtacgcccattctagcctgccggccgagctggactctggggcctgcggcggctccagcctcaactcagagggcaacagtggtagtggtgacagtagcagctatgacgcaccagctggcaactccttcctagaggactgcgaactctcccggcagatcggggcgcagcttaagctgctgcctatgaatgatcagatacgggagctacagaccatcatccgtgacaagtaagccaagagcggaaggggaaagggaagtggagggtcttgcaggctgtgggcggggattggaagtaaaagggctaagagacagtgttcttggccttggcaaactttggagattggggtaagaccttttatttggtgtgtgtgtgtgtgtgtgtgtgtgtgtgtgtgtgtgtgtgtcgtgtaactcgaacgccaaccttctctttccaagttccggtgtctaacatcactttgggtggggaggaagactttaggtagcctctgggctctttgtctctcccaggaaagacaactccttggccattccaggcaggtaaactcccctatactatgtgggcagtgcttgtccacatggtaaacctataacccagaaatggttactatccaaggttatgcactaccaccaatcacctcaggttcataaatagaaataaagcaatttcaaggaaattctattcaggccctgaccctttagtatttgctactgcaaacaaggtcttttagtcttggagttcaggtttacttgatcacatgaaagcttatcgtccaactcttatcatttttcactgtaaactcacagaacatagttaatggatcaaagggagcctaaaggagcctttggcccttcctaatcccacaaaccaatgtagccagaacttcatgttaaaatgtaattttgaaatttctaaacctacgttgtaaatgggttttctccagggaaatatgtaccatgatgaactacagctattttctttattggcagcactttaaatgagcagcatatcaaaacaccccttttttagtggcaggggttggggggacatgccttgatcttttaaaaatggctactgaatgacagatgccactccctaaaccagactctagaaaccttgtcttacactattgtaataatactgtttctctgcttgcagtttttcctctcttccacatgcacc

SEQ ID NO: 8416 - DNA, 8778 bp, artificial
  synthetic oligonucleotide
tcttgttttgatatagtatggaaagacccaccacaatttttagtaatgtattgctgcttatttaggctggggacattgtttttagttttgtttttgttaaccaaattagaggctttatattccctttatctttaaaaaattgtcatcctctctcacaagacctgttttagcccctctaggaggctggtttaaggtgcctatggtaagaggagctatatttacataggtctagttatggaaggtgccatcagttatcataccctgttctctttggggcttattctcttctctattttgatgtgacagcataaatgtgcactgtggaactgtccgataatagaagccactggagtacatattttttcttttattgtttctggtccttagcatctatatagtgaagggattgctttgtgaattgactttggtatggggaaatcgggattgagccagcaggactgcatgttgttgtatatatgtgaaacaggcaagattgagaacattgtctgtattgatttaaaatgtctttttagattttgaaatgtgcaatatttgaaacataatatgttggttgtattattgaatttcaaggaaataaatttctctctttgaaagtgcagtaaacactgagtagattatttgctcagccatacgtatgtgggttgctggtgaacttgggataagaaaaaatttcttcatttatgtcgttttgttgttgttgcaatggattaaaccacacatccttctcttctgcctcctttatatactaaactcagcaaaatctgagtaatgtgcttttcctgtgaatatagttcatgacctcatatttaaaggcaatgcagtgtatttaaaagatcatcctccctgtccagttttttgttttttattttttgtttcctgaaacattaaagctgttgtgtgagctgttgaatgcttcctgtgtatttgtcctaggtggggctttggcatggcctcagcaagctgcttgtttaaaagtttagcaatgttagagtatgtcagtatgtgacataggacaaaaaaaggagcacattcagccttgtgactctctttagtcacctggaggggagaaaattatccttagggtgaatgaacatcctgtgtaaccctaatgtgagtgcaatctaatgtgatttgagttatgtgactaagtaatgtattgtccttaaccaaagctgtgtgcatcagaattgcctgtggagtctctctctctttttttaaaatacaagttcctgactcccatccttagcagttgtttgtatagtcttgagtaaaacctgaccacaggtaattgtgctgtgtttagactgggccattgcccctgggagaatggccagtctcccttgtgtgctgatttgctagcctgctgattcgggctatagatatggtgatccagggattccacacactaaacagaactaggctagagagcctgacctagcattacatcaacactggaggaatctcccaacatttccttccagcttgcacaaaaccaaaatgcccaccgcagaaaaaaactgtgacgtgcaaattgtttaaaacatggacatattttcggtttttgtgtgtttcccgtgtgagtcctctgacttttagagcaggaaggaggaagtcaccactaagctatacggacctctgttataacatttactgggcatatcctggtatacctaactagactggactccaaggaggcagaaagggggtctgacctggcacagtccctgacacaaaggataattaatgtagcaattgtaatcagataaaatgatagtttcccttgtttttctgtcccatttttttgcaataatttcaacatttgttttatttttttaaagctttcaggtttcacttatttatttttttccataagttattggggtacaggtggtatttgattacatgagtaagttctttagtggtgatttatgagattttggtgcacccatcacccaagcagtatacactgcatcatatttgtagtcttttatcccttgaccccctcccaccctttcctcccaagttgctaaagtccattatattattcttatatctttgcatcctcatagcttagctgccacatactagtgagaacatatgatgtttagttttccattcatgagttacatcacttagaatagtaatctctaatctcatccaggtcactgcaaatgctgttaattcatttttttaatggctgactagtattccatcatatatatatatttgatatgtattccatcatatatatatatttgttggccatttgtatatcttcttttgagaattgtctattcatgtccttagcccactttttgatgggattgtttgtttttttttttcttgctgatttgtttgagttcctcgtagattctggatattagtcctttgtcagatgtatagattgtgaagattttctcccactatatgggttgtctgtttactctgctgactgtttcttttgctgtgcaaaagctctttagtttaattaagtcccagctatttatctttgtttttattgcatttgcttttgtgttcctggtcatgaaatctttggctaagccaatgtatgtaagccaaagttatcttctagaatttttatagtttcaggtcttagatttcagcccttaatccatcttgagttgatttttgtataaggtgagagatgaggatccagtttcattctcctacatgtggttagccaattatcccagcaacattagttgaaaagggtgtcctttccccacttcatatttttgtttgctttgtcgaagatcagttggctataagtatttgggtttatttctgagttctctgttctgttccattggtctttgtgcctatttttgtaccagtgccatgctgttttgatgactgtggccttatagtatagtttgaaatcaggtagtgtgacacttccaggtttgttctttctgcttagtcttgctttggctgtgtggggtcttttgtggttccatatgaattttagaattgttttttctaattctgtgaagaatgatggtggtattttgatgggaattgcattgaatttgtagattgcttttggcagtatgatcattttcacaatattgactctacccatccatgagcatgggatgtgtttccattcatttgtgtcatctattatttctttcagcagtgttttgaagttttacttgtagaggtctttcaactccttaggtaaattcctaaggattttattttttttggcagctattgtagagggttgagttcttgatttgattctcagcttgggtactgtttgtgtatagaagagctactgatttgtgtacattaatcttgtatccagaaactgctgaattcttttatcagttctaggagctttctggaggagcctttagggttttcaaggtaaaagatcatatcctcagcaaacagtgacagtctgacttccactttatcaatttggatgccccttatttctttctcttgtctgattgctctggctaggacctccagtactatgttgaagaggaatggtgagggtggcatccttgtcttgttccagttcttagagtgaatgctttgaacttttccccatttagtattatgttgtctgtgggtttgtcatagatggcttttattacattaagttgtgtcctttctatgctgattttgctgagagttttaatcatggaggtatgctgcattttgttgaatgctttttctgcatctattgagatgatcctgtgatgtttgtttttaattctgtttatgtggtgtgtcacatttattgacttgcatacattaaaccatccctgcatccctgatatgaaacccacttgatcatggtggattatctttttgatgtgctgttggaattggttagctagtattttgttaaggattttagcatctatgttcatcaaggatatcagtctgtagttttcttttttggtcatatccttccctggttttgctatcagggtgatgctggcttcatagaatgaattagggagcattccctctttctctgtcttgtggaatagtgtcaaaaggaatgttttcaattcttctttgaatgtctcatagaagtcttctgtgaatctatctgatcctggactttttttttgttggtaatttttaaattaccatttcagtcttgctggttgttattggtctgttcagggtatcaaatttttcctgatttaagcaaggagggttgtatttttttcaggaatttatccatctcttctgggttttctagtttatgtgtgtaagggtgttcatagtagccttgaatgatcttttgtatttctctggtgtcagttgtaatatctcctgtttcatttcttagtgaggtcatttggattttctctcttcttggttaatcttgctaatagtctattaatttaatttatcttttcaaagaaccagctttttgtttcatttatcttatatttttttttttgcttcaatttcacttagttctgctctgatcttggttatttcctttcttctgctggatttgggtttggtttgttcttgtttctctagttccttgaggtgtgaccttagaatgtcagtttgtgttctttcagtctttttgatgtaggtgtttagggctgtgaacttccctcttagcactgcctttgctgtatgccagaggttttgggaggttgtgtcattatttgggaggtatgtgtcattcagtttgaagaatttttaaatttccatcttgattttgtttttgacccagtgatcattcaggaacaggttatttaatttcatgtatttgcatgattttgaaggttacttttggagttgatttccagttttattccactgcggtctgagagagtgcttgatataatttcagttttcttaaatttattcaggcttgttttatggcctatcatatggtatgtcttggagaaagttccatgcactgttgaatagaatatgtattctgcagttgttggacgaaatgttctgtatgtatctgttaagtcaatttgttccgaggtatagtttaaatccattgtttctttgttgaccttctgtcttgatgacctgtctagtgctgtcagtggagtactgaagtcccccactgttattgtgttgttgtctaactcatttcttaggtctgttagtaattgttttataaatttgggaggtcctatgttaggtgcatatatgtttaagattgtgatagttttccattggacaaggcttttcaccattatataatgtccctctttgtctttgttaactgctgttgctttcaagtttgtttcttctgatataacaacagctactccagctcggttttggtgtccatttgcatgaagtgtctctttccacttctttaccttacgtttgtgtgagtcctcatgtgttaggtgagtctcctgaaggcagcagataattggttggtgagttcttatccattctgcggttttgtatcttttaagtggagcatttaggccatttacattcaatgttagtattgaaatgtgaggttctgttgcattgattgtgctctttgttgtctatgtactgtttttttttgtttttagttttggccttttacctgtatttttgttatataggtcctgcatgatttatgctttaaagagtttctgttttgatgtgtttccaggatttgtttcaagaattagagctccttttagtggtttttgtagtggtggcttgataatggtgaattctcttagcctttgtctgaaaaaggctatatttttccttcatgtatgatgcttagttttgctgcacacaaaattcttggctgattttttgtttgtttgtttgtttgtttgaggaggctgaagatagatagctcatagcttgtagggtttctgctgacaaatctgctgttaatctgataggttttcataggttatctggtgtttttgtctcacagctcttaagattctttccttcatcttaactttggatagcccgacgaaaatgtgcctaggctatgacctttttgtgatgaattttccaggcattctttgtgcttctcatatttggatgtctatgtctctatcaaggctggggaaattttcctcaattattcccccaaatgtgttttccaagcttttagaattctcttcttcctcaggaacacggattattcctaggtttagttgtttaacataatcctagaattcttggaggctttgttcatattttcttattcttttttctttgtctttgttggattgggttaattcaaataccttgtcttcaagctgtcaatttctgtcttctacttgttcaattcggttgctgagactgtccagaacatttcccatatctaaaagtatgtccaaagtttcctaaatttttgattgttttttctttgagctatctgtttccttgaatatttctccattcagttcttgtatcgtttttggatttccttgcattgggctttgcctttctctggtgcctccctgattagcttaataactaacctcctgaattcctcttcaggtaaatcagggatttcttcttggtttggatccattgctggtgaactagtgtgatttttgggggctgttaaagagccttgttatgtaatattaccagggtttgttttctgtttcattctcatttgggtatgctctgtcagagggaagatctagggccaaaggctgttgttcagattcttttgtcccacggggtgtttccttgatgtagtactctcctccgtttcctatggatgtggcttcctgtgagctgaactgctgtgattgttgtctctcttctggatccagctacccagagagtctgttcagctctgggctggtactgggtgttgtctgcatggagttctgtgatgtgaaccgcctatgggtctgtcagccatggataccagtgcctgttccagtggaggtggcaggggggggtgcagtggactccattatggtttttagctttggtggtttaatgttctatttttttgctggttggcctcctgccaggaggtggcactttccagagagcatcacctgtagtagtatggagagggactggtggtgggtggggccctagaaatcctaagattatatgccctttgtcttctgctaccagggtgagtagggaaggaacattaggtgggggcagggctaggtgtgtctgagctcaggctgtccttgggccggtcttgctgtggctgccgtaggggatggggtcgagatgcccaggtcactggagttgtgtacctaggaggattatggctgcctctgctgagttctgcaggttgtcagggaagtgggggaaagccaggagtcacaggcctcacccagctcccatgtaaaccgaagtgctggtctcactcccaccatgccccctccaacagccccaagtctgtttccaggcagtgggcacgactggcttgaaaaattgcccagactacctgcctccaagttgagaaagaaaaacttctttccctgcctgtggagtctgcacactggatttgtgccctccccctagttctggccaggaggcttcttgccccattgaaattgttaaaaaggtcagctagagatttccttctccctgtggagatttaccccctgctcctctggcctccctcctgatggatccctgttttgtcaggcaggaatgggctgcttggggacccagcaagcttccagggcctttctgctgctttctctacccctgtatttcactcggctctctaaattgactcagctccaggtaaggtcatacatttctcccacaaacagaccttcagattcttcagtgggggtgtgtgtttgggaggggagggtctccctttctcacttccacagttggggcactcacagtatttggggtatctcccaggtcctgcaggagcaatctgcttccttaagagggtctgtgggtcctctcctctgtcctattttgaatgttcacattgaatgcagctttgaggtgcaggtaaatagttattgacactctgtgagtttattaagaaggcgctaaagtgctgtggccttgatgccttgcacctggcaaaaaaaaaaaatagtaacataatattattttttttaaactttttgcttttggttaaatttgctccaaattcttcactgggggtttgtttttgtgaaggtaaaggaaggagaaggaaaaccattcataaatcatctgtatactacgacaaactttgggactatattttagtgatcacataataataaagtagttatggatgtaaagctcatgttttcactaaacattaaatgaaacattcctttggttaaaacctgccggaaaagctttttttgttgtactttcctttaacttgttgctcaaaaccaaaaaaagcacattagagctgagtttgagtccatttaattcttcctcctcaacttagattgcctggcaaagtacaggatgctcagttaaatctgaattcaaataaacaatgaataattttttatgttaagtatgtcctaaatatttcatgggatttctgaaatacaaatttacttggggggggggtgggtcctgattttgatttacttaatctggcaaacctatgcccaactacaacacccaacctgcccctcgccccatatgctacaaacaaactttgtatataatcctcccagagagagtgatatatttaaatttttgaaatgacaattaattcagtgctactagcattttatttaaattaagttgtttttaggtgataagtcacaagattttgctttagtcattgttggaaagggt

SEQ ID NO: 8417 - DNA, 435 bp, artificial
  synthetic oligonucleotide
caacctcaaatgagttcaggcactctccctttctctccttttctactatcttccctatctttcttgttaacagtgttaacaaagatgatagcctatggcagtgacaattattatgaagaagtagaattaaaatgtagattgtgcaacacgagagagactccatattatatacagttttcaatttagaaactgggactgtagtgtctacaccccttgtaaatagccacatagacgcaaactggtttctgattactttggctgaactgaggttgtccaaaacttacaggtgaataaagagtagaaaccttataagttcatgacaaatgaaagtatttaaaaataatgttcagtaataggtgcaccaggtggttctgttaagatagtcagagtgaagcaatggtagaaatgcatgtctgaagttgtttcttggttatt

SEQ ID NO: 8418 - DNA, 758 bp, artificial
  synthetic oligonucleotide
tcaaaattgaatttgctggttcaaggcagggtccagtactaacttcttccagtggtaatatttactcacctggaaccaataggtattaaccagaacttcttcttatctccaaacacctgctggatattcttgatgaagccaaggttgaacccatttttctctgggccacttgtaaacactggagtgcagaaggcctctaaggcagggcaggagagttgaagaaaagaggaagaaagcaataaagaaacaaatttcagcatagtcatgattttacatttctccatgtatgtgacttggttctattatatctttttgctgtggtagcacagacctctcatttttaggtattgctaaattgcttagtaaaaaccagtttaatcacttcacacaaactaaacttgttactgcatataaagaattagaactctctttttaaaagacaggggaaacacatggtggcagaaataattaagcagccacgggggtagtatgtattttgtactgctgaatttagaatataggaacagatttaacagcactttatttgaatctaagcggcaacaacagccgaatgaccaccatctttagagctgggaagaaagtaatgacacataaagagatggtaatgacattgatttggttttgaaacatttcaaaaatgaaagtgttcatgctgaagcctgcagtgtaagaaactgagttttacttcagctaaaatgtcaattggtgagccataatcacttcaaagactgtaagga

SEQ ID NO: 8419 - DNA, 12888 bp, artificial
  synthetic oligonucleotide
ctaaaatgatgaataatttgaactaatataatcatttcatctaaagtgtacattaagcacatattactgattcaacacaatagacagttaattcagcagagatttgtgtttacttccactaatggaagtatgtgagtgactaaagtcgtgggtataattgagtcaaagaggaagggagaagaacatgcatatctgggtccttttgcatattttaaaatatactgtcaatgctcctatcctcatttaagccacattgtctcttagctagttgactgcaatatctgtgtaatttatcactctgctttcatacttgcccctcaaaagacctactatacagagtagctgggtgatctgtcaaaatctacatcagatctggtgtagtggctcatgtctataatcccagcactttgagagactgaggcacaactatcgcttgagaccaagagttccagaccagcctggacaacatagtgagaccctgtctctataaaaaaataaaataaaataaattagccaggcatggtggtgtgcacttgtggcctcagctacttgggaggccgaggcgggaggattgctagagcccaggagttcgaggctgctgtgatccatgaatgaaccactgtactccagcctgggcgatagagcaagatcctgtttctaaaaataaaaaaaaaaatgtaaatcagatcatatcactctccacttaaaactctcaatggatttccaacaccttcagaataaaatccaaactccttaccatggcctgtatcatctagcctctgcctatctcttcaaatgaatcttgtaaaactctcctcatactatgttccagtgaaactggctgcctatctgctcttgtaatcaagcttgctcctgtttcaaggctttttgtgcttgcagttccttttgcctgggatgatcatccctctgctccttttggtatgatggttaattttactttttttatttcaataggtttttggggaacaggtggtgtttggttacatggataagttgtttagtggtgatttctgagattttggtgcacccaccatctaagccgtaaacactgtacccagcatgtagtctgttaacccttgccaccccctacccttccccctgagtccccagagtacactatatcattcttaggcttttgcatcctcatagcttagctctcactcataattgaaaacatatgatattaggttttccactcctgagttactttacatagaataatggtctccaactccatccaggttgctgagaatgccatgattttgttccctttttatggccaagtagtgtatattttttatggctgagtagtgtgtgtgtgtgtgtgtgtgtgtgtgtgtgtgtgtgtgtgtatatatatatatatatatatgtaacattttctttattcactcattggtttgggctggttccatatttttgtaatttgtaattgcaaactgtgttgcgatgaacatgcctgtgcaagtgtctttttcatataatgacttcttttgctctgggtaaatacccaggagtgggattgttggatcaaatgacagatctacgttagttctttaaggaatctccatactgttttccatagtggttgtagtagttcatattcccaccaggagtgtaaaagcgttcccttttcaccacatcaaagccaacgtttattatgctttgatttttaaattacggccattcttgcaggaataaggtggtattgcattgtggttttgacttgcatttccctgaaaattagtgatgttgagaatattttcacgtttgttggccatttgtatatcttcttttgagaattgtttattcaggtccttagcccactttttgatgggattgtttttttcttgctgatttgtttgggttccttgtagattctggatattcgtcccttgtcacatgcatagtttgtggataatttttcccagcctttgggttgtctgtttactctgctatttcttttcctatgcagaagctttctagtttaattaagtcccatcaatttatctttgttggtgttgcatttgcctttgggttcttggtcatgaactatttgcataggccaatatctagcaaagtttttccaatgttatcttctataatgtttatggtttcaggtcttagatttaagtcttcgatccaacttgagttcagtagatttttgtatatggtgataaatgaggatccagtttcattcttctacatgtggcttgccaattatcccagcatcatttgttgaatagggtgtctttccccactttatgtttttgtttgctttgtcaaaaatcagttagctgtaagtatttgggcttatttctgggttcctattctgttccattggtctatgcacctatttttatacctgtaccatgctgctttggtgactatagccttgtagtatagtttgaagtcaggtaacgtgatgcctccagatttgttctttttgcttactcttgctttgcctaatgcgggcttttatagtttcacatgaattttagaattgttttttccagtgctgtgaagaatgatggtggtagtttgatgggaattgcattgaatgtgtatattgcttttggcagcatggtcattttcacaatattgattatacccattcatgggcatgggatgtgtttccatttgtttacgttgtctatgatttctttcagcagtgttttgtagttttccttgtagaggtctttcatgtccttggttaggtatatttctaagttttgtttgtttgtttgttttctgctatagtaaaagtagtggagttcttgatttgattctcagcttggttgctgttggtgtatagcactgctactgatttgtatacattaattttgtaacgtgaaattttattgaattcattgatcagatccaggagctttttggaagagtctttagggttttctaggtatatgatcacattatcagcaaacagtgactgtttgacttcctctttattcatttggatgtcctttatttctttctcttgtctgatcactctggctaggacttccagtactatgttgaatagaaatggtgaaagtgggcatctttgtcttgttccagttctcaggaacaatgctttcaacttttccccattcagtataatttagctgtgggtttgtcatagatggcttttattaccttaacatatttcccttctatgctgattttgctgaggattttaatcataaagggatgctggattttgtcaaatgttttttctgcgtctattgagatgatcatgtgatttttgtttttacttatgtttatgtggtgtaccacatttattgacttgcctgtgttaaaccaaccctgaatccatggtatgaaacccacatgatgatgatggattatgtttttgatatgctgttgaattcggttagctagtattttgttgaggatttctgcatctatattcattaggaatattggtctgcagttttcttttttagctatgttctttcctggtttttggtactagggtaatattggcttcatagaataatttaggaaggattccctctttctctgtcttttggaatagtttcagtaggagtggtaccaattcttctttgagtgtctgatagaattcagctgtgaatccatctggccctggacttttttttgttggcaatttttttattaccattttaatcttgctgcttgttactggcctcttcagagttcccatttctttctggtttaatctagcacagttgtatatttgcaggaatttatccatctcctctaaattttctagtttgtgcccacgaatgtgtccttagttgccttgaatgatcttttgtatttctgttatcggctgtaatatctccctttttgtttcaaattgagcttatttggatcttcactcttcttggtttatctcactaattgtctatcaattttatcttttcgaagaacaagcttttcgtttcatttatcttttgtattcttattttttgtttcaatttcatttagttctgctctgatttttgttatttcttttcttctgctgggtttgggtttggtttgttcttgtttctttagttccttgaggtgtaagcttagattgtccatttgtgctctttcagactttttgatgtaggcacttaatgctatgaactttcctcttagcactgttttgctgtatcccagaggttttgataggttgtgttactattatcattcagttcaaagaatttttaaaacttccatcttgatttcattgttgactcaacaatcattcatgagtagtttatttaaattctatgtattcacatggttttgaaggttcctactaaaggtgatttccaattgtattccactgtggtctgagaaagtacttgaaataattttgattttcttagatttactgaaacttgttttgtggcctatcatatggtctatcttgaataatgttccatgtgctaatgaatagaatgtatattctgcagtagttgggtagaatgttctgtaaatatctgttttgttttgtttgttttattttttgtttattttgttttgttttgttttgtctttttgagacggagtctcgctctgtcgcccaggctggagtgcagtggcgtgatctcggctcactgcaagctctgcctcctgggttcacgccattctcctgcctcagcctcccgagtagctgggactacaggcacccaccaccatgcccggctaattttttgtgtttttagtagagatggggtttcaccgtgttagccaggatggtcttgatcgccttacctcgtgatccgcccgccccggccacccaaagtgctgggattacaggcctgagccaccgcgccaagcccctgtaaatatctgttaagtctatttgttctagtgtgtagtttaagtctactgtttctttgttgtttctttgttgactttcttttttttgttttttttttttaaatttatttattattattatactttaagttttagggtacatgtgcacaatgtgcaggttagttacatatgtatacatgtgccatgctggtgtgctgcacccactaactcgtcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaaggatatgaactcatcattttttatggctgcatagtattccatggtgtatatgtgccacattttcttaatccagtctatcattgttggacatttgggttggttccaagtctttgctattgtgaataatgccacaataaacatacgtgtgcatgtgtctttaaagcagcatgatttacagtcctttgggtatatacccagtaatgggatggctgggtcaaatggtatttctagttctagatctctgaggaatcaccacactgacttccatactcatctgacaaagggctaatatccagaatctacaaagaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaatgcaaatcacaaccacaatgagataccatctcacacctgttagaatggcaatcattaaaaagtcaggaaacaacaagtgctggagaggatgtggagaaataggaacacttttacactgttggtgggactgtaaactagttcaaccattgtggaagtcagtgtgactttctgtcttgatggcctgtctcgtgctgtcagtggagtagtgaagtcccccgctattattgtgttgccatctatttcatttctcaagtctaatagtaattgttttataaatttgtgggctccagtattaggtgcatatatatttaggattgtgatattttcctgtttaactgtccttttatcattatataatgtccctctttgtctttttaaactgttgttgctttaaagtctgtttttttttctaagaatagctaaccctgcatatttttagtgtccatttgcattgaataccttttttcactcctgtaccttaagtttatgtcagtccttttatgttaggtgcgttgaagacagcagatacttggttggtaaacttttattcattctgccattctgtatcttttaagtggaggatttaggccgtttacattcaacattaatattgagatgtgaggtatcattctattcatcatgctagttgttgcatcaatgccttttttacattgtgtttttgttttataacccctgtgagatttatgctttaaggaagttctattttgctgtattttgaggttttgtttcaagatattgaactccttttaacatttcttgtagctctgccttggtaatggtaaattatctcagcatttttttgtctaaaaaatattttatctttccttcatttatgaagttttctttcgctggatacaaaattcttggctggtaattattttcttaaagaggcaaaatataggacccaaatcccttctagtttgcagggtttctgctgacaaatctgctgttagtctgatagctttcccttcataggttacctgatgcttttgcctcacagctcttaagattttctcctttgtcttgactttagatactctgatgactgtgtgcctacctgatgattttttgctatgaatttcctgggtgttctttgagcttctgtatttggatgtctatatctctagcaaggccagggacattttcctcggtttttcccccaaataagttttccaaacacttagatctctcttcttcctcaggaacaccaattactcttaggtttcagaataacataatcatttaacataatcacaaaacttcttggagcctttgttcatttttttgaatcttttttctttgtctttgtcagattgggttaattcaaaagccttttctttaagctctgatgttctttcttctacttcttcaattatattgttgtaactttccagtttcttttgcatttgtctaagtgtgtttcatttccagaagctgtggatgttttttatttatgctgtatatttctctggagatattttaatccatatcctataatatttttaaaatttctttaaattatttttcatctttctctgatccctccttgaacagcttaataattgactttctaaattcttttctgggcaattcacaggattcttcttggtttagatccattgcttgtgacctaatgtggtctttgggggatgtcaaagaaccttgctttataatattatcagaattgtttttcttgttccttctcatttgggtagactatgtcagaggaacgttctgtggctcaagggctgctgttcagattcttttcttccactgggtgatcccttgatgtggtgttctccccatttttctaaggatggggtttcctgggagccagactgcagtgattgttatttactcttctgggtctagccacccagcagagctaccggactctgtgctggtactggggagtgtctgcaaagagtcctgtgatttgatccatcttcagttctctcagtcatggataccagcacctgctccagtggaggtagcaggggagttgaagtggattctgtgaggatccttgactgtagatttttttatggccctggttttctcaaatgctgtttgtgctaacagtgaagctatcacgtggacaaactcaggacctctggttagccaggatgtcccaggcagtggaattagctgttgttttctcctttcttggagcagggttgttctttttttcttttttcttttccttttttttttgagatggagatggagtcttgctctgttgcccaggctggagtgcagtggcacgatctcggctcaatgcaagctccgccttccgggttcatgccattctctcgccttagcctcctgagtagctgggactacaggcgcccaccaccatgcccagctaattttttgtatttttagtagagacagggtttcaccgtgttagccaggatggtctcgatctcctgacctcgtgatctgcctgccccggcctcccgaagtgctgggattacaggcgtgagccaccgtgcccaaccacgttcttttatgtgttgttgtaatggcttgagttggttggcctccagccaggaggtggggctttcaagagagcatcagctgtggtagtatagcggggattcaatctttccctagggtcacctggataagtattctggtttctcaggcaatgggcagggacatagaactcccaagagatttcatcttcagctaccagggcatgtagagaaaggccatcagggcaggttaggcatgtctgagctcagactctccttgtgtggggcttgctatggttgctgtgggaaataggggtgttgttctcaggttaatggagttatgttcccaggaggattatggctgcctctgctacatcatataggtcaccagggaagtggagaaaagccagcagtgacaggcctcacccaactcccatgcagccagcaaggccagtcacactctccccgtacccaccaacagcacctagtttatatccaggaagccggtttgcagggctgacatcttgccttgctacaagcatccccatggagaaagcaagcagggctttcaggccctgcccctccctgcctgccacagcttctgtgctcgtatctatacttcccattcatctccctggattctgcccaagaaaattcatgctcagttgaaattattacaaagctcagctgtgagtttccttctctctgtggctgttccccaaggaacccttgaaatagagagccctagtgaaaaggaaatggctagtctgggcttccctgaagaccgtgagtgcctacagggttcttcccactgcttcctctacttttatatttctctcggctctccaaatttgtttccgctctaaggaaggtgaaatccttttcccacaatcagaatttttagattccccagtggggatgcatgttcagaagtggactttccccctctcaacactttgggcactcacaggtttttggctgtctcatggagtttgcagtggcaagatgcttctttcaaaggatctgtgaattctttccgctttcctggtatgttcctgtggtagttctttttttttttttttttcctgagacagagtctcgctctgtcgcccaggctggagtacagtggcgtgatctcctctcactgcaagctccgcctcctgggttcacgccattctcctgccttagccccccgagtagctgggattacaggcacccgccactgcgcacggctaattttttgtatttttagtagagatggggtttcaccatgttagccaggatggtctcgatctcctgatctcgtgatccacccacctcagcctcccaaagtgctggaattacaggcatgagccaccacacccggccaccctgtggtagttcttagatcaaaagttcatggtgtgagtctccacatgttgctttgtccatccaagtgggagcggcaagttagtcctgcctcctatatgccgtatttttgtctggttttaattctgatggttaattttatgtgtgaacttgactgagtcatacggtgcccagatatttgattaaacattctttctaagtgtctttgtgagagtttttctgggtgagattagcatttgaatcagtagactgagtaaagcagattgtcttccccagtgggggtgggcttcaaccaagcctttgaggaccaaaactggcacaagacagggatgccctctctcaccactcctattcaacatagtgttggaagttctggccagggtaatcaggcaggagaaggaaataaagggtattcaattaggaaaagaggaagtcaaattgtccgtgtttgcagatgacatgattgtatatctagaaaaccccattgtttcagcccaaaatctccttaagctgatatgcaacctcagcaaagtctcaggatacaaaatcaatgtgcaaaaatcacaagcattctaatacaccaataacagacagagagccaaatcatgagtgaactcccattcacagttgcttcaaagagaataaaatacgtaggaatccaacttacaagggatgtgaaggaccttttcaaggagaactacaaactactgctcaatgaaataaaagaggatacaaacaaatgaagaacattccatgctcatggatagaaaaaatcaatattgggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcacggtggcgggcgcctgtagtcccagctactcgggaggctgaggcaggagaatggcgtgaacccaggaggcggagcttgcagtgagccgagagcccgccactgcactccagcctgggcgacagagcgagactccgtctcaaaaaaaaaaaaaaaaaagaaaaaatcaatattgagaaaatggccatactgcccaaggtaatttatagattcaatgccatccccatcaagctaccaatgactttcttcacagaattggaaaaaatactttaaagttcatatggaaccaaaaaagaccctgcattgccaagtcaatcctaagccaaaagaacaaagctggaggcatcatgctacctgacttcaaactctactacaaggctacagtaaccaaaacagcatgctactgttttggtaccaaaacagagttatagaccaatggaacagaacagagccctcagaaataatgccacacatctacaactatctgatctttgacaaacctgaaaaaaagaagaaatggggaaagcattccctatttaacaaacggtgttgggaaaactggctagccatatgtagaaagctgaaactggatcccttccttacaacttatacaaaaattaattcaagatggattaaagacttaaaggttagacctaaaaccataaaaaccctacaagaaaacctaggcaataacattcaggacataggcatggtcaaagacctcatgtctaaaacaccaaaagcaatggcacaaaagccaaaattgacaaatgggatctaattaaactaaagagcttctgcacagcaaaagaaactatcgtcagagtgaacaggcaacttacagaatgggagaaaatctttgcaatctacccatctgacaaagggctaatatccagaatctacaaagaactcaaaccaatttacaaggaaaaaacaaacaaccccatcaaaaagtgggcgaaggatatgaatagacacttctcaaaagaagacatttatgcagccaagacacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtgaaagtcagtgtggcaattcctcagggatctagaactagaaatgccatttgacccagccatcccattactgggtatatacccaagggattataaaacatgttgctataaagacacatgcacacgtatgtttattgcggcactattcacaatagcaaagacttggaactaacccaaatgtccaacaatgatagactggattaagaaaatgtggcacatatacaccatggaatactatgcagccataaaaaaggatgagttcatgtcctttgtagggacatggatgaagcttgaagccatcattctcagcaaactatcacaaggacaagaaaccaaacaccgcatgttctcactcataggtgggaattgaatagtgagaacacttggacacaggaaggggaacatcacacaccagggcctgtcgtggggtggggggaggggggagggatagcattaggagatatacctaatgtaaatggcgagttaatgggtgcagcacaccaacatggcacatgtatacatatgtagcaaacctgcacgttatgcacatgtaccgtacaacttaaagtataataaaaaaagaaaaaagcaacactgtatatatatatatatatatatatatatatatatatatatatatatatacacacacacacacacacacacacaaatttatgtagaatggtatttattaaaataccatgtgtactactgcagactggaaatggtaatgtttaaataaattactgtatatccgttataaaaaaaaattcagaggaagggagaatttgttctctctgcctgactgcatgagataaaacatcagtctgtcagactgggacttacgtgatcagggttcctggttctcagaactttagactcaaactggaacttacactattggctctcaggttctcaggaggcctttggacttggagtagaaattataccattgtttctcctagtgcttatactttgggctcaaagtaggactacaccatcacctttcctgggtctccatctcactgatggcagacagtgggacttctcagcctccataattatgtgagctaattcctcaatgtaaataatgtaaataataatttatatacatatacctcattgttctttctctatagagaaccctactgatagttattccaaagaaac

SEQ ID NO: 8420 - DNA, 1160 bp, artificial
  synthetic oligonucleotide
gatcagggggaggtttgtcagccagacggtcacatctctctttgagcctaacacttagcaataaaatgttaattctaatatttgagttcattgcttcactttactttctctgctttacaaactctaacaaaaagctagaccttgtttttcagctatttgaaggaatgaagataatggtgtaagacgcccataaggtgtgcccaagatctcattcttcatgacagtacaagaattgctcaagagttgtttcccaatagatgatggagactactgtgttggggggtggggaacaagggttgaaaaactacctattgggtactatgcttactatttgggtgatgggctcaattgtaccccaaatctcaccatcatgcaatatacccagctaacaaacctgcacatgtaccccctgaatctacaaaaaaagttgaaattattttttaaaagagttgtttccatgatttagccaccctctagaattcaagattttctcaagagttgcatccaatgtttagctggctacccactgggagtatctctaatactgggatcaaattctggtgctaatacatgatattacattttgaaatggcttagttttcctcattgatatccacttcaaaagttagggttgtcttccaggtatcctaatttcttctaattatccattaggcatctactactcatcaatttacataaaccttctatgaagctggttagattatcagtctataccaattctttgggagtagtgagtctcataagtttgccagccactatgcaaagcagggcttcatattagttgtcttaaacagcattgttaagtttcaaagagctttctagtactcatgtattggaatttggtgaatgacatcaagctaccaaaatatataaacttcttatgtttataagctttattgatagtccctttcagattttgtttgttccatgctgacgaggtctctcctttttggtctgttttgggcgttgaagtgtcgtgcaaaatccaatggatttggaatcagatgactaggttttgaactctggatttgcccttaataactatatgtcctcgagaagctggttaaccttgccgataatcataagtgtatatatatgatcacatgtatgtatatgtgtgtgtatgtgtatatatatat

SEQ ID NO: 8421 - DNA, 247 bp, artificial
  synthetic oligonucleotide
aacagttaagggtcagaaaaatagggaaaaagtccagagaatgagactatgttctaagggctatttcttcaggcctttcatcagtcatactttctttttttcttcacatataggtctattttattgggtcttaaaaattctccttttcatgattatttgaatggatttgttactatggttacatttcacctgtgttaaaaatctgaccagacaatgtttttcttttttctaatgagtctgcttgaag

SEQ ID NO: 8422 - DNA, 606 bp, artificial
  synthetic oligonucleotide
aaaaaatggacaatggcttgaatagacattttcccaaagaagatatatggatggcaaacaagtacataaaaagatactcaatatttttttcattatggaaatacaaatcaaatccataatgagataccccttcacacccagtaagatggctataataaaaataaaactgaaaataacaagtcttggtgagaatgtggacaaattggaacccttctgtgctgcttgatgggaatgtaaaatggtgcagtcactgcggaagatagtttggaggttcctcagaaagttaaacatagaattaccatacagtccaattatccccatccatctccctggtgtatatactcaaaataattgaagacagatattcaaacaaatacatgaatgtttgtaacagcactattcagaagagacaaaaggtagaaatagcccaaatggccattaatggatgaatggataacaaactggtatatatatatatatatatatatatatatatatatatacacacacacacacacacacacacacacacacacacacacaatagactattattcagccattaaaagggataaattactgttacataatataatgtggaccaat

SEQ ID NO: 8423 - DNA, 1279 bp, artificial
  synthetic oligonucleotide
tgggcccaaggtagaagcagagagttttcatccaaggtaccttggggtgaccaaaccagagaacagaatgagttgaaacaatgtaggaaagccagagcgggggaggccaaggcaggcagatcatgagatcagggaatcgagaccatcctggctaacacgatgaaaccctgtctctactaaaaatacaaaaaaaaaattagccgggcgtggtggcgagcgcctgtagtcccagctactcaggaggctgaggcaggagaatggtgtgaacctgggaggcggagcttgcagttagccaagttcacgccactgcactccagcctgggcgacagagcaagactccatctgaaaaaaaaaaaaaaaaagaaacaatctaggaaaaatgatggttaaggaggaggggggattgattgaagtttattacaactcaaggaaggctagaggcaggaatttgaagctgagacaaagccagacatccagaaccagggagattaaaagatgagagcaagaataaatgcagacaacttggaatcaatggcagcaacaactggagtgggttgttggtgtagtcggaaagaacgagagaatgagaatatgcttttagaggtggtgtgagaggtctgaggtgattactaaaatgcctgttagtatatgtagcttaggtttatgagtcagccaatgtatgatacttatgtgggtcagtcagattaacagaaaaatggtagacataaccctttactgagttggtgcacactgttcctagattttcctgaaggaaaattccgacatattttaaaatgttttgtggtagcaggaaagctcctataactgctcttctagctgatatctgtccaattgtgctaagtattggagctgattagtatcaatggcagtcaaatacttatttcactatgtattctgatttcccatatgaagtttcctaggcagttggagaggcatgggatggcattgataggtaggacctagcagggagtggtggaatagatattaatatagtttgggtgggaagcaattggaacttgaaaggctggcatggtttttcaatagccacaaatattattgtcaatgttagataatgatgacaggtctgaaaaggagaaggcagcatgccacacatttatatctcccatggagctattcagctgtcttatagtatatcttcttgggtggtttttatcccttctgggtactatggggcctgacagggttgtagtattgcttaatattaagtatgggggaaattgtgggtcagtgttataga

SEQ ID NO: 8424 - DNA, 9573 bp, artificial
  synthetic oligonucleotide
gaatgcagatcctgggacacaactagccatgccaaagaatgcagactcctcaccacctgactgttctgtgagtgctggctctatccccagattctcacagtaataatagctgaaacttactgactgcttaccatgtgctaggcactgctttttttttattatactttaagttttaaggtacatgtgcacaacatacaggtttgttacatatacatacgtgtgccatgttggtgtgctgcacccattaactcttcatttaacattaggtatatctcctaatgctatccctcccccctaccccccgacaacagggcccagcgtgtgatgttccccttcctgtgtccatgtgttctcattgttcaattccgacctataagtgagaacatgcagtgttttgtttttcgtccttgtggtagtttgctgagaatgatggtttccagcttcatccatctccctacaaaggacgtgaactcatcctgttttatggctgcatagtattccatggtgtatatgtgccacattttcttaatccagtctatcattgttggtcatttgggttggttccaagtctttactattgtgaatagtgctgcaataaacacacgtgtgcatgtttctttatagcagcatgttttataatcctttgtgtatatacccagtaatgggatggctgggtcaaatggtatttctagttctagatcccctatgaatcgccacactgacttccacaatggttgaaccaagtttacagtcccaccaacagtgtaaaagtgttactacttctccatatcctctctagcacctattgtttcctgactttttaatgatcaccattctaactggtgtgagatggtatctcattgtggttttgatttgcaattctctgatggccagtgatgatgagcatttcttcttgcgtcttttggctgcataaatgtcttcttttgagaagtgtctcttcatatccttcgcccactttttgatggggttgtttgtttttttgcttgtaaatttgtttgagttctttgtagattctggatattagccctttgtcagatgcgtagaattcaaaaattttctcccattctgtaggttgcctgttcactctgatggtggtttcttttgctgtgcagaagctctttagtttaattagatcccatttatcaattttggcttttgttgccattgcttttggtgttttagacatgaagtccttgcccatgcctatgtactgaatggtattgcctaggttttcttctagggtttttaaggttttaggtctaacatttaagtctttaatccatcttgaattaatttttgtgtaagttgtaaggaagggatccagtttcagctttctccatatggctagccagttttcccagcatcatttattaaatagggaatcctttccccattgcttgtttttgtcaggttcgtcaaagatcagatagttgtagatatgtggcattatttttaagggctcttttctgttccgttggtctatatctctgttttggtaccagtaccatgctgttttggttactgtagccttgtagtatagtttgaagtcaggtagcgtgatgcctccagctttgttcttttggcttaggattgacttggcaatgtggtctctttttggttccatatgaactttaaagtagttttttcccattctgtgataaaagtcattggtagcttgatggggatggcattgaatctgtaaattaccttgggcagtatggccattttcacgatattgattcttcgtacccatgagcatggaatgttcttccatttgtttgtatcctcttttatttcattgagcagtggtgtgtagttctccttgaagaggtccttcacatcccttgtaagttggattcctaggtattttattctctttgaagcaattgtgaatagcagttcactcatgatttggctctctgtttgtctgttattggtgtataagaatgcttgtgatttttgcacattgattttgtatcctgagacgttgctgaagttgcctatcagcttaaggagattttgggctgagacgaagtggttttctagatgtacaatcatgtcatctgtaaacagggacaatttgacttcctcttttcctaattgaataccctttatttccttctcctgcctaattgccctgaccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcaatatctaatttattgagagtttttagcatgaagggttgttgaattttgtcaaaggccttttctccatttattgtgataatcgtgatttttgtcattcgttctgtttatatgctggattgcctttattgatttgtgtatattgaaccagccttgcatcccagggatgaagcccacttgatcatggtggataagctttttgatgtgctgctggattcggttagccagtattttagtgaggatttttgcatcgatgttcatcagggatattggtataaaattctctttttttgctgtgtctctgccaggctttggtatcaggatgatgctggcctcataaaatgagttaggaaggattccctccttttctgttgattgaaatagtttctgaaggaatgtaccaggtcctccttgtacctctggtagaatttgactgtgaatccatcgggtcctggagtttttttggttgataagctattaattattgcctcaatgtcagagcctgttattggtctattcggagattcaacttcttcctggtttagtcttgggagattgtatgtgtcgaggaatttatccatttcttctagattttctagtttatttgcgtagaggtgtttgtagtaatctctgatggtagtttatttctgtgggatcagtggtgatatcccctgtatcattttgtattgcgtccatttgattcttctttcttttcttcttttttagtcttgctagcagtctatcaattttgttgatcatttgaaaaaagcagctcctggattcattgatctttgaagggttttttgtctctctatttccttcagttctgctctgatcttagttatttcttgccttctgctagcttttgaatgtgtttgctcttgcttctctcattcttttaattgtgatgttagggtgtcaattttagatctttcctgctttctcttgtgggcatttagtgctataaatttccctctacacactggtttaaatgtgtcccagagattctggtatgttatgtctttgttctcgttggtttcaaagaacttatttatttctgccttcattttgttatgtacccagtagtcattcaggagcaggttgttcagtttccatatagttgagcagttttgagtgagtttcttaatcttgagttctagtttgattgcactgtggtatgtgagaccgtttgttataatttctgttcttttacatttgctgaggagtgctttacttccaactatgtggtcagttttggaataggtgtggtgtggtgctgagaacaatgtatattctgttgatttggggtggagagttctgtaggtgtctattaggtctttttggtgcagagctgagttcaattcctggatatccttgttgactttgtgtctcattgatctgtctaatgttgatagtgtggtgttaaagtctcccattattattgtgtgagagtctaagtctctttgtaggtctctaaggacttgccttatgaatctgggtgcgcctttattgggtgcatatatatttaggatagttagctcttcttgttgaattgatccctttaccattatgtaatggccttctttgtctcttttgatctttgttggtttaaagtctgttttatcagagactaggattgcaacccctgcatttttttgttttcatttgcttggtagatcttcctccatccctttattttgagcctatgtgtgtctctgcacatgagatgggtttcctgaatacagcacactgatgggtcttgactctttatccaatttgccagtctgtgtcttttaattggagcatttaggcaatttacatttaagttaatattgctatgtgtgaatttgatcctgttattatgatgatagctggttgttttgtcgttagttgatgcagtttcttcctagcctcgactgtctttacaatttggcatgcttttgcagtggctggtaccagttgttcctttccatgtttagtgcttccctcaggagctcttgtaggggaggcctggtggtgacaaaatctctcagcatttgcttgtctgtaaaggattttatttctccttcacttattaagcttaatttggctggatatgaaattctgggttgaaaattcttttctttaagaatgttgaatgttggcccccactgtcttctggcttgtagagtttctgctgagagatcagctgttagtctgatgggcttccctttgtgggtaacccgacctttctctctggctgcccttaacattttttcctcatttcaactttggtgaatctgaccattatgtgtcttggagttgctcttctcgaggagtatctttgtgacattctctgtatttcctgaatctgaatgttggcctgccttgctagattggggaagttctcctggataatatcctgcagagtgttttccaacttgtttccattctcaccgtcactttcaggtacaccagtcagacgtagatttggtcttttcacatagtcccatatttcttggaggctttgttcatttctttttattcttttttctctaaacttctcttctcgcttcatttcattcatttgatcttccttcactgataccctttcttccagttgatcacatcggttactgaggcttgtgcattcatcacgtagttctcgtgccatggttttcagctccatcaggtcctttaagggcttctctgcattggttattctagttagacatttgtctaatcttttttcaaggtttttaacttctttgtcatggattcaacttccttctttagctcagagtagtttgatcgtctgaagccttcttctctcaactcgtcaaagtcattctccatccacctgtgttcattgctggttcggagctgcattcctttggaggaggagaggcactctgatttttagaattttcattttttttcctctgttttttccccatcgttgtggttttatttacctttggtctttgatgatggtgacgtacagatggggttttggtggggatgtcctttctgtttgttagtttttcttctaacagtgaggaccctcagctgcaggtttgttggagtttgccggaagtccatttcagaccctgtttgcctggatatcctcagcggagcctgcagaacagctcatattggtgaaccgcaaaggttgctgcctgattcttcatctggatgttttgtctcagaggagtacctggccttgtgaggtgtcagtctgcccctactggttggtggctcccagttaggctactcgggggtcagggacccacttgaggaggcagtctgtccgttctcagatctccagctgcatgctgggagaacgattactgtcttcaaagctgtcagacagggacatttaagtctgcagaggcttgtgctgccttttgtttggctatgccctgcccccagaggtggagtctacagaggcaggcaggcctccttgacctggggtgggctccacccagttcgatcttcctggccactttgtttacctactcaagccttggcaatggcgggcgcccctcccccagcctcgctgcggccttgcagtttgatctcagactgctgtgccagcaatgagtgaggctccgtgggcgtgggaccctccgagccaggcacgggatataatctcctgatgtgccatttggtaagactgtgagaaaagcgcagtatttgggtggaagtgacccgattttccaggtgccgtctgtcacccctttccttggctaggaaagagaattccctgaccccttgcacttcccaggtgaagcgatgcctctccctgcttcggctcacactcactgtgctacacccattgtcctacacccactttctgacaatccgcagtgagatgatcctggtacctcagttggaaatgcagaaatcatttgttttttgtgtttctcatgttggtagctgttcctatttggccatcttggctgaggccctgctttaactgctttctgtgcaccgtttgtttaatcatgttaaaaactctcagaggttataccattatcattccctgtttggagatgtagtaattaagacacagacttgcctacaattcatatagaaagtaagtgattgagccaatattgagaacttaggtagcctgactccgtggccaaggctcttcaatattatgctttgctacctcataagaggccaaagatccttgaacgaaggtgagtagaaacagaaaatctcctagtagctttctctgcctttactacttcccttcaatcatttcttctttctgtgttacctactattattgttattttgcctatgattaaatactcctgtctcattaacactgccctcacagtgacttggtaggaaatctcttagtagtcctcatatctctgcctctattgtaagtattttatgtggtgcttggtgagtattcctactagtttatcctactatggaactctatgcttgcatatttcagagtcagaaagtgagtggggctgatggactgctgggataaacagagcaggctttctatatgaattagttcatgggtatgtggaatgaggatgtcttgtcttcatgctagagaaatatcaaaaaccaggaatagggagcaagtttcgctgaagggaggctatgcttgataatactaagtcaaggaaactacaggcagctggtcaaagctagcctattaccagtttttgtaaataaaaatttattggaatacagccatccattcacttatgtattgtctgtggctgcttttgtgtgatgactgcagaattgaattgttgcagtagagaccatatggcccacagaggctaagataactactatttggccctttgcagaaatattttgccagcccttgatgtatgagatggagcatcctgtattattcgaggtttctatgcagggaaatgctaagagattaaatttgagttttagatagagacatttggaagcactgagaagaagaaatctagattcaggggccagagagatcaaaacagggtaaaaaagaactagcgagcactgagagcaagtagataaaagggattagcatttagatgtgccagtgaagataggttttccaggatttgactgaagtgtgtgtgtgtgtgtgtttgtgtgtgtttgtatgtgtatgcatgtgtatgtcgagaaaggaggatttctaattctgagaaaatgagaggacagagagaggaacatagtacaaaaagatagaagaaataccctcccatttctgtaatttctgtttgaaatgaccactacatttctttctgcagaaagagttttctttgcagaaattttccctagggctggtctgccagtatctgtatttcttaggcaacagtgcccctagtgtctatatgacagtatcacaatctgctagacaagatttcttgatgagggcttaaaaaagaccaattgcaaagatcacattgctgagacagtttttcttctttgtcaaaattgatatagatgaccaggtacactctcaccagaaatacactggtaaagtctgcttattaggagaggctgtggagggtggacctggtgtcttttttttgccttgtgaggctaattcatataaatgtcaggtataaaaatagtatcttctttcaagaaactgccttcagctttgccatatctacaatgccatggactaagaataacaccttaatgagttttgagggttacttttcataggtggtctatggcaggaactactgaatttatgaactgcccctctttgtcatcctttgcctatccttcaaggccaggatagttgccttccagttgaagccttgttaggatgtgaaagcacaagaagatgccaagtcaagatccagtcccagttgtgcaaagcaccacccctatcatgtagaagcctggatgtcttagtcctcagggctgcccttacttttccaggggatagccataattctcaaccaaaagtctttagtctcaaccttaaacacacactgagtgtgtcaattcagtgcgcggtcctcccttatacactttcaagggagactggcctatcttttggcactagcctcaagaagccaggaatggcaggcagccatgagctacacatcatgggaattaaattgaaagtgtaaatgaaaagagtataatggggtaggtctactgtgacttttgttctgctttcaatctctaattattttggcatggaacaattaaagtaaataatgactagttacaattttgtcaatatatttcttgcagattgaatgtgttcatgcacagattttatcatcttgttactcaaacgactgatggcttctgaccctgcctgaaaatttcctaagaggtaacagttctaggacacaggtgagtagcaagtgggattgccctccccacttccttttttattttttcctgttttcactatttccttctttcttctccatctttcctgaatctaagtcctctcaatctggtaaccccatcactaatggacatttttttactttattaattttatgttatttttacatgtgatctatacttgtcatacatttttaagtgtacgatacagtattgttgactgtaggtacattgttgtattcattggggggtaatccagaaccagcatgtagactagaaagaattctagaacaggagttgtgaaaagctccttctagaaaggagttgaagtttatcattaagtatcttactggcatggggaatattgcttaatatgtctgatgtctggtttctcacctttattaagggggtagagccagatgagctctgagatacctgaaatccatttgaaatactttgaaatccatgaacacatcttttctagttcccagtgtttctgtgggaggatacagagatatcatgagttcacaataaaggagagtaaggaaaagggagaagatgaagaaaagagctcattcagtgagagaggagttaattctaacccatgacatctgtggagactttaggatgaggtgagaagtgagcataatttgaatataagggaagataacttcatgttagaggcttgagtttgattcttggatcactggggaagcaagctttggagctagacttcctgggtttgaatccaagcatcactacttagcagctatgatatttatatgatttagaatcatccataccatggggataaaatggtaatttgttatgattaaatgagttaacatatataaatgtcttagaacagtgtatggtagttagtaatgtttctgtacagagaaatggtaggtgac

SEQ ID NO: 8425 - DNA, 159 bp, artificial
  synthetic oligonucleotide
ctgtgggagagcattagtctactctttatggggttgcagactggatagggaaaagtgtaggagagcagcaaataggatgatgatattatgtctctttgaaatctctatgtatattgggcagaggacaaggtataggactggcatactgggcagtatggt

SEQ ID NO: 8426 - DNA, 424 bp, artificial
  synthetic oligonucleotide
agatgatataggtttgattaccttagagccacatagttcattttttttttctttaaatgtgctgaatgctactcctgtgttaattttctttgtgcttgtctctgaaccatgtgaaactgcttttcctggattttccatcttgcactatcattgctctctgttacaagatgctgcaaaaggttttgctaacaaattacttcttgtgttctatacagagatagtcctgggttcatgagtgctactcacacacccaacttctctctaatgatgcccactgatgccctattaacccacagaagatgctttttttatatgaagtgtgatggcaaattaatagatggcaaattgatttgcaaaagtttctccaggtgacaagggagaagcttgttttcttacaagatgatctcacacctgcccctgtgtg

SEQ ID NO: 8427 - DNA, 5277 bp, artificial
  synthetic oligonucleotide
agaaggggcaggaaaagattttctaaccactcatccctgaaagagggcactcctaggactcaggaactgaaagtgattatattctccgtgttgtctccctaggaaggatccaaatcataggttaaagggaattctggatggaatatatacaggatgatgaatccatatctaaccaatacctattctgcaagccccaacatggccaaaacttcaatacttggtggacattgatggcccacagagtctgcaaatgaactcaggcctttccatcttccaaatgagttcacaaagataagaaagatattttgtctggtgttctaaaggcttaatagtgacttgcattggagtaatttgtacagcatcctctgtaagtcttgtttaccagacactcacttctacccctaagtgtttcttagtgggcgttaattctaaattggtgcctaaaggatgggagtactcaaatctctcttggtcttcaaaggaatggctgtggacacagagagactataccttttcccacaccataggcatgtgccctgcaagtctcactcttgtcacttctggaaaactgcacgtggtctctgtgacacagggctatttcccacttctgttcttcaactctgagcaaccctgggcaggtcagaagttctttcaggtcattgttctttcaagattccaaaaaaattacttaacacttctggagctccagaaacgatgatatttgacgctctctaaatgagataagcagataaggctggaggcttgaagaggttcagctggagaagactcataggtcagagtagggagactggacagaaatgcatactctataccaagacagctctcatggagccccagtggtggaacaaggaagagcctggagaaatttcagcttcactttcattctcctgagtgctatcatcttgcttctccactctgaccatgcagcctttctttgtatattccaaaagtcagaaaatttgaggggaattattggacaggcccagagtggggatccttggactccaagcccagttctcattgactggctgtgtgaccttgggcatattagttaagcctcagtttcctgtagtgttaagtgggactattaaaatgcttcttagagaaatggtggaaagattagatctaagaacatgaagaacccagcacagtgcctgacgcatatttagtattaaaacaattggcagcattacattgatcatcgttgtccagatgctacatgttccccttggcagatttctttctctctttactggagccccccagaagagctgacatgtttgtggacccagaaattgcaccaatccaaaaagtcagagtaaaaaaaacttggcaacttaacgtgcttgcttccataccctctcccgtctcacaagcatgtatgggttaacagtccaagggagctgaagaatgagagaattgctgtttagcacacaggcaagattttgttccaaggtcccagattttgagttggatactctcccgcctgacaaccccaccccaccccattttcaagaaccctttcagaccagactttccaattactcattttctcgtcgctagaagccctgcccttagcattcagactttggaatgctaccgatgggaagatcactgagactgggctgtattgccctagcaaccgcggagtgcgcctgcgcagtggcatccccaggccgacagctctaattaggcttctgcatctcaaccggccagactttggatacaaaacggcatatcttccttctccctgccgctcccccagcgaaacgattgtgtcgttctcttcctgaggctgatgaaaatgtgaggaatgtcttccaactctctcccatctaataggaggtagcagatgggagtagcccccggtgattaaatggatgaaaaaggcagaaagcttctgtgtgccaggaaatgaagacatatagatcctacactaccggtaggcagcagccatccctctgtaataagtgattttccatatgacactcatccttataccagggctccgtctcagaaattgttacctgctggctctctagggaaggcttatggggagctatgagacaggttagaagctgtaagggggatcagaatgaagacagcctaaatgcaaacactcaccttaacagcttgggtgctgaaataaactgcattggcagaggatcccctgcagagttcctccaggtagatttttcagtctgactgaaggtgcaaggccattgttggctctcaagagtcactctgaggatatgggcccttgttacctctgccacagagttatttctcccactcctcctttaaagtcattgtctttctgagctatttcaaattcttcacaggtgctttacacgctgcttctgtcttcactagcagtccttcccttcctctccccaacctcagatcttacaatagatgtcactaaagcacatcttgtccccagccctccataccacttcatccttcccaccactattcctgactactttcccactcatccaggcttgacacccctgcaccttccccagactatcttagatgccatcaccttcccactatccttcccagcacttaaaatcgggagttattcttgtggactctcatagaactctgagcttatgcctattatgccactttccatagcataatataattgcttgtttacttccatgagccctcccccttaagctctggagcccagctgggtcttcttcactcttttattcccagcacacagcactgttctcagagcatggcaggtgcttaatgcctatagaataaatgaatgcacaagcatagggtctaattcattatgcttttattgcaaatacaggtaaatgacagttttgtgtatatatatatttgtgtatatatagttgtatatatgtatacggcagtagacacaaagggagagcaatcacagatcagtggttttgtgtttgttttgttgtgtgtgtgtcattgttatttaactcctgtaccagaccattttactgattatttcaaagatgtaaatattatcaatacattttacagagctgtctgaacttttatgctgaaacaagaccgggatggcaaatgaaaaattccatttataaatattggtcattaacctaatccaagagtatattaaaaggaaggaaatactactagaattggaacacagacagcaagcacaatttgtacttcccacacaagccctacctggattctaatttagagccccaatgcctattttaccaaggcatctttaacttatgccactcagctgaagtgatacatattccctagacttcacgtggggtcaaggaaaaacatgatagttgcctcagatttggctctggcctcctcatcttccacagcctccctatattgttctggccagttctgtggtcgctttctgtagagcctggccatgtactccaagactttcattttgatggtttcatggtgagctcgaggaccccatagaagctcatattcaactggattagagtaggacagtggcctgcattccagatagcgctgtctcataagcttacgggtgatggaatgctttctccctacatccacactaaatcttcgaagcaagttccagacattggcctctttgacacggttgcccatcaggaagatcaaacctaggattggcattacatattcttgagtgggtctccccaggctctctagcatcacttgctcttcctctgattctggttgctggacaaggaggtagatgtgctcactggtatcaacctcaatcagagacaacccatagaacatatcaagaattagagtagctctattgaggatatttgggaacacatcctcaaattctttgccagtgtgagccaatagctcatcctgatgtataggcagcatctcctcagtgacactaatagccaactggaccaaatcatttgccttatcattcatagtgtcctccgaccagaactctaagccagcagtcaggcttctttctttggttttgtcaccttccagggccttattatattcttctggccagctccagggttcttcatcatgggcatctgacacaaacttcagggcttccatctttgtgatttccctgtgggctctagagccccacaagaactcaaactcaaggggattagtgccatacaccggccagtactccaagaatcgcatgcacacaaagtcagtagtgaggaggttccttgtgttcccaaagaggttgttgatcctctgaggcttatcccacatatcaacttttagcagcaagtcccaaatggaggcctctcttgctcggttcccattcaagaggatgtggcctaggactagggccaggagacttgcttttggcatgtccagggactccgctatcctatcggtgatctggaaaccccgtttgctgactaaattgtaggtgtcagcctgaggatcaataactctcaggttcaacccaaagacctggtccaggtgagctgaggctcgtctgaggatctcagggaactgatctgagtactctctgagaaactccagcatctcggactgctggatagacccctccgtctggcttttcattctcatgaaattcaccaaagcaatcgacctgtcttctagagggtcatggaccctgagcgcccccaaacgtctggactgctcgtcgatcaggacctccaggtcattcgggtcctgaacggcctgggaagtgttgacacactgagagttgattggcgcctgagggcactggggggcatcaacgactagcatggaggtgggggacccggaggcgttagtagcttgtatttcacctctgccgtcgccgtaatctgcagtgatctctgcgctacagtggcgtgcattctggcttaccagagacatggttccaggagacaggagcgggaacggtgagatcagcgatcagtcggagagaggaccgcagcagtgttggtgcctcggcacaaagctgaagcccgagaccctggagctggaaggatcaaaagtgaaatctggtgtgaagagcgatctttctacacaagtgctggccagcaacgactgcaagcctcagagcgttattttgccgcagcctacgcaggcgcagtcagtctttgcattgtggtggccacgccccactcctcgtcttccatgctttgtctctcattcctgccccctcacctctgaagggcaggctaggctggttgaagtggttgctgctgaattcgaacttgttagagaagagaattcgagaaatggagtaacagatatagcaaa

SEQ ID NO: 8428 - DNA, 1671 bp, artificial
  synthetic oligonucleotide
attctgatgagggtgaggggtgctctcagacacctgcaaattagcatcacactcccctaggctctctagcaagatattctgggagaaaaacctctgaatcttatttccagctactgctcaaggaagggactgtttccaaagaaaatcacagtcataaataagggaatttttttgtgtgtgtctttttttcttctttgttcctttccctctctttctgttaatggcagccatcccttcacatcacttagaatcactgagaatctttcctaccctggcttacaaattgtgcagaatccctgtagagtaaggtgctcctttgtctgtttccactgtctctgacctaattcttgactgactggccatttacctgatctacattaaaagcgaggagaactgtgttctcatcccagaaaaaaatgtatgacccaggcagtttgattcacctctctgagattcatgtcttcatctgtaaaatgaggcacttgatcatccttggctccacctggaggcaagttggggtcatagagagagctctggcatggtgatccagggccatgaactccagtcacagctcttctactaacctagcatttgatttagttctagtccctttccacttctgagcctcagttccccatctaaacagccatgactgacaatggatgagtcctagactcttgcaaatgaagaacttaatcccccaatatgcctgtgtgttgataaggtccatatcctctgatcttgagcagatacagccttttcttttcctctggattgcttcttgaaagtggatgtagtaaaagccctttcctttatgcttgatactttattttctcaggtaagctctccatacctttgccctggagcctgtatttatggatttttcatcagcaaagcctatcagttagtgtaattagcttattgtcaacttcaatcttggccctctccatgcactgtcccccacctacatcaggttctctcttatcttaacttagtgagcagagctcctggctgcatcaccatagcaaccagcagctagggcaaattaagccatgacagagttattagactcttaagcttattatagagtccagaatattagctggaggagagaggctgaaagaaagaatccaaggcagaacttagctgcaaaaatgtgggcagcagagaagctgaatgcttcaaaccatctccgacctggacatcataggagccatgggcagggtgtcaacactttggcatgtgcactcagccaccaggccagagggagaggcaccaggcccattctcttctcaagaaaataattctggacacctccctgccaacatgcttcaaatgaaagaatttgtgtctagatttttaaatagtgccaattactgaactcaccctgaatcctactcctaatctggtgacacatttttttatcaatcattcagctttactctacaaaattttcttgcatgaaacaaaggccattttctacttgtttgaagctctcttttcccagtcaaggcccctgctgccttggcccgtgagtttggcctgttaatctcaaaagtctattaattactgtaattaggatattcaaattacaattctccccctcctccacatggacagccacccacccttcttttatgctcttttcatttcattcaggaagaaaagctc

SEQ ID NO: 8429 - DNA, 16481 bp, artificial
  synthetic oligonucleotide
aagagatcttgattctaatctgcttgtttagcaaatcccatcatcccatccctttgacatacggacttttaatttctctagtgagaactcccagccactcagagatctgcctccttccaacctcttaaatggctcaagactggaccagccatacctattttattagtgacaactaaggggtaagactggttcctttatgatcactgatgagtgacgtcagctaaagcagaaaatcaggtagtctacgtatgaaacctcccaattttctcttctactcttctcttgctctctttttctttctcttgtcatggagattttttcaatatttttcttttggtggcagtattgctccactgatagagccatctctttctcccaccttttgtttttgaaaaacacctacagttgaaacaagtatatttcacttgataagagtatttttcatctgggatttgcatctaagggagattttccagaacttaccactaataattctctgtccaggctttcttgattacataggaaaagaagatcagacagattccatgatctactttctgtttcttttcttcatgattttttctttttaataacttttctatagctgtaaaatatacaccaatcattatataaaatttgaaaaacagaaaatgttaaagacaaaaataacatcatcatttatcccataaacaagagagagcactactgttaaaaatctaaagcaatctctccagtgagttttctttgtgtacattttgatataattgtgatcacattgtacacataatttaattatctgattttgtattgtttatatctcataagcatgtttacatattcttctaaaattgttaaaaagattttataatttaaaacttttaattatatcatttaatgcctgtggaattatctaccatataaatgaatcatcagttaattgggattgcttacaaaacgttggtattttaaataataccaacatagattgcttataaaacattattattttaaataatatataaataatatttctataaactaagtaaactgagtgctttcttacttgaatttcaggcaaaatgcatccctggaaaaagaaagactggttgacccaagtatccacctaattggagaatgccaatctgtgaggtattttatcatttagtctccacaactcacccatttaaggaagagaagaaattcctgtagagcttttcctgagcacaaaaattttgatcattttttctctcaattatgatctattctgaaacaaactagctgtgaatttttgaaattggtttacccagggctgtgataaaattgtgcctttctaaaatggtccaaatccatggaattggcaaccttgcacatatttttaaacaaaattactcttctcccagccaagaaaacctatcctccagaaccaaagaatttttgatgatgagggtcaccttaaataatgagatacatgcatacatcattttattgcttttcactttattgcaattcacaaatattgctttcaggtttgtggcaaccatgtaccaagaaagtctatcattgtcatttttacaacaccatgtattcgcttattgtttctttgctacaatttggtaattctcaaaatatttccaactttttcattattattgtgtctgttgtggtaatctgtaaccagtgatctttgctgttactgttgtaattttttttttttcttttcaggcagagtcttgttctctctcccaggctggagtgcagttgcgtgatctcagctgactgcaaactctgcctcctgagctcaagcaattctcctgtctcagcttcctgagtagctggtattacaggtgacccccatcatgattggctaatttttgtattattagtagagatgaggtttcaccatgttggctaggctgatcacaaaatcctgacctcagatgatacaccctccttggcctgccaaagagctggggttacaggtgcgagtcaccatgcccagactgttgtagttgttttgaggtgctatgaaccacgctcatataagatggcgaacttaatacattttgtgtgtgttctgactgctccactgaccagtcattcctccatctctctctctattcctcaggcttctctatttgctgagacacaacaatatttaaattaaatcagctagtaaccctaaaatggcctctaagtgttcatgtgaaagagtcatacctttatcattttaaatcaaaagctagaaataattacatttactgagactaatcagcttactgaaagtaacctcatcgaaaggtgagaaaagccaaactaggctttttgagccaaacagttaaccaaggtgtgaatacagaagaaaaagtcttaaaataaatttaaaatgctactccagtgaacacaagaatgatacgaaagtaaaacagtcttattgctaacaagaattaagctttactggtctggatagaagatcaaacaagtcacaacattcccttaaaacaaagcctaaaccagagcaaggacctaactctcttcaactctgtgaaggtggtgagtgttgagaaagctgcagaagaaaactttgaaactagcagaggttggtttattagatttaaaggaagaggccatctccataacatgaaagtgaaaggtgaagcaacaagtgctgatgtggaagctacagcaaggtatccagaatatctagctaagatcattgaagaaggtggatacactaaacaaccctgtcaatttaaagaaaactgccttctattggaagaagatgccaggacattcacaactggagacaactcaattccagtcttcaaagctgtaacaaaacagactgactcttgttaggagctaaagcagctggtgactttaaattgaagccaatggtcattcactattccaaaaatcctagggctcttaagaaatatactaattttactctacaaattagaaaacctagatgaaatgaatacattcctggatacatataatctatcaagattaaactataaagaaatagaaaatggaatagaccagtaatgagtaatccaattgaaacagtaacaaaatgtgtcccaataacaagagaaaactatactcaggactgactttaatgttatattctaccaaactttgaaaaaagaactaacagctattctactcaaactatttcaaaaacttgaagaggagggaattctttgtaactcaatctataaggctagcattatcctgatattaaaattagacaagagcacaataaaaaaagaaaactacatatccctgatgaaaataaatgcaaaggttgtcagcaaaatactagcaaattgaattcaacaacacatcagaaagataatacaatatgatcaagtatgatttattccaggaatgcaaggatggttcaacatatacaatttaatgtgatacatcacatcaacaaaattaaagacaaaaattataagattatctcaatagacaccaaaaaagtatttgataatactcaacaatggagaaagggggagttagatggtgggatgaaaagctccattgatcgttccccctgctggcatacaattttaacaaatatctgcacagaaaaaagtaacttccctaagaaacaaaaatcaggtgagccctcacagtaccttgttttgtctttgtatcactgaaaaaggcactaaagagatagaaaaaaaagtgttaagttacaaattccacctctctctcccacaccccatgcagcagtggcttggtgcagagatcatcactgaatgctgagggagggagaacacagcaagtgtgaggcactgaactcagtcctgtcttgttagaggagaaaacaaatccagactaaacttagctgacacccacccatggagagagcatttaaaccaaccctagccagaggagaattacgaatcccagcagaccaaacttgagttttcacaaacctcattattatggactacagtgctctgtgtctctaaatgaacttgaaagacaatctgggctataaggactgcaactcttcggtgagtcatattgctgaactaggcctagagaaagtggactggagggacacataacctactgagacatcagttaatgtggttaagagagtgctggcattacccctcccctaaatccagggtgcacagctcacagctacaaaaaagaccccttccttccacttgaggagaggagagggaagaatggggtaatctttgccttcatcttggctatcagctcagctgcagccagatatggcactgataagagagtgctgaggctcctgttttagtccccagatcccaggaaacaatttcagataaacagtgggccagaaggaagcacacttctttggaggaaataacccagccctggcaacattcatcacctgttaactgaaaagtctttagtccctgaataaccggcagcaacatagccaagtactatgtcaagggccttcagtaagcctctgagacttgctggcttcaagtgacactcaatgattaccagctgtggtggctacagggcaaaatttctgcttgagaaaagtataggaaaaagtaaaggggactttgtcttgcaacttaggctctagcaagaccaccaggtggtagagcaacaagcaacatctttggatccccggttttagaactcggcccttggacagtatttctggacatgccctaggccagaggggagccctctgccttgtgggtgagtctcaagtcagtcagcatttacaacaagctgacttaagagaccttggggataagggaacataagcagtagtctggcagtactcttcatggcctggggtggtggtaactatggggtgaggcgtctctgcctttggaaaggggagggaagagtgggaaaggctgcatcctgtgatttgactgacagctcagccacagtacaatagaacacaaagtggatttctaaggttttttactctagtccctgaatcttgtataaaagctctgaacccacctggagcttgggggacctcacaactctggagggaagaacacaagcctggctggttttgccactggttgattctagagccccagggcctagagaaaacataggcattagcaagaaagcgcttacagcaggccttgggtgagacccagtgctgttctggcttcaggtctgacccagtacaatcatagtgattgtggtcacagagaggcttgtgtcacttcatcccagatttaggtggctcagaacagagacagaaattcttttggtttgaagaaagtaagagaagaaaataagagtcctcatctggtaatccagagaaatcccctagagtttttccaagaccatcaaggtgatacctctgggagtctgcaagaaccacaatgttattgggcttggagcaccccctaaagcagatactgcttagatcacaacacccaagttctttgaaatatctggaaagccttcccaagaaggatgagtacaaataagcccagacagtgaaggccacaataaatacctaactcttcaatgcctggatactgatgagcatctactgacatcaacaacatccaggaaaacattatctcaccaaatgaatacttaaagcaccagggacttatcctggagaaagagatatgtgatttttcaaacaggaagtacaaaatagctgtgttgaggaaaatcaaagaaatttaagatatcaaaaacaaggaatttacaattctatcagataaatttaacagaggttgaaataattaaagataaccaagcagaaattttagagctggaaaatgcaagtggcatactgaaaaatacaccaaagtccttaaatagcagaattgttcaaagcaaaaaaaagaaataaggagttgaacaatcagaacacatggacacagggaggggaacatcacacaccagggcctgtcgggggtggggggagctagaggaggaatagcattagaagaaatacctaatgtagatgacaggttcatgggtgcaagaaacaaccatggcatgtgtatacctacataacaaacctgcacattctgcacatgtatcccagaatttaagtatataatgagcttggaaacaggctacttaaggatacacatgaaaaagaataaatacttaaaaaacaatgaaacatgactacaggatttagaatatagcctcaaaaggaaaattttttggccttagagttattggctttaaaatggaggtagagaaagacataggggtagaaagtttattttaaagaataataacaaagaactttccaaacctggagaaagatatcaatactcaaggaaaaaaaaaaaaaaggttacagaacaccaagcaggtttaacccaagaaagactccctcagggcttttaataatcaatctctgaaaggtcaaggataaagaaagatttctaaaagcagcaagagaaaagaaacaagtaacacacaatagagctccaatacatctggcagcaaacttttcagtgggaaccttacaggacagacaagaatggcatgacatatttaaagtgctgaaggaaacaaaactattaccttagaatggtatgtctagcaaatatattattcaaatgagaaagagaaataaagacattgtcagacaaatgaaaactgaaggattttgttaacaccagtcctgtcctaaaagaaatgataaagagagtcattcggtcagagggaaaaggagattaatgagcaataagaaattacctgaaggtagaaaactcactggtaatggtaggtacacagaaaaacacagaatatcataacactgtaactgtcgtgtgtaaactactcttatccaaagtagaaagacgaaagaaaagaatcaaagtaataactacaacaacttttcaagacatagtacattaagatatgactagaaacaaaaaaagataaaaactgagggtagaaagttaaagcatagagtttttattaattttttttgcttgtttgtttatgcaaacaatttcaagctgttatcaggttaaaataatggattgtaaggtagtatttgcaagcttcattgtaacctcaaaccaaaaagcatacaatggagacacaaaaaataaaaagcaagaaactaaatcatgtcatcagagaaaatcacctctactaaaagaagataagaaagaaagaaagaagaaagagatgaccataaaaaaagaaaacaaataacaaaatggcaggagtaagtccttacttaataataacattgaatgtaaatgggctaaccactcaaactgaaagatattgattagctggaataaaaaaaagacccattgatctgttgcctacaaaaataaaaaaacggaacacatttcacctaggaagacaaacagactgaaaataaatgaatggaaacaatattccaagccaatggaaaccaaaaaggagcagaagttgctttacttatatcagggaaaatagatgttaagatgaaaactataagaagagacaggaaggtcagtatataatgaaaaaggtgtcagttcagcaaaggcatacaacaattttaaatatataaacacctgacaccggagctacaagatgttaaatcagatttagcctaaaaccacctccttacatagttaggttcagcctaaaggtatttttgcacattgtgaactataacaagtggaggtgtaaacagacagtagtctacacttgtgccagtcagcgagttttggccaatcaatgtagccaactgtttgaaccttgttcagataaggcaaaagccaagctgtaaccaatccagctgtttctgtacctcacttccattttctgtatgtcactttcctttttctatccataaatcttcttccatcatgtggctccactgcagtctctgagcctactgtggctcagaaggctgaccgatttgtgaatcatccattgctcaattaaactcctttacatttaattgaactgaagtatttcttttatcagagatatataaaggaaatactattagagataaagagagagagaagccccaatacaataatagctggagacttcaacacccaactgtcagcattggacacaacttccagacagaaaatcaataaagaaacatcagacttagtcttaactataaattaaatggatctaatagacatttacagaacattttatccaacggctgcaaaatacacattctttttttcagcacataaattattctcaagaatagactatatgttagatcacaaaacaagtctaaaaatattcaaaaactgaaataatatcaaatatcttctcttactacaaggaactaaaactagatattaataacaagagacattttggaaactatacaaatacatggaaattaaacaatatgctcctgaatgacatgtggatcaatgatgaaattaagacagaaactgaaaaatttcttgaaacatatgctaatggaaacacaaaattccaaaacttatgagatacaccaaaagcagtactaagatggaagtttatagctataagtgcctacaagaaaaaagaggaaaacattcaaataaacaatttaacaatgcatcttaaagaactagaaatgcaagagcaaatcaaaaccaaaattagtagaagaaaagtagtaataaagatcagagctgaaagtaattaaattgaaatgaagacagcaatacaaaagatcaatgaaatgaaaagttattttttggaaagttaaacaaaattgacaaaatgttacatagactgactaataaaaaaggagataaaaataaataaaatcagaaaagaagaaggagacgttacaactgataccacagaaattcaaaaaattattagtagctactgagcaactatgttctaataaattggaaaatctagaagaaatggacaaatttctaggcacataaaacttaccaaagttgaaccagggagaaattcagaaccttaacatatcaataacaagtaacaaaatcgaagccatgataaaattcccccagttgagaaaagcccaggaccctaaagcttcactgttgaattctaccaaacacttaaagaagaactaataccaaccctactcaacctctcccaaaagaatagaggaagaaggaatacttccaaactcattccatgaggccattgttacccagattccaaaaccagacaaagatacatcaaaaaaagagaaaacaacaggccaatatctctaatcaatatttatgcaaaaatcctcaacaaaatactagcaaattgcattcaacaatacttagaaaggtcatccattatccaagttgggtttatccatgggatacaatggtggttcaacatagaaataatgtgatacatcataccaacagagtgaaggataaaagccatatgatcatttcaattaatgctgaaataacataacttttcttcatgagaaaaaccctcaaaatactggagataaaagaaacatacctcagcataacagaaccctatacaacaaacccacaattagtatcatactgaataaggaaaaactgaaagaaagcctttcctaaaaaatgacaaggatgcccactgtcaccactgttattcagcattgtactggaagtcctagctagagcaattagacaagagaaagatataaaagacatccaaattggaaaaaaagaagtccaattatccttgtttgcagatgatatagctcatatttggagaaaccttaagactacaaaaaaaaaactattagaaccaataaacaaattcagtaaagttgcaggaaacaaaaccaccatataaaaatcagtacttctatatgcaaacaacgaacaatctaaataagaaattcaaaaagtaatcccaaatacaatagctacacataacattaaatacctagcaattaactaaagaagtgaaagacctctataataaaaactataaaacattgatgacagaaattgaagaaaataccaaatatagaaaaatagtccatgttcacagattgaaagaatcaatattgttaaaatgtccattctacccaaagcagcctccatattcagtgcaatccctatcaaaataccaatggcattcttcacagaaatagaaaaagtaattctaaaatatatacaaaaccacaaaagacccagagtagccaaagttatcctaatcagaaagaacaaaactggatgaatcacactacctgacttcaaattatgctacacagctctagtaaccaaaatagtacagtattggcataaaaacagacacatagaccaatggaagagaatagagaacccagaaatgaattcactcacgtacagtgaactcattttaaacaaaggtgcaaataacatacactacagacagtctcttcaataaatgatgctggggaaactggatatccacatgcagataaataaaacttgacccctctctttcagcaccatatacaaaaatcaaatcaaagtggtttaaagacttaaatctaagacttcaaactatgaaactacttcaagaaaacattaggaaaaacctccaggacattggtctgggcaaagatttcttgagctgtacctcacaaacacaagcaaccaaagcaaagatggacaaataggatcacatcaagttcatcaatttctgcacaggaaagaatagaaacaacaaagtaaaaagacaacccactgaattaaaaaaaaactatttgcaaaccagccatctggcaagggattaataaccagaatatataaaaagctcaaacaactttatggaaaagagtttaataatctgatttttaaaaatgggcgagtgatttgagtatgtctcaaaagaagacatataaatcgaaacaagcatatgaaaaggtgctcaacatcattgattgtcagagaaatacgaatcaaaactacaatgacatattgtcttactccagttaaaatggcttatattcaacagataggcaataacaagggctggataagatgtggagaaaagggaacacttgcacactgtcagtggaaatgtatattagtacaaccactatatagaacagtttatggactcctcaaaaattacaaattgaaataacatatgacccagcaattctgatgctgggtcacacccaaaataaaggacattagtgtatcaaagagatgtctgcactcctatgtttgttgcagcactatgtacaataactaagatttggaagcaacttaagtgtccatcaacaggaaaatggataaagaaaatatggtgcatatacacgatggagtactatttagccataaaaaggtgacatacagttatttgcaacaatatggatgaaactggagatcattatgttaagtgaaatatgccaggaagagaaagacgaacatcatatgttcacacttagttatggaatctaaatttaaaaaaaatgaattagtgggcatagagagtagaagaatcgttaccagaagctggcaagtgtagtggaggggctgaggaaaagtggggatggttaatgggtacaaaaaaagttggttagaatgaatgaataagacctactgtttgatagcacaaccgagtgactatagtaaattataacttaattgtacatttaaaaataacttaaagattacaattggattgtttgtaattcaaaggaaaatgattgaggtgatgaataccccattctccgtgatgtgcttatttcacattgcatgcctgtatcaaaacgtcttaagtaccccataaatatatacacctactgtgtacccacaaaaattaaaaataataaaaaataaaactgaactatgcttcatgataaaaactcttgttaaattagttgtagaaagagcatacatcatcacaataataaccataacatacctcatcacaataatgaccatatatgataaacacacagcaaacatcataatgaatggggaaaacctgaatgtgtttcccctaagaactgggcaactatgctcactttcactagtcttattctacatagtactggaagtcctagccaaagcaattaggtaagagaagtaaataaatgacattcaaattgggaaagagaaagtcaaaaggtttctctttgaagatgacttaatcttataagtagaaaaacctaaagactccacccaaattcccttagaactaatacacaaattcactgaagtggcaggatagagaatcaacatacaaaaatcagtagtgcatttacataacaataataaatcagctgaaaagatttcatgaaaccagtccctaaaagggacagctacaaaaataataaaatgcctaggaataaggttaaaaaaaaggtgaaatatttctacaataaaaattttaaaacataggtgaaataaattgaagaggacacaaacaaatggaaagtcattctatgtacatgaattagaagaattaatattattaacatggccatactacccaaagcgatctacagattgaatgcaatccctatgaaatcaccaaagaaaattttcacataaatagaaaaaccattctaaaatttgtatggaaccaggaaagaccccaaatagccaaagcaatgttaagcaaaaagaaaaaaagctagatgcatcacactatctcacttcataatatcttactacacaatagtaagcaaatagcatggtattgatataaaagcagacacatagttcaatggaaaagaatagagaacccagaaattaatccacacatttatggccagctcattttcaacaaaggtgccaagaacatacattggggaaagaataccctcttcaataaatggtgctaggaaaactggatattcatatgcacaataatgcaactagatcattgtctcctaccaaaatcaacttaaaatagataaaagactaaaacgtaaaacccaaaactatacaactactagaagaaacctttgaagaaaggcttcttgatgttggtctaggcaaatattttatgggtaagttttcaaaaacacaggcaacaaaaacaaaaatatgtaaatgagactatatcaaaataaaaaccttctgtacagcaaagaaaacaataaacagagtgaagagacaacctgtaaaatgggagaagatatttgcaaactattcatccaacagggacctaatagccaagctatacaaaaaactcaaacaactgaacagctaaaacataaacaatggccaaaatatctgaatatacattttttcttaaaaatataaacaaatggccaaatgtatgtaaaatgatcaacatcactaatcatcaggaaaatgcaaatcaaaactacaatgacatgtcatctcatccgacttagaatgactattatcaaaagcacaaaaacttacaaatgctggggaagatgcataaaaaagaaaactcatacactgtttgtggttgtattagataattatgggttgctatgaaggcatacctgagactggataacttataaagaaaatcatttggcttatagttctgcaggttgtacaagcatggaaccagcatatgaagcttctggtgagacctcagggagcttttagtcatagaagaaggtggacagggagccagcatgccacacggtgaaaaagggagcaagacaaatgccagcctttttttttttttgagatggagtctctctctgtcgccaggctgcagtgcagtggcatgatcccatttcactgcaatctccacctcccgggttcaagcaattctcctgcctcagcctcccaagtggctgggactacaggcatgcaccaccacgcccagctaatttttttgtattttagtagagatggggtttcaccatgttggcccagatggtctggatctcctgacctcgtgatctgcccccctgagcctcccaaagtgctgggattacaagcgtgagccaccgcgcccggccatgccagcctcctttaaacaaccagctgtcatgtcaactgatagagtgagaacccactcattagcatgaggacagcaccaaggcattcatgagggatacacccccaagacaaaatcaccccctgccagaccacatctccaacattggggatcacattttaacatgagatttggaggggataaacatccaaactgtatcagtgagaatgtgacttaatccagctattgtgaaaaatagtatagaagtttttcaaaaaactaaaatataagtaccttacagcccagcaattccactgctgggtatttattcaaaggaaaggaaatcagtatatgcttattgcagtttattcacaataggcaagatataggctcaatataaatatctattaaatgatgaattgataaagaaaacatggtatgtatacacaatgaaatattattcacccataaaaaggataaaatcctgtcattcagagcaacatacataaatctgtaagacattatgttaaatgataattataaatgcctatcaatgatggactagattaaaaaaaaagtggtacgtatacaccatggaatattatgcagccaaaaaagaaaaagatcaattcctttgcagggacatgggtggaactggaggacattatcctcagcaaactaacacaggaagagaaaaccaaatactgcatgttctcacttataagtgggaactaaatggtgagaacacatgggcacataaaggagaacaacacacactggaagcttttggaagttggagggtgagaggagggagataatcagaaagaataactaatgggtactaggcttaatacctaggtaatgaaataatctgtataacaaacccccatgacacaagtttacctgtataacaaacctgcacttgtatccctgaacttaaaataaaagttaaaaaaaagaattataaataccacatattctcactcatatgtggaagctaaaaagtattgagctcataatagagaggagaattgttcttagagcctagaaataatcgagaaaggaaaggatagggagaggttgattaacatatacaaagttactgctaaatgggaagaataagttgtaatgttctgtagcactgtgaggtaaatatagttaaccaaaatttagtgtatgttttcataaagctagaagagggtattttcaatgttcacaacagaaagaaatgataaatattcaaggtgatggatatgctaattatcctgatttgatccttacacattatatattacacatgtatcaaaatctcactctgtatcccataaataggcactgttgttagatgtcaactaaaaataaaaagaaaatattgtatgacattgtattgctttatttgctttattgctttggtctggaactgaacccacaattcttagaggcatgtttttatcagctaccaggtgcttggcacctggggctggcatagctaatcagaaaattcaatccattctaggagagctgagggagtttgcttgggattttttccccctgatttaataccctaaaagttgtcaaaaagttaccaaacattctgtctccaactccaccagttataatgatccacctggtcttccatcactcttcaatgtccaggtcatgaatttccaatcatttagccatagccagataaccatctcagacagagatggaagaataactattaaaggaagtataggatgccactagtgccatagccaattgtgacacctgggatgagtttaacctagaagagtaaccatgggactccaaatatcacttaaatagtggcccagaatgcatcagagcattccaacatgcaaatgcataccaaatcacttcagtccctggtccacttctcagttccagctctaactcagtcttcctgtgcctttaattggtgcagaacccatcactcctagatcatagctgatatatattcagagcttctattactaagtacaggttctccttgacatataatgggtttatgtcctgctaaacccattgtatatgcccattgtaagctaaaagtattatgtcaaaaaatcatttgctaaaccaaaccgatcaaatatcatagcttagcctagcctatcttaaatgtactcagaacacttacattagcctacacttggagaaaatcatccaaaacaaaatgtattttgaaatagagtgttaaatatctcatataatttattgaatactctgctgaaagtaagaaacagaatggttgtatgagtactcaaagtacagtttctactgaatgtgtatcactttcatactattgtaaagtaaaaaaaaatcataaatcaaatcactgtaagtcacgggccatctacatattttgggaaagtctcttcatttcttcatatcatacttgcctgaaaagtaggccattatttattaaactcctatcttccttcctattattccttcaaataagctcactgatttctttgtgttttaggtatattaaccattgacaaatagatgaaggaaacaaaaatagcaaatatgggcattgagaaaagtttaagattctgacaaaattacagatatgctagtttagtccttctgaatgc

SEQ ID NO: 8430 - DNA, 15376 bp, artificial
  synthetic oligonucleotide
tgttgtcagacatcgtattagaactctcacgagttatagaccttactaagagtaatttccattagtctggttacattccaattatcatggcgccttatgaagaaaaaagataagccagttttgaaaactggtggccataatttaatttcatgacaacaaaataagttgacatagtaaatttatggcctatctgtattttacttaatggtataataccatgccagataacttacttgaaacttatcccataaccaagtaatagatgaacttctctggattactgcaatatgaataattttatctcttggaccatcaatcatgatatgcccaacataacaaaaccaatgttatgagaccaagaataggaaatgggaagcatcttttttaaaaaaaaatgtattttaggccagacggggtggctcacgcctgtaatcgcagcgctttgggaggccgaggcaggcagatcacgaggtcaggagatggagaccatcctggctaacacggtgaaaccctgtctctactaaaaatacaaaaaaaaaaaaaaacaaacaaacaaacaaaaaaaactaaccgggcgtggtggcaggtgcctgtagtcccagctacttgggaggctgaggcaggagaatggtgtgaacctgggaggcggagcttgcagtgagccaacattgcgccactgcactccagcctgggagagagtgcgagactctgtcccaaaaaaaaaaattattttagttttaggggtacaagtgcaggattgttttatagataaactcgtcacagtgttttcttgtacagattactacgtcactaaggtactaagcctagtgcccaacagttgtttctttcttctccttttccttcttccagcctccaccttcaagtagaccccagtgcctgttgttctctcttttgtgtgtgtctatgagttctcatcatttagctcccacttataagtgagaacattcggtatttgattttctgtttctgtgttagtttgctaaggataatggcctccagctacatctgtgttcttgcaaagacatgatctcattctttttatagctgcatagtattccatggtgtatatgtaacacattgtctttatccaatctgtcattgatgggcatttgggctgattccatatccttgctattgtaaatagtgctacaatgaacattcacatgcatgtgtctttgtggtagaatgatttataattttgtgggtatatacccagtaatgggattgctgggtggaatggtagttctgattttaattgtttgaggaaaccccacactgatttccacattgtttgaactaatttacactccaaacaacagtgttaaagtgctcccctttgtctgcaacctcgccagcatctgctattttatgacattttaataacagccatctgacaggtgtgagatggtatctgattgtgattttgctttaaattttccttttttttaatttcaatttttagtttttttttattattatactttaagttttagggtacatgtgcacattgtgcaggttagttacatacgtatacatgtgtcatgctggtgcgctgcacccactaactcgttatctagcattaagtatatctcccaatgctatccctccccctccccccaccctacaacggtccccagaatgtgatgttccccttcctgtgtccatgtgatctcattgttcaattcccacctatgagtgagaatatgtggtgtttggttttttgttcttgcgatagtttactgagaatgatgatttccaatttcatccatgtcctaaaaaggacatgaactcatcattttttatggctgcatagtattccatggtgtatatgtgccacattttcttaatccagtctatcagtgttggacatttgggttggttcccagtctttgctattgtgaataatgccacaataaacatacgtgtgcatgtgtctttatagcagcatgatttatagtcatttgggtatatacccagtaatgggatggctgggtcaaatggtatttccagttctagatccctgaggaatcgccacactgacttccacaatggttgaactaatttacattcccaccaacagtgtaaaagtgttcctatttctccacatcctgtccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccacttttggatggggttgtttgtttttttcttgtaaatttgtttgagttcattgtagattctggatattagccctttgtcagatgagtaggttgtgaaaattttctcccattttgtaggttgcctgttcactctgatggtagtttctcttgctgtgcaggagctctttagtttaattagatcccatttgtcaattttgtcttttgttgccattgcttttcgtgttttagacatgaagtccttccccatgcctatgtcctgaatggtaatgtctaggttttcttctagggtttttatggttttaggtctaacgtttaagtctttaatacatcttgaattgatttttgtataaggtgtaaggaagggattcagtttcagctttctacacatggctagccagttttcccagcaccatttattaaatagggaatcctttccacatttcttgtttttgtcaggtttgtcaaagatcagatagttgtagctatgcggtgttatttctgagggctctgttctgttccattgatctatatctctgttttggtaccagtaccatgctgttttggttactgtagccttgtagtatagtttgaagtcaggtagtgtgatgcctccatctttgttcttttggcttaggattgacttggcaatgcacactcttttttggttccatatgaactttaaagtagtttttttccaattctatgaagaaaggctttggtagcttgatggggatggcattgaatctgtaaattaccttgggcagtatggtcattttcacgatattgattcttcctacccatgagcatggaatgttcttccatttgtttgtatcctcttttatttccttgagcagtggtttgtagttctccttgaagaggtccttcacttcccttgtaagttggattcctaggtattttattctctttgaaacaattgtgaatagaagttcactcatgatttggctctctgtttgtctgttgttggtgtataagaatgcttgtgatttttgtacattgattttgtatcctgagactttgctgaagttgcttatcagctgaaggagattttgggctgagacaatggggttttctagatatacaatcatgtcatctgcaaacatggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgcccattcaatatgatataggctgtggatttgtcatagatagctcttattattttgaaatatgtcccatcaatacctaatttattgagagtttttagcatgaagggatgttgaattttgtcaaaggctttctctgcatctattgagataatcatgtggtttttgtctttggatctgtttatttgctggattacatttattgatttgtgtatattgaaccagccttgcatcccagggatgaagcccacttgatcatggtggataagctgtttgatgtgctgctggattcagtttgccagtattttattgaggatttttgcatcaatgttcatcagggatattggtttaaaattctcttttttggttgtgtctctgcccggctttggtatcagaatgatgctggcctcataaaatgagttaaggaggattccctctttttctattgattgaaatagtttcagaaggaataatatcagttcctgcgtttacctctggtacaattcggctgtgaattgatctggtcctggactctttttggtgggtaagctattgattattgccacaatttcagatccttttattggtctattcagagattcaacttcttcctggtttagtcttgggagagtgtatgtgtcaaggaatttattcatctcttctagattttctagtttatttgcgtagaggtgtttttagtattctctgatggtagtttgtatttctgtgggattggtggtgatatcccctttatcattttttcttgcgtctatttgattcttctctctttttttctttattagtcttgctagcggtctatcaattttgttgatcctttcaaaaaaccagctcctggattcattaatttttgaagggtttttgtatctcgatttccttcagttctgctctgattttagttatttcttgccttctgttagcctttgaatgtgtttgctcttgcttttctagttcttttaattgtgatgttacggtgtcaatttttgatctttcctgctttctcctgtggacatttagtgctataactttccctctacacactgctttgaatgtgtcccagagattctggtatgttgtgtctttgttctcattggtttcaaagaacatctttatttctgccttcatttcattatgtacccagtagtcattcaggaggaggttgttcagtttccatgtagttgagcagttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttccggtggagagttctgtagatgtctattaggtacacttggtgcagagctgagttcaattcctgagtatccctgttgactttctgtctcattgatctgtctaatgttgacagtggggtgttaaagtctcccattattaatgtgtgggagtctaagtctctttgtaggtcactcaggacttgctttatgaatctgggcgctcctgtattgggtgcatatatatttaggatagttaactcttcttgttgaattgatcattttaccattatgtaatggccttctttatctcttttgatctttgttggtttaaagtctgttttgtcagagactaggattgcaacccctgcctttttttgttttccatttgcttggtagatcttcctccatccttttattttgagcctatgtgtgtctctgcatgtgagatgggtttcatgaatacagcacactgatgggtcttgactctttatccaatttgccaggctgtgtcttttaattggagtatttagtccatttacatttaaagttaatattgttatgtgtgaatttgatcctgtcattatgatgttagctggttattttgctcattagttgatgcagtttcttcctagtctcgatggtctttacattttggcatgattttgcagcggctggtaccggttgttcctttccatgtttagtgcttccttcagcagctcttttagggcaggcctggtggtgacaaaatctctcagcatttgcttttctgtaaaggattttatttctccttcacttatgaagcttaatttggctggatatgaaattctgggttgaaaattcttttctttaagaatgttgaaaattggcccccactctcttctggcttgtaaggtttctgccgagagatccattgttagtctgatgggcttccctttgagggtaacccgacctttctctccggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccgtcactttcaggtacaccaatcagacgtagatttggtcttttcacatattccgatatttcttggaggctttgatcaattctttttattcttttttctctaaacttcccttctcgcttcatttcattcatttcatcttccattgctgataccctttcttccagttgatcgcataggctcctgaggcttctgcattcttcacgtagttctcgagccttggttttcagctccatcagctcctttgagcacttctctgtattggttattctagttacacattcttctaaattttttcaaagttttcaacttctttgcctttcgtttgaatgttctcccttagctcagagtattttgatcatctgaagccttcttctctcagctcattgaagtcattctccatccagctttgttccgttgctggtgaggagctgcgttcctttgtaggaggagagttgctctgctttttagagtttccagttttactgttctgttttttccccatctttgtggtttgtctacttttggtctttgatgatggtgatgtacagatgggtttttggtgtggatgtcctttctctttgttagttttccttctaacagacaggaccctcagctgccggtctgttggagtaccctgcagtgtgaggtgtctgtgtgcccctactggtgtgtggctcccagttatgctgctcggggatcagggttcagggacccacttgaggaggcagtctgcccattctcagatctccagctgcatgctgggagaaccactgctctcttcaaagctgtcagacagggacatttaagtctgcagaggttactgctgtctttttgtttgtctgtgccctgctccaagatgtggagcctacagaggcacacagggctccttgagctgtggtgggctccacccagttcgagcttcctggctgctttgtttacctaagcaagcctgggcaaaggtgggcacccctcccccatcctggctgccgccctgcagtttgatctcagactgctctgctagcaatcagcgagactccgtgggcgtaggaccctccgagccaggtgcgggatacaatctcgtggtgtgccgttttttaagcctgtcggaaaatcgcattatttttgggtgggagtgacccgattttctaggtgcgtccgtcacccctttctttgattaggaaagggaactccctgaccccttgcgcttcccgagtgaggcaatgcctcgccctgcttttgctcgcgcacggtgcgcacacccactgacctgcgcccactgtctggcactccctagtgagatgaacccggtacctcagatggaaatgcagaaatcactcatcttctgtgtcgctcaggctgggagctgtggaccagagctgttcttattccgccatcttggctcctccctcctgctttgaatttttctaatgatcagtgatattgaggtttttttcatacgcttcttggccacatgtatgtcttcttttgaaaaatgtccgttaatgtcccttgcccagtttttaatggggttgtttctttcttgtaagctgctgtaagttctttatatatggtggatattaaaatttttcagcttcatagtttgcaaatattttctcccattctgtgggttgtcgattaatctgttgatagcttctattgctgtatagaagatctatagtttaattagatcaaatttgccaatttttgcttttgttgtgattgcttttggtgtcttcattgtgaaatatttgcccattcctatgtccagaatggaatgcataggtcttttttcagagtttttacagctttgggttttacatttaaatctttaatctatcttgacttggtttttgtatatgatacaagagagcagtccagcatcagtcatctgcatatggctagccagttatcccagcaccatttatttaaaatggagtcttttcctcattgcttgtttttgtcatctttgtcgaagaacagttggttgtaggtgtgcagcactatttctggtctcgctattcttttccattggtctatgtgtctgcttttgtactagtaccatgctgttttgtatattgtagccgtgtagtatactttgaagttgagtagtatgatgcctccagttttgttttttttgcttaggattgccttgattattcagggttttttttaatataaattttaaaatagctttttctagttctttgaagaatgtcattggtagtttgatagaaatagcttgaatctgtaaatagctttgggaagtatgaccattttaatgatattgattctatctgtaaacatgaaatgtttttctttttatttgtgtcatctctgatttctttgagcagtattttgtaatttttattgtaaagatcttttatctccctggttagctgtattcctagggactttatgtttgtgtagcaattgtgaataacattgcattcctgatcggactctcaacttggctgctgttggtgtataggaatccttgtgacttttgtacatgattttgtatcctgaaactgctgaagttgtttttcagcttatatggctgttgggctgagactatgtggttttctatatatggaatcatgtcatctgcaaacagggatagtttgatttcctctcttcctatttggatgccctttatttctttctcttgcctgattgctctagccaggacttccaatactatgttaaagattattgatgagaaaaggcattcctgtcttttgccagttttcaagggggatgcttccagcttttgtccatttggtatcatgttagttgtgggtttgtcatagatgactcttttattttaaggtatgttccttaaatatctagttcataaggagtttttaacagatagggatgttaagttttatagaaagtcttttctgcatctattgagataatcatgtggattttgtctttatgtttacatgattactgttacatatactgatttttgtatgttgaactgatcttgcatcttgaggatgaagcctacttgattctgtttggttagctttttgatttgctgctggatggggtttgcaattttttttgttgaggatttttgcatcaatgttcatcaaagacattgccctgaagttttctttttctactgtgtctctaccaggttttggtatcagaatgatgttggcctcatagaatgagttgggaaaaagtccctcctcctaaattttgtggaatagttttagtgggaatggcaccagatcttctttgtacatctgggagaattcagctatgaatccatctggtcttggatttgttttggttgacactgtatttattactgattcaattttggagctctttcttggtctgttcagggaatcaattttttcctggttcagtcttggaagggtgtttgtgtcaagaaatttactcatctcttctagattttatagtttgtgtgcatagagttgtttatagcagttttctatagttattttttctctgcggtgtcagtggtagcattctctttttcatttctaattatgtttatttgaatcttctatattttttctttattagtctagctaatggtttatcattaattttgtcaagaaaacaactcctagatttgtttattttttgaatggtttttgtgtcttgatttctttcagttcagctccgatttttatttttatttttggtcttctgttagttttggagttggtttgctcttgcttctctaattctttcagttatgattttaggttgttcatttagaatctttctattgttttgatgtgggcatttagtgctatgaattcccctcttaacactgccttagctgtgtccagatattccagtaagttgtatctttgttcttgttagtttcaaaaaacttcttgatttctgtcttaatttcattatttacccaaggtttatttggcagcatgttgtttaatttccatgcaattgcatggttttgaacaatttttttaagtcttgacttctatttttattgtgctgtggtgctaaaatgagttctaaatcttgaaaaaaattattgaaatacatcaaaacaaaacttccttaaagcctaaatctcacaggacctataaaatagcaacacaatacatttttaagaaaccaaggtattcaggcaacaaatagcatgatgaataaaatggtagctcacatctcaatactaacattgaatgaaaatggcctaaatgctctacttgaaaaatacagaatggcagaataaataagaatttaccaaccaagtatctgctgtcttcaagagactcacctaccacataaggacttacataaacttaaggcaaaggaggagaaaaagacattccatgcaaatggagaccaaaagtgagctggagtagctattcttatatcacacgaaacaaacttcatagaaacagtggttggagatatacctaatgctagatgacacattagtgggtgcagcacaccagcatggcacatgtatacatatgtaactaacctgcacaatgtgcacatgtaccctaaaacttagagtataataaaaaaaaaaaagacaaagaggggcattatataatgatcaaagttcttgtccaacaggaaaatatcagaattctaaatatatatgcacctaacactggagctgtcaaatttataaaacaattactactaaacctaagaaatgggataaacagcaacacaataatagtgggggacttcaatactccactgacagaactagacaggttataaagataaaatttaaccaagaaataatggacataagctataacctagaacaaatggacttaacagatgtttacggaacatcctacccaacaactgcagaatatacattctattcatcagtgcgtagaatactttttaagacagaccttatgatagatgactaaacaagtctcaataaacttaagaaaattgatattatatgaagtactctctctgaccacagtggaataaaattcgaaatgaattccaaagggaaccttcaaaagtgtgcaaataaatggaaattgaataatttactcctgaatgatcgttgagtcaacaatgaaatcaagatggaaatttaaaaattatctaaactgaacaataatagtgacacaatctatcaaaacctctgggatatggcaaaggcagtgctaagagaaaagttcatagccttagatgcttacatgaaaaagtttgaaagaacatgattgatgatctaaggtcacacctcaagcaactagagaaacaagaacaaaccacacccaaacccagcagaagaaaaaacaaaaacaaaaaaaaaaaacaagatcagaacagaactaaatgaaattgaaacaaaaaaaaatccacaagacaaatgaaagaaaactctggttctttgaaaagataaataatattgatagaccactagcaaaattaaccaagaaaacaacatagaagatccaaatatgctccattagaaaagaaatggggacaaaacgcagtggctcatgcctgtaatcccagcactttgggatgccggggcaggcagatcacgaggtcaggagttcaaaaccagtctggccaacatagtgaaacttcgtctctaataaaaaattagctgggcttggtggcaggcgcctgtgatcccagctactcaggaggctgaggcaagaggttgcagtgagccgagattgcaccactgcactccatcctgggtgacagtgcaagacaagactctgtctccaaaaaaaaaaaaaaaaagaaaaaaaaagaaaaagaaagaaaacaaatgggaaatactagaaccaaccaacaccacataaatacaaaagattattcaaggtttctatgagcaactttacaagcataaactaaaaaacctagagaagatggatacattgctgtaaatatgcagccctcctagcttaaaccaggaagaattagaaaccttgaacctaccaataacaagcagcgagattgaaatagtaattttgagatttccaaaaataaaaaagtccaggaccagagagattctcaactgaattctatcaacattcaaaaacgaatttgtaccaatctatttgatactattccacaagatagagaaagaaggaatcctccctaaatcattctatgaatccagcatcacactaataccaaaaccagggaagaacataacaaaaaaaagaaaactacagaccaatatctctgataaacagagatgcaaaactccttaacaaaataatagctaatctaatctaacagcatatcaaaaagatagtccaccatgatcaagtgtgtgtcataccagggatgcagggatggtttaacatcagcaagtcaataattgtgatacaccacttaaacagaattaaaaacaaaaatcacatgattatctcaacagatgcagaaaaagcacttgacaatatccagcatccctttatgattaaaaccctcagcaaaatcagcatagaaggacataccttaacgtaataagagccatctatgataaacccacagccaacataatactgaatgggaaaaagctgaaagcattccccctgagaactggaacaagacaaggatgcccactataaccactttcaatcagtatagtactcgaagtcttatccacagcaatcaaacaagagaaagcaataaagcgcatccaaatcagttaaaaacaaacaaaaaacgccaaactgttgctgtttgctgatgatatgattgtatacctagaaaaccctaaagattccttcaaaaaggtcctagaactgataaatgaattcagcaaagtttcaggatacaaaattaatgtgcacaatcagtagctctaccacacaccaacagcaactgagctgagaatcaaatcaagaactcaaccccttttacaatagctgcaaaaaatcaaatatatacaaaccaaggaggtgaaagacctctacagggaaaactgcaaaactactgaaagaaatcatagatgaactaaacaaatggaaaaacatcccatgctcatggatgggtagaatcaatattgtgaaaatgaccatactgccaaaagcaatctaaaaattcaaggcaattctcattaaaataccaccatcattcttcacagaactaaaaaaaaaaaaatcctaaaattcatatggaacaaaaatgagtccacatagccaaagcaagactaagcaaaaagaacaaacttggaggcatcccattactcaacttttaactatactataaggccatagtcaccaaaacagtgtggtactggtataaaattaagcatgcagaccaatggaacaaaatagagaatccgaaaataaacccaaatacttaacgccaatttatttttgacaaagcaaataaaaacgtaaactgaggaaaacacatcctatttaacaaatgttgctcggataattggcaagtcacatggagaaaaatgaaactggattctcatctctcaacttatacaaaaatcaactcaagctgcatcaaaaacttacatctaagacttgaaattataaaaattttacaagataacatcataaaaacttttctagacattggcttaggcaaagacttcatggccaagaacctaaaagcaaatgtaacaaaaacaaagataaatagatgtgacttaaataaaacgctcctgcacagctaaagaaataatgagcagagtaaacagacaacccacagtgttggagaaaattgtcacaatctgtacatccttcagaggactaatatccagaatctacaagaagctcaaggaaattagcaagataaaaaaagaaaagagtgacatcaaaaaataggctaaggacatgaatagacaattcttaaaggaagatgtacaaatagccaacaagcatgtgaaaaaatgctcaacatcattaatgatcaaataaatgcaaatcaaaaccacagtgtgttaccaccttactcctgcaagaatggccataatgaaaaaattaaaaaaaaataattatagatcttggcagggatgtggtaaaaagagaacacttttacactgttggtgggaatgtgaagtagtacaaccactgtggaaaacaatgtggaaacatcttaaggaactaaaagtagaattatcatttgatacatccatcccaccactgggtgtctacccagaggaaaataagtcattatgcaaaaaagatacttgcacacacatgtttatagcagcataatttacagttgcaaaattatgaaatcagcctaaatgtccattgatcaattagtggataaagaaattgtggtatacatatagaatggaatactgttcagccacgaaaaggaaaaaattaatggcatttgcagcatcctgaatgaaattgaagaccattgttttaagtgaagtaactcaggaatggaaaaccaaaaatcctatgttctcactcataagtgggagctaagctatgaggatgcaaaggcgtaggaatgatacaatggacgttggggccttgggggaaagggtgggagggggttgaggaagaaaatactacaaatttggtacagtgtatactgctaggttaatgggtgcactgaaatctcagaaatcaccactaaagtagttactcatctaatcaaatcccacctgtttcccaaaacctatggaaataaaaataaaataaaataaatattcagcctaatcgcatttttgtagagcatctatgtgtgctggggttccactccagcccccagttgctttggactctccaaagcacaacggcaaaaacagccaaggcaggcaaaacagcaaagatggtggcccacccctccccttgggagctgtgtcccagggaggttttaaactgtttttggttggaaaacaccagcagggtttactggacaccctggttgagagattccacccagtgaagagaaatgggattcaagatccatgtgactaagcagcctgatcacttctccttagagcactaggctgtgctgggggagctctcctgcctacagttgccttggactccctgatcagtctttgttgttgtaagtatagaagaagaatgactagacagatagcaaagtggatgtataatactttgaggggcttgctaatcaccaggataatctactatctttttattttatatccattctatcattggatcttcaaaattacctatatatttttaattttcttactgaagcctcactctttgtggttctgcaaaacaaacaaaaaaaagaactctttatcctttctaagtgaaaaagaaataataggaagtttcaatgcctc

SEQ ID NO: 8431 - DNA, 1345 bp, artificial
  synthetic oligonucleotide
actcttaatcactttactcttgttcccacatcatttatggttattaaatagtattcccaggatgtctctactaacctaaaatgaaaggcagtaagcaaaaagtaaggaaataaaattggagtctatttggggactctatatttcccttaaactcagagaaacttatcccaccataggaagaaaaagcaaaagccacaattttttcataaaggagagatggagagactaaacttgaatttttgttagatttcttcacaagatagtacaatataaaatgttctaggggaagtttcttgggataattttgattttttggtatcttaaatacagtcttaacaagatataaagtggaaaaaatgtaacatttctactgagcttttgagctttatgctccaaaagtgttactcatcctaccttcaccccccactgtcactgccatctccacaatttaacaatccaagaagtagaagaatctaccttttgggaaaagtgagtctttgcaatcatttcaaaacataagaacatactatttctcccacgatgatttcccacctcaatttcccatcaatgtgtgtttcctaatgcctaggctgtcagcagtatttctgctaagaaaagttgcttcccaattctaccttgaaggtagaattcagtctcaagtggatggtaatgctgcaaacctcaataactctgccagcaaatgggacagagaggctacctggccaatgaattctgtggtaaggtttctgtggaagatatcatcttaaaagaacacatcggtcagatctgtttcacatcacatgggataaatgagggcaaaaagtgtgagtactggggagaggatggaagagagtgaacagtgcatgaacagagggtatacatctatttcaagaagggagtgacaaaaggaagacaacatacaatctaacacttctctcctgacccaaataatataatgacaggtttgcagaaaagaatctgacttcttggatatattccaccagagaaatcacaaagaaactgatccatctgtcacaaaattctcaggtgtatatcttccctctgcctgccaattaagcatagagcactagaaaataaaatacctgccatatgtacaaatgctaacctattgctaaaggcttacagaagaaggttttgtcctcccttactcattccataaccaagaagttcgtcctctggtcaaacccacatctttcttcgataccaacaaaacccaatttcctttagatggtctgtctgcctgggcttaggtttggggttcagaaacacttaatcacactgtattagttcccctcgactcatccttctgatgacctcttagatg

SEQ ID NO: 8432 - DNA, 1033 bp, artificial
  synthetic oligonucleotide
aagcaatagctcttccattacctatttatatttatcctttgtggcttaattcaaattttcatcttgaggaaaaaagcaacagacacccaatttctgtgaggtaagtacattgtataaaagaagcttagagaggttaagtgacttgcccaagatcacatggtacataggggattgagccaggaataaatcctagaacttcattctagatctcataatccttcgttgagcccacatgtttactctgtatgcatgttaactcagtttctgggtatgacccatcagctgggcaacgatattgtggtatgtgctgtctagatgcttgtgtgcagcatcacaattctagctgccaggccaaagaaacatcaggctccaggaccaagaggattacaagattactgggagtataaatgtctctggctcctggccacccactgatgtgatttgtgggagataagtgccccaacagtcctattgctgtagctatctgttgctaccacttctagttagacgaacgccagaggagtgtacttgtgtatcaaaatgcatgcccaggtatcatcattatcataaaactttcaatggtcttcgttgagactactttgcttatggattatctaagacacatatttcatcctagtcaccaccaccttccaccactcaatcaagactcaatctgattatctaaaaggattttagcatcatcctaaactgaacagaattttaaagttaaagcaaataatactaaccaaaaacaccacataatatgttataaagccaaacccaaatgcttttgagattcctgctatttggaactttcattatttgggattgctgctatttgggattctgactgtttgggataatctccatttctttacccctttaggtgggcaggaatcatttaaaagcagatggcaaagacggcctcctggctcctggttagttggtggttagcaactgtcagggtcctgactcagcagagtataggaaggaactgcatagtcacttagcagtggaccaactagaaaactgc

SEQ ID NO: 8433 - DNA, 16049 bp, artificial
  synthetic oligonucleotide
tctgcataactggtatatgctgcatacctagtgaaacaaagtaaacatccaaaaataaaaatataccctcattcccccttctcagcatgactgccaatattgttggtcgcctactggatttcatagcactcttgtaaagctctgtatttcctcccaggaatgatcaaaggacctaatgtggtaacttctgagggtcttctaccttccttgacaactctgttctaccagtagccatagacattatactgaaaattggctggaatgccaaagcagtaatcagacatttaataccctgcttacatagaaacatcccattaaaattacctcctccatcgggccaatatgtctgactagaagcagctgctttcagaggctcccttcaaaacaaaccataataagcatatgaatccttcaccagcaaccaaggtatccaggttctctcatcaaagttgactagaaggctgatgtgactcatggagagaaggcagaacagtgtggtgtggtggcccacctgagagccacacagggaaggggaaccccttccccacagtcaagggaggcagtgagtgagcgtgctaccaagccaggaaaactgtgctttttccatgaaattgtgcaacccatggatcataagaacccactcgcaaaaccatgccaccagggcctaacgtcccaaccccagaacgtgcagattcttacaacctcccagctggaatctgctaaaacctattgaactccccgggggaggggttaccagcaccaactgtggctgcctgctgtctaagctatttgagctccttgggggaggggcagcagccagcactgggactcacaactgcctaacacgctaagctccctgggagtggggaagggcagtacccatttctatagctccaggctgtgcttctcccctgctggagccagaggggctggagtgcttggtcccaagacttgtccctacagctcaacacactgattgtgcagtctgcagccagagtgcctcttcaggcctaaatctgactcatccttcctcattgggtggggcttccctgcagtatctctaataactccagccagaggctcagggacagaatttggatctccctaggcctgatcccctagtgggagaggtggctgcagtctctgcagaccagcagacggcctctcctcctggtagttctgaggaatccaggaagcccagacgaatgggttactccccagtgaagtgcacactctccaccaagagacaaagtgctttgttaaatgggtcctgctccccatgccatcaaactggctgagatcttccaacagaggttgtagacactctacacatgagcaatcctactggcataaggttggtgcccctcgaggtcagaggtcccagaagaaggagcaggcaaccatctttgctgttctccagcctccttgagtgacatctccaggctcaggagcaaatcagatgaatagggcctgaagtgaagccccagcaaactgcagcagccctatagaagagggacttgactattgcaagaaaaaagaaacaagcagaaagctacagtaacagcatcatcaacaacagcaaaaaaggccccaacaaaaacctcatccaagcatcggcctcaaagaccaaaaataaaaaaaaactcaggaagatgagaaataatcaacgaaaaaatgctgaaaatccaaaagaacaaagtgtctcttctctccaaattatcacagtgtctttccatcaagggtgcagaactggatggagaatcagatggacaaattggcagaagtaggcttcagaagatgagcaataaaaaattacactgacctaaaggagcaagttctaacccaatgcaaataagctaagaaccttgataaaaggttaaaggaattgctaactagaataaccagtttagagaggaatataaatgaccttatggggctgaaaaacatagcacaagaactttgtgaagcatacacaagtatcaacagctgaactgaccaagtggaagaaaggatatcagagtttgaagaccaccttactgaaataagacatgcagacaagaatagagaaaaaagaatgaaaaggaatgaacaaagcctccaaaagatatggaaattcataaaacgaccagacctatgattgatcagagtaccagaaagagatggggacagtggaaacaagctggaagacatacttcaggatattgtccaggatatcttccccagcctagccagacaggccaacatacaaattcaggaaacatagagaacaccattaagatactccatgagaagttcaaccccgagacacataatcatcagattttctaaggccaaaatgaaggaaaaactgttaagggtagccagacagaaaggccaggttacctacaaagggaagcccattagattaacagtggacttctcagcagaaactctacaatccagaagagattgggggccaatattcaacattcttaaagaaaagaattttcaacccagaagtttatatccagccaaactaagcttcataggtaaaggataaataaaatgctttccagacaagcaaagactgaggaattttgttacaaccaggcctaccctgcaagagcccctaaatatggagaggaaaaaccaatacagcccctgcaaaaacacaccaaaatataacgaccaatgacactatgaagaaattgcatcaactagtgtgcaaaataaataaatagcatcatgatgacaggaaaaaattcacacataatagtactaaccttaaataaatgggataaatgccccaattaaaaaacacagactggcaatttggataaggagtcaagacccattggtgtgctgaactcaggagacccatctcacatacaaagacacacacaggctcaaaataaagagaaggaggaaaatttaccaagcaaatggaaacatgaaaaagcaggggttgcaaacctagtctctgataaaacagactttaaaccaacaaagaacaaaaaagagaaaaaaaagaattacataatggtaaagggaacaattcagcaagaagagctaattattctaaatatatatgcacccaaaaaaggtgcacccagactcataaaacaagttcttggaggcctacaaagagacttagactcccacacaataatagccagagatgttaacaccccactctcagtgttggacagatcaacaagacagaaaattaacaagtacattcaggacttgaactcagctctggatcaactggaactagaagacgtttacagaactctctaccccaaatcgacagaatatacatttttctcagtgccacatggcacttattataaaatccaacacataactggaagtaaaatgttccttagcaaatgcaaaagaactgaaataatagcaaacaatctctcggaccacagtacaatcaaattagaacttgggattaagaaactcactcaaaaccacacaatttaatggaaattgaacaacttgctcctgaatggctcctgggtaaataacgaaattaaggcagaaatcaagaagttatttgaaaccaatgagaacaaagagacaacctaccagaatctctgggacacagctaaagcagtgttaagaggaaaatttatagcactaaatgcccacatcagaatgaagatctcaaatcgacactgtaacatcacaaataaaagagctagagaggcaagggcaaactaatccaaaagctagcagaagacaagaaataactaagatcatagaagaactgaaggagataaagacatgaaaaacccttcaaaaatcaatggatctaggtgctggttttttgaaaaattaacaaaatagatcactagatagactaataaagaagaagaagagagaagaatcaaacagagacaataaaaaatgataaagcagatatcatcactgaccccacagaaatacaaacgaccatctgagaatactataaacacctctaaacaaataaaatggaaaatccagaagaaatggataaattcctggatgcatacgacctaccaagactaaaccaggaaaaagtagaatcctttcatagacgaataacaattctgaaattcaggcagtaattagtagcctaccaaccaaaaaaagcccagaaccagacagattcacatctgaattctaccagaaatacaaagaggagctggtaccattccatctgaaactaccccaaaaaaattgaaaaggagaggctccttaattcattttatgaagccaccatcatcctgataacaaaaccgggaagagacacaacaaaaaaagaaaacttcaggccaatatccttgatgaacatcaatgtgaaatcctcagtaaaatactggcaaactgaatccagcagcacatcaaaaaacctatccatcaggatcaaattggcttcattcctgggataaaaggatggttcaacatattgaaatcaaacgtaatccatcacataaacagaaccaaagacaaaaaccacatgattatctctataggtgcagaaaagggccttcaatcaaattcaacattccttcatattaaaaattctcggctgggggtggtggctcacgcctgtaatcccagcactttgggaagccgaggcaggtggatcacgaggtcaggagatcaagaccatcttggctaacatggtgaaacccgatctctactaaaaaatacaaaaaattagccaggcgtggtggcgggtgcctctagtcccagctacttgggaggctgaggcaggagaatggcaggaacccaggaggcggagcttgcagtgagccaagatcacaccactgcactccagcctgggcaacagaacgagactccatctaaaaaaaaaaaaactcaatgaactaagtattaatgaaacatatctcaaaataataagagctatttatgacaaacacacagccaatatcacattgaatggataaaagctggacgcattccttttgaaaaccggtacaagacaatgatgtcttctctcaatactcatattcaatataggattggaagttcttgccggggcagtcaggcaagagaaagaaataaagctattcaaataggaacagaggaattcaagttgtctctgtttgcagatgacattattttatatttagaaaaccccatcatctcagtccaaaacttattgaactgataagcaacttcagcaaagtctcaggatacaaaaccaatgtgcaaaaatcacaagaattcctttacaccaccaatagacaaggagagagccaaatcatgaatgaactccaattcacaatagctacaaagagactaaaatacttaggaacacagctaacaagggatgtgaagggcctcttcaaggagaactacaaaccaccactcaaggaaataagagaggacacaaacgaatggaaaaatattccatcctcatgcaatattttgaccatactgcccaaagtaatttacagattaaatgctattcccatcaaactaccattgacattcttcacagaattagaaaagactattttaaatttctatttttttaattttaagttctgggatacatatgcagaacgtacaggtttgttacataggtatacatgtgccatggtggtttgctacacccatcaacctgtcatctaggttttaagctccgtatgcattagttatttgtcctaatgctctccctccccttggcccccaccccctgacaggccctggtgtgtgatgttcaactccttgtgtccatttgttctctttgttccactctcacttatgagtgagaacaggcagtgtttgattttctgtccctgtgttagtttgctgagaatgatggtttccagcttcatccatgtccctgcaaaggacatgaactcattctttttatgactgtatagtattccatggtgtatatgtgacaaattttctttatccagtctatcatcgatggtcatttgggttggttccaagtctttgctattgtaaatagtgctgcagtaaacatacatatgtatgtgtctttatagtagaatgatttataatttattgagtaggtacccagtaaagagattgctgggtcaaatggtatttctggttctagatccttaaggaatcaccacactgtctaccacaatggttaaactaatttacactttcaccaacagagtaaaagcgttcctatttctccaaattttctccagcatccattgtttcctgactttgtaatgatcgccattctaataggcatgagatggtatctaattgtggttttgatttgcatttctctaatgatcagtaatgatgagcttttttcatacgtttactggccgcataaatgccttcttttgagaagtgtctgttcatacccttcacccactttttgatgaggttgtctttttcttgtacatttgttgaagttccttgtagattctggatagtacaccattgtcagatggattgcaaaaatattctcccattctgtaagttgccaattgactctgacgatagtttcttttgctgtgcagaagctcttcagtttaattaaatcccatttgtaaattttggcttttgttgcaattgcttttgaagttttaatcatgaagtcttttctcatgcctatgtcctgaatggtattgcctaggttttcttccagggtttttatggctctaggttttatgtttaagtctttaatccatcttgagttcatttttgtataatgtgtaaggaaggggccagtttctgtttctgcatatggctagccaattttcccagcatcatttattaaataggtaaccctttccccattgcttgtttttgtcaggtttgtcaaatatcaaatggttgtagatgtgtggtgttatttctgaggcctctgctctgctccattagtctttatatctaattagtgccagtaccatgcctttttggttattgtagtctggtagtattgtttgaaatcaggtagcatgatgcctccagctttgttaattttgcttagaattgtcttggctatacgggctctttttttggttccatatgaaatttaaaatagtttttctaattgtgtgaagaaagtcaacagtagattcatgggaatagcattgaatctataaattactttgggtggcatggccattttcacattatccgttcttcctatccatgagcatggaatgttttttcatttgtttgtgtcctctcttatttccttgtgcagtggtttgtagttttctttgaacaggtccttcactttttttataagttgtattcctacgtactttattctctttgtagcaattgtgaatgggagctcactcgtgatttggccctctgtttgtctaatattgatgtataggaatgctcgtgatttttgcacattggttttgtatcctgagactttgctgaagttgcttatcagcttaagaagtttttggagtgagatggtgggttttcctaaatatacaatcatgtcatttgcaaacagagataatttgacttctctctttctatttcaatatgctttatttctttatcttgcctaattgccctggacagtacttccaatactatgttgaacaggaatggtgagagagggcatcattgtcttgtgccagatttcacagggaatgcttccaggttttgcccactcagtatgatattggctatgtgtttgtcataaatagcttccattttctgctaccttttgaatttggttgctcttgaatctctagttcttttcattgtgttgctaggttgatgaatttagatttttctagctttctgttgagagcatgaagtgctacaaatttccttcttaacactgctttagctgtgtcccagagattctggcatgttgtctcttggttctcattggtttcaaagaagttctttatttctgttttaatttcgttagttactgagtagtcattcaggagcacgttgttcaatttccatgtagttgtgcagttttgagtgagtttcttaatcttgagttctaatttgattgcactgtggtctcagaaactgtttgttatgatttccgttcttttgcatttgctgaggagcattttacttccaattatgtggtcaattttagaataagtgtgatgtggtgcttagaagaatgtatattctgttgatttggggtggcaagttctgtagatctctattaggtccgcttggtccagagctgagttaaagacctgaatatctttgctaattttctgtttcgttgatctgtctaatattgacagtagagtgttacagtctccaacaattattgtgtgggaatctaaatctctttgtaggtctccaagaactttttttatgaatctgggtgctcctgtattgggtgcatatatatgtagaatagttagctcttcttattgcattgattctttaaccatcatgtaatgcccttctttgtcttcttttatctttgttggtttaaaatctgttttgtcagagattaggattgcaacccctgcttttttctgctttccatttgctcggtaaatattcttcaatccctttcttttgagcctatgtacgtgagattggtctcctgaatacagtacaccgatgggtcttgactctttatccaatttgccagtctgtatcttttaattggggcatttagctcatttacatttaaggctaatattgttatgcgtgaattttctcctgtcttcatgataataacaggttattttgcatattagttgatgtagtctcttcatagtgtcattggtctttttattttggtgtgtttttgcagttgctggcactggttttttctttccatatttagtgcttccttcaggagctcttgtaaggcaggcctgatggtgacaaaatccctcagcgtttgattgtctgtagaggattttatttctccttctcttattgtgtccggaattggtgggttcttggtctcactgacttcaagtatgaagccgtggaccgtcgcggtgagtgttacagttcttaaaggcggcatgtctggagtttgttccttctgatgttcggatgcgttcggagtttcttccttctggtggggttcgtggtctcaccggctcaggagtgaagctgcagaccttcgcggtgagtgttacagctcttaaggtggtgcatctggagctgttctttcctcccggtgggttcgtggtctcactggctttaggagtgaagttgcagaccttcgcagtgagtgttacagctcataaaggcagtgtgggcccaaagattgagtagcagcaagatttattgcaaacagagaaagaacaaagcttccacagtgtggaaggggacccgagcaggttgccactgctggctcgggcagcctgcttttattctcttatctggccccacccacatcctgctgattggtagagccgagtggtctgttttgacagggtgctgattggtgcatttacaatccctgagcttgacacaaaggttctccacctccccaccagattagctagatacagagtgtcgacaaaaaggttctccaaggccccaccagagtagctagatacagagtgtcgatcggtgcattcacaaaccctgagctagtcacagggtgctgattggtgtgtttacaaaccttgagctagatacagagtgccgattggtgtatttacaatccctgagctagacataagtgttctccatgtcatcaccagagtagctagatacagagtgtcaattggtgctttcacaaaccctgagctagacacagggtgctgattggtgtgtttacaaaccttgagctagatacagagtgctgattggtgtatttacaatccctgagctagacataaaggttctccatgtccccaccagactcaggagcccagctggcttcacccagtggatcccgcactggggctgcaggtggaactgcctgccagtcttgtgccatgcacccgcactcctcagaccttgggttgtggatgggactgggtgctgtggagcagggggtggtgctcatcggggaggctcaggccacacaggagcccacagagggagtgggagactcaggcatggcaggctgcaggtcctgagccctgccccgcgggaaggcaactaaggcccgccaagaaatcgagcgcagttccagtgggctggcactgctgggggacccagtacaccctctgaagctgctggcctgggtgctaagcccctcattgcctggggctgctctgagtgtggggtctgccaaacccacacccacccagaattccagctggcccacaagcaccatgcgcagccccagttcccactcgtgcctctcccttcacacctccctgcaagctgagggagctggctctggccttggccagcccagaaaggggctcccacactgcagtggtgggctgaagggctcctcaagtgccaccaaagtgggagcccaggcagaggaggcaccaagagtgagtgagggctatgaggactgccagcacgctgtcacctctcattatgaagcttagtttggctggatatgaaatcttggttgaaaattcttttccttaagaatgttgaatattggctcccactctcttctagcttgtagggtttctgcagagagatctgctgttagtctgttgcgcttccctttgtagataatctgacctttctctctggctgcccttaacattttttcctttgttttaaccttggagaatctgactattatgtgtcttggggttgctattcttgaaaagtatcttagtggtgttctctgtatttcctgaatttgactgtttgcctgtcttgctaagttggggaacttctgttggataatatcctgaagtatattttccaacttggtttcattctccccgtcactttcaggtacaccaatcaattgttagtttggtcttttcacaccatctcatatttcttgaaggctttgttcattccatttcattcttttttctctaatcttgtcttcacactttaaattgttaagttgatcttcaatctctgatatcctttcttccacttgattgattcagctattgatatttgtgtatgcttcatgaagttctcatgctgtgtttttcagctccatcaggtcatttatgttcttctctaaactggttattctagctagcagttcctacaggaaactttttctcaaaaaggttacaagaacctttttatcaaggttcttaccttccttgaattgtgttaaaacatgctactttagctcagaggagtttgttattacccaccttctgaagcctacttctgtcaattcatcaaactcattctccatccagttttgtgtccttgctggagaggagttgcaatcatttgaaggagaagaggcattctggtttggggaattttcagcatttttgtgctggtttttcctcagcttcatgagtttatctacctttgatctttgatgctaatgttccttggatggggtttttgtatgggggtcctttttgttgatgttgatgttattgctttctgtttgttagttttccttctaacagtcaggcccctattctgctggagtttgctggaggtccactccagaccctgtttgcttggctatcaccagcaggggctgcagaacagcaaagattactgcctcctctttcttctagaagcttcctcccagagaagcgcctgcccaatgccagccagagctcttctgtatgaggtgtctgtcaactcttgctgggagatgtcttccagtcaggaggcacaggggtcagggatccacttgaggagggagtatgtcccttagcagaggtcatgcgttgcactgagagatccactgttctcctcagagcccgcaggcaggaatgtttaagtctgctgaagctgtgcccacagccgcaccttcccctagttactctgtcccagggagatgggagttttatctataagcccctgactggggctgttgcctttctttcagagatgccttgcccagtgaggaggactctagagaggcagtctgtccatggcccctttgctgcactgtggtgagatccacctggtccgaacttcccagccttcttaacactgttgggggataatcgcctactcaagcctcagtaatggtggacgcccctccctccactaagagtgattaccccaggtcaagttcagactgctgtgctggcagagagaatttcaagtcagtggttcttagcttgctaggctctgtgggagtgggacctcctgagcaagaccacttggctccctggtttcagccccctttccaggggagtgaatggttctgtctcactggggttccaagtgccactgggggaaaaacaaaacaaaaaaaactcctgcagctagctcagtgtctgcccaaacagtcacccagttttgtgcttgaaacccagggccctggtggtgtaggcacatgaggggatcttctggtctgtgggttgcaaaaaccatgggaaaagtatagtatctcaaccagacagcacagtccctcacacttcccttggcttggggagtgaggtccatggacccttgaatttcccaggtgaaataatgccccaccctacttctgcttaccctgtgtggactgcacccactacctaaccagttccaatgagatgaaccgggtacctcagttggagatacagaaatcacctccttctgcattggtctcgctgggagatgcagactggagttgtcctattcggccttcttgccagatctcccttaaatttcatacggaatctaagaagtccccatagagccaagacaatcctaagaagaacaaaaaaacaaagctggaggcatcacactacctgacttcaaactatactataagtctacagtaaccaaaacagcatggtactggtaccaaaacagacatatagaccaatggaacagaacagagatcccagaaataacaccacacttctaaagccatctgatctttgacaaacatgacaaaaacaagcaatgaggaaagaatctcctattcagtaaatggtgctgggaaaactggctagccatattcagaaaacagaaactggaccccttccttacaccttatagaaaaattaactcaagatgaattaaagacttaaatgtaaaacccaaaaccataaaaaccctagaagaaaatctaggcaataccatacagggcatgccaaaagcaatggcaacaaaagtcaaaattgaaaaatgggacaaatgggatctaattaaagagcttctgcacagcaaaggaaactagcatcacagccgaaaaacatgaacaaaaaagcttaacatcactgatcatcagagaaatgcaaatcaaaatcacaatgatataccatctcagctagttagaatggcgattattaaaaagttaggaaacgagatgctggcgaggctgtggagaaaaaggaacacttttacactgttggtgggaatgtaaattagttcaactattgtggaagacagtggggcaattcctcaaggatctagaaccagaaatattatttgacccagcaatcccattactgggcatatacccaaaggaatgtaaatcattctactataaagacacatagacatgtatgtatattgcagcactatttacaatagcaaagacatggaaccaacccaaatgcacatcaatgttagaatggataaagaaaatgtggtacatacacaccatggaatactatgcagccataaaaaagaatgagatcatgccctttgcaggaacatggatcttgctggaagccatcatccttagcaaactaacacaggaaaagaaaaccaaataatgcatgttctcactcataaatgggagttgaacatggaggacacatggtcacagagaggggaataacacacaccaaggcctgttaggaggtggggggcgaggggagggatcttagaggatgggtcaataggtgcagcaaaccaccgtggcatacatatacctatttaataaacctgcacattctgcatatgtatcccaatttttagaagaatttttttttaaaaattactttctctggttatgactgaagaagtgtcctacaaagtggacatatgtgtgtgcactcatccacaagctttttgcctcaaagctcagagatctactgagaaccatgagtaagaagtgattgggggcctagagaccttggggagggagactttgtcagaagtgaaattttcttatagatagaaagcagcagggagacaccagaagcttcacaacttggatggcttatttgaaggccccattctgtcctcactctcttcttgttttctctctgtccatgtatgttttctggaaagttgacattccaaacctaatcccatgtgcagccaggctggcaagtaaagctgagttgccaattactttgctttttttggactccactttccctgagtggcaatgaaaataataatcctacagcctttcctgacaagttctgcaggtaagagcttgttttaggtataatccttcatgggagctaagggcagaggaaagaagaatggggtcaattaaataacctctagagcatctttctgattatgtgactcagtcatctgtgggcttttgccattgctgtcaattaaggttgacaccaaggccaagcagactttatgagctaggacatagctggatcacccttaggactaagaagaggagaagacatcattccagatcctaccagagccctctacttctcccttttgttgtcatgtcatctgtttagaagagaagcctgagacaattttatgtggggggcgggggtcggggaagggtgtacgtgcatgcgtgcgtgtgttccaactttccaagcaagggatctcttctaacctagcctaagttggaatagtgctacaggtccaggaccttagccttagagagcagagctattcttcctgtctcttacttcccactatgtagcactcaatgtttgatattggtactggagaccatgtgactttatcttccttaaatatggtattaattttcacccagaaaaataaagcgattaatggaaatcgggcacttaagataataaaagggagtgttttgccttagggcaaagcataaggatttaattttcccagaattctcaatctgattctgaggccagcaacaactagttttggggcagtacaaatacataagatgaaatccccaaccagggacctggagccagaagaacccacaagggcttcaaatggcccaggtgttggaggcctttttaacaatgtggctgtaatctacacagtaaccagaccaagcaagcctgctttagcagataacctcaaaagtgcaaagataatattgagatgtggaggaatatcaagggaggctccacaagaaggatggagttttgtttttttgatctattccttacttagggcaggggaagaacagctgtttacaagggtggatggatgtgagggacactatgaaggcttccacctgaacatcagcctctttgagactagacatttcactgttaatgttaacaatccatttctttggtttaaggtgtgtgaattcccagggctgtccctggaaaaagaagtatattcaacccttgacaataaatcataaggaaggtagaggagaaccaatagagggaggtttgcctttggaatgtgaaatagttccttcaagtgaaccagagattatagagcaggaggtgaccttagagattttttaattcaccttgaaacttaactataataaacggttccctcagacaaacagaaatgagaggaagagtttgagctgggaatagagagaggctctggactgtgtgggaaagttgaaccaggaaaataatttcactgttaggaggactggcacatgaccttgaagggaagatgcaagatggtattggcaaagatgaaggagcacaggcaaaactaagccagtgcatgtagcataagtgtgtctaatattaaaacagaatttgcaatgaattccaagggtacagaaaattcttttgaaaggccagacttctacttgatggttttctttgctttaagtcgctcgggctaattggaatggaatgtttcagttaagcaaacactca

SEQ ID NO: 8434 - DNA, 1126 bp, artificial
  synthetic oligonucleotide
cacattgcagtcccaacaaaggacagaaaggcaaccacatgggagaaatccagataacgcaggccaatttctacctcagcccacaaacgacaaggaactaggtagccagtcttgcacatgagagattagatactgttctaagcctaccattttctcttacacagctctctaaaacatcgcaaggtatactcctcaactcaattctaattagctgactcattcacttcctgccttacctattataattagctcttttcttcaagatttaccaatccctccttctaccctaaatagcatccctaaacagctacacagcattatgaccgtctacagttaaaaagatggaaaagttttcattcacggtttggtattccgttaactttggcctgaagtgagaccagacacaaagaatgccttcaggagctggcatgcagagccaggaatcactggggccacatacaacctagtctcagctccagccagatgaaattactggatgctgtgaggtcacatactgcttcccagacaaaccaaggcagagcccaaaactctgcattacctcctcaaaatggcctctcatatctcacacaaaaaaaaaaaaagcccaactttgggtgcaactagcaactagcctcttttgaatctcccctcaacaaaccctggcccctgtattttcctgtcttcttatttgatctgttttctatcctggttctcagctgagtatcaacttctgttaagtacctgattccttgctttggcttgaatcagcatagtcttcagccatcttcctgggtttaccgaccacaggctcgagttctgcagaattggtttaaactggtcaaaatagatttgaactgaccagaactgattttctttgtcaaaaaatatttgaactgatcaagatcaacttctgacaattttaaacccttttgggccagttttacattactaatgcaggagcaagccactgagggaatcaggatgaaccaggaatgagatgaagctgcttcaatctgcttagaagaccagcaaggaggggacaaaaaggacctgatgctaaggatcataccatttgtggtggtggtgctggaggggggataagaaaggacctaatagtccgagaggt

SEQ ID NO: 8435 - DNA, 797 bp, artificial
  synthetic oligonucleotide
ctgtactcctaaaacattcataatactgctttcccataattagctttgcacaccatgctcattgaatatgcaggctgtaaagaatgccttgataggacaagtgatgtttgtgttacggaaatagtattactagtctagaaatccaaaatttatttgtctcttaatcaatacatatactataaaatgtatataaaagggatgccatttaaaactaagaattaaataaatatgaaacagaagctgaaattgggattcccaccaagctatttcaaccgttcaactgcttttgaactaattcctgggagatcccccatggttagtataattttactctaaattttagtttttctgtatccccaaggttcacttttattttctggtgtgataagcagtgtcttttatctcactgaatataaaagagaaagtatcagccccaattgccactggtttctctcttattaccctgagggaattcagcctgagaacaaggacaacatacaaagcagggcagaatcaagagaatcacagaggaaaggtgccagagtcatgactgaaccatacttgaaacctgtccaaccgctggacttttctgttacatgagccaatattcctctgttttgttctgatcagtttgagttttctgtaatttgcaaccaaagcaacctgaataagctactttcctaaagcacctagcaccatgcttggtatactcagccataagagccctgttccaatgctgattccccactgaagcatgttctaaaccccaaacacaatttattgctccattatttggg

SEQ ID NO: 8436 - DNA, 293 bp, artificial
  synthetic oligonucleotide
attgaccatttcaaaaggataagtttatgtttttcctggaagtattaaaaattacagaacgtgtccagtggtaaagagaataccactgcccatcaacatgcttataaatataccaattttcccttctgggtaaagatgaaggagtaaatacatttaccttcatctccttccaaaaatccagttaaataatagaatgagacatttttcataagacaggagattttgagagatttatgtggagaatttgactcatccataaagaaagatgttaggtactgacattgagtatttcc

SEQ ID NO: 8437 - DNA, 524 bp, artificial
  synthetic oligonucleotide
tctccacctagaagcaaagcatgataaaaatgcacagccacacaggtttatctactcaagggattcttctttgctaacaagactttggactattggactaaatggtgctgttttaagcccttccgggaagcctgggtgtgtgtgtgtgtgtgtgtgtgtgtgtgtgtgtgtgtgtgtttgtgtatgttttaggggtgggaggtagggaagatgagatctgggaataggaacaatcccttagactatcaccaattcatcttgtcaaagaacaaaggtatttcttacaacacacttcccagcctcagtcttctttcccccacatttacataatctctttcactttccagtgtaattcaaaaagggagtcaggataggtaagaataacagctacaaaacattgcttttcagggattgcaaatagaactacctccaaagaacaacaggcagtattttgtctcattgttcctacagtggggaacctcaaactcactaacatggcccagaacttatctatatatcatcta

SEQ ID NO: 8438 - DNA, 947 bp, artificial
  synthetic oligonucleotide
ttttattgtctttcatttagattaaatcttctgtgaaagtgaaagtgataagttttcaggaaacaactgaatagagtaaaaaagacagcataacagataataaatagaagactgttctagataggaagggaatataggcaagaaaaaataagtttaagatcttctggtaaagcagattgcaaagtcagtcagctattgaaatagatatacaaagctccaactaagccatctacatcttggtgtttgtcaagataccactgttgctaccagtgtcttggcattgcaagttggcaccagatggtggtacctagaggctcatgactgggactaccagtgcagtggcctgggaactatgtttggaaatccctgtgcatgacttctctgctctgcctccaaatggaggaaattcacttggctgattttcagaaactctctaggaggaatgtgaagcaggtttctaatcttgctctgcttagacataaattaagatcttgtttgttcagaatgactactacccaatcctgccagaaactccactgtgctctctggggtgcaaaacctctatttattaggttatatttttggccaggagttcacactgtgctttgttctcattgctctgccactcccatggactggctgccgagcaaaccagacactgacccctgattcactcttccatcaattctattcatatctcttcattgtctttgcaagatgtgaccaagcacctcaaagcaaatgctgagagccttttgtattactccagagtgacaagctcctcccaggccctggagacacagaggcaatccagctgcaatgcttatcctcctggccccacccaacaatggtactacagttgaagatacagagctctgaaattctagctctcttagaattctttaagtatcagcaaggctggcccggtttaaaagaagtgcatgcaa

SEQ ID NO: 8439 - DNA, 1862 bp, artificial
  synthetic oligonucleotide
tagagctccttgaaggttggccactaatagaggaaagatagaaacgactggaatgcccttaaagcaaaaagcagctgaggaaaaaactgttaaaagggagtatataaacagtttgaccacaaactaccaggttccgacttgctgataggggtgtaaaaataacctgtcagctttgttttaagtgccaaacagtgagtgctgaagtgacacgatgaccagtcaataggcactgtcagtgccactcctcaaaacctttacacggctctccattgcctaccagaaaaggtaaaaattaccttgtgctgaatgtgaggccctcagtaagttggcccaaacttgttttccagccttcttttccactgtgtctcagatccatgaaatcagattaatctattgactgccccttcaaaaaccacattcgactgaaagtcaggagacctagattctagtccttgcattctcattaactgcccacataacattggaaaaaataatttaacctctctaaaccttgctttcttcctctgttaaatcaggatagaaatcgccactctgatgacatcatgcacttttttgaggagtccaacaacagatacaaaagctcctaggagatcccaacaggttttaagcaccaagtttctgtcaaccaaggctgtagcattctcatccatgagggcactaaatctctcctacttatgaaagaatccatctgggaccaattatttcattatctgagctctttgcctctttacccagatgttctaagagagtgtgtttacatttcttttgacccaccacccagacagatttaatctctaccttctttttctatgtatcttccacaatattttatggcttccactagccactgtatattaattacctgttcatgggtccgtctacccctctagagtatgggatgctcaatgtcagaaagtgtaacatattgaatttaatacacccaacacacactatgcagtatgtctcaacaaagtttacattactggactattgaattgaatctcttcaatatgatgagaccctatttaaactaatatggagatataagtgtttattattataacatccattatacttaattgatttcaacaaatatttgattagaacaaactacacacaaggcacaaagctaggtactagttatccagctataactaagacagagtttgccttgaacactggctctcactcctggctgcacattgaaatcacttagaaaagcatttcttaaatactaatgtctaagcccccaccccaggaattattgtttaactcatctgggatacaggctgacattaaaatttttagtgttcagcctagactgagaatcactagtcttatggtggaaataggcatgacacaaggaaatataatgagtattttgaaagaggaggaatgctacaggaatttattatctagtcttgggagtgttgaattctatatccagcaaaaatatccttccagaaagaagtggaaatggaaacatcctcaggtgaagaaaaataaataatttgtcttcagtagagctaccctaaaagaagggtgaaaagaagttctctaaatagaaagaaaatgatgagaaaaagaaagaaatcttggagccttaagaaagaaaaagagacatcaagagggtaagcactctgtctcctcaggagtttttaaaattacatttgatggttgaaacataattgtagctctctctgagtggttctcaatgtatgcagaaaaaatatttaagacagttacaaacaagggagggtgaccccagggtacttatgccataaaaataagaatttatttctacaaaaatacctacacatgattgttcatatcagctttat

SEQ ID NO: 8440 - DNA, 1936 bp, artificial
  synthetic oligonucleotide
aatttaagtgagttgattagcaaccttaatctcatctgcaactttaatacctctttgctgtgtaccctaacattcgtgggttttggagattaggatgtggacatctatgggggtagggaacactattatgtctaccacaagttttcaagggttagaattcaggagctcaagtattgccactgaggatgatggagaaaatgagaggaatccatttggataggaagagaaggttttgccaagttaagtggagtgtccaaatggtaatggtcccagagctgtcttgagggtctggatctcaggtgacacatcatgattaaggacatgggtttaatgagttttacacctgcagctgaagtctgaaagcctttaagctacttgatcctttagaggcagacatttaggaagagaataacacaaggatgaagagttgaagaaggagcctgacacagtggctcacacctgtgaccccagcactttgggaggccaaggtgggcatatcacttgaggtcaggagtttgagaccagcctggccaacatggtgaaaccctgtctctactaaaaatacaaaaatcagccaggcatggtggcacacacctgtagtcccagctacttgggaggctgaggcacgagaatcgcttgaacctgggaggtggaggttgcaatgagcctgtgccacagcacaccagcctgggtgggtgacagagtgagactctgtctccaaaaaaattaacaaaaacaaaaaaaagatctgaagaaggaattgttctcatcacctcttatctaggctcaacatggggcaaacactcattcttacagaactgaaagaaatcaaaaaaagtcctagaggggcctgaagatggtgcaacaaaattgcaaatgggaccatttagctgctcccttcaaccacatctgtcacccagatgttccatctaaccacagcacatgcccacaccaaaaagccggcattatatgctccacaaggtctgtggccagtgtaaaagtgtggaggaacccatccacatggcaaagcaagtttgttatttgtgttacatcaaagccagggcctcaatgaattactgccctctgaggtcatttaattatgattaagtgaactaagaaccagtgtaaatggcatttatactccagtgaattaaggtatgagatatagccaaagtgaataagatttatggcccaaactcatgcaaccttacagtaatttcatgacacttttactatgaggcaagcgatgccagttcttgaaataattaaaagtacataccagctccaaggctgggcttcaggcatttatgggacgccatgagacagaataaggagcaggtttctttgtgactaatttactctagaaagcagcagctgtttcttttacctgcagcaaacatctcaattagagtaggaagattgactctgagcaagccatactgaccccaggaggtcagaccacactgcacatcttgaggagccagttcctccccaaataagtcagtccgtcacccaaaggagaaatgcttcatagacaagtagtttttcaaatccctaggctcatataccactgccctctgcagatccctttatgcccttgaggagattaccttagtctgggttgccatccatggaaggcaaggaatcactgtccacagatcccaagggaattggcaaagtggaaaatgggtcagccagaatgtgccccatttaccttgggcatcttcttctccattgtcagccatccattgctttctggtacttcttcagggtaacgcaccagttggtatcctcctggcttctgatttggcactctacctaagggattctgatctcttctctcccattcactgagttgggtctcatgagcagatcccagagtcaaccaggcaagggaagaattccattgtttttagcttttcagatttccaaatta

SEQ ID NO: 8441 - DNA, 1355 bp, artificial
  synthetic oligonucleotide
ataattttttcaaatgacaaatcagttcaaataattttctacccaaaacctttcagtggatcctcatttcctactggataaagtgcatactattttgtatggccaacaacagagcttcccaaccaacgtgccctaaatggattacaggtgtacccagatattgatcccttcagccctgggggagaggcctggggtagctgagctccaaagacttttgccttaggaagagcagtgttttaacttatgaaaaaggttggaaagagtcctttcacaaatttggtgccccaatccctaatctcctacttagctcctaaatacacccccccaacacacacacacacacacacacacacgtgcacgcatgcacatgcatgtgcattcacattctttttttagagacagagcttcactctgtcacccaggctggagtgcagtggcacgaccatagctcaccataaccttgaatttctgggttcaagcaatcttcccacctcagcctctcaagtagctaggactacaggcatgagccactgcacctggccacattcattttcttaatacaggaatgtatagatgcttcccagtggttcttgaacattataatgcatcagaatcaccaagggagcaaattaaaatgcagattcacaggccctactacagagattaatatgtctgggaatctgcatttttaagaagcaggctgttcaactctgatgcaaatggtttgtggaccacatttggaaaattaccgtcactctacagctacatgggaccatatcataattctacaaatatatctgctacttcctttgttttcacccatgttgttccctgtgcttgggatgcctgtcctttttcttttccagtcctgtgcttataactcatttcctctggaaagctttccctggctcccaaggccatgttagttgtccccctattttttcacaggccccatacttcttttgcagcacttaaatgattatctgcctgcaagtcccatgggggcaaaaatcatgttaatcttatttaccattttatccctaacacactagaatataacctagttcaggatagacattcagtaaacattgaaattaatgtcttgtcttgaatgcaggtcaagaaaacctaacttcagctgaccattttagatctaggtgtgataacttctgtcagtctcaagttagagcaagccaccaatctcctagaattagtaagctgagagcccaattcttccctatttcctagtttatatgatcattccctgtgctttgtaacaaaactgctgatgttgctttcaaaagtttcaccttcaccttctttgaaagaatagcaccccgtatcacttccaaggc

SEQ ID NO: 8442 - DNA, 3510 bp, artificial
  synthetic oligonucleotide
gagcaagggggtagttctgggagctggactctaagccttgaatgaaagcaggtggagctgagacaggggtgggagctctcgcctaggaggccgggaccgtggctgcagcgcgggccgagcctcgaaggcagcagggctgtggcagctgatttcctggaacaggatcctgcatgggccgtgggcatgtgaggcggtcggccggcacacaaatcgcttttggcccgtgggtaccaggcagctgtggcctccgcctgccttggggtcgctctgtccagggtaggagacaatccaggcagcctggcacgaattgggaatctaggaaaacctcgcggtgtccaccgtgtaagggcacaagtcctggggcagcttttgccggaaactacctctggactccttgcctcagtgaggaaaccgtcctgggcccactcccagtcccagaaacagttgtctcttgggcccaaagcaggaaacgttcaacctccatccaggattgtctgtttgcctgccactatacaaactgttcaacacagctgcctgtctcacatatagaactaattacacaattaatataagccttgatctgagacaaagatcattaggtttctaagcaaatgtgttcgctcctcggtaatttgccatttttattttcaatttccaattctatactaagacatcatggggggttctgtgacagctacctttgcccctccgcatcctccaatgtcctctgcttcctcccaaggaccctataatccaagaaagacaccttttccccaagccagtaagatgttctgcctacactcagacatgacacccttcccttctttttcccaccctccttcttgccaacatctgccccaaaccccccaaacctctccatcctcctattctccatgccttgctagagctgcatctggagtgcacagcaaaaaggggaacataggggccagtgcggggtaaggccaagcctagcaaacaacttaggggcagggttggtcttccttgctgggaacaggcagaaaccctaatgaggtctatggtatcttggaaaaatgcactcaaacatagctagagtacagtaggttgggaggggtaatggaggggtgcaggtgtctgtataaacttgcagcaggtcctcaaaagggtgataaggtggagtgggaggagagggagtgttaacttggctcctttccctttcattgcttgtgattttgcagtccccttttgttcctcttcttaaggaataggactcccacactggcctcagaggcttcctgaaatggcataaagataccagagtaactcattgccgatatgtaaccaaaaaaaaagatcatgaaatgatggagagatgtggggtgggggtagcgaaagtggaaaaattatgagcacacctcccagcagctccaaatatttttctgattttgtgcctaagctgagcccagtaacctacaaggtcaacataaatcagtaataggctcttgggataagtggtctttaattacctccctaaagacacatcttgatttcttttcatttcccaggtctgctaagggtgttaagtttaaggagaaaccaaaggaaataagattggcaggaggaagggacattttcactgctgcttaactgactgcttcatttttggttttgcctttgaaaaagaaaacaacactggctaagagcacctctgcatcaccttttccttttcctccttccctgacttcctgtcactttcctgcacttcctgtaaagaaaatgataactggccaaagctgtctctttgtaaccttccctgccaactttaaaacacatactctttctcagtttagcttttggcacagaaagaggtggcgttcaagtttgctaactctttcctccctccacatttgagttaatcagccagggtattcaataaattgaaactttaacattccataagtgctttagcagtcaacattccagcagggtaaagtaggccagacttaagatataaaatattatagatttctgctaggggggaagaggtagtctccaaaagccatgtgaagtaaatagctatttgttgtaattggagagcagggcccccaaggattaccctggaatccatgtgttcagaacaagtcaggctaagcccaagagcagtcccgactccaaataataacctgttggcacagcatatgctctccgctctccatctgcaatcagtagccaggagtatttcaatcaccgcctggctggtagcatttatatgaagttcacaaggatactgacattccgaggggcacctgtggactggcagagcagagcttgggagccaaactgaaggagagtcctcccaccaggtgggatggagtgggctcatgcagctgccttggttcttgagtgatctggttctcatttggcaagatgccaaagcagcactgtctcggccccaaaggtctgacaggatggctgaaggattcaggcaagttatggaactagattaaatgacacattagacagtcatctagctaggttctgaagcagtggggcccagaacagatcagttttgactgagggcctggggagagaggtataagaagtgtctggaaattgtcaagaaaagggcagagcctgatgtgggcaggtcaagatgaggcagagtagagagaggtcctgggccttgaaggggtaagagtactgaggacaaactttgtctacttaatacttcacctcaacactttgctgttaacacccctgtccagctgtagctgggaaaatatgaaaatggcttattttctctcccccttcatgctggctgggattcaggagaaggtttaggaatatctcttccatcatcatgtgccactgggttcccacagtttgaaaccagctaataggaaagttggcgagggaaaatgatgcccaaagacagctgggcagggataattccagctgttggagacccctgttactggacacaacccaagtgacttcctgtatgatctgtcctttggcatcagggttaacagagagttggagaaaaactgtggtgactcaaatggccacacctcttgggtttcatgatttgttctcacactatgtcttgggcagtgagatcacaagctgtgctctgctacttaatgagctcagggttgtcagagacatgagatacttacagaatgagggaactcagacttgaagctcaggagtaacctgcctgagcaaagcaaagaactaaaggctcccacgttagtgtccctcagagtttaggacccagaactgaatcatgacctggtttctagtttcctttccatactgggcactctcctttgaacatgctctgtttttccattttcttctctaagcacagtagaactaaacacaccattctcagtgtggtctaaccatggcagagcagagtgggacaatcctccctcccttttgttagttaccagacctgtatcagtgaggccttagatcacactagctttttttctattttttccactagctttctaatttttaatt

SEQ ID NO: 8443 - DNA, 2849 bp, artificial
  synthetic oligonucleotide
gaagaatgagggttccagggtctggtgacagccttaagccctcagctaggactaggctagcggcagtgcattttctctattctggaagctagcctagcactgaggaatggtgagtgatttactgaccttaacccttccaggggatcccaactcctggctctggcttttaagtcacatagcatactttctggctgcctgcaccccatgaaatcagaacacatttttccatgacacctaagagataggcctgtccccagcactcagtatcggcaactccagcaagtagtatggcggttggatcaagtgtgagaagggacagaggcaagagacccaggaactgccagcctgaagtagccagattggaagagcttttcaaggagatcttttctgagctttcagactgacaggcctgagacccttcattaggagagatcacagctcacctcccatggagctttatatagatccgaggcctttgcctgttagttgacatggttgactgtaatctcaatgaatttgaacatcattagctctaagtagggagaaagctcagtgggtaccagcagggcattgggaggccatagcagcaattctcaggctcagagagccaggtgatgccatctcctccaatctcctcccttcaggaaagatttcaactaaaacatttctgtgtaactcatgaaagagaatgaaggagatacagacaagagtgttttgtgctatttggaagaaagttacctccagtaatacagagagataggactggaattttctaacatcaatgtgctattgctatttcagggtttctctactagcaagctgggataggagaaatagtcatataatgggttctgctttattttctcaccctcacagaagaaactcacacgtgaatgtgttttccgggaacagtttgaagaaaactggtacaacacctatgcctcaaccttgtacaaacattcggactcagagagacagtattacgtggccctgaacaaagatggctcaccccgggagggatacaggactaaacgacaccagaaattcactcactttttacccaggcctgtagatccttctaagttgccctccatgtccagagacctctttcactataggtaatgaacctctggtgtgccctctgtgacccatgtaccctggggccacggttgtctctgcaagcactatattcatagcttttcaatccttccttcctatcattttagataacagaaaagcacttactgttgaactcaacccagctgttcccttgttgttcaaagtgtatatcaaggttgggttattttggggagggatggggggctgggctcgagggaatcttgtatatacttttttctttactcatgttccttcccctgaggtagcataacaaagaatgggagcccctgctaagggccaggggtgtcttaccccacaatttactcaaataccttgacaatgggtataaatgaaaggccaaggaatctgccacagatgctacctacagagctttggaaaagtctcattaagaaaatccttggggctacagccttgctgcaagccttccctgcattggctctgcagatttctcatctgtcctgacatgcagttttcctgtcattggaagtgggagatggggtaggttgtaagaaaatgatattaaaatgtaagcatggatactgtgcataaggacaaactatttataaaatgtatatgctatttattttatatatttatttatttcaaaataataattttatttttaatgagagatgcgatggctggattttcatcagaaagaataaggtcctactgaaacaggataaaatgagttattaaaggcttttactgacaataaaatttgtctttatattgtaagattctgtctaattctattgatttgtacatttagtagggttagaaggttggccagcttctttctctccaactcattagaattttctgatattggcatcacactgcctatgctagatgactccatcagccaatatgttagcattatctagaggccttatgtgaagtcctagtggtcctttccagttctatgactttaaacatacaggtgaatcaaagcttcaggaaggcctagaccaacagctattactgaagctcccatttgtgcttaggactatgcatagagaaactctcctttgggacttggttagggtccaaagccctaaggtcaaaacactaattgggggcttcttacttcagatatgaagatgaagggattcaaaataaacacaaatcggctggtgcagtagctcacacctgtaatcccagcattttgggaggccaaggcaggtggatcacttgaggccaggagttcgagaacagcctggccaacatggtgaaaccccgtctctactaaaaatacaaaaattagccaggcatggtggcaggtgcctgtaaccccagctactcgggaggctgaggcaggagaatcacttgaatcctggaggcagaggttgcagtgagccgagatcacaccgctgcactccagcctgggtgacagagcaagattctaattccaaaaaataaaataaataaataaacacaaatcaacagagagactgatttttttgaaccagtcaacttccattctggagatttccccattctctttacccccaccctcacctcctgccagtgcttctcctagggaatttgggaggctgtaaacacactcatctacagaagtagtgcttagcgtactgtatatggtctcttgaccagcagcatcacctggaaacttgttagagatgcaaattatcagaaattctggaggcaaggtccagcagtttacatgttaacaagccttgcagggg

SEQ ID NO: 8444 - DNA, 8417 bp, artificial
  synthetic oligonucleotide
tttatgaggtggaacaatgaacaataaacttagttcagaatacttcaacctttagggttctcaattggtgactaattgaatttgtgtggaagccactgcattaaaaatgagttttactatattaaaacatattttaaagtattcagactggggttttcagacacttctgtttggatcacagaacaaaatggaagaaaaaagcagaaccctctagcactactgaagagagacagaaggaagtaccttgaaaacatcaagaagggaatgtaatagtctgttctcacactgctataaaggccataaataaatatctgagtctgggtaatttaaaaagaaaagagttttaattggcttacagttctgcaagctcaggatgcttccaatcatggcagaaggcaaagagggagcaggtgtctcacatggcaggagcaggagcaggagcaagagaaggtggggaggtgctacacacttttaaatgactagatctcatgagaactcactatcatgagaacagcacaaaggggatggtgctaaactattcatgagaaatccacagggggcaaggccaagatggccaactagaaacagaggcgatcagaggcgctcatcgaaaagaaccataattagcgtgtgaatccttcacaggtaaccaaggtatccaggttctctcatcggaactgactaggcagctgatgtgattcatggagagaaaggaagagcagtgtggtgcagcggtccacctgagagccacacggggcaggggagcccccaccccccagccaagggaggtgttgagtgcgctacccaggcggggaaaccgtggtttttccatggaactgtggaacccatggatcagaagatcccattcgtgaacccacgccactggggcccagagtcccaacccctgagtcacgcagattctcaacagcctctcagctggaatctgcttaagcctgcagagctcccagggggaggggcgacaagcaccacagctgcgactgcctgctatgtaagccatttgagctccttgtgggaggggcagcagccagcactgcgactcataactgcctaacacgctaagctccctgggtgggggaagggaggcttccatctctatagctccaggccacgcttttcccctgctggagccagggagactggatggcttggtcccaagaggtttcccccatagcccaacacactggcagtggcagactgcggccagagcgcctcttcagtcctgaccctgagccatccttcctcactaggtgggacttccctgcaggaactccaacaactccagccagaggctcaaggacagaacctggatctccctgggcctgagcccctagtgggaggggtggccatagtctctgtagaccagcagacttagcctttcctcctggtagttctgaggaatccagccagcccagatgagtgggtttaccctcatcaaagcatgccccctccaccgaggaacagtcaaagtgcttcgttaaattggtcctgttccctgagccacccaactgggttagaccctccaacaggggttgtcagatactctatacaggagcgatcctactggcatcaggttggttcccctgaaggttagaggtcccagaagaagaaagaggcacccatctttactgttctccagcctccttgagagacatctccaggcatgggagcaaaccagatgaataggacgtgaacccacagcaagccatagcagccctacaaaagaggtatctgaccatcaaaagaaaaacaaacagaaagcaacaacaacagcatcatcaacaacaaaaaaattctccacaaaaaccccatccaagggtcaacagcctcagagatcgaaactagacaaactcatgaagatgagaaagaatcaacaaaaacatgctgtaaacccaaaaggccagagtgcctcttctcctccaaatgattgcgcctctccaggaagggtgcagaactggatggaggaagagatggatgaattgacagaagtaggcttcagaagatgggtaacaaaaactccgctgagctaagggagcatgttctaacccaatgcaaagaagctaagaaccttattaaaaggttagaggagctgctaagtagaataaccagtttagagaggaacataagtgagctgatggagctgaaaaacactgtacaagaactttgtgaagcatacacaaatatcaatagctaaatcgaccaagtggaagaaaggatatcagagtttgaagacaactttgctgaaataaggcatgcagacaagattagagaaaaaaagaataaaaaggaatgaacaaagcctccaagaaatatgggacttcataaaaagactgaacataaaattgattggagtacctgaaggagacaaggagaatggaaacaagctggaaaacacacttcaagatattatctaggagaacttccccaacctagcaagacaagccaacattcaaattcaggaaatacagagaacactactaagatattccatgagaagatcaaccccaagacacataatcattagattctccaaggtagaaatgaaggaaaaagtgttaagggcagccagagagaaaggtcaggtaacctacaaagggaagcccattagactaacagcaaacctctcagcataaactctacaagccagaagagagttggggccaatattcaacattcttaaagaaaagaattttcaaaccagaatttcatatccagccaaactaagcttcataagcaaaggagaaataaattcctttacagacaagcaaatgctgaggaatttcattaccaccacacctgccttgtaagagcttctgaaagaagcactaaatatggaaatgaaaaaactggcagggcacggtggctcacgcctgtaatcccagcactttgggagggcaaggcaggtggatcacgaggtcaggagatcgagaccatcctggctaacatggtgaaactccatctctactaaaaatacaaaaaaaattagccaggcgtggtggcaggtgcctgtagtcccagctactcgggaggctgaggcaggagaatggcatgaacccgggaggtggagcttgcagtgagccgagatcgcgccactgcactccagcctgggtaacagagcgagactccgtctcaaaaaaaaaaagaaaaagaaaaacaggtaacagccactgcaaaaacacaccaaaatataaagaccaattacatcatgaaaaactccatcaactagtgtgcaaaataaccagatagcatcatgatgacaggatcaaattctcatataacaatactaaccttaaatgtaaatgggccaaatgccccaattaaaagacacagactggcaaattggacagagtcaagacccattggtgtgctgtattcaggagacccatctcacgtgcaaagacacacataggctcaaaataaagggatggagaaaaatttaccaagcaaatggaaagcaaaaaacaacaaggattgccatcctagtctctgacaaaacaaactttaaaccaataaaaatcaaaaaagacgagggcttacatactggtaaagggaataattcaacaagaagagctaactattctaaatatatatgcacccaatacaggagcacccagattcataaaacaagttcttagagatctacagagacttagactcccatacaataatagtaggagactttaacaccccactgtcgatattagacatgttgacaaggcacaaaattaacaaggatattcaggacttgaactcagctctggatcaagtggacctaatagacagctacagaattctccaccccaaatcaacagaatatgcatttttctcaccaccacgtggcacttattctaaaatcaacaacataattggaagtaaaacactcctcagcaaatgcaaaagaacagaaatcataacaaacagtctctcacaccacagtacaattaaattagaactcaggattaagaaactcactcaaaaccacacaattacatggaaattgaacagcctgctcctgaatgactcctgggtaaataatgaaattaaggcagaaatcaaaaagttctttgaaacaaatgagaaccaaaagacaatgtaccagaacctctcggacatacctaaagcagagttaagagggaaatttataggactaaatatcagaaagctatatattttttatatatttataggactaaatatcagaaagctatatattttttatatatttataggactaaatatcagaaagctatatatcagaaagcatatatcagaaagctagaaagatctcaacacactaacatcacaaataaaagagctagagaggcaaaagcaaactcatccaaaagctaacagaagacaagaaataactaagatcagaacagaatagaaggagacagagacatgaaaaaccctccagaaaatcaatgaatctgggagttggttttctgaaaaaattaacaaaataaataggctgctagctagactaataagaaaagagagaagaatcaaatagacacaataaaaaatgataaagtggatatcatcactgaccccaaagaaatacacactaccatcagagaacactataaacacctctatgcaaataaactagaaaatctagaagaaatggataaattcctggacacatacaccctcccaacactaaaccaggaagaagtcaaatccctgaatagaccaataacaaattctgaaattgaggcagtaattaatagcctagcaacaaaaaaagccaggaccagacagattcagatctgaattctaccacaggtacaaagaggagctggtaccattacttctgaaaccattccaaacaattgaaaaggagtcactcctccctaactcattttatgaagccagcatcatcctgataccaaaaccgggcagagactcaaccaaaaagaaaacttcaggccagtatccctgatgaacatcaatgtgaaaatcctaaataaaatactggcaaatcaaatccagcagcacatcaaaaaacttatcttccacgatcaagttggctttatccctgggatgcaggggttgttcaacatacacaaatcaataaatgtgatccctcagataaacagaaccaaagacaaataccacatgattatctcaatagatgcagaaaaggcctttgataaaattcaacatcccttcatgttaaaaactctcaataaactaggtgttaatggaacatatctcaaaatagtaagagcttattcatgacaaacccacagccaatatcatattgaatgggcaaaagctggaagcattccctttgaaaactggtgcaagacaaggatgccctctctcaccattcctattcaacgtagtattggaagttctgaccagggcaatcaggcatgagaaagaaataaagtgtattcacataggaagagaggaagtcaaattgtctctgtttgtagatgacatgattgtatatttagaaaaccccatcatctcagcccaataactccttaagctgataagcaacttcagcagtctcaggttacaaaatcaatgtgcaaaaatcacaagcagtcctttacacaaataattgacaagcagagagccaaatcatgaatgacttcccattcacaattgctaaaaagagaacaaagtacctgggaatacagctaacaagggatgtgaaggacctcttcaaggagaactacaaacctgtgctcaaggaaatgagagaggacacaaacagatggaaaaacattccatgctcatggaatggaagaatcaatattgtgaaaacggctatacagcccaaattaacttatagattcaatgctattcccatcaaactacaattgcctcttcacagaattagaaaaaaactactttaaatttcatatggagtgaaagaagacccaggatagaaaagacaatcctaagcaaaaagaacaaagctggagatatcacactacctgacttcaaactatgctacaagactacagtaaccaaaacagcatggtactggtaccaaaacagacatatagaccaatggaacataacagagacctcagaaataacaccgcatatctacaaccgactgatctttgacaaacctgacaaaaacaagcaatgaggaaaggatctcctattcaataaatggtgctggtaaaactagctagccataggcagaaaactgaaactggaccacttccttacaccttttacaaaaattaactcaagatggattaaagacttaaatgtaaaacccaaaaccataaaaaccctagaagaaaacctaggcaataccattcaggacatagacatgagtaaagacttcataacaaaaactccaaaagcagttgcaataaaagccaaaattgacaagtgggatctaattaaactaaagagcttctgcacagcaaaagaaactagcatcagagtgaacaggcaacttacagagtgggagaaaatttttgcaatctatccatctgacaaaggtctaatatcagaatttccaaggaacttaaatgaatttacaagaagaaaacaaccatatcaaaaagtgggcaaaggattcgaacagacacttctcagaaaaagacatttacgaggccaaaaaacatatgaaaagaagttcaacaacactgatcattagacaaatgcaaatcaaaaccacaatgagataccatctcctaccagttagaatggcagttattaaaaagtcaagaaacaatagatgctggcaaggctgtggagaaataggaacacttttacactgttggtgggaatgtaaattagttcaaccattgtggaagacagtatggtgattcctcaaggatctagaaccagaaataccatttgactcagcaaccccattactgggtacatacccaaaggaattaaatcattctactataaagacacatgcacgtgtatgtttattgcagcactatttacaatagcaaagtcatggaaccaacccaaatgctcatcaatgatagaatggataaagaaaatgtggtacatatacaccatggaatactatgcagccataaaaaggaatgagaggatgtcctttgcagggacatagatgaagctgaaagccatcatcctcagcaaactaacacaggaacaggcaaccaaacactgcatgttgtcactcataagtgggaattgaacaatgagaacacatggacacaagaaggggaacaacacacaccagggcctgtaggggttggggggtgaggggagggatcttagaggacaggtcagtaggtgcggcaaaccaccatggcacatgtatacctatgtaacaaacctgcacgttctgcacacttatctcagaacttaaagataaataaattaaaaaaaaaaaaagaaaagaaatccgcccacatgatccaatcacctctcaccaggccccacctccagcgctggggattacaattcaacatgagatttggtggggacacagatccaaatcatatcagggagtattctgttttatttaagtcttgcttaaagtaaaaacagacatgagagctgatatgcaaaataacaaaataaggtactctaaatggttcacaaaaggctggggttaaatcatagttgaaggaagaattgcaggcttgttcaatgggaagaaaaacatttgcctcttccagttggttgtgagacactgagtgaataagtatttcaaacctattttctcatctgtaacacaggaataatgaaaagtgactggccatagttcctgaaacacaataggtgttcaataaatcttgatcactgtgtgagagaagattcagagaggtgaagtaatttgtccaagtttagagatggatccacgctcctaagtgctagcatattaaaatcattttaggaccgggaatactggctaacttctgtaatcccagcactttgggaagctgaggctagaggatcacttgagcccaggagttcaagatcagcctggccaacatagtgagacatcatctctacaaaaaataaacaaaattagccaggcatggtgatgcactcctgtagtcagtcgcactacttaggaggctgaggtgggaggattgcttgagcccaggtcaaggctgcagtgagtcaagatcactccattgcattccagcctgggtgacacagcgagaccttgtctcaaaaaaaaaaaaaatcattttgctgtctttcatttcttcagaaatatgaaaactgttcatggtccatgtggtacatctctgtaactcaataacagtcacccttattctgacagagatcactatactaacacagagctttctattttgttttcttgtgaatatatcatcatttctcatttgaaatagaggattttaaagtactcggtgcataaacttgcctggtctaaggaaggctgaatgattctatccttg

SEQ ID NO: 8445 - DNA, 12999 bp, artificial
  synthetic oligonucleotide
accagccactggctgatacattcctctcatatcaatctgctggtagttagaaggattcatgatcaaatttgggggctttggcatcatgaggtgacccagtgttgcttgttgataagtcatttgttgctgttgctgctgattgtactgctgctggagccttctgttcataagtattcgctgaacacagctgattaactatagagaaaaaatgggagtcattacaagtgcatgacctgtctcaaaagaggtatcaagttttgacttaaaatcaatttgttaagggggtaccataccaaaaggaaaacacattattgttaacaccattactaatgtgatggcattcacaggaccattactgtagaaaccagttagtaagatcatttagggctaaattctcttaatgtcttgactattatattgcaagcagcatttagcttagttgccatagtaatgtgttctgtactgtgattagtctcaagtattagttacaacactttttgttaagactcctttctttgtcattcttttgaatatttcacatgatgacagacaaacattttagtgacaaacaccaaagggaaaggcacttgcagtaggaataattctgaccaggaatatctcaaatgtactaatatattgtaaaaccacataaccctgcagtgctttctaagtaaaatatatgccacagaaatagattccctggtgtcaagcgtagaaatttccaagtataaggcagaaggctggcaaacgactgtgttgggaaacatgatcaaggatcctggaatacagtacccttttaaagaattatataacttagtaggaacctttgatatgtatcatccatagctctaccttttattctcaaattaaacacactgataagtatactactatttcgaggttgtttaacaatggcaaatgtgactggaggcagagcaagatggctgaatagaagcctccactgatcgtcctccccgaaggaacaccaaattgaaaaactatctgcaataaaatcaccttcatgagaaccaaaaatcaggtgagcaatcactgtaccagattttaacttcatatcactgaaagaggcactaaagggggtaggaaagacagtcttgaactgccaatgccacccctcactcatcccctggcagcagccgtgtggcagggagagagaatctatgtgcttgcaggaaaagagtacagtgattatgggactctgcattggaactcagggctgccctgtcacagtgaaaagaaacaccaggcagaactcagctggcacccacagagggagcatttacaccagccacagccagagggaaatcacctatcccagcaggcagaacccgagttccgacaagctttgccactgtggactaaagagttctgggggcctaaataaacctgaaaggcaatctaggccaccaagagtccaagtcctgtactgtgctgggctgaaagccagtggacggggggcgggggggggggcacatgacctagtgagacaccagccagggtggccaggagattgcttgtgccacaccttcgcaaaccccaggcagcacagctcacagctccaggagagactctttccttttgcttgaggtgaggagaggagagggaagagtaaagaagactttgtcttgcagcttgaatatcacgtcagccacagtaggacagggcaccaggcagagtcctgaggcccttgttccaggccctagctcctggatgacatttccagacataacctgggccagaggaaactcattctcttgaaggaaatgactcaatcctgacaggattcaacatctgttgtctgaagagcccttgggccctgaataaccagcagtggtacccaggcagtacttgcagtgggccttcagtgagactcagagacatgctaccttcaggtgtgacatagcacattcccagctgtggacactatgggaagagactcctgcttgagaaaagaagacgaaagagtaaagagaactttgacatacagcttaggtaccagctcagccacagtgggctagggtaccaagcagaccctcggggaccctaattccaggccttggcttttggatggcatttgtggaccttccctgggctggaggggagcccactgcccagaagggagagacgtagtcctggtagcatttaacacaagctgactgaagagcccttgggccctgagtgaacatcagcagtagccaggcaatacctgctgtgggcctggggtgctagtggtcacagggagagactcctttgcttgtgaaaagcggagggaagggtagaaagattttgtcttatggcttgggtgccagctcagccgaagtagaatagagctccaggcagattcctaaagattctgactccaggccctggatcttagatagcatcttgggatcggcctagggctgggggaaatctgcagcccagaagggaaggacacaagaggagctggctttgccacctgatgaatgtggagccttagagccttgagcaaacaaaggcggaggccagtagttactgtggatcttgggtgagacccattgctatgcaggcttcaggtctaacccagtgtggtccccgtgaagggagccagaggggtgcttgtgtcacctctccaccagctttccagacagcttagcacagacagagagagattctgtttgggagaaagtaagggaagagaacaagagtctctgcctggtaatccagacaattcttccagatcttatccaagaccaccaaggcggtacctctatgagtctccaagactacaagagtcacagcattacccggtttgggatgccttctaatgcagatacagatgcagtgaccattagatcacaatatccaactccctttgaatacctagaaagccttcccaagaaggatgggtacaaacaaggctagactacaaagattataataaatacctaactcttcaatgcccagacacgaatcaatgtccacaaccatcaagaccatccaggaaacacgacatcaccaaacgaactaaataaggcctcagggaccaatcctagagagacagatacatgtgaatatatgtgacagagaattcaaaagagctgtcttgaggaaattcaatgaaattcaagataatatggagaagaaactgataatcacatcagataaatttcacaaagatattgaaataatttaaaagaatcaagcagaaattctggagtcaaaaaatgcaattgacatactgaagaatgtattaagagtctcttaatagcagaaccgatcaaggagaagaaagaattagtaagcttgaagacaggctatttgaaaatgtaccatcagaggagacaaaagaaaaaagaacaaaaaacaatgaagcacatctacaagatctagaaaatagcctcaaatgggcaaatctaagagttattggccttaaagaggaggcagagagacagataggggtataaagtttattcaaagggacaacaacagagaattccccaagcctagagaaaactatcaatattcaagaaaaagaaggttatggaacaccaagcagatttaacctaatgaagactacctcctaccatttaataatcaaactctcaaaggtcaaggataaagaaagtatactaaatgcagcaagagaaaggaaacaaataacatacaaaggagctccaatacatctggcagtagacttttcagtagaaaacttacagcccaggagagagtgacatgagatatttaaaaggggtgaaggaacaaacaaacaaacaaacaaaaaacttttaccctagaacatcatatctggtgaaaatatgcttcaaatgtgaaggagaaataaagactttcccacacaaacagaagctgaggaatttcaatatcaaacctgtcctacaagaaatattaaagggagtttctcaatctgaaagaaaaggatgttaacaaacaacgaaaagttacatgaaggtataaaactcactggcaatagaacattagttttctctttgcttgtttgttactttgtttgcttgtttatgcaatcagtgttatcatcagcttaaaatgatgcattacattatttgcaagcctcatggtaacttcaaaaaaacaaacatacaacagataaacaaaaaactataagcaagaaatcatgccgggcgcggtggctcaggcctgtgatcccagcgctttgggaggccaaggtggatggatcacctgaggtcagtagttcgagaccagcctggccaacatggtgaaaccctgtctctagtaaaaatgtgaaaattagctgcgcatggtggcgggtgcttataattccagctactcaggaggctgaggcaggagaatcgctcaaacccgggaaggcagagattgcagtaagctgagatcatgccactgcactccagcctgggcaacacagtgaaactccgtctcaaaaaaataataataaaagaaattaaaacatacaaccacagaaaattgctttaactaaaaggatgataggaagaaaagaaggaagacagggatcacaaaacaaccagaaaacaaataacaaaatggcaggagtaagtcctaacttatcaagaataatggggttggaggctgggcacagtggctcacgcctgtaaccccagcactttgggaggccgaggcgggaggatcacaaggtcaggagactgagaccatcctggttaacacggtgaaaccccgtctctactaaaaatacaaaaaattagctgggcgtggtggcgggcacctgtagtcccagctactcaggaggctaagataggagaatggcctgaacccgggaggcggagcttgcagtgagctgagattgcgccactgcactccagcctgggcgacagagcgagactccgtctcaaaaaaaaaaaaaaaaaaaaaaaaaagaataatggggttgggcaagatggatgactagatgcagcaaggtggaaaagctgccaccgaaagacaaggatgactggcacactcctaacagatcttcagagagaaggcaatgagagtgggcggagggaagaaacagaagcttggttggaggaggaagctgggaaccctgaatggggctaccgcacaccaggactcattcctggcccacaagaactccaggggaatgagtgagttgaagtggcaagaagcaactggctcttgcctcgggcctctggaattccgccaggaggagacccacagccaacattatactgaatgggcaaaagctggaagtattcatcttgaaaactggcacaagacaaggatgccctctatcaccactcctattcaacatagtattagaagtcctgggcagagcaatcaggaaacagaaataaataaaggttatccaaataggaagagagaaagtcaaactatcacagtatgcagatgccatgattctgtatctagaaaactctagtcttggcccaaaatgcttcttaagctgataaacaagttcagcaatatctcagggtacaaaatcaatgtacaaaaatcagtagcattcctatacaccaacaaaagtcaagcaaagaggcaaatcaggcatgcaatcccattcacaactgccacaataaagaataaaatacctaggaatacagctaaccagggaggtaaaaggtctctacaatgagaactccaaaagactgctaaaagaaattagagatgtcaaaacaaatggaaaaacattccatgctcatggataggaagaatcaatattgttgaaatggtcatactgcccaaagcaatttatacattcaatgctattcctatcaaactactaatgatattcttcataaactagacaaaactattttaaaattcatatggaacaacaaaaaaaaggttgaatagccaaggcaatcgtaagcaaaatgaacaaagctggaggcattatgctatacaacttcaaactatactacagagctacagtaaccaaaacagtgtggtactggtacaaaaagacacacagaccaatggaactgaatagacagctcagaaataaggccacacacctacaaccatctgatctttgacaaagttgacaaaaacaagtaatgggaaaaggactccctactcaataaacagtgctggggtaattggctagccacagggagaagattgaaactggaccccctccttacacaccatatacaaatatcaactcaagatgcattcaatacttaaatgtaaacccgaaaactataaaaaccctggaagacaacctaagcaatataattctggatataggaatgggcaaagatttcatgatgaagatgccaaaagcaattgcaacaaaagcaaaaatggacaaatgagatccaactaaactctgcacagcagagcttctgcacagcaaaggaaactatcaacagagtagagagacaacctacagaattgcagaaaagttttgcaaactatccatctagcaactaatatccattatctataaggaacttaaagaaatatagaagaaaataacaaccccattaaaaagtgggcaaaggacatgaacagacactttgcaaaagaaaacacacacgtggccaacaatcatatgaaaaaaagctgaacatcactgatcattagagaaaggcaaatcaaaaccacaatgagataccttacaccagtcagaatggccattattaaaaagtcaaaagatgctggtgaggttgtagagaaaaaggaatgcttatacactgctggtgggagtgtaaattagttcatccattgtggaaagcagtgtggtagttcctcaaagagctaaaaacagaactaccattcaaccctgcaatcctattactgggtataaattcaaaggaacatacattgttctattataatgacacacgtatatgttcattgcagcactatccacaaaagcaaaaacatggaataaagctaaatgcctatcaatggtagactggataaagaaaatgtggaaataaaaaataaaaataaagaaaaagttcaggaggggtgaaaaaaaaaaatccacgtgtgtaaaggtgtattctaaatgtgcctttcttcctgatacctacagtgactgaagctctagatacatgtgccctctgcctactcatactcacgtcccctcatacggcattcattacggaatgccccattatcaagttccacagcaaaaattgaggcgttgcatcctgtgatttccaaacctcagctagcagagccatagcctgctactaatgcctctgcatttggtttattgaacgcagctcatcacaaagagtctgacaaattcaacatgttatagacaactagagcttttctcattccaacagtagctgactcaactattagaaatctcagagatcaaaaatctactttctcattctcggcttgtaaagctgagcccagatctcagcacacattttcaagactgttgtcaatctatttatttaattttattaatatcttctataaacctaataataagaacaagatcatgtcctttgcaggaacatggatggagctggaggccattatccttagcaaactaatgcaggaacaggaaaccaaataccatatgttttcactaaaaagtgggaactaaatgatgagaacacatgaacacatagagggcaataacagacactggggctgaccagaggttggaggctgagaggagggagatgatcaggaaaaataacttatgggtgctaggcttaatacctgggtgacaaaataatctgtacaacaaacccgtgacacagatttacctatataacaaacctgcacatgtatccatgaacttaaaatgaaagtttaaaaacagaataacagtgaatataaatggactaaactctccaatcaagacatatagtgtctgaatggatttttaaaaaagacccaaccatctgtttcctgtaagaaatacattgtacctataaagacacatatacagtgaaaataaagggatgaaaaaagatatttcatgaaaatggaaaccaaaaaagagcaggactagctatacttacatcagccaaaacagatttcaagacaaaaaatataaaaagagacaacgatggtcattatataatgataaaggggtcaattcagcaacaagatacaacaattgtaaatatatgtgcacccaacactggagcaccagatataaaaagcaaatattattagagctaaatagagagacagaccccaaaataataatagctggagacttcgacacctcaactttacacattggacagatcatccagacagaaaatcaataaaaaaaaccaacggacttattctgcactatagaccaaatagatatttacaggacatttcatccaatggtcacagaatatacattcttttccttggcacataaatcattctcaaggaaagaccatatattaggccacaaaacaagtcttaaaacattcaaacaaatgaaatcatatcaagtttcttctctgaccacaatggaataaaactagaaatcaataacaagaggaatttttgaaactatataaacacatgaaaattgaacaatatgctcctgaatgaccagtgggtcaaagaaaacattaagaaaaaaactgaaaaacttcttaaaacgaatgataaaggaaacacaacatacaaaaacctatgggatacagcaaaagcattactaagaggaaagtttacagctctaagtgcgtgcatcagaaaagaaaaaaaaaacaaacacctaccaatgcatcttaaagaactagaaaaacaaaagaaaataaaaccccaaattagtaaaataaataataaagatcagcacagaaataaataaaaagttggttttttgagaagataaacaaaactgacaaaccattagccagattaagaaaaaggagaagattcaagtaaataaaatcagagatcaaaaagtagatattaaaactgttaccaaagaaattcaaaggatcattagaggctcctatgacaaactacatgcaaaaaattggaaaacctagaagaaatggataaattccaagactcatacaatctaccaagattgaaacattaagaaatccaaaatctgaacagagcagtaacaagtaacgagattaaagctgtaataaaaagtcttccagcaaagaaaagcctggaaaccaatgtcttcactgctgaattttaccaaacgtttaaagaagaactaataccaatcttcctcaaactgctgtgacaagtagaggaggagggaatacttcaaacacattctataaggccagtaacaccttaataccaaaaccagacaaacacatcaaaaaaagaaaactacagggcaatatctgagatgaacattcatgcaaaaattctcaacaaaataatagcaaacacaattcaacaccacattaaaaaggtgttgttgaacatgaccaagtgggatttatccaagggcttcaaggatgatttaactatgcaaatcaatcaatgtgatacatcaaataacagaatgaaggacaaaaactgtatgataatttcaactgatgctgaaaaaacatctgataatattcaagatcctttcatgatataaatcctcaaaatacggttatagaaggaacatacctcaacacaataaaagccatatattgacagactcacagccagtatcgtactcaatggggaaaaactgaaagactttcttctaaaaattggaacacaacaaggatgccagcttttaccactgttattcaacatagttctgcaagtcatagctagagcaatcagacaagagaaagaaataaagggcatcccagttggaaaagaagaagtcaaattatcctgtttgcaaatgttatgatctggtatttggaaaaacctaaagactccaccaaaaatattttagaactgataaacaaacttagtaaagtggcagcatacaaaatcagcagcatttctaaatgccagcagtgaataatctgaaaaagaaattgagaaagtaatcccatttacagtagccacagtcaaaattaaatacctaggaataaacttaaccaaagaagtgaaagatgtctacaatgaaaactacacaatgctgatgaaagaaatggaagagggtacaaaaaaatgaaaagatcttccatgttcatggattggataaattaatattgttaaaatgcccatactacccaaagcaatccatagatacaatgcatccttatcaaaataccaatgacattcttcacagaaacaaaaaaaaaattctgaacttttcatggaaccacagaagacccacaataggcaaagctgtagtgagcaaaaagaacaaaactggaggaatcacattacctgacttcaaatgatactacagagctacagtaaccaaaacagcatggtactggcataaaaacagacacacagaccaagagaacagaagtgagaacccagaaacaaatccacacaccagtaaactcattttttgcacaggtgccatgaacatgcattgaagaaaggacagtctcattaataaatggtgctgtggaagctggatatccatacgcagaacaatgaaagaagaccccaagctcttgccatatacaacattcaaatcaaaatggattaaagacttaaatctgagacctcaaactatgaatctactacagaaaaacactgggcaaactgtccaggacattgaactggcaaagatttcttgagtaatatctcacaagtacaggcaaccaaataaaaaatggacaaacaggataccactaagttaaaaagcttctgcacagcaaaggaaacaatcaacaaggcgaagagacaacccacagaatgcgagaaaatatttgcaagctatccaactgacaagggattaataaccagaatatataaggagctcaaacaactgcataggaaaaaaaatctaataatcagatttaaaaatgggcaaaatatctgaatagatatttctcgaaagaagacatacaaatggcaaacaggcataggaaaaggcactcaacatcatcagtcattagataatgcaaatcaacactacaatgagaggctgggcatggtcactcacgcctgtaatcccaacactttgggaggctgaggtcagaggatcgtttaagcccgagagtttgagaccagcctgggaaatatagtgagaccccgtctctacaaaaccaaccaaccaaacaaaaaagataatgaaatatcatcttaccccagttaaaatggcctttatccaaaagacaggcaataactaatattggtgaggatgtggagaaaagggaacttgtgtacactgttgttagtaacgtgtattagtacaagcactatggagaacggtttggaggttcctcagaaaactaaaaacagaggtactatatgattcaccagtcccactgctaggcctatacccaaaagaaaggaaatcagtatattgaagaggtagctgcactctcatgtttattgtagcactgttcacaacattaagatttggaagcaacctaagtatcaaccaacagatgaataaacaaagaatatgtggtacatatatacaatggagtactattcagccataaaaaagaacgagatactgccatttgcaatagcatgcatagaattggagatcattatgttaagtgaaataagccaggcatagaaagacaaagttcatatgttctcacttatttctggaagctaaaaactaaaacaattgaactcatgatgataagagagtagaatggtagttaccagaggctgagaagggtagcagggagtggggtaatgggggatggttaataggtacaaaagtatagttagaatgaataagatctagtatttgataccacaacagggtgactacagtcaaaaataatttattgcacatttaaaaataactagaagagtataactggattgtttgtaacacaaagaaaggataaatgcttgaggtgatagatatcctttaccctgatgtgattattatgcactgtatacctgtatcaatataccttatgtaccccataaatatatatacctattatatactcacaaaaattaaaagttaaataaaatacaattggcaaatgtggtaaaactctggcaaaaattcctacgtagatgtccagaatatatgagaaataaaattatatggactagatcatatgtaaacttcaaggattcccatttaggtagctgttgcatttttgtaacaaaatatattacttttacttgacattcctgggttttttacatttcttccagaattatcaatgactatccatccctccatagtaggaataattactgacgtagatgtcatacaaacttattataaagtcaagaaaattaaacataacctagaaatagtcagacgtcagaattcttaccatctgttgttttgtcaatacatcattgtagattgcttctcttcgtttaacatcaagctcctggctggcttgtctacttaatgctaacgcctgtacttgggcctctgagagattcatgttctccttccactaaaagaaaaattttctatttactccttattactgtacaattgaggaaaaataattaaggtattttaagatattcgggatttcccaaggtttcaaaccccccttttcctttattcttttctgaagaaaaacatgatgcaaaacagggtactaagttgttcactgctgtacctgggctggctatctctggaatgaaacaataatttagatttaatttgtacaactggtaattaaaatgtttatataaacaatgcatacatttccatgtttgatttctcaattcttacattttacccatttctctcttgtgccaacatctatgtaaaattgctgggttacggtttggcattatccatccattttaccagtattttactattgcaaatcaatttataagaaggaacaattaaaaatttaaaaaaatggcagtagggggtggagggtacaaattggaggttggaataagacaattgccaattagcttactacagctgaaattatatcctcaagaggttga

SEQ ID NO: 8446 - DNA, 7475 bp, artificial
  synthetic oligonucleotide
agcatgttaatttaataaaagaaaacataaaaactgaaacaatgacaagtctcaagacaaacttgtgaaaggccagttcaggcttatactatgcctgaaaataataccacgcactattttaccattttcatcttcaggagacacttattttgagaaacgccatttctaaacccctttaacgtattcaccccactaattccagatttaaaacctatcctatcaagtcagacatgactgtctaaggtcaggttatggtgaaggttcagcctctaatgatgcaataactttccttttgacttacagtcaactgaaatgccaatgtaagtcacaggaaaagtacatgtgaatttgtttgttttctatcttaaaaagtttcagattttttgcctaaaacattacctccatcctggctactataatcctcttttcaaagaaccgaacaaaacaaagaaatgcaaacaatactaacatccaattacaaaaccaggaaataactaccagtaccattttttattttattcctccacacattgacacacacacacctttgcataaaaatggaactggacaaagggcaagatggctgatgagaagcagctgtggtctgtggcactcacagagaggcatgaaaaggggtgaatgaatccaataccttcaaatgaaatatccaggttctcacattgggactgaataggcaaaaagcatggagagcaaggagaagggctacggcccatccaggagccacgtggagcaaaaggaacccccacccccagccaggggaggcagtgagtgattgtgcaacccgctcaggaagccaccacgcttctcccatggatctttgcaacatgcggagcaggagatcctgttgtgaacccattccaccaggaccttgggtctgatacacagagctgtgtggagtctcagcaaaacagcagctcaggcgcacacagagatctgggagttctgcatgctcctgccccgggatccccgccaaggcataaaatccatccatatacatccctaggaaggggtctgaatacagggagccaagcagcatggctcggcaggccccatttccatcgcacctcacaggctaagacccactggcttggaatctcagctagccaacagcagagggctgaagtccgcctgagacaagaccaagttccagcgggaggggcggtcgccatctctgcaattcaggggaaatagccaatacagcctgccagctgtgaagagtggacacggcccagaggaggaggggccgcccacagcgcagtgcagtggccttgccagataagggggccagactgcttcttcaaccagacggacccactccaaactgagcaggacttcccatgcagggtcagagatctgatctctcgctgggagggagctgggggtggtgggggggtggggggcggctgatatctctgtggtttctggggactcagttgttccagcctccccgttgtggagagtgcagaccacccagacaaggagcaccccctccttccccgcacaaggcgcagcgcagctgccttgccagattgtagccagactgcttctttgacaggtcccgacccactcctgcagacagagatctgatctctccatgggagggagctccccaggggagggccagcggccatctctgtgcttccgttaaatcagccatttcagcttgctggttatggagaatacaggtggtacagaggaagaaaagggtccaccccagtgcaacacacctgctctaccaagaagcaaccagactgcttcattgggtgggtccctgatcccatccctcctgactgggtgagatcttccagtgcaggttgccagccgcctcctgcaagtgctggagaagccgaggaaactagggtctggagcaaagccccagctaaccacaggagccctacagtagggtggcgtgattgttaaaagaaaaacaaacagaaaacaacagcagcaatgtcaacaacaacaaaaaaaggccccgaaaaaaaacccattcaaaggttagcaacctcaaggatcaaaggtagataagcccacaaagatgagaaacaatcaatgcataaatgctgaaaactcaaaaagccagagtgccttttcttctccaaatgactgcaacacctctccagcaagagcacagaactgggctgaggctgagaaggatgaaataacagaaatacgcttcagaaggtgagtaataacaaatatcgctgggctaaaaaaaagcatgttttaacccaaggcaaagaagctaagaatcacgataaaacaatacaggagctgatagcaagaatagccagtttagagaggaacataaccaacctgatggagctgaaaaacacaacatgagaacttcacaatgcaaactatcaatagcagaagagaccaaggtgaggaaagaatcttagagctggaagactatctttctgaaataagacaggcagacaagaatagagaaaaaagaatgaaaaggaatgaacctctgagaattatgtgattatgtaaggagaccaaacctacgactgactggggtccctaaaactgacagggagagtggaaccaagctggaaaacatactttaggatatcatcgaggagaacttccacaacctagcaagacaggccaaatttcaaattcaagaaatgcagagaaccccagtaagatattccacgagaagatcaaccccaagacacataatcatcagattatccaaggtcgaaatgaaagaaaaaatgttgagggcagccagagagaaaggccaggtcacttacacaaaagaaagcccatcagactaacagcagacctcttagtggaaaacctgtaagccggaagagattaggggccaatattcaacattcttaaataaaagaaattccagcccagaatttcatatacagccaaaccaagcttcataagcaaaggagaaataagatcccatttagacaagcaaatgctgagggcattcatcactagcaggcctgccttgcaagaggtcctgaaggaagcactaaatatggaaagaaaaaaccattatcagccactaaaaaaaacactgaagtacacagtccagtgacactatgaagcaaccacacaaacaagtctgcaaaataaccagctagcatcacgatgatgctaaagcagattcataaagcaagttcttagagacctacaaagagaattagactcccatacaataatagtgggagagtttaacacccctctgacaatattagatcattgagacagaaaattaacgaggatattcaggacctgaactcagctctgcatcatgtggacctgatagatatttacagaactcttcacccaaaaacaacagaatatacgttcttctcattgccacacaacacatactctaaaatttatcacataataggaaaatactcctcagcaaatgcaaaagaactgaaatcataacagtctcttagaccacagcgcaatcaaattagaactcaagaataagaaatccactcaaaaccacagaactacatggaaattgaacaacctgctccttaatgactcttgggtaaataatgaaattaaggtagaaatcaagaaattttttgaaactaatgtgaacaaagagaaaacacatcagaatctctgggagagaaatttatagcactaaaatgcccacatcaaaaagctagaaagactgggcacagtggctcacgtctgtaatccctgcactttgggaggctgaggcgggtggatcacttgaggtcagtagttcgagaccagcctggccaacatggtgaaaccccatctctactaaaaaatacaaaaaattagccaggcgtggtggcaggtacctgtaatcccagctacctgggaggctgaggcaggagaatcccttgaacccaggaggcggaggttggagtgagctgagatcgtgccattgtattccaacctgggcaacagagtgagactccgtctcaaaacaaacaaacaaacaaacaaacaaacaaaacaaaacaaaactagaaagatttcacgttaacaaccaaacatctcaactaaaagaactagagaaccaagagcaatcaaaccccaaagctagcagaagacaagaaataactaagatcagagctgagctgaagcaaacagagacatggaaaacccctaagaaaaaaaaaataacaaaagaaattcaacgaatccaggaagtggtttcttaaaaaaattaataaaatagttagaccgctagctaggctaatgaagaaaagaaagaagaatcaaataaaataaaaatcaaataaaaaataaaatcagaaataagggggacatccccactgaccccacagaaatgcaaacaaccgtcagagaataatataaatacctctgctcatataaactagaaaatccagaagaaacagacaatttcctggacaaacacaccctccaagactgaaccaggaaaaaactgaatctctgaatagactagtaacatgttctgaaattgaggcagtaataaatagcctaccagccaaaaaaagcccaggaccagatggattcatagccgaattctaccacaggtacaaagaggagctgaatactgaaactattccaaaaattacagaggaaggactcctccgtaactcattctatgaggccagcatcatcctgatatgaaaacctggcagagatacaacaaaaaaagaaaacttcaggccaatatccttgatgaacattgatgcaaaaaaatcctcaataaaataatggcaaactgaatgaaaccagcagcacatcaaaaagcttatccaccatgatcaagatggcgtcatccctggaatgcaaggttggttcaacatatggaaataaataaatgtgattcatcacataaacagaactaaacacaaaaaccacatgattatctcaatagatgcaaaaaacatcttcaataaaattgagcatgccttcattgtttaaaactctcaataaactaggcattgaaggaacatatctcaaaataatatgagcaatatacgacaaacccatggccaatatcatactgaatgggcaaaagctggaagcattccccttgaaaactggcacaagacaaagatgccttctctcaccactcctattcaacgtagtattggaagtcctggccagggcaatcaggcaagagaaagaaataaagtatattcaaataggaagagaggaagtcaaaatatctttgtttgcagatgacatgtccctatagctagaaaaccccactgtctcagcccaaaagcttcttaagctgataagaaacttcagcaaattctcaggatataaaatcaatgtgtaaaaattactagcattcctatacaccaacaacaggcaagcaaagagccaaatcatgaataaactctcattcacaattgctacagagagtataaaatacctaggaatacagctagcaagggggaagtgaaggacctcttcaaggagaacaacaaaccactgctcagggaaatcagagaggatacaaacaaatagagaaacattccatgctcatggataggaagaatcaatagtgtgaaaacggccatacttcccaaagtaacttacagattcaatgctattcccattaaactaccactgacaattcttcacagaattagaaaaaaaaaactatttgaaaattcatatggaaccaaaaaagagcccaaatagccaatgaatcctaagcaaaaagaacaaagctgaaggcatcatgctacctgattttatctataccacaagcctacagtaaccaaaacagcatggtactggtacaaaaacagacacatcgaccaatggaatggaatagaatagagaacccagaaataagactgcacacctacagccatctgctctttgacaaacctgaccaaaacgagcaatggggaaaggattccctatttaataagtggtgctaggagaacaggcaagccatatgcagaaaactgaaactagaatccttccttacaccatacacaaaatttaactcaagatggattacagactgaaatgtaaaactccaaactataaaaaccccagaagaaaatctaggcaataccattcaggatataggcatgggcaaagatttcatgagaaaaacaccaaaagcaattgcaacagaagccaaaattgacaaatgggatctaattaaactaaaaagcttctgcacagcaaaagaaacgatcatcagagtgaacagacaacctacaaaatggaagaaaacgtttgcaatctatctatattacaaaggtataatatccagaatctacaagacatttaaacaaatctatgagaaagaaacaaccccattaaaaagtaggcaaaggacatgaacagacatttctcaaaagaagacacacttgtagcctataaacatatgaaaaaaagctcatcatcactgatcgttagagaaatgcaaatcaaaactacaatgagataccatctgatgccaatcagaatggctattactaaaaagtcaaaaaacagcagatgctggaaaagttgtggagaaaaataacacttttatactgttggtgttcaaccattgtggaagacagtgtggcgattcctcaaagacctagaggcagaaataacatttgacccagcaatcccattactgggtatatacccaaaggaatagaaatcattctattataaagatacatgcatgcgtatgttcactgcagcactatttacaaaagcaaagtcatggaatcaacctacatgcccatcaatgatagactggataaagaaaatgtggtacatataccagatggtacatatacacactatgcagccataaaaaggaacaagatcatgtcctttgcagggacatggatggagatggaagccattattctcaaactaatgaaggaacagaaaaccaaaccccacatgttctcacttataaagtgggacctgatcgatgagaacacatggacacatggagggggacaacacacacttggcacctgtggggggttgggggagggagtgcatcaggaagaatagctaatggatgctgagcttaatacctgggtgatgggatgatctgtgcagtaacccaccatggcacacatttacctgcataacaaagctgcacatgtattctggaacttaaaagttgaaagaaaaaaaatggaattgaagtatatgtagttttgaaacatactcttatctcttaatacctttccgtggatatcattttacatcaaatccaaaccttcatcatttctaatagctgcacagtgcttatatagttatactttatcatctatttaatcattcccttacttaagagtttattaaaacattaagactgcttccagtttttattaccaaatctgcgaacaagggttaatgaataaagtttaatgtatttcaatcacttctttatatgattatgccaaaaaattcaaagactaaagataagcatgctttccataattttcatt

SEQ ID NO: 8447 - DNA, 35991 bp, artificial
  synthetic oligonucleotide
caccaccaaaaaaaactagaaagacagatacagaatatcacagctttcctagaacagaaacactcaagtagaaactgacaacttctggaggccaaatatggattagtttgagagtttaaaaatcctgacatcccagtcttagaggggcccctacactttcctaggttttacctccaggaatcctacaagggttttagtatgttttcactgcaaatatttgaggaaaatttccttgtgccttgagcaggaggagaggaaagaaactatattcaaatatgctcacaccattatctaccaagaggaaagacaattagaaaacccccgaggcttatagccttcctgtctcatctaagtgggagggcaagggctaagaaacacttctgagagtcacaattcagggactcaggaccaattaaaaaaaaaagaaatgacatttaatcatgagattacaaaacacttcccctccctaattccttaccactacatcaatagggttccagtgtaataacagtgaatgacaactgagacagcagcaagacagattctcagggaaactcaaaagacaaatggggaggaaaaaaattaaaacaaagaaactaggccaggcacagtgaatcacgcctataatcccagccctttgggaggccgaggaaggtaggattgcttgagctcaggagttcgagaccagcttggggaacattagcaagatctcatctctactacaaataaaaataaaagtgagaggctcacttgagcccaggaggtcaagaccagcctgagcaacatagtgagaccctgtctctacacacacacacacacacacacacacacaaagtcacatgtggtagtgtgagtctgtcatcctagctactccagagactgaggtaggagaatcacttgagtctgggagatcaaggctgcagtgagccacagtcacaccactgcactccagcccaagcaagagagtaagactttgtctcaaaaaatttaaatttaaatttaaaaaagtaaagtcatggctattgaaggcctttgttcatttcttgaaggcctttgttcatttcttcattgggttttcttttcgctgctcagtaaaagttctttacacattctggatattaaaccctcatcagtcatatgatttgcaaatattttctcccattctgagttgtctttctttttattctcttgatagtgacctttttttggggggggggattgcttcattttgtttgtttgtttgttttgagatggagtcttgcgctctcgcccaggttctagtgcagtggcacgatctcagctcactacaacctccacctcccatgctcaagtgattctcctgccacagcctctcaagtagctgggactacaggtgcgcgccaccatgcccagctaatttttgtatttttagtagagacagggtttcaccatgttggtcaggctggtctcgaactcctgacctcaagtgatccacccgcctcagcctctcaaagtgctgggattacaggtgtgagccaccacatccagccgatagtgacctctgatgtaaaaaaatttttaaatttttaatgaagtccaacttacttattcttttgctgcctgtgctttctacattatgtttatgaaatcattgccaaatcccaggtcatgaaaatcagcccaaatgttttctgctaagagttttataattttagctgttaacgttaagatctttgatgcatttaactgttttatatggtgcaagataggggcccaacttaattgttccatgtacatatagagggttttatttttttttggatatagagttttgttggggatgatgaaaaagttttgggcataggtagtaatgatcatgatacattataaatatatttaatgccactgaattgtacacttaaaaataattaaagtgataaatattagaccaactaagaagaaaaggcagtaagttcttcattctgatagataagtggaaaataaaccaacaaacccatccaacatcaactctaatcctcctaatcaagacaggtagagtagttcagattttctaacctaatgttctaatcttttctaacctttatggtgctccctcagccctgattttctctgctacaaaatgttccacagaaccactttaagtagcaattctagcggaaacctcatctgggtggacaaaggagaagcaggattgggcagaaagaaaactgcctttcccacatacaggggaactgtgagaccctggaggaacctggggaatggggcagaagaaacaagatcaggaaaagatggatgactgcaagaatttcaagcgtgcctcatccaggtacaagagctaaaattgtgtagacaatgacactttggatatattatcccagagggaacacaggagttcaacagaaaagcgacagcaaaaaccaaaatctaggaagcaaaaggaaaacagagagcctgtgtggctgggacccacagggaaccagaagtgattccccaatatgggagagggtgagtatttttctgtggtccactaccatacaatccagtcctcagtagagcaccctgaccctcttaagccctgaatctaattaatttagggaatgactggaagactgtgagaaagaactgtttcagggagggaacacattctgtgtcccatgccatttttgaaacctaagcagctgtaacaagacacgatgcaggatctcagctcataactgtgagcagtacggggaagcaacagggccagtcctagccattagggaaacttgggctgctgtttggagaggcagagtgtgagtaggggcggggatggggtggctctgcctggtgtgggatgcagccaccaccagtgctagaagcaaacaccacccccaggatttgagcacgattaattgccctggaggcttaagtcttgagctggatggggcttatatgacccgaccctgggatgatttagggactaggcaagaactgcagagttctgactgaacagcagggacaagaggaaggaactccgcctggactggggcatgaaaggaacacaactcactcctgggaccaggcccaacttccccatggcaggatctcagcagtggcactcatccctcacccaagcattttgccagcagcctgaagatcattccaccccgcctatcatgacattacaccactgtgggggcctgagtgcaagctttcccagtccagctctaccaggctttgacctggctgagaaacagtgcaggatccaggttaccaggggattccacaaccaaacccactacctgaaacactctgaaacaccagagtacttctcccaggggacagaggtcagggataacaccctaccagtaccgcctcagctgcctcatgcctgcaagtaccaccttactggcctggatctcattgtaaccactgctaacacaaatgcaaagtgcttgggacccacaagagtatctcaacaaaactactaccaccataaactatgccatgccagttgcccaggagctcaagagccagctcacccacctggtacaccattacaacaggcatctgagaaagtcactcagaagcccaagaatcagcctgcctggaactgccaacacagttaccagcacacactgccccagggcacatggatagacatgcttagcccaccatcactaccattgaaacctaaagacaggcctattaggcattccaatccccagcgcaacttcagcctccacaaataaactcaagctaagacatcaaggaaaccacagacaccattaatgctatttatagccaaagaaatcatacagaggctgggcacggtggttcatgcctgtaatcctaacattttgggaggccaaggagagaggattgcttgagaccaggagttcaagaccagcctgggcaatataatgagacccccatctctaaaagaaaattgaaaattagccaggcatggtggcacacgcctgtagtcctaggtactcaggaggctgaggcagaaggatcacttatgcccaggactttgaggctgaagcaagctatgaatgtgccactgcactccagcctgggcaacagagctgtctcaaaataaatcatacagagacttcactactgcacgcacccagaagcaaggcccaaccaacattatagtcacatcttcaggaagaaatctcccctcaccatgaaagtaaattcaaagataagaagtgactgttacagcacatgcacagaaatcaatgaaaagacaaaggaaacatcagaaaccaaggtaatatgacactgtcaaaggaacacgattctgcagcaacagatcttaaccaaaatgaaatccacaaaatcccagataaaatattcaaaatattgattttaagggtcactgagatgcaagaaaagtctgaaaaccaatacaagaaactcagaaaatcaattcaagatatgaataagaaatttacaaaggagaaacccttaaaaaaaaattctgaccaggcacggtgccttgtgcctgcaatcccagcactttgagacaccaacgcaggaggatcacttgagtcgaggagttcgagaccagtctagacaacatggtgaaaccccatctctacgaacaattaaaaactagctgggttagccaggcatggtggtgggcgcctgtaatcccagctgcttgggaggctaaggcaggagaatggcttgaaccgaggaggcagaggttgcagtgagccgagatcgcaccactgcactccagcctgggtgacagagtgagactctgcctcaacaacaacaacaacaacaacaaaaacctagctgggcatggtggtatgcgcctatagtcccagctacttggaagactgaagtgggtggatcccctaagcctgcgaggttgaggctgaagtgaacctccgccactgcattccagcctgggcaacagagtgagaccctgtctcaaaaatgaaaaaaaaaaaaaaaaaaaaaaactagagagctaccatataatccagcaattccactgctaaatatgtaccccaaagaaaggaaatcagtatatcaaagagttatctgcactcccatgattactgcagcactattcacaataaccaagatttggaagtaacctgagtgtccatcaacagacggacgaataaagaaaatgtgttacacatacacaatggagtcctattcagcccttaaaaaagtatgagatcctgtcattgcaacaacatggatggaactgtaggtcattatattaagtgaaataatctagacatagaaaaacaaacttcacatgttctcacttatttgtggtatctaaaaatcaaaacaattgaactcatagagatagagagtagaatgatggttaccagaggctaggacgggtagtgggggccagggcactaatggggatggtggcacagtggggatggctaatatgtataaaaatatagttagatagaatgaataagacctagcatttgatagcacaatggggtgactacagtcaataataattcattatgcattttaatataactactagagattagaaactattagagattagaaactagattgtttctaacaccaagaaaggataaatgcttggtgatggatacaaccctgatgtagttattgaacattgtatgtctgtatcaatattatctcatgtaccccataaataaatatacctatgtacacacaaatttttttttattttaaaaatacccacaatgaggtatcatccagccccagttagaatgactattactaaaaagacaaaaaataacacaagttggtgaggttgcagagaaaagggaacactcatacactgttggtgggaataacacatgttctcattcacatgtggatgctgaaaaatgtgtacacatggacgtagagcatggaatgatagataacagacttggaaaggtgagagagcaggaggtgggagatcatgagaaattacttaatgaatacaatgtgtgttatttgggtgatggaaactctaaaggcttgacttgacggctctgtaatctatccatgtttaaaaaaaaagtgcacaagtacccccgtaaatttatataaataaaaaaagatcatcaacaaaacataaattcctttgagaatgtttagaaatgaagcataaaaccctcttttcattaattaaaaaaagacaactagagttcctagtctgtatatacttattgtatttgagcatcttgccctagatacatgtaacctaacaatatcacagtcttaccacctaaaactacatatcactccttgtccgtctggttaaacttatttattttcagatgatggttctattcctggagaatctaaattagtacacactctcaaaatgcaaattcctatattcaactattaaatggttttcttatcaaaatggcaaatatcctgattttctaaatttctggtctggctttaacatcaacaaaagtcctataggtctgtttctttcaacaggctaatgccttaggggaaagaacagtcataatctgggattaataacataagcaaatagatttaagagacacaattttctaattgtacatgattttttgaaaaaccctttttttgagatggagtcttgctctgtggcccaggctggagttgcagtggcgcgatctcggctctactgcaacctccacctcccgggttcaagcaattctcctgcctcagcctcctgagtagctgagactacaggcgcacaccaccacgcccggctaatttttgtatttttagtagagatgaggtttcaccatgttggccaggatggtctcgatctcctaacctcgtgatccacccgcttcggcctcccaaagtgctgggattacaggcgtgagccaccgcgcccggcctgaaaaaatccttttacagcatctgtgtagcattaaaatttcaaaacaaaggccactcatgtcaaattcacaagtatctcttgcctcgaaaacttccatttaacctcttctggaactgacataaaggattttaacacaaaatcagccagacgcagtagatcatacttgtaatcccagcactttgagaggccaaggcaggcagatcacctaaggtcaggagatcaggaccagcctggccaacatggtgaaaccccatctctactaaaaatacaaaaatcagccgggtgtggtggcacacacctgtaatcccagctacttgggaggctgaggcataagaattgcttgaaccccggagaagggggttgcagtgagctgagactgcgctactgcactccagcctgagctatagagtgagactgtctcaaaaaaagggggcgggggacttaacccaaaatcagagttaacttctattcaagagcacattcatttactcattttataatatttacaccaaatgctgaatatattcttggcacttggtattgaaataaaaaacagataaaacctgacctcaaggagctcacaatctaatagtaaagacaagccattaagcagcccaggggtaatctagggtagaaaagggggatccatctctctgtgaatttcctaatgttttctaaatttctgactatatctaatctttatatagtttcctttaagtgttaaaactctcaccttatttccaacacctgctaacctccattttaagaaacaaagtttgctagagagtcaagactttcctgaagaataacttgggaaagcaaatatatattattatgcaaagaatacttaatcctggtttaaataagagtctgatttcacctttgataaagaaggggagaagaacaaaatctaggtttcctgacagaaaataatcatgcattcctatacctgtagctaaatatcccagtgctttaactaaacccatctacaaatcattagagtaatcatttaatttggggcccactattcaattatttttctgatccatgcatttattgtatataaatttaaaataaaacaatataagaaagttttccatgtactgatatatggaaagcttctcaagacacattaagtggaaaaagcaaaggggaggcaagtgtacataacatgccaccttttatggtataaaggggaatgattaaagatctgtggttaactgctactgaacacacaaagaactctggaaagataggttaggcatcagtagcagtgattgggctggggggtggtaagctgctggcagctgtgggaacagagaacagggaagtgggggaaatttctaacttttatactttatacctttaaaaatatcttttataccttttggtgttcaaaccatataaatattatttcttattccaaaaataattaaataaaaagaagataacattgaaacagaactaaaaaggttttttatttttatttttatttttttttttggagatggagtctcgctctgttgcccagactggagtgcagtggtgtgatctcggctcactgtaacctccgcctcctgggttcaagtgattttcccgcctcagcctcccaaggagctggcattacaggcgtgtgccaccatgactggctaatttttatatttttagtagagatgggatttcgccatgttggccaggctggtctcgaactcctgacctcaggtgatccacccacctcggcctcccagagtgctaggattataggcataagcaacagcacccagcctaaaggttttaaagtgagatacgaaatggtttcaattattccctatgacaggctatttactaagtgttttaaaaaacttttatttgtatatatttagggggtacaagtgcagatttcgtacatgcatatattgcatggtggtaaagtgggattttagtgtacccatcacccaaatactgaacaaagtactcaataggtaatttttcaaccctcacccccctgccaccctctcaccttttggagtctccaatgtctattattctactctattctatgtgtaaccatttaagttcccacctgtaagtgagaacatgtagtatttgactttctgagttatttcagttaggataatggcctccagtcccatccatgttgctgcaaaagacatgatttttttttcttttttgtggctgaatagtattattccacagtgtgtatgtatacacacaaacacacacacacaccaattttcttcatcacttaggttgattccatatctttaatcttgtgaacagtgctacaatcaacatacaaatgtaggtatctttttgacataataatttatttccttttcgatatatactcagtagccactactcaattttgaggaagcacaaagaaacaaatcactccagataaaaataaagcttatttccctaatcaataaaaatgaaatcagacaaattctacaatgcaagcactagctagacagagttttgaaaaatgctaattaaaatctgaaataatacagtaatcccactttgtccatggttgttttgctttccatgaattcagttacctgtggtcaactgcagtccaaaaatattaaacggaaaattccagaaataaacaattggtaagttttaaactgcacgattctgagtagtgtgacaaaatcttgcactctcctgctctgtccagccgtggacatgagacatccctttgtccagtgtatacatgctatatacgctgcctgcccattagtcatggacactgtctgctcctgacaaccagcaacagacatcatcaggacgtgatgattcaggaccacccaagcagatgatcctccttctgatgtaacaccagaaggtcaatagtagcttcatgctgcattacaatgcctaacataattcacctaccttcatcacatcacataagcattttatcatctaacatcatcatcataagggtgagtacagtacaataagatattttgaaaccaaattcacataaattttattacagtatattgttataattgttctattttattatagttattgtcagtctctcactgtgcacaatttataagttaaactttatcataaatatgagtgtacaggaaaaaaacataagtgtatataggattcagtactatccacagtttcaggcatccattggggtcttggaacttatcccgtgtgaataaggggagactatggtagtattaaatttattacacaaacgatgaaatcatcatgcccggggcaaaagatacacaaacgtataacaccacctttgaaaacagagtgtttactttatcattagaatgtaataaacttgttctacataatagacacctaagggaggaggtataaacatattttattaacgcgcatagtaacttccatatctttttttttttactttacgatctgaaatacatgtgcagaacatgcaggtttgttacacaggtatagatgtgccatggtggtttgctgcacctatcaacccatcatctaggttttaagccccacatgcattatatttgtcctaatgcactccctccccttgccccccaacccctgacaggccccaatgtgtaacgttcccctccctgtgcccatgtgttctcactgttcgactcccacttatgagtgagaacgtgcagtgtttggttttctgttactgtgttactctgctgacaatgatggcttacagcttcatccatgtacctgcaaaagacacgaactcaatcttttttatggctgcatagtatttcatggtgtatatgtgccccattttccttatccagtctgtcattgatgggcatttgagttggttccaagtctttgctattgtaaatagtgctgcaataaacatacaggtacatgtgtctttatagtagaatgatttataatcctttgggtatatacccagtaatgggattgctgggtcaaattgtatttctggtttctagatccttgaggaatagccacactgtcttccacaatggttgaactaatttacccttccaccaaaagtgtaaaagtgttcctatttctccacatcctctccagcatctgttgtttcctgcctttttaataatcgccattctaactggcgtgagatggtatctcattgtggttttaatttgcatttctctaatgaccagtgatgatgagctttttttcacatttgttggccacataaatgtcttcttttgagaaatgtctgttcatatcctttacccactttttgatggagttgttttcttcttgtaatttaagttccttgtagattctggatattagccctttgtcagatgcatagattgcaaaaattttctcacattctgtaggctgcctgttcactccaatgatagtttttttgctgtgtggaagctctttaattagatctcatttgtcaattttggcttttgttgccattgcttttggtgttttagtcatggaagtctttgcccatgcctatgtcctgaacggtattgcctaggttttcttctagggtttttatggttttaggttttacatttaagtctttaatcgatcttgagttaatttttgtataagctctaaagaaggggtccagtttctgttttctgcatatggctagccagttttcccagcaccatttataaaacagggaatcctttccccattgcttgtctttgtcagatttgttgaagatcagatggttgtagatgtgtggtgttatttctgaggcctcggttctgttccattgttctatatatctgttttggtaccagtaccatgctgttttggttactggagccttgtagtatagtttgaggtcaggtagcaggatgcctccagctttgttctttttgcttaggattgttttggctctacgtagtttttcctagttctgtgaagaaagtcaatggtagcttgataggaatagcattgactctgtaaattactttgggcagtatggccattttcacgatattgattcttcccatccatgagcatggaatgtttttccatttgtttgcgtccttatttcctcaagcagtggtttgtagttctccttgaagaggcccttcacaccccttgtaagttgcattcctaggtattttattctctttgtagtaattgtgaaagggagttccttcataatttggctgtttgtctattattggtacataggaatgcttatgatttttgcacactgattttgtatcctgagactttgctgaagttgcttatcagctcaaggagtttttgggttgagatgatggggttttctaaatatacaatcatgtcatctgcaaacagagaaaatttgatttcctgtcttgctatttgaataacctttatttctttctcttgcctagccagaacttccaacactatgttgaataggagtggtgagagagggcatccttgtcttgtgctggttttcaaaaggaatgcttccaacttttgcccattcagtatgatactggctatgggttgtcataaatagctcttattattttgaaatatgttccatcaatacgtaatttattgagagtttctagcatgaaggggtgttgaattttatcgaaggccttttcggcatccattgagataatcatgtggttcttgtcactggttccgtttatgtgattgattacttttattgatttgcgtatgttgaaccagccttgcatcacagagatgaagcagacttgataatggtggataagctttttgatgtgctgctggattctgtttgccagtattttattgaggattttcacatcgatggtcatcagggatattggcctgaaatttccttttttggttgtgtctctgacaggttttggtatcaggatgatgcttgcctcataaaatgagttaggaaggaatccttctttttctattgcttggaatagtttcagagggaatggtaccagctcctctttgtacctctggtatcattcggctgtgaatccatctgctcctgggctttttttggttggtaggctattaattactgcctcaatttcagaacttgttattggtctattcagggagtcaacttcttcctggtttagccttgggagggtatatgtttccaggaatttatccatttcttctagattttctagtttatttgcgtagaggtgtttataatattatctgatggtagtctgtatttctgtgggatcagtggtgatatcccctttatcattctttattgtgtctatttaattcttctctcttttcttctttattagtctggctcatggtctattttgttaatcttttcaaaaaaccagctccttgattcattgatttttggagaggttttcatgtctctatctccttcagttctgctctgaacttagttatttcttgtcttctgctggcttttgaatttgtttgctctttttctctagttcttttaattgtgatatcagggtgttcattttagatctttcctgctttctgatgggggcatttagtgatataaattcccctctaaacactgctttatctgtgtcccagagatttctggtacgttgtctctttgttctcattggtttcaaagaacttctttatttctgccttaatttcgttatttaccagcagtcattcaggagcaggttgttcagtttccatgtagttgtggggttttgagtgaataagtgtgatgtgctgagaagaacgtatattctgttgatctgtggtagagagttctgtaggttactattaggtctgcttggtccagagctgagttcacgtcctgaatatttttgttaattttctgtctcagtgatctgtctaatattgacagtgtggtgttaaagtctcccactattattgtgtgggaatctaagtctctttgtaggtctctaagaacttgctttatgaatctgggtgctcctgtattggaagcatatacatttaaaatagctcttcttgttgcatcgatcccttaaccattatgtaatgcccttctttgtccttttttgaactttgttggtttaaagtctgttttatcagagactaggattacaacaccccttttttttttgttttttccatttgcttggttaatattcctccaaccctttattttgagcctatgtgtgtctttgcacatcagatgggtcttctgaatacagcacaccaatgggtcttgactctttatccaatttgccagtctgtgccttttaattggggcatttagcccttttacatttaaggttcatattattatgtgtgaatttgatcctgtcattatgatgctagctggttattctgaccgttagttgatgcagtttctttatagtgtcgatggtctttacaatttggaatgtttttgcagtggctagtaccagtttttcctttctgtatttagtgcttccttcgggagctcttataaggcaggtctagtggtgacaaaatctcttagcatttgattgtccgtaaaggattttattcctccttcgcttacgaagcttagtttggctggatgtgaaattctgggttgaaaagttttttctttaagaatgttgactattggcccccactctcttctggcttgtagggtttctgcccagatatccttcctctgggagcttccctttgtgggtaacccgacctttctctctggctgcccttaacattttttccttcatttcaaccttggagaatctgacgattatgtgtcttggggttggtcttctcaaggagtatctttgtggtgttctctgtatttcctgatttgaacgttggcctgtcttggtaggctgtggaagttctcctggataataccctgaagtgtgttttccaacttggttccattctccccatcactttcagggaccccaatcaatcataggtttggtcttttcacatagtcccatattttttcagaggctttgtttgttccttttcaaccttttttctctaatcttgtcttcatgccttatttcagtaagttcatcttcaatatctgatatccttttttccgcttcagcgatttgactattgatacatgtgtatgcttcacgaagttcttgtgctgtgtttttcagctccatcaggtcatttatgtcctctaaactggttattctagttagcagttcttgtaaccttttatcaagttccttggcttccttccattggattagaacatgctcctttagctcagaggagtttgttattacccaccttctgaagcctagttctgtcaattcgtcaaactcattctccgtccagttttgcggccttgctagagaggagctgtgttcatttgaaggagaagaggcattcgggtttttggaatttccagcatttttgcactgggttttcctcatcttcgtggatttatctacctttgatctttgaggctgatgaccttttgatggggtttttgtgtgggggtcctttttgttgatgttgatattattgctttctatttgttagtttttcatctaacaggcccctcttatgcaggtctgctgcaatttgctaaaggtccactcctgaccctgtttgcctgggtatcaccagcggaggctggagaacagcaaatattgctgcctgctccttcctctgggagcttcgtcccagaagggcaccagcctgatgcccacgggagctctcctgtgtgacgtgtctgtcaacccctgctgggaggtctctcccagtcaggaggcactggggtcagggacccgcttgaggaggcagtctgtcccctagcagagctcaagtgctgtgctaggagaatcctccttgtcaggatccactgctttcttcagacctagcaggcaggaacatttaagtctgctgaagctgcgcccacagctgcaccttcccacaggttatctgtcccaggaagatgtgagttttatctataagcccctgactggggctgctgcctttctttcagagatgccctgcccagagaggaagaatctagagacgcagtctggccatagccactttgccacgctgtggtgagttctgcccagtctgaacttcccagcctccttagtgctgtcaggggaaaactgcctactcaagcctcagtaatggcagacgcccctcccctcaccaagctcaatcttcacaggtcagcttcagactgctgtgttggcaatgagaatttcaagccagtggttcttagcttgctgggttctgtgggagtgggacccgctaagcaagaccacctagctccctggcttcagccccctttccaggggagtgaatgggtctatctcactggggttccaggcaccactggggtatgaagagggggaaaaaaaaaaaactcctgcagctagctcactgtctgcccagatgcccagttttgtgcttgaaacccagggctggtggagttggcacactaaggaatctccgggtctgcggactgcaaaaatcatgggaaaagtgtagtatctgtgccggatagcatagactcacgggttcctttggcttggggaagggagatctctcgctccttgcacttccgggagaggcgacgccccaccctgcttctgctaccctccatgggctgcacccactgcctaaccagtcccaatgagatgaactgggtacctcagttggaaatgaagaaatcccccgccttctacattttggtctcactgggagctgcagaccagagctgttcctattcagccatcatttttttttttttaagatggagtctcaatctgtcactcaggctggagtgcagtggcacaaaatcggctcactgcaaccactgcctcctgggttcaagcaattctcctgcctcagcctcccaagtagctgggattacaggcacacaccaccacgcctggctaatttttgtatttttagtagagacgaagtttcaccatgttggccaggctggtctcgaactcctggcatcaagtgatccatccgcttcaacttcccaaagtgctgggactacaggcatgaaccactgcacccgacctatatcttttgatatatacatcatatcatgaaatttatgctctttttatgaaatccatactcttataaattcagcatccaactgttaaatgcatccactctgaaaaatagatgtctacactagacatctcatgaaatcttcatcttggtattgtctccactgcacacatgaagaaacaactcagatgctgggtaaatttcccaaggttacacagcaagagaactggatgtgaacccaaatctgacaccacatcatgcaattccaaattaaatcaagttgagactagagcttaaactgtctgaattttattccaaaggattggagatgaatccatttctccaccatttcctttctccgaaactaaaaaatatcagatgcaaatggaactcttactgaaattaaatggcaatctctaaatgatgaataatctctaaatagataataaataaaataatctctaaatcaaaaaatattctttgaaaaactcctctaacgctggaaaaacaatgggtaagcaataacatagtttggctggttccatttgtaacttaagaaaagcctgaaattgaatagaaggaaagtattatctttttttttttttttggagacaaagtctcactctgtcgcccaggctggagtgcagtggcacgatctcagctcactgcaacctccaccctctgggttcaagccattctcctccctcagcctcccgagtagctgggattacaggcccctgccaccacgctcagctaatttttgtatttttagtagagatggggtttctccatattggccaggctggtcttgaactcctgacctcgtgattcacctgcctcggcctcccaattgacttatctttaaacatgggaacagtgacacctcattcaatctcttctttcctataataatattccaactatgaaaattttaggttaagaactcttccctcctccttgcattccccttccctggtaatagtaaatccactacagaaaatgaaatattaaaagtgtgaagtacaggctgggcacggtggctcacgcctgtaatcccagcactttgggaggccgaggcgagtggatcacttgaggtcaggagttcgagaccagcctggccaacatggtgaacctctgtctctactaaaaatactaaaaattaggcaggtgtggtggcgggcgcctgtaatcccagctactctggaagctgaggcaggagaatcgcttgaacccgggacacggagtttgcagtgggccaagatgacgccattgcactctagcctgggcaacaagagcgaaactccatctcaagaaaaaaaaaaaaagtgtgaagtgcaaaatagaagttacctacaatctgaccatccagagataagcatgtaaggaaatgctcgccgggcacggtggctcacacctgtaatcccagcactttgggaggccaaggcgggtggatcacttgaggtcaggagttcaagaccagcctggccaacatggtgaaaccccatctctactaaaaatacaaaaaaattagccgggtgtggtggcatgctcctgtaatcccagctactagggaggctgaggcaggagcatcacttgaacccaggaggcggaggttgcagtgagccgagatcacgccactgcactttagcctgggtgacagagcgagattccatctcaaaaaaaaaaagctaacatagacctgattttaacaaaacgaaatggttactgctttataatcttttctttccattaagatactgtgaatatttttctgcatcattaaatattcttctaaaacatcatttttagtggcagcacagtattccatgacgtaaagctgccatttctttttcaagctaatggaacttaaagatgggacattctttggttgcataactgcagctgcctactaataagatacataacatggctgttaaattttaaatttatttattcagatcagaagcactacaataaaaaataggcaatgtgagttgactattacaaaagattcactgagaaaaataagctgacattttatattcacttaaataattaccaatgcttccttatgcttttgactttaagtattaaattacagttatctacacaaaaacatcgaccaggatgaagaactgcagaacaagaacattctcaaactgccagtggaagtataaatcagaagaaccattagggagaaagaaactctagcatatgtgcaaaggagacatgtttaagaatgctcatgagaacagtctttagtagcaccaaattcgtaaaaaaaaaaaacaacaactatccaccagtagcaaactattatctatataacttaatactaaacaggagtgaaggctgggagcagtgactcacacctgtaatcccagcactttgggaggccaaggcaggtggatcacttgaggtcaggagttcgagaccagcctggccaacacagagaaaccccgtctctactaaaaatacaaaaattagccaagtgtggtggtgcacagctgtaatcgcagctgcttgggaggccaaggcaagagaattgcttggacctgggaggcagcagctgcagtgagcaaagatagcaccactgcactccagcctgggcgacccagcgagactctgtctcaaaaaataaaaataaaaataaaataataataaataaacaggaatgaaaagtgggcaatatagatcagtgctgcccaacagacatataatgtaaggcatttcaaatatatatttaaattttctagtagccatattttaaaaaaggaaaccactggtaaaatttttacattttatttaatccaatacatccaaactattatcagttccatatgtggtcaatatatcagattttttcagattttggaatatttgcattaaacctttgagcatttcctttgagagtcatgtcagtaatcaaaaaattttgggttttggagcattttctatttcagattcttagggatactaaacttttagtgagatattttacatgtttttaatactaaatatttgaaattccatgtacaaatatatttctagcacatctcaatgtggactagctacatttccagtactcaatagccacagatagttagtggctattgtattggacagtgcagatctggagttacatcaaaatcctaaaaacaacattgagcaaacaaacaaaaaaaaaaaaggcaagttgcaaaataatatgtactgtatggtgccacttacataaacgtataaaactgaaaaaatttcattctcagtaaactatcgcaagaacaaaaaaccaaacaccacatattctcattcataggtgggaactgaacaatgagatcacatggacacaggaaggggaacatcacactctggggactgttgtggggtggggggaggggggaggggggagggatagctttgggagatatacctaatgctagatgacaagttagtgggtgcagcacaccagcatggcacatgtatacgtatgtaacctgcacaatgtgcacatgtaccctaaaacttaaagtataataataaaaataaataaataaactgaaaaaattctaaataaggtttatgtatatggaaacatgtttatgtagaaaacattaaaataacccatgaggcttcaactctatctgtaatgttttaattctttaaaagaaatctaaagcaaatatgacataagattttaaaatatttcccacttaaataataaaaaaatagaatatgcttgcttctgtttatattcaattacttacttctgaaaatatgctacagaaatatttagtgtgtaaatttcatattttactttgtactacatagatccgtagcatctttctgttgttcatgtattaagtttgataacagaagttcaaggaaaagttcaaaaaattaagtaaggataaaaactgatgaattttgtcttgtttattcaacaagcatttactatatgattattgtgtgtattcagggagttcataatgtggtgaacagctttttgttacaagcagtcatatggagatgaaagtatattttagcactacatagaacaccaagatcaaagtaaaagagcaaaatacttaaacagtgagttttggccctgagagtaattgttaaatggaaaatttttaaaggcattcttctttttatgtatatatttaaagggtatggccaggcgcagtggctcatatctgtaatcctagcactttgggaggcagaggcgggcagattgcttgagctcaggagttcaataccagcccgggcaacacggcaaaacccatctctacaaaaactataaaaattagccaggcatggtagcatacacctgtagtcccagctacttggggggctgaggtgggatgatcgcttgagcctgggaggtcaagcaggcagtgaactgtgatcatgcctctgcactccagctgaggcaacagcgagagaccctgtctcaatcaatcaatcaataaagtgtacaacatgaatgttttgatatacatatacatagtgaaatgattactatggtcaagcaaaatgtcccatctccacatatagttatctttttctgtgtgtgctgaaaacacctgaaatctactcttttaacaactttccagtacatgatacagtattattaactatagtgttcatgctgtacattagatctctagacctagtcatcctacgtgattccaacttggtaacctttaaccaatatctccccatttctcccaccttcctacccatttaactacttttctactctcttcttttgcagacttggcattcttagattccacatataggttgaagtcatgaagtattattttttccacgtctggctaacttcacttgccataatgtcctccaggttcatctatgttgtcaccaatggcaagcatattagtttagtgtaccatcttaagatacgcaatgacttggccaggcgcggtggctcatgcctgtaatcccagcattttgggaggccgaggcgggcagatcacgaggtcaggagatcaagaccatcctggctaacataatgaaaccccatctctacaaaaaatacaaaaaaaattagccaggcgtggtggcaggcgcctgtagtcgcagctactcgggaggctgaggcaggagaatggcatgaatccgggaggtggagctttgcagtgagcagagatcacgccactgcactccagcctgggcgacagagcaagactctgtctcaaaaaaaaaaaaaaaaaaaaaaaagatacacattgactcactagaagagattttttttaaagactgcaataaacacacaagcaaaaccctcattcattctacttagttttagctaaatactgtatatattacttgtacatagctctaaatattttaataaaggttcgtagaacatgaaagaaaagttcaaaatgggaagcactggaaccatagagactatgagttgtcataatgtggaacttcagatataacagtctttcaaaacaggaaaaacaattagttgaaaatatgactttaaaaactgaacctcaactatactaatatctgtaatttactttgaaatgaataagaaaataaaatgaaatgttacatcaatggagagttggacagatggatcaatatgtgataaaacaagaagagtaaaaaaaaaagaagagtaaaatgttaaaggtagaatctagatgttaataatattggtgttcagtgtaaaatttttaaagctttgctgtaagttttaaattttcataatgtgttaaaaattaaactttaatgtgaggataatagcttttaactacaattatgatgtgtactggcaccagaagaaaaaaaatcaacttatctttttgcaaatagttcattttaggtaaataccccatagtatagtttgttcaaaaaacacttcaatacaatatgattatgtttggaaatttagtctagaataatccactgaagggtaagtgttaaccaaattcaactaactgcaagatgataattgttgaagctgggtgacaggtacttagggggtttcgttattttatatatatatatatagttgtcttttgttttttgttttttttgggatggagtctcgctcttgttgcccaggctggactgcaatggcacaatcttggctcactgaaacctccacctcccaggttcaagtgagtctcctaactcagcctcccaagtagctgggattacaggtgcctgccaccatgcccagctaatttttgtgtttttagtagaaacaagagttcaccatgttggccaggctggtcttgaactcctgacctcaggtgatccgcccaccttggcctcccaaagtgctggattacaggcgtgagccaccgggcccaacccattatactattttcttttttcttttttttaaaaaaaaaaaaaaaaaaaatgagtcttgctctgtcacccaggctggagtgcagtggcacgatctcggctcactgcaacctccgcctccctggttcaagaaattctcctgcctcggcctcccgagtagctaggattacaggcgcccaccaccacgcctggctaatttttgtatttttagtagagacggggtttcaccatgttggccaggctggtctcgaactcctgacctcgtgatctacctgcctcagcctcccaaagtgctgggattacaggcgtgagccaccacacccggccccgttatactattttcttatttctgaatatgcttgcaattttacagaataaaaaagtcaaatagcctgggcgcagtggtgcacacctgtaatcccagcactttgggaggctgaggcaagcggatcacttgagcttaggggtttaagaccagcctgggcaacaaggtgaaaccccgtctcaacaaaaaatacaaaaatgagccaggtgtggtggcaaaggcctgtagtcccagctactgtggaggctaaggtgggagaatcacttgtgcccaggaggtctaggctgcagtgatccaagatcatgccactgtactctagcctgggagacagagtgagaccctgtctcaaaaaaaagagttaaatatatagagaatgttttaatacctagctccgtatactatagcctagaacagattaaataagctatttcaattttttatattaaaggtataactaatcctggctcaactttaaatcattatcttgtagaaacatactgatccttgtttttatgaacagttacttctaagtctgccagatacctctgccttccttgatctactattgtattgtacacttagggtattaagagacatgtcatgaacttaggatattaagagaagtgtcatgagttccctaagtctgagccaagcttctggactctgctcactctgatcaaagaatttaagagaatgttacctattctacagtcaacttctaacttactccacatttttcacaacaaaaacccacaagtaatgaagaaatggtgatccagattccaacacatatagaaggcatgtgatgcaaaaatcaaataagatgtatttttcatgtagaaggagtagagaaagaaattactcaaattttacagaagactggaattgttttactccttttttccctccaccacagacttcctcctagtacagtaagcagaaggactgttctttctagtagttaacctactctgacctctaacaagtatactactaagctagttattgaacttaaaacagtcaaaactacagactacacaaattcaatgtagaaactgcatttcacaataaagaacagatacaagctactttgagattaggaaaataaacttttccaatcaaaaacaactgtgttggcagggtgcggtggctcatgcctgtaatcctcacaggccgaggcaggtggatcacatgaggtcaagagttcaagaccagcctcgccgacatggtgaaaccctgcctctacaaaaattagtcaggtgtggtggtgggtgcctgtaatcccagctactcgggaggctgaggcaggagaattgctttaacccaggaggtggaggttgcagtgagccgagatcacaccattgcactccagcctgggcaacagagcaaaaactctgtctcaaaaacaaacaaaacaaacaaaaacaaacaaaaaaactatgtcaatgacaaattgcatactcttagaaaacccccttagcctctgggctataccataatgattttaaatagcaaggaaacagctctgaagcacgggaacaataatacaagtaatcaagaagattctaaataatctattgtcacagcaatagaagtgtagctaatttactttcttcagattgtggcattgacagaaaaacataaaaatcactttaagatacaacaggtatcctttactgtattttctcgaacaagagttttaacataccttagagaaaaatattccactttcttacagaagtgttataaaatacacagaaaacaacctaatggactagttaaaaacacggtactgtaccaagaaccttgaactgggagtcagataaccttggttctagtcctaattactaattagatctatgctgttaagcaaactgcaacctcaggagagctcaattttctcatttttttttaattttttttatttttatttttattttttttattgatcattcttgggtgtttctcgcagagggggatttggcagggtcataggacaatagtggagggaaggtcagcagataaacaagtgaacaaaggtctctggttttcctaggcagaggaccctgcggccttccacagtgtttgtgtccctgggtacttgagattagggagtggtgatgattcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaagtctcccatgtctacctctttctacacagacacggcaaccatccgatttctcaatcttttccccacctttcccccctttctattccacaaaaccgccactgtcatcatggcccgttctcaatgagccgctgggcacacctcccagacggggtggtggccgggcagaggggctcctcacttcccagcaggggcggccgggcagaggcgcccctcacctccccgacggggcggctggccgggcggggggctgacccccccacctccctcctggacggggtggctgccgggcggagacgctcctcacttcccagacggggtggcagcggggcagaggggctcctcacttctcagacggggcggctgccaggcggaggggctcctcaattctcagacgaggcggttgccacgcagagggtctcctcacttctcagacggggcggccaggcagagacgctcctcacctcccagacggggtcgcagccgggcagaggcgctcctcacatcccagacggggcggcggggcagaggcgctccccacatctcagacgatgagcggccgggcagagacgctcctcacttcctagatgggatggcggccgggaaaaggcgctcctcacttcctagatgggatggcggccgggcagagacgctcctcactttccagactgggcagccaggcagaggggctcctcacatcccagacgatgggcggccaggcagagacgctcctcacttcccagacggggtggcggccgggcagaggctgcaatctcggcactttgggaggccaaggcaggtggctgggaggtgaggttgtagcgagccgagatcacgccactgcactccagcctgggcaccattgagcactgagtgaacgagactccgtctgcaatcccggcacctcgggaggccgaggctggcggatcactcgcggttaggagctggagaccagcccggccaacacagcgaaaccccatctccaccaaaaaaatacgaaaaccagtcaggtgtggtggcgcgcgcctgcaatcgcaggcactcggcaggctgaggcaggagaatcaggcagggaggttgcagtgagccgagatggcagcagtacagtccagcttcggctcggcatcagagggagaccgtggaaagagagggagagggagaccgtggggagagggagagagggagagagggagagagggagagggggagagggggagagaggtagagggagcctcatttgtaaaatgagagaattttactagattaattaaaatgctttccatctataaaatttgcttctggaaaagaccatctatccaacataatagattttttttttctttttgagacagagtctcgctctgtcacccaggcaggagtgcaatggcacaatctcagctcactgcaacctccgactcctgggttcaagcaattctctcacctcagcctcccaagtagctggaattataggcacccgccatcatgctcggcaaaattttgtatttttgtagagacagggtttcaccacgttggccaggctggtcttgaactcctgacctcaggtgatccgcccgcctcagcctcccaaagtgctgggattacagccatgagccccagtgcccagccccaacataatagatttaagagtagctgcaaatccactcctggaaataaccttttcctctgcaatatattgatgcccacatccctcagctgttttattcacactatcttcggaccaaaggagaagtctggatcacttaaggattcccaaccccaaactgtatttctgaaatgttactgccttcctcttcttatctaggttacctgatacgattgttatataactcaacaggtcactgagataaaattttagagctaaaagcagtttaaaatgagagactgaactaaaaaatatcactacagattaaaaggaaaacactgaggctcagggtcacagttatcataagacccagaactaaaagttacagaaagcataatccagtgctttttcaacactccattctattaataacactatgttccataacttgaaaatattttgattcaatttcatgttacccaaggtttcaaagttattttatttcatcaactaagtaaaaatcaagttattatcgcttaatggaagatatgtcataacaaatctactttacctatcacaccactgttaatttatcatcctgtttatagcagaaaagtcaacagtcctcatagacatctggtcccagggtaaggaaagacttctccttaccttatgtttcctgcattttagaaaagcacataaaacaataacaaagattatatcattacacaaatgaatactgcttttaacaatttttattgaaaaacttacgaataaaaggagatgttttaactgtccagctgacttttttagtacagaaattatccttttattttctatttatttattcaactgattttttaaaattggatcacaacttaagccatgctactcaaaactaaggaaatgtgaaccacacccatgtttcctttagaagaagacattaaatccacatacagaaaaaattctgttcataggcaattttcttacaaaatagagacagaatacataagtgatataaactaaatgcatctatggaaacactcctagctacttcttagagggcaaaacactatccataccattataataataacattaaaaaccatgaaaatctcacttctgaaatcaatgtcaacagtgtccctttgagaaatcctgctttaaagtaacaaagtttggtgccttctttcaaatttaactcatctatgttgtatctatgtatctaatgtctgtctgcatggttaacaaaaacacattaaaggctcagagcttgtagcttaccaactttttctttccccacaaaccaccatcacaagccacaatttttaccccaaaggaagagagagaggatcaacagacaaaaatggaaaaagtaagcgaggcactgtgatgtgcacctgcagtcccagctactcaagatgctaaggccaggagtacgaggctgtagtgtactatgttcacacctgtgaatagccactgcaccctagcctggacaacatagtgagaccccatctcaaataagtattttttaaattttctaaatgggaaaagcagcaaattatgtcatacacaaggattgttttttcccacaaactgttttttgtttgttttttttttttttgagactgagtctcaccctgtagcccaggccaggctggagtgcagtggtgctatcttggctcactgcaacctccacctcccgagtcctggttcaagcaattctcctgcctcagcctcccgagtacctgggattacaagtgcatgccaccatgcccagctaatttttatatttttagtagagacagggtttcaccatgttggccaggctggtcttgaaatctgacctcatgatacacctgcctgggcctcccaaagtgctgggatgacaggcgtgagccaccgtgcccagcccaaaaactgttcttaaatggattgcaacaaacggaaacaatctgggagaggtagtctttaatacaatttccacagacctgtccatatgtgggtttttattctttttacaatattatttgatcctctcatttgtttcattacatcaatttattttcaaatatgagaactgctattgttttataccatccaattctccatgataatgtaaccgttaaaaatatttttcagggccaggcgtggtggctcacacctgtaatcccaacactttgggaggctgaggtgatcagtgcccttgagctcaggggttccagaccagcctgagcaacatggtgaaactccacctctaccaaaaaatacaaaaagcagccgggtgtggtggaacacgctactgaggagactgaggtgggaggatcacttgagcccaggaggttgaggctgcagtgagctgagattgtgccaatgcactccagcctaggcaacagagcaagactgtttcaaaataaaaatgggaaatgataaacttttttttttttttgacacggagtctcactctgtcacccaggctgaagtgcagtggcacaatctcggctcactgcaacctccacctccagggttcaagtgattctcctgcctcagcctcctgagcagctgggattacagacgcatgccaccatgcctggctaatttatgtatttttttagagatggggtttcaccacattggtcagactggtctcaaactcctgacctcaagtaatctgcttgcctcagcctcccaaagtgctggcattacaggcgtgagccaccatgcccggccaaaaatgataaactttacatagaaaaatctactggaaaccacccaagtgattaaaattaccatcatcagtaatgggaccaaccaatgtcatgcatctcctgttacagaggcactgaaaacaacataccatcacttctgttatttcttccaaaaatgcatacccttcatctaatcataaagaagcatcacacaaacccaaatagagatacattctaaaaaataattgttctatactcttcaaaaatgtcaagatcaggacagacaaagagaggccacagaactgctccaaattaaaaggacattattagggtaatgaaaattagaatacagatttttgcccacttcactcctgctttgaatatcaagaatcttcatcagtattgacaatatgtcagaattttgacaaatgaggatgaagaagtctacacacagggtgatgtgatttaagggcaacatatgacatctagttttagttttatataaatctccatcccttcctattttcctactttacaggctagagttatcttcttgagtttaatattcaccattgaccatttttaccatttcactgtatcactattcttttaaaaagctgatcatataactctacagactttaaaagtatttgttgattttctataatgaaagggggaaaatgaaacattttagcatagcataaaaagcctttctcggccgggcgtggtggttcatgcctgtaatcccagcactttgggaggccgaggctggcggatcacaaggtcaggagttctgagactagtctggccaacatggtgaaacccggtctctactaaaaatacaaaattagccggaagtggtggcacgcacctgtaatgccagctactcaagaggctgaggcagaagaatcacttaaacccagaaggcggaggttgcagtgagccgagtgaggcactgcactccagcctgggtgacagggcaagactccgtctcaaaaaaaaaaaaaagcctttctcaaacctgaccccaactagcatccttctttccaattctacctcccatattctctccaatcatacttattatctcatttttctcaaggcacccaagggctcctctaccgtatctctagacataacccgttccaccacctagaatatttccccctcctcagcacatttccccccaccatccccaatgacccaactcagaattgctgtctctcttgggaaaatacttgctatcaactctctaaggaaattttttgctattcttccacatctcttggtttatatctctgtaactgtacttaaccacatagtctatttcaaccatttactcctccacttagctcagtattcattatctacaaatgcctattatctagaaaagtggttctcaaacccataccgcccacagggaacatctggcaatttctggaaatatttttgcttgtcacaactcagggtaggggtgttactggtatctagtgggtagaggtcagggataaaatgcattcacaggacagcctctaacaaaaaattttctggacaaaatgtctatagtgccaaggttgagacaatctgttctaaaataatacttagctcatgttaagccttaaaagtgtttatcagccaggcatggtggctcacgcctgtaatcccagcactgtgggaggccgaggcgggcggatcacctgaggtcaggagttcgagaccatcctgaccaacatggggaaaacccgtctctactaaaactacaaaaaaaattagctgggcacggtggcatacgcctgtagtcccggctactcaggaggctgaggcagaattgcttgaacccgggaggcagagaacccgggaggcagaggtgcagtgagccaagatcatgccactgcactccagcctgggcaacacagcaagaatccgtctcaaaaaaaaaaaaaaaagtgtttatcaaaatagaaaaatgaggccaggtacagtggctcactcttgtaatcccagtactttgggaggccgaagcagaaggattgcttgaggccagaagtttgagaccagcctgggaaacatagcgagatcccttctctcaaaaaaaaaaaaaaaaaagcttttttttgagacagagtctcgttctgtctccaggctggcgggcagtggcgccatctcggctcactgcaacctctgccccctgggttcaagcaattctcctgcctcagcctcccgagtagctgggacttcaggcatacaccaccatgcccagctagtttttttttttgtatttttagtagagacagggtttcaccattttggacaggatggtctccatctcttgacctcgtgatccatccgcctcggcctcccaaagtgctgggatcactcccaaaggcgtgagtcaccacacccagccaaaaacaaacttttttaatggttaaaatgctaaatcttgtggtatgtgtatttcaccaccaatttttttttttttttgagagacggggtcttgctctgtctcccaggctagagtacagtggtataatcatagctcactgcagcctcagactcctgtgctcaaaggatcctccctcctcagcctcccaagtatttaggactacagttgtgcaccaccacacctggctaattttttttttttttttgagacagagtctcactatgttgcccaggctggagagatatttccctgtggcaaatttcagctaaaaaaaaaaaaaaaaaaaaaaaaagaactgagatattcaacaagctatgttggatgcactatagtatagtcagcctttgaaggaaatatattatttcatatgcttaacaacaggtccaatcactttaacatgaaacattcacccttaattctctgcttttagctatatgttcagaatacaaaatgaaaattcataatcggggtggttggttttgaactttgggggtatctgaggaaggaggaaatggaaaaagcaagaaaaatgggaggtgggaaaactctccccaattctgtagaaattaatcaagccaaacttcaaacctctaaataaaatggcagagaatgagctgattaataattttagcatgagaagcaaaatcggccaggcacgatggctcacgcctgtaatcccagcactttgaaaggccaaggcgggcggatcacgaagtcaggatatcgagaccatcctgatcaacacagtgaaaccccgtctctactaaaaatataaaaattagctgggcatggtggtgcacgcctgtagtcccagctactcaggaggctgaggcaggagaatcgcctggacccaggaggcggaggctgcagtgagccgagatcgcacgtctgcacaccagcctgggcgacagagcaagactctgtctcagaaaaaaaaaaacaaagcaaaatcattctaaaacatagtaaaagcaaaggcattatacacctcctgataaaatgtgctgtgaaggacaaaacatcacttcatagtgttcctaccaaaatatataatcaaagggaaacatcagacaaattcaaatcaactggcctgtgttcttttaaaaatggagaagaggccgggcgcagtggctcacatctgtaatcccagcactttgggagtccgaggcgggcagaccacctgaggtcaggagttcaagaccagcctgaccaatatggtgcaaccccatctctactaaaaatacaaaattagccgtgcgtggtggggcatgtctgtagtcccagttactcgggtggctgaggtaggagaatcacttgaacctgggagatggaggttgcagtgagccaagactatgccattgcactccagcctgggcaacaagagcaaaactgtctcaaaaaaaaaaaaatggcaaggtgagctgttccagatgacaatgaaatataatgagtgttctagaattagatggtagatcagaaaacaagaactttttgtctttcatcatgaaggatgtcatgaagcaattggtaaaatgtgaataaggtctgtagattaaaaatggtattgtatcggccgggtgcagtggctcacgcctgtaatcccagcactttgggaggccgaggcaggcggatcatgaggtcaggagatcgagaccatcctggctaacacggtgaaaacccgtctcgactaaaaatacaaaaaattagctgggcgtgatggcgggaacctgtagacccagctactcgggaggctgaggcaggagaatggcgtgaacccagcaggcggagcttgcagtgagccaagatcgcgccaccgcactccagcctgggcgacagtgtgagactctgtctcaaaaaaaaaaaaatggtattgtatcaatgctaatctctcttttattttaagagatgggggtctcactctgtcattcacactagactgcagtggcatgatcatagttcatggcagcctggaacttctaggctcaagtgatcctcctgactctagctttctgagtagctgggactccaggcatgctccacaccggctaatttagtacttttgtttgtttgtttgtttgtttgtttgtttgttttgtagagacagggtctatgttgagaagactggtcttgaattcctggcctcaaacaatcctcccacctcagcctcccaaagtgctgggataacaggtgtgggaggccgcactcagccttaatgctaatttttaattttgctaactatactgggatcatgtaacagactattcctagtttcgagaaatatgtattaaagtatttgggagtaaagggacatcatgtctgcaatttactctgaaacaattcagaaaaataataatagaggatgataaagtaaacatggtaaaatgttaccccttgctgcatctggatgaagcacatctgagaatctttgtgctatttttacaaattttctacaagtctgaaattatattttgtaaccttttatacagtaaaaaaaggaagggatgattactctttatctccctaaagatagatcggattcatctcctgaggttacagttacaaaaaaacaatcacatggccaggtttggtggctcatgcctataatcccagcactttgggaggccaaagagggcagatagcttgagtccaggagttcgataccagcctgggcaacatggcaaaaactcatctccacaaaaaaatacaaaaattaactcagcatggtggcatgcacctatagtcccagatattcgggaggctgaggtgggagtatcacctgcaaccagggaggcggaggctgcagtgagccatgactgcaccaatgcactccagcctgagtgacagagtaacagcctatctcagaaaaaaacaaaaattaaaaacaataattctttatttatttatttatttatttatttatttatttatttttgaaacggaatctcattctgtcgcccaggccggagtgcggtggtgatatctcggctcactccaacctctgcctcccggcttcaagcaattttgcctcagcctcctgagtagctgggattacaggcatgcgccaccacgcccggctaatttttgtatttttagtagagacggggtttcaccatgttggccaggctggtcttgaactcctgacctcaggagaaccacctgccttggccacccaaagtggtgggattacaggcatgagccactgcacccagccaaaaacaataattcaataaaatattataccctatcaaggagacactgctgagaaagctgttttaagtgaaatgtctttgacttgtggatggatcttaaaatattattttgtgtaacagcacaacttttctgtggggcaagggctcggttactagccaaaatgtatattaatagatttttaaaaatac

SEQ ID NO: 8448 - DNA, 761 bp, artificial
  synthetic oligonucleotide
caattatcctatttccacaatagtggcatttcaggttactcttcataactatgggggaggttatagttagatataatgataaccatgaaaacattcttcacagaaatttggttagcacatatggttatttctactgacagaaaccaaaagacaaaataaaaaaaatcccttcaaattggtactttgtttctccacctaaaggaagagaataaagactaaaataacagcaaaacatagaacagctttcgagaaacgcttaatttctatatacaggcatcagctcaatattttatgatttttctttcccattctaagggagtccttttctttcttacttttttttttttttttgagatggagtctcgctctgttgccaggctggagtgcagtggtgtgatcttggctcactgaaacctccatctcctgagttcaagtgattctcgtgcctcagcctcctgtgtagctgggattacaggctcctgccaccacacccagctaatttttatatttttagtagagacggggtttcaccatgttggccaggatggtctcgaactcctgacctcgtgatctgcctgccttggcctcccaaagtgctgagattacaggcgtaagtcactgcgcctggccagggagtccttttctaactgagcctatttttctcttaggtacaaatggaataagtgacaaactctaatttgtagaaacattttaggccatgtataagttacactgattttagcactaagctatatttttat

SEQ ID NO: 8449 - DNA, 1425 bp, artificial
  synthetic oligonucleotide
taatgtgaaaggaaaatttgcctttgacctggaagtcaactttatagtaagctgaaattataaataactgatcatggaactattgcagatcacctttgagccaaaaatttggcctggattttggttatgcctactactatgtgcctctcatttgtatttatacctggaattggcattattaactccttttcactcctgcctagaaaacttaaagtgtcaccagacccaagggcggagtggtcctataaaacaaactcgtagcctgtctgaagactagctactagctccttggctgttttggcatattcatcttgattatagctcttggtctttcatcatattagggatgtttatgatgttattaaagaaaatcttgtcaaatgcagtctgttcctagttatctactatcagtcacctgttgtataattataacaatgtttggatttgtggattattattttagtatataacattggattttatgtatgttacctgaagaagagcaatatctgtaccacatatttctttgtttttcttttttgagatgaagtctcactctgttgcccaggctggagtgcagtggtgtgatcttgacacactgcaacctttgcctcccggattcaagtgattctcctgtctcagcctccctagtaactggaattacaggcgcctgccaccatgcctggctaatttttgtatttttagtagagatggggtttcaccatgttggccaacctggtcttgaactcctgacctcaggcgatccacccacctcagcctcccaaagtgctaggcttacaggcatgagacaccgcgcccggcttatatatcattactttcttggctgagagctgtagtctgtggtagttgttttgttttgttttttgttttttttttgtagttttcttgatcgtgatcaattaagcagaaagtagaatttcagtcaggtaacctgtctatattagctaaattatcttttgcttattacatagagtgctagaagtatgctgtcatggcatatgtcctagtttctcatcaaatggaccaaagtcagtgattttatttgaagaggaaaaattgaacgtcattgtaaattaagttgcaagtttagtaaccatattgtaccactgtttgataaatttgaacgctttatggtatttcatatttagaatgttcaaaatagtactgaagtattcaaatacatacaaccctgagcgatattgaagtaaaataaacatgtatttaaggaagtgtcaaccttcaattatatacctttttgtcactgaattaacacttatttctcacgacgtggaagcagtttcagtatggtttgtactaagctaagtgatagttgtcatctgtatgacaatttagaatgttttctgtgtccatttgtgatcaaaattatatgttgctttgtgtgat

SEQ ID NO: 8450 - DNA, 1284 bp, artificial
  synthetic oligonucleotide
ctaatcacataattctctgcttaacttttccatggcttcctattacctataggataaatcacaaccattattggcatatagaaccccataatagagcagttgcctaattttcaagcctcttatctttctctacttttttgtttccattcatctggaattctctgcctcatatatccttgctgattcctgtttgtcctttaacattcaggtattatctctcctaagaatacttttctgacccatattcccagggatgaatgggtatcccttttctgtattctctgtcctattgttcctgtgacatgttcagctttgtatcctgagaatcccagttcctgacgcacataataagtgctcaataaatattagttgctcaatgtttaattttatataattcactgctgttacgaagaactttcctatttactcgtatgatccttgtaatagccctggaagataatagggcatattttctcatttttcagatggtagaactaatgggtgtggttagctaataagtggagaattgatgctggaacttaaatcttctgactcccaacccagtatttgtgtgtgtgtgtgtgtgtgtgtgtgtgtgtgtgtgtgtgtgtcttcatcatgaatctttgtaagatgtcagccaaagagatgcaatcatgacagtagttaaattatatgcagtaactaagctacaagaatataatcattgttttataatctaattgggcaaaacaataaagatgttcttattttgaacaaaattaatagtatgctctagtgacttagggggatataggagtatatgctataaaatcctatgaatactgccttcactcataaaccggcaggcttatacttttcttgccaacaaagttatcctaattgaacattatttttatttttttaaattgacatataatagttatacatatttttaggaaattggacattttaaaatattaaacttcatattaccttttatttttctgtagctgatcctgtttcatgtataaccttttcagttggtagagtgtgaagtgttggagtaatttatgaaaggaatggaaggaaagagtagtttgtactctgttgtgaaattcttgggtgtgtttgtcaatatacatgtttcaaatgcctgataggtaccacagtcacatatgtctgcatatataactttaccattcttgtaggtacacaagacattttatgtttctttctaacaagaagagtaaaaatgaaaactaatagggaaactccattagattgagttgtctcactcttctt

SEQ ID NO: 8451 - DNA, 623 bp, artificial
  synthetic oligonucleotide
attgctttgatgccagtatgccaatcatcaacatgatggtaaaatttcattataaaaataagaactatccattaacaaactactctgtctctcagattgggagtagagataatggctagaagaaaaaaagttttgtttattcaggtagctcagattttcctgggaattgggatgggaagtattgaaattggaagtcactgcggaggaaagtgtagagataacttaatgctaacggatagtaggaacttgctcgttttaaaggaatagattgtcagtgcctggaggtatggattgtgatgcaaggcaaggatgcaattgaatgatcaatactgcaaatgaaaagaatctttccctttctaccagacacgaatgagccgttggtagtaatagctcagccttcatcggaaatgccgcttttgacttcaactaatgaattttatactaaagggatgacaccagttcaagacaaggaggaaggaaagaattcatctaagtgttacatacaggtcactggcatgacttgcgcttcctgtgtagcaaacattgaacggaatttaaggcgggaagaaggtgagacactcttgaagcttgttattttatgtgctagtttgggagctccatct

SEQ ID NO: 8452 - DNA, 1811 bp, artificial
  synthetic oligonucleotide
attgaaggattaatcagaacattttgaactgcagttgttgcaggaactgtaaacagagaagaaagcccccccaaaaccaagctatgaattacccagaatctgaaacatatgataaaaagtatacaacaaagctgaatgtaattctaataccaatttcaatagcatgaagtgcaactatatcatagaagaaacataggtacttatactgcaatgagttgaattaaattttaaaaaatctttatttttaattggcaaataataattgtgtatttatttttaaattactatttttttgagacagtgtctcgctctgtcgtccaagctggcgtgatcttggctcactgcaacctccgcctcctgagttcaagtgattctcgtgcctcaggttcccaagtagccgggattataggcgtgtaccaccaaacctggctaatttttgtattttcagtagagacggggtttcaccacgttggccaggctggtctcgaactcctggcctcaagtgatcctcccgcctcggtctcccaaagtgctgggattacaggtgtgagccattgtaccctgccaataattgtgtatatgtacgggatataatgtgatgttctgatctatgtatagataaagattaaacatatctagtacaaggttgaagaagttctgttgtattttaacaacctagaatttcaatttagtcatgggaaactgcactggattcatcatgcaacatattaaacaaaggcctatgttcaaggtcaggaatcacttccctaataggccagtattttacgttagttgcttattgtgtgtggttaggtttcagaagatatgaaatctagacatacacattagtaaactgtgctatgacagaattcttattccaatctgtgtgtgtgtgtgtgtgtgtgtgtgtgtgtgtgtgtgtatcctatgaagtaaaggtacaatttcatttgaatttacatttatgttctggattgcatacacatattcatcactaagttttgtcgctttcttgagcttttaccttaactgcttttccttgaagacgacttagatttgtggaccctaactgtttagctgacggtgttctttgaaaatctgatgaacacactgaatactctttccctcctccccaaaacgttacatatatagtagtccccccttatctgcagtttcagctacttgtggtcaactgcgatccaaaaatagatgagtacagtacagtaagatactttgagagatcacactcacatatattttattacagtatgttgttgtaattgttaattaattattgttaatttcttgccgtgcctaatttataaattaaaccttataatttagaaagtttataaatttaactttaaaggttgtaaatttaactgggggtcttggaacaatccctcaaggataaggggggagactactttatgtaaaatttcacagaattttagagggctcataggtccctctgaagaaccctcatttgcagcattactgccaccttcctgttgggtattaaaacaatttacctcttgctataggaatacaaacggtcctacaatttcaaattattcacaaattctgtcccccactcccaatcacattacctggtttgacaggtgtggactgagaaggtggaatctgcaccgtaaatctttggcttgtcactgacattggagttgcaactttatttgggacagacaccgtttgtggggttgctgtagttacaataaacagaccatgtttgttaggtgacttatacagatttatattctacactcagcttaccgcaaactatcttcaaagca

SEQ ID NO: 8453 - DNA, 2677 bp, artificial
  synthetic oligonucleotide
cagcttaatatttatggctacttgtcttaataaaactttccactaatttgtagacggtttataaattttgtgggtttttgtagagacagggtctcgctatgttgcccaggaaactcctggcctccccgcgacagcctcccgaagtgctgagattacaggtgtaagctactgtgctcagcctaaatgctgattttaataagtaattgtcctgtctatatgatcagttttaaacagatatcacagtgtgaatactactgtcccctagcttgagctcctttcgttctttaggctgaattctatgatactgttaacataatttggttgaaaatgttcttacaaggctgggtgcggtggctcacgcctgtaatcccaacactttgggaggccgagatggggggatcacttgagtcagtagttcgaggccagcctgggcaatatggcgaaactccctttctactaataatacaacacttagccgggcgtggtggcaagtgcctgtagtcccagctcgggaggctgaggcacaagaatcgcttgaacccaggaggcggaggccgcagtgagccaagatcgcgccactgccttctagcctgggcaacagcgagtccctgtctcaaaaaagaaaataaaagaaaatgttcttacaataaaaatatcttttcaagttcacaagttaggcaagtttttggtgtttcattaacttacggaaagcaaattccaacatttgatttataacccttggttcatactctgtgattcccatatccttcaggatctgtgccatcacctgtggattcaaataaaaacaccagatgcagaatttggtactggaaatcaaggctgcactgaagggtagtatttatatttatgatacaaggttccccttctttgggctccaaagtcctactcacccttgccctcccaagtgagtcagtgatcacacgaaatcgcatagtacgcttttgcagaaaacttttatttttattttttggcggggttgggggcggggtgtggggcaaagagaagacagaatttggcttctccagcagaggtaagtagctccagctggttgtcatttttggctgtggcggcgggttaaggtagcatcagaaccctggacgcggagtcagggctggcagatagctagagacgagggggaggcaggggcccgaagcccaggacacaaagctgggcagccgttccgcaagctccactggaccgcgaccctctggcaagacttggcccaagcggcgagataggggcccgggggccagggcgcatccccatcaccctctcctcctgacggccctgactagactgaaacgagcgtgcgagccgaccctcaggccctcagcgtggccccgcctcgcaggtccctggctgcacctggcttcgcgatccgcggcttatccttcgcacttaccaaggcatctctcggagcgttcttgggaggcgccatcttgcccgactccatgttatccagccactcgtcatccgcggagacagaggagagaggagagctcgcgggctcctcgctcaggctccacccctgcggggagcgggaggagggaaacggaaggcggggttacgtgccagccgccgggggcgggagtttcagcaagccgctggccaggggaagagacgcgctggggtgcccgagttcagtattggaagaggcaggtaatccttccccatggagcctgctggggcctgaaagaagtagaggggccgagaagctcgacttcccagagttgtttcccggcaaagggcaccaagtgggccaacctcacctttgcgggggtccctcctcacacctccacggctaccacctttgcccctttcggcctcccggaattccagacccagtcggtgttagggctgcttggtccaacacagttggacccgttacgtttgaatgtcacatcaacaaggaatacatttttagtataagtatatcccagatttgcacaggccatacttatgctacgaaataattgttctgatattcatatttaaccgggtgtcctggatttttattagctaaatctgacaatcctacccaatagcttgctctccccacagcaagactttggtcagcccttgtcacactcaaagccctaccgtggctgcccatttcacactgatgaaaaactaaagccttcactcggcccgttagagaccctctagcctctcttggccctggagcagcttcctgtctccccgctgaggccaacacaggacccttccttgcctcccagttacacccttcccagcccctcacccacagaacagcccgaatgacttttcgtgagaacctaccatccagccccagtgactttcaaaaaatgtgcatcagttaactatctctggcttaaaatgtcgcagataactcattcttaccctccacatccaccaacgccctaggattctccctcaggaacaggaaccgtgactcacccaggccagaaacggagcaggcagccatgttggcgctttccctcacaatccacactcaacctagcaacaagtcttgtccgggtgacctcccaaagttctatccatgtctccacatctccatccagtgctactatgctaacgagtccaagccaacatccttaccaagattacagaaatatgctccccaaatagtgtccccccacattccttacacagctag

SEQ ID NO: 8454 - DNA, 341 bp, artificial
  synthetic oligonucleotide
aaatcactatcttgcatgcacataaaatgggttaaagttatccaaatttcaattgtgcttctctttttttgtcagttgaatatatacgattagcactgcttacttagcttttaaatatgtgtgagatccattgtaaacaaagattatcttcacagtggtgatggagttacatttaccctagttgatctacaaccatccatggcctagtttttaaggtaagaacttcattctaaacaaagtacaccaccccatatcccccagactctccagtctgtatcagttactacttataattccttcagtctgccttactatttgccaacaaagtgaccttgccttca

SEQ ID NO: 8455 - DNA, 587 bp, artificial
  synthetic oligonucleotide
atatacctaaaactgaggttgaagattaaagcatatgaaagaaaagcttacagatcctgcttcctccatttctagtacataagtaggagtgtcatttgggtttgtgttggggcacaccagtctactgacaacagattcctttcctgcttcttttagcttaggaggtggaggtgttgcaggcatagttcctgatgtatggaagactgctatttaactgaaatcactgaagaatagattaagatggaaaattagtctcagattcttattgaagtatagacttaaatattgtaaatatttaaatatacttcaagccaaagttgtttctggtagctaatctgaatgagtattttgtagaaatactcagttcaattatcttgtgctgtttcatggtactcatatagcaacttttgaagtcttcacctttgcctttaataatagacacaaaatactagaatatcataaaatgctacagttaacaacaaaaattcatcataacattaataatcatccacaaacaagtgctttttaaaaataaaactgtatacttcatcccattccaaaaggaagctgtttattttggaacgatt

SEQ ID NO: 8456 - DNA, 757 bp, artificial
  synthetic oligonucleotide
aaaaccactttagtataatttatggaaagccttaaatgaaaatttaagttttattaggcaatgtcactataagaaatatattttatgttccagaataaactttttattacccaatatatgaccatgatgggtgagaaacaatagataagtaaaggtacaattataccagaaggctggtatgatagttgattttccttagcagtaggaattaccaatattttttataatttaaatttaaaccatgccttggttattttcccattggttgtgatgaattttcatcaactcatctacactctgactcatgtttgtgagttaacaacacatattttcaaaatagctgactattattaaagcttggagctggttttgactgtgcaaagttaactgactcctgtaaaggactttgtttaatgttattacagtatttattaaaataattctcttttaggatcagctgatgtacctctgatgtcaccacctggtactttgccatcagtctatcttcttcctggctacgtctcagatatgctagtgtggtttttacttgatgtttagctctaagttatcatttaacatttttcattatgtcactatatcagaacttctggcatgttatttatttatttattttactgttatcatcattgctaaaagctattgcatttaaccaaagctttaaaaccagtcctcttttagattgccttataaacgatgtttaattcatccagcgaatttggatctcttaatattcact

SEQ ID NO: 8457 - DNA, 725 bp, artificial
  synthetic oligonucleotide
cacaatagccacgtttcaaatgctcagtagctatatgtggatgccatatataatattaaacagcacagatatagaacatttttttatcacagaaatttctagtggttaatactggatagtagagaaataaagcgagaacaactttttgttttgacttgtaataatgacagtcattttgatatgaattatgctttattcttaattatcacatactttctacaaattaactttgttgttttaattaatttaatgcatgcattatttagtcagcaaaatttgttgagtgcttattaagtgccagaggttatgctggatgctgccccttaggagctcacagttcagtgaggagacacagatgtaaataagatagagaagcaagtgctatataatagcaggatattcaaaatattctgagtatacagagcaggaagaacttaacttgtctgaaaaatgaggggtgacagttgtgttgtatcttgaagatgcataggagtttgcacacacataggcaaagaggtagaaagaagaccattgccagccaagggaagagcacgtgcaaaagcacattggagtgttcattcacaatctggcgaggagtttgttgtggctagagcataggatgcatgtgggtagcagtgggaaactgtaaaaagtgagactgggaagattatgaagggctttataatcccgtcagaagctatgcttgacaaaaatttttaatcagt

SEQ ID NO: 8458 - DNA, 17356 bp, artificial
  synthetic oligonucleotide
aaaaaaaaaacagttgatattagaggaaagagatataaagtctttatataatcttactgctttgtccttattacagactttgtctatacgctgtaaaatagtgttttcctcacttaaacatcccatgcctcttgttgataagagtacaaatgtcatgcacccatcagaattctgatatagattttttgccaaaagggacttttctcttcacctcccgaattatgctgtatgtttttcatatcccccactagtcaggaagattttgccaggctttatttttgtatttatgttgcaaagcagtgctacctttttcattttttaggtataaaattataatatttaaaatgatagttttttttcaaattatctgcaaactacactaccttcagagcttttgacattttttgaaaagttctaccttctgaaattcctacattattagactttcatacatttaatttttgtagacatttcttttggactatttccctatggcaaatagtctagaaaagggaacctgtaaagtcactgatttaagatatcttctgaagaattttttttttcataaaaacaattttagagagtctggaaatgttttatttgcattttttaaatgtatgtattttggcttaaatatgtaaataagaatatgtaatatatgtttttctgcgtgtagcttattttatttaacataatatcttccagttcatccatatttggcaaatgaaagactttcattcttttatatgactaaataatattccattttgtatctgtaccacttttttattcatttattcattgatgaaaacttagatggatcattaaacatcatgtgcttatattgacatgtacacctaaatatgtataattattattaatccataataattatagatatttaaaaaacatgaaatgtgtctatgattaaatacagttaaaacttataattttcataaaaataaaatgtatatttatgactgaaacaaaaacttcaaacacatatattcataagttttatgaatcaaatttaacaccaccttaacttgtgatctttttaactttgtcatataaattaattataaatttgaactcataaattagatttatattaataaaatgacactctctttttgtgttcttttttggaaaagggtcagtatataattttgcctggtaataggattcttctcagattattgccttaaactattatttacaccactgtcacatattcctctccccatataattgcccctttcatgttttcccattcttactaccatgctgtctcacatttcccttcatctctctcatcatactccttcacattttcttttttttaacttttaattttttgtggatttgtagtaggtgtatataattgtgggatattttgcaataggcatacaatgtgtaataatcacatcagaataaatggggtagccatcaccccaagcatttatcatttgttgtacaatccaattatactcttttagataatataaaatgtacattaaaaattattttaattactgttttttaaatttcgaggtacatgtggaggatgtgcaagtttgttacataggtaaacgtgtgccatggtagtttgctgcaccgatcaacccataacctgggtattaggcccagcatacattagctcttttccctagtgctctttcccctatgccccaccctcccctgacgggccccagtgtgtgtttttccacttcctgtgtccatgtgttctcattgctcagctcccaattataagtgagaacatggggtgtttggttttctgttcctgtgttagtttgctgaggataatggcttccagcttcattatctcattcctttttatggctgcatagtcttccatggtgtatatataccacattttctttatccagtctatcactgatgagcatttggattgattccatttctttgctattgtgaagagtgctgcagtgaatataagtgtgtatgtatctttataatagaatgatttatatttatttgggtatatacctagtaattgtattgctgggtcagatggtatttccagttctaaatctttgaggaattgccatactgtcttccacaatgattgaactgatttacattcccaccaacagtgtaaaagtatttcttttcttggcaacatcaccagcatctgttgtttcttaactttttaataattgccattctgactgacatgtgatgatatctcattgtggttttgatttgcatttatctactcatctgcgatgttgagctttttttcatacatttgttggttgcatgtatgtctttttttttttttgaaaaatgtgttcatgtcctttgcccacattttaatggggttattttttttcctgtaaatttgcttaagttcctcgtagattctggatattagaccttagtcagatggatagattgcaaaaattttatcccaatctgtaggttgtctgttcactctaatgatagtttcttttgctgagcagaagctcttcagtttagttagatcctatttgtcaattgttgcttttgttgcaattgctttggcaattttatcacaaaatatttgctcatgcctatgttttaaatggttttacttagattttcttctagggtttttatagttttgtgttttacatttaagtcattaatgaaatgagttaatttttgtataaggtataaggaagggatctaatttcaattttctgcatatggctagccagttcttccagtaccatttgttaaatagggaatcctttccccatttctagtttttgtcaggtttgtccaggatcagatggagtagatatgtggtcttatttctgaattctctattctgttccattggtctatgtgcctgtttttgtaccagtgttatgctgtttttgttactgcagccttgtagtatagtttgatattgggtagtgtaatgcctccagctttgctctttttgcttaggattgtcctggctatacaagctctttttggttccatataaattttaaaatagttttttctaattctattcagaatgtcagtggtggcttaatgggaataacgttgaatctatatattgctttattgcaatattgattcttcctatccatgagcatggaatgtttttctatctgcttgtgtcctctctgatttccttgagcagtgatttgtggttctctttcaagaggtccttcacttttcttgttagctgtattcctaggtattttattctctttttggcaattgtgaatggaagttcattcacgatttggctttctgcttgtctgttgttggtgtatagaaattcttgtgatttctgcacattgattttatatcctgagactgctggaattgcttgtcagcctaagaagcttttgcgctgagtcacttggattttctagatacaggatcatgtcatctgcaaatagacaatttgatttcctctcttcctatttggatgccctttatttctttctcttgcctaattgccgtggccagaacttccaataatatgttaaataaaagtgttgggagagggcatccttgttttgtgctggttttcaagggaaattcttctggcttttgcacagtcaggatgatattggttgtgagtttgtcataaatggctcttattatttggaggtatgtttcttaaatatcagttttttgagagtttttaacatgaagagatgttgaattttatcaaaggccttttctgcatctagtgagattatcaggtgattttctttttgtctttagttctgtttatgtgatgaattacttttattgatttgcatatatagaacccaccttgcatcctggggatgaagccatcttgattgtgatgaacaagctttttgatgtgctgctggattcagtttgccagtattttattgaggatttttgcatcaatgtttttcagggatattggtctgaagttttctttttttggtgtatctctgccaggttttggtatcaggatgatgcttgcttcataaaatgagttatggaggagtccctccttttcaattttttgaaatcatttcagaagaaatgataccagctcccctttttacctctggtagaattcagctgtaagtccatctggcttgggtattttttggttggtaggctatttattactgcctcaatttcataactcattattggtctattcagtgattcaacttcttcttggttcagtattgagagggtgtatgtgtccaggaatttaaccatttattttagattttcccacttgtttgcatagaggtgtttatagtattctctgatggttgtttctatttctgtggggtcagtggtgatatcttctttattatttttattgtgtttatttgaatctttcctcttttcctttttattagtctagctagtggtctatttattttattaattttttcaaaaaatgaactcttggatcattgattgtttggaggattttttttttgtctctatctccttcagttccactctgagcttggctatttcttgtcttatgctaactttggggtttgtttgctcttggttctctagttcttttagttgtgatgtgagggtgttgatttgagctctttttatctttttgatgtgggcatttaatgctataaattttcctcttaatgctgctttagctgcatcactgagattctggtacattgtcacttttttctcattggtttcaaagaacttgatttctgccttaatttcattatttgcctataagtcattcaggagcagattgttcagttttcatgtagtcgtgtggttttgagtgtgtttcttaatcttgagatctaattttattgtgctgtgatctgagagactgttatgatttcagttcttttgcatttgctgaggagtattttactttcaattatgtgattaattttagagtaagtgccaggtggtgctcatcaaaatgtatattctgttgttttgggatggagttctgtagatgtttatcagatccacttggtccagagctgagttcaagttctgaatcagtggggtattaaagtctcccactattattgtgtggggcactaagtctttttggaggtttttaagaacttgttttacaaatatgggtgttcctgtattgtgtgcatatgtacttagaataggtagacattttgtttaattgaaccctttaccattatgtaatgtccttctctgttgcttttgaactttggtggttcaaagtctattttgtcagaagctaggattgcaaacactactttttctgatttccatttacttggtaaatttcctcctttttaaaattttgagcctatgtgtatcttcgcatgtgagatgtgttgcttgaatacggcacactgatgggccttgtctttttatccagcttgccattctgtgtcttttaattggggcatttcactgatttacacttaaggttaatatcgttttgtgtgaatttgatcctgtcatgatgctggctggttaattttgcagacttgttaatgtagttggttgatagtgttgttggtctgtgtacttcagtgtgtttttgtagtggctgttaacagtttttcctttttatgtttagtgcttccttcaggagttcttgcaaggcaggcttggtgatgacaaaatccttcagcatttgcttgtctgaaaaatattttatttcccctttacttatgaagcttagtttggccggttatgaaattctgagttggaaattctcttctttaagaatgttgaatatcggccccaaaatctcttctgattcctaggattttcactgagaggtctgctgttagtttgatgggctttcctttgtaggtgatttagctctcctctctgactgcccttaacatttttttccttcatttcaaccttggagaatctgatgattatgtgttttgaagtagatcttctcgtggagtatcttattggggttttctgaatttcctgaatttgaatgttggcctgtcttgctaggttgacgacgttctcctggatgatatcctgaagtggtttttcaactttgttccattctccccatgtctttcagttactccaatcagttgtaggttttgtctttttacagagtcccatagttcttgaaggttttgtttgttccttttcattcttttttctttaatcttgtctgcctgccttatttcagcaagacattcttcaagctctgatattctctcttctgcttggtcgattcagctattgatatacgtgtttgcatcatgaggttctcgtgctgtatttttcagctccatcaggtcatttatattcctcctgtaatcttttatcatagttcttagcttctttttattgggttagaagagaattctttagctcagtgaagtttgttattacccactttctgaaacctatttctgtcagttcatccatctcagcttcagccctgttctgtgcccttgctggagaagtcttgtgatcatttggagtagaagaggatttctggcttttggaattttcaatgtttttgaatttttttaaatatcttcgtggatttatctgcctttgatctttaaggctgttgaactttgaatggggttttgtggggtcttttttgatgatgttgtaattgttgctttctctttgtttgtcttttaacagtcaggcccctcttctgcaggtctgctgcagtttgctgtgggtccactcccgaccctgtttacttgggcatcaccagtggaggctgcagaacaacaaagattgctgtctcctccttcctcaagaagcattgtcccagaggggcaccgacttgaggccagccagaactctcctgtatgacgtgtctagcgacccctgttgggaggtctcacccagtcaggaggcatgggatcacggacccatttaaggaagcagtctgactgtcccttagcggagctgttgcactgtgctggtggaatccccctcctccagattgcctggactcttcagagccagcaggcaggaaatattaagtccactgagtctgagaccatggccacccctctccccaggtgttctgccccagggagataagagttctgtgtgtaagccccctgtctggagttgccgaaattcctgcagggaggccctgcccagtgaggatggatctgggtcccacctaaagaagcagtctcgccactatctgccacagcctttgtgctgcactgtgaggagtaccattcagtccaaacctcccagtatctctagcactgaccagggaaaaccaccgactagaacctcagtaatggtggtccgctcttccaccaggagctcggtcatcttgggcagactttaggctgctgtgttggccagtggggattccaagccagtggatcttagcttgtggggttccatgggagtgggacccactgagggaggccgtttggctgcctggcttcagtctcctttccatgggggtgaaaggttctcctgcctcactggagttccaggcaccatcggagcacataaaaactcctgcaactaaatgcctgcccaagcagctgctgtgggtctgcccacttttgtgcttgagacccaaggccctggtggtgtaggctcatgaggaaatctgatccacggattgcaaaaatccgtgggaaaaatgtagtatcccggttaggtaacacagcccctcaccacctcccttggctgggagagggaggtcccattgtcctgtacagctcgcaggtgaaccgtcaccccatcctgcttttccttgctctatatgtgtcacgccaaccacctagtcagtcccaatgagatgaactgggtacctcagttggtaatgcagaaattacttgtcttctgtgtttgtctggccgggagctgtagaccagagctatttctcctaggccatcttcccctacccccttgactttttccaattaaattattattcactatactcatcctgttgtgctatcaaacactatcttattcattctttataactattctctgtacccgttaatcatccccactccccatcacctcctgttcctcttcccagtctctggtaaccatccttctactatctatctatatgagttcaaatgtttaaatttgtggttcccacaaattagtgagaatatgtaaagtttgtctttatgtgcctagcttatttcacttaatataatgacctcaagtttcatccaggctgttgcaaatgacagaatctcattcctttttattgctgaagagtactccattgtgtatatgtaccacatttttaaatccattcatctgtttatgaatacttgggatgcttccagatcttggctattgtgaatagtgctacagtatacatgggagggcaggtgtccctttgatatactgatttcctttctttcatatatattcctgttaatggaatttctggatcatatggtagttctatttttagttttttgagaaatctccaaactattcttcatagtagttgtactaacttacattcccaccaacagtgtacaaaggtttcctattctccacatccttgccaacatttgttattgcctgacttttggataaaagccattttaactggggtgagatgatatctcatggtagttttgatttacatttctctgatggtcaatgatgttgagcacctttttatatgcctgtttgccatctgtatgtcttcttttgagaaatgtcttttcaaatcattggcatattttaaaatcagacaattagatattttttcctatagagttggttgatgtctgtagtagtccattctcaaactgctatgaagaatacctgagactgggtaatttataaaggaaagagatttaattgactcacagttccacatggctggggaggtctctggaaacttacaatcatggcagaaggtgaaggggaagcagggcacatcttctcatggtggcagcagcagggtagggggtgggggaactgccaaacacttttaaaaccatcagaacatatgagaactcactcactattatgagaacagaatagaggaaacagcccccatgatccagtcacctcccaccaggccccttcctcaacaggttgggattacaatttgagatgagatttgggtagagacatagagccaagccatatcaacctctttatatatattctgatttttaaccccttgtcagatggataacttgcaaatactttttcccattatgtgagttgtctatttactttattgattctttaatttgctatgcagaagctctttaactttgtgtgattctggttggacatttttgctcttgttgcctgtgctggtgaagtattactcaataaatcttcgcacagtccaatttctggcgagttttccaagtgttttgtttcagtagtttcatagatttaagtctctaatacatttttatttgatttttcatatggtgagagacagggtctagtttcattattatgcatatgtttctctagtttgtccagaaccatttattaaatagactgctctttcctcaatgtatgtttttggcacctatgttgaaaacgagttcactgtagatatatgaatttatctctggttctctattctttttttttaaattgtgggtacatagtaggtgtatatatttagaagatacactgtatgtttggatacaggcatgcaatttgaaataagcacatcatggagaatgggctatctgttctctcaagcatttatcctttgagttacaaacaatccagttactatcttgtggttttattttttcttttttaataattttatttcaataattttttgaaaacaggtggttttgggttacatgaataagctctttagggatgatttctgagattttggtccacccattacctaatcagtgtacactctacccaatatgtagtctcttatctctcaccctccttccactcttccctgagtctccaaagtccattatatgctttgcattctcatggaagtagctcccacttataagtgagaacatgcaatatttggttttctattcttgagttacttcacttggaataatggtctccaattccatccaaatttctgcaaatgctattgtcttattccattttatggctgggtagcattccatggtgtatatataccatattttctttatccacttgttggttttgggttggtttcatatttttgtaattgtgctgctttagacatgtgtgtgcaagtgtctctttcatataatgacttatttttcttttggtagatacccagtgaggggattgctggatcaaatgttacatctacttttagttatttaataaatttccatagtgttttctgtagtggttgtactcgtttacattccaccagcagtgtaaaagtgtttccttttcaccatgtccacatcaacatttattattttttgatttaagaaagtatggccattcttgcaggagtgaggttctatcacactgtggttttaatttgcatttttctgataattagtgatgttgagttttttttatacccttgttgtgtgtatatcttttgacaattgtgtattcatgtcctttgcccactttttgatggaattatttttttccttgatgatttgtttgaattccttgtagattctgaatattagttgtttgttggatgtatagctcatgaagattttctcccactctgtgggttgtctgttaactctgctaattatttgttttgctgtgcagaagctttttagttaaataagtcccatctatttatttttgtttttgttacatttgcttttgggctcctggtcatgaattctttgcctatgccaatgtctagaagagtttttctgatatcatcttgtagaatttttataatttcaggtcttatatttaggtctgtgatccatcttgagttgattttttatatggtgagagatgaggatccagcatcattcttctaaatgtggcttgccaattatctcagcagcatttgttgaatagggtgttctttctccagtttatggtttatttatttatttatgtattgctttgttgaagatcagttggttgtaagtatctggctttatttcttggttctatattatgttccattggtctacatgactcttttaatgccagtaccttactcttttggtaactatagccttgtagtatagtttgaagttgggtaatgtgatgcctccagatttattctttttgtttagtattgaactctgaacagaccaataacaaacagcgagatagaatcagtaataaaaaaattgccaaaaacaaaaagcccaggaccagacagatacaccagtgaattctattagaaattcaaagaagaattggtaccaattctactgaaactgtttcaaaagatagagaaagagagaatcctccttaaattattctatgaagccagtatcaacctaacaccaaagccaggaaaatacgtgacaaaaaggaaaagtacagacaaatatccctcatgaacatagatgcaaaaatccacaacaaaaatactggctaaccaaattcagcaatatattaaaaagataatacatcatgatcaagtgggttttataccagggatgcagggatggttttatatactcaaatcaataaatgtaatgcattacattaacagaattaaaaacaagaattatatgatcatctcaatagatgcagaaaaagcatttgacaaaatcgagcatcctttatgataaaatctctcaacaaaattggcacagaagggacacaactcaaagtaataaaagccatctatgacaaaccgacagcactgaatggggaagagccaaaagcattgcccctgagcactagaataagagaaggatgcccatttttatcacttctattaaacatagtactggaagtcctagccagagcaatcagacaagagaaaaaagtaaaggaaatccaaattgaaaaagaggaagtcaaagtgtcaatgtttgctgataatatgattgcatacctagaaaaccctaaagactcctttaaaaagctcttagatctgataaataaattcagtaaagtttcaggatataaaatcaatgtacacaaaccagtagcactgccatacaccaacaacgaccagctgagaatcaaatcaagaactccatcccttttacaacagctgcagaaaaataaaatacttaggaatatacttagctaaggaagtgaaagatctttatgaggaaaactaaaaaacactgctgaaaaaaatcacagatgacacaaacaaatggaaacgcatctcatgctcatgaacaggtagaatcaattttgttaaaatggccatacttcccataccaatttacaaattaatgcaattcccatgaaaataccatcatcattcttcacagaacaagaataaaacaatcctaaaattcatgtgaaacccaaaagagcctgcatagcctaaacaatactaagcaattgcattctttaagctatttaaagatatataataaagttattacagactgtgtagtcactcttgtgctatcaatagtaagccttatttattctttctatattttttgtacccattaaccatccccacctacccttcagcccgctactactcttctcagcctttggtatccatccttctactctccatgttcatgagtctgtttttatttttattagaactgataaacaaattcagtaaagttgcaggatacaaaatcaacatacaaaaatcagtagcatttctatatgccagcagtgaacaatgtgaaaaagaaattaaaaagtaatcccatttataataaccacatgtaaaattaaatacctagaaattaacttaaccaaggtgaaatatctttacaatgaaaactataaaaccctaatgaaggaaatgaccaaaaaatgagttttctattttgttccactgatctgtgcatatggttttatgccagtaccatgctgttgtggttactgttgctctgtagtatgatttgaactcaggtgatttctccagttttgttctttttgctcagaatagctttagcttttcagggtcttttgtggctccacataagttttatagttgccttttctctttctgtgatgaatgtccttgatattttgataaagactgcactgtacctatagattgctttgggcaatatgaactttttaacaatactgattatttcaatttatgaacataaaatatctttccatctttgtcctcttacatttctttcatcagtaaattatagtttaattgtacaggtattttaagtatttgattaagttatttcatagatatttaattttacttgtagctattgtaaatgggattactttcttgatttctttttcagattgtttgcttttggcatattaaaaatgttgtcaatttttgtttgttcattttgtattctgtaacttccttgaatttgcttattagttttaattttttgctggcatcattagattttttcaaacataagatcctataatctgcaaacaggaataatttgacttcttttccagtctggatgccctttatttttctccctttctgattgctcaagctatgacttccagtcctatgttaaataacaatggtgatagtggttatctttgtcatgttccctatcttagtggaaaagctttcagtttttccccaatcagtatgatactaactgtgggccattgtatatgacttttattttgttgatgtaagctccttctatacccagttttttgaggttttctttttcaatcataaagaaatgttcaatattatcaaatggtttttcagcatcaattgaaatgatcatgtggtttttttccttcattgtgttgatatatcacattaattaatttgcatatatggaaccatccttgaatccctgggataaatctcacttggttatgatgaatgttctttttaatgtgttgttgaattcagtttgctactattttgttgagaattcttgcatcaatgttcatcagagattttggctttttttttgataagtgtttggttttgttatcagggtaatactgatcttgtagaatgagtttggaattattccatttacctctattttttggaataattggagtagaattggtattatttatttaaatgtttcataaaattcagcagtgatgacattgtgtcccaggcttttgtttgctgggagacttttcattatgatttcaatctttttactagttactgttctatttatgttttggatttcttcatggttcaatcttggtagattttatgtgtctggaaatttacctatttcttctaggttttccaatgtgttggcacatagttgctcatagtaacctctataaacctttgagtttctgcagaattggttgcaatgtctctcttttaatctctgattttatttattttgtcttctgtctttttcttctcagtctggttaaaatgttttattatttttatcttttgaaaatactttttgttttgttaatcttcgtattattttctcaattttaattttctttatttcttctttgatctttatttcttttctcctatgaattttctctttctgttttcattgacccactggtcattcaggagaatattgtttaaattccatgtgattatatagtttccaaaattattcttattatagatttctagttttattccattgtggtcagagtagatgctaaatattatttaatattttggatgttttaatacttgttttgtggcctaacataatagtttatctttgaaaataatccatgtgttgagaagaatgtgtattcaacacccattatatgaaatgtaagtctttctacatctatctctttctttaccttctctttaagtccaatacctcttagatttgcccttttaaaaatctactaggcgtgcctcatttttttttgtttcctttgtgtagttttaaatagcctgtcttaaagctcactaattatttattctgcttgatcagttctgctattaggagactccgatgcatctttcggtgtgtcacccacatttttcacctctagaatttctgcttgattcgttttaattatttaaattcccatgttcgatttatctcctggaattctaaacttcttctctgtgtaattttgaatttctttgagtttcctgaagacagctattttgaattctctgcctgaagagtcaccatatctatgtctccccaaggtttgtccctggtgctttatttagtttattttctgaggttatgttttcctggatggtcttgatgcttatgaatatttggtgatttgggggcattgaataattaggtatttattgtagtcctcaaagtctaggcttgtttgtactcattcttcttgggaaggctttccaggtatttgaagggacttaggtgttgtgatttaagtttttgggcactatatctgtatttccattagtggcaccccaagcccagtaacatcatatttcttgaagatttgtacagggaccaccttggtggtcttagataagatctggaagaatttcctggatttccaagaacagacttttattcactttcctcactttctcccaaacaaacagagtctcactctctttgctgagctgcctggagctggggtgagggataacacaaacatccctgtggccacccccacttggactgtgctgggtctgatctgaagcctatacagtactggaccttgcccgaggcctgctgtaactactacctggctaccacctatgtttgtccagggacctaggagtctacaaataccaggtggttaagccagttaatcttgtgtccttccctccaggaaagcaagttcttctaggcccctgacaggtccagaattgccatctgggagctactgcctagagtcagaaacctttgattttacctggtgctctattctattttggctaagctggcactgaaaccacacgacaaagtttttctcagtctttcctcccatttcctcaggcaggggtgtttctcacctcttccaccactaccaccagtccacaggaagtactgccaatgtttccttaaagcccaagggcttgtcaagcagtttttgctaggtctgtgactcaccttcacagcagcagcagtggtctcccctcttgcccagggaaagtccagaaatgccatccaagatcaaagatgtggaattgagtaccccaagagcgcacttggtgctctttcccagtgtggcaatgctagcgcctaagttgcaagaaaaagttgcctttatacttccttctccttttctcaagcagaaggagtctatccatcttcatagccatcacagctgtgaatatgcttggttactccttattccagcatctctctgagtctcacccaaggcccatgacatgtattctcttgttatcggtgctgattattcaaggtccaatgagggctttaatcagcaggtaacaaatcctgtcaactcggtccttcctttcaagagagcagattcccttcaatttcaaggtgtgtctagaaatgtcatccaggagttagggctgggaattggggcctcctgtctctgcttagtgccctattctattgtggctgaactggaatccaagttgcaaaacaaagtccacttcactcttccctctcctctcaagccgaaggaagggtttgcttttggagctgatggctgcacctggagtttggggagggatgatgtaagcactcccttagctgccctggatagtgtctcgctaggtcatgtgactcccctagtccagcgcagcactatgaattgcttaggaattgcagtccttctggcctagacagctttttaagttcatttaggatcctagagtgctttagctcacagcggtgaggcttaccaaaactcaggtttcaactgctaggatgagcaattcccctttgtatagggctggtctaaatgctccctccacaggcatcagctgagttcttcccaatgttgttagcactgcattgcaatgtaaagttccacattcattttgctcaccctcccccaaatgcacagattctctctccatgccatgaggccactgacaccaggtcggggggtgggtggtgttggcaattcaagactgtccttcctaccctcttcagtgcctctttcagtgatatgaagttaaaatcaggtactgcaatctctcatctgatttttggttttcatgaaggtgctttttgaataggtggttataaaaaaaattgtattcctgcagggaggatgatcagtggaggcttctatttggccatcttgctctacctcattctgcattttcttgtatgtacattttactattcatttacccccatatattctgcctgcctgaaagaggctc

SEQ ID NO: 8459 - DNA, 1032 bp, artificial
  synthetic oligonucleotide
ctgttgtgtgttaagaaaagcagatgaatctcaggaagaatagtgagctttgtggaactataacttgccctattttcactctctgcttctatctctgcagcagctatgaaaatcagcaactcaaaattagggtaaaaaccagcagcctggcagccactagaaatggaagtttggagatggagctcttttaactttcattttcagaggatttttactattcaacttgtgtgatggttcgctggaagacacccctttggaagactatatttgacttgactcaagagtttattcagtggaaaaaagcccctcccctcagggacatttgttgaaaacacttacagacaatggtttaacttcacaggtgtatgcagcagtggataacagaaggaaaagccaataagataaccaaacatcttaaaaagaaaatctggagaatgacatgtctgtagaggctttgaaaaactctaacatatttctgagaatctaggaggccacatgcatcctttgggctgtgtgcatgaccaggatgttgtgcatactcagagaagacccaagtgttctactttaacacttatggcatactttgacacttgtgcaagcaggaagtgaagaagttgtgccttcacacatgcacgcacacacacacacacacacacacacaaacagtctcttgaaaagactggaggacttattggtttaatatatttaaggaaatctgttttcagtcattagctgattattaagctaattgagcagagacttcagtgaccatgcaagacaaagaatacagaccttacaaaattagtttcaaaaagtcagaaaataaacaagcataaacaacaataatctccagggaaggagcaggagaatctaacatccaaaaattaaacataatattatttaaaatgttctttttcccagataaaaatataagacatgcaaagatataagaaagtatggcttatacacagttaaaaatatatctttcccctgaggaagtccagatgttggactcatatgacaaagatttta

SEQ ID NO: 8460 - DNA, 5960 bp, artificial
  synthetic oligonucleotide
taagacattcatttaattctactcaagggacttatcccatataagattaacacaagtgcaaaaatacacaatgctatattgaaaaaatacaagaatatttacttaattttaaaatttatttttagtcaagagaaaccaataaaaagcattcaaataggagaagaagttaatttatctctcttcactgatgacctagaaaaccctaaacactatgacaaaaggctcctagaattgaaaaacaactttagtaaaatttcaggatacaaaatcgatgtacaaaatttagtactatttccatataccaataacattcaggctcagagccaaatcaagaaagagattccatttacaatagtttcacacacacacacacacacacacacacacacacacacacacaccttcccctaggaacacacctagcaaaggaggtgaaagatctctacaagtagaactacaaaacactgctaagataaattatagatggcacaaacaaaggaaacagtagatgttggtgtggatgtggcaatcagggaacacttctacactgctggtgggagtgtaaactagtacaaccgctatggaaaacagtgtggagattccttaaagaacaataagttgaactaccatttgatccagcaatcccactacagggtatctatccagaggaaaagaagtcattattcgaaaaagatacttgcacatgcatgtttatagcagcacaattcacaatagcacaatcgtggaaccaacccaaatgcccatcaatcaatgagtagataaagaaattctggtatatgtataaaatggaatactactcagccatgaaaaggaatgaacagcatttgcaatgacctagatgggattagagagtattattccaaatgtagtaactcaggaatggaaaaccaaacatcatatgttctcactgatatgtgggagctaagctatgaggatgcaaagtcataagaataatgcaatggactttgggacttggagggaagagtgggaggggggtgagggataaaagacaacaaatatggtgcagtgtatactgcttgagtgatgggtgcaccaaattctcacaaatctgcattaaagaatttattcacgtaaccaaataccacctgtaccccaataacttatggaaaaataaaattaaaaaataaaataaatgaaaaacaaacaaaaaaccattcagtattcatggattggaagaatcaatgtcaaaatggccattctgcccaaagcaatccacagattcaatgctatttctatcaaactacaaatatcgtttttcacagaattggaaaaaactagtctaaaattcatatggaagcagaaaagagactggatagccaaagcaacctcatgcaaaataaacaaggctggaggaatcacagtcgctgactcaaactatactataagggtaaagtaatcaaaacagcatggtactggtacaaaaatggacacatagaccaagggaatagaatagagaaagaataagtaaagccacacacctatatccgtctgatatttgacaaagttgacaaaaataagctatggagagagaactccctattaaataagtggttctgggtagctggctagccgcatgtgaaagaaagaaactggacacttacctctcaccgtataaaaaaattaactcaggatggattaaagacttaaatgtgagactcaaactataaaaatacttggaagaaaatgtagggaatactattctcgacatcacccttgacaaataatttattactaagttctcaaaagcaattgcaataaaagcaaaaattgacaaatgggatctaactaaactaagcttctgcactgcaactaactaaactaagcttttgcactgtaaataaaaatatcaacagcatgagcaaacatcctacagaatgggagaaaatattggcaaactatgcatctcacaaaggtttaatacgcagaatctataaggaacttaattcaacaagcaaaaagcaaataatcccattaaaaacttggtaaagtacatgaatagacatttttcaaaagaagacgtacaagctatcaacaaacttataaaaaatgctccacatcactaatcattagagaaatgcaaatcaaaaccaaccgcaaggagacatcatctcacatcagttggagtggctataattgaaaagtcaaaaaacaacagattctgataaggctgaggatgaaagggaacagttagacactgttggtgggaacataaattagttcaactcttgtggaagacagtttggagatttctcaaagaacttggaactaccatttgactcagcattcccattactgggtatatatccaaataacaatgaatcatactactaaatagacatatgcactcatatgttcattgcagcactactgacaataataaagacatggaatcaaattagatgcccataaatggtgaattggagaaagaaaatgtggtacatatacagtatgaaatattacacagccataaaaaatgaaatcatgttctttgcagcagcatggatgcaactggaggccattatcctaagtgaattaatgcaggatcagtaaaccaaataccacatgttctcacttgtaagtgagagctaaacattgggaatacatggacatagcaatggcaacaatagacactggggactattagaagggggagggggataagggttgaaaatctattgggtaccatgctcactaccagggttacaggatcaatcatactcaaacctcagcatcatgtaatttacacatgtaacaaacctgcacatgtaccccttgaatataaaataatttttgaaagtattaaaaaacagagctgcgaagaacattggattaggcagccactctcaaggaacagaactgtcttaattaaggaaactttctagtcctagacattgttcttagagaagggagtcctagtaataagtcttttgtgacatttggaattgctgtgggctagtgactgctatatgctttccacttctaccttcttctttatttttttgcagtagacatgtctattattattctgtcattgtctcaccattttatgttgagtatgggtaaagtatacaacctgtcttcataggtctatggatcaaggggagctgtatccaaggagtcacatccacatcccaccctgatgtacatcataagatcagggagttagtgcctgatactgtgatgggatgagactttgggagtctttggaggaaacagaatgtgcttttcatgtgggagaggtgtgaatcattggggctaaaacaggctatagtagatttttacaataattcctcccaattaatcatacctctttttgtacatgcacctttgtaatgtgactttatgtacttactattaaaaaaaggctatctatttccccaaattttgaatttagactggctttgtgacctgcttagaccaataggacatggcaaataagataaggccttgcggttacatttattatcctggagctctgaaccaacctaactgtgaaaaatactggaataaagacgacatagagagaaaggtccagctgagcccagacactaaccaactcataaattgagtgcagctacatgatggagcccaggagataacagagaactacccagtcaaccccacaaaacagtgagaaataataaatcattattgctttaagtcactaagttttggagacatgctgcatagcaatagataactttacaatattatcctaggctctactaaagaatataaacaaaaagtaaggatgattttttttaaaagtaacatacctgtgcatccctgactttcttttccttctgctgattaggagatgacaagacctggaacagacccagagataaaagtaatgttttcaggatggaaaaaccaacctgtcaactatgaactactcacctatggaccagtatatgaggaagaataaactttgatgttgttgaaaacttgttaggcttttgtgtttgtgtgtttctctgttatagtagccaggtctgtatcctaactaaaacagatggcaagtcaaattcctaaatttcattaaaggtggtaaactcattaactgccacctacactcaattatctaaagcatttgagtcttttttgataaactgcaaagaacactggtacatcaagacaaataaattacttgtaagtttaaaaaaagctaagaaataaataattgcatgaaatggggtctaaactgaaaaaactggttttgtatacacatttatatatttatcatttaaaaatataaaagagattacatgtatattaatatatgtacagaaaatgtccaaaaagctacacaaagagctgttaacactgattacttctgaggagttgaaaagaggtaggagtaaagagggtgattttaattttacatccctctgtactacgctgttttttcttttgttatgagagttatttttacttcttcccactttcatgggtattatacaactcactttggttcacaaagcaaggtcagccactctgagtttgtgtgactcccttaagtttatagattaagaaatgggtcagaaaagtgaattagcttatttaggcacagcctgtagcagaagcagtttggggaaataaatcctctatactcatacagtactttttttattactccacacctgttcagttccattgttcattcctgtgaaatataatcacaaaactattagctatcccaaatgttccaaggatgtttctggagtatacgactcagaagagcaatagaaagatcatcacagtacaatatttgtctgttgcagtaatcctagaaaaggcaatgaaatttccaagaatgcaaacagatgcaaatgcataagcagttggaactaaaacataagcatgtgttcagagtccatgaatagcctcttttttcctcactagacgtagtttaatgatgtgatcttttcagcactcagaagagcaatggctgttattccagattaatccttaggtaagaactcttattgaggccagttaggattttgtctagtgtcttatgtacggatttctgttttatcgagtggttgtggggtcaccaaaggggctgcaataaaagcctaacagacctagtacctacctgaatgggttggctacttgggatttgtgttgtgcaaatgttcaatctctacaatattaatagttttcataggatcttaacgtttcagagccatagatattagaacttaccaaatccaaaaaccctttttatacaccctttaaggtccaaaaaggagggtttttgaaaaaccataggtttacttgtttttgtttgttttatatttcagacgacatgtattgttttttccagatttgggatagcaactaaaagggaggttcacccaggttttcactgattcatcttctcaaaagttttcaaagcatggttctctggaccattagcatcagcatcacctggggcttattagaaatgcaaattctcaatcagaaaaaaggtagtcagggcctaaaatctgtgttttaacaagactttcaggtgattttgatgcataataaaatttaggaatttgtattatcatttataaatggtattttattatataactgctctgggccaaactttaaacattcttcaatgtatattatctcttttaatccttttagtgaggggtattattattccacttatttaagtttggcagttacttaaggccaaacagcccatctctaaactatgatgtaggtaatccccaatttcttttgtagtcttcctccatctggcccacccacttcctttcactgctgcccaaacactacctccaggttcttaatacctgtatttgcatgtgatggagagtcagtcacctggattctattttcatctcactgtgtggctttgggtagttctttttccttttctggtcttcagaatattt

SEQ ID NO: 8461 - DNA, 1684 bp, artificial
  synthetic oligonucleotide
ttcagtagaagattcagggagcagcaaatgctgatgacagctgaggtaacagaagacaggttgccaggaacagtcactaggacacaggatctacccagaaattatttcatcacgatttcttctattccacctgtgcctgaagcaattgtagtgacaataacgtgatagaaaggacacagtgcgggtactccattctatgtttgggtcatgtgtctcaagccaatggattccaataatcagagggtatcgtggtgcatgaataatgtcaaactggagctcttcaacatggtttccaatttgaacttggacaggtgatgtttccttagttatgggtccattaataagtggatggccgtcgacagtttccagcatcagagggaagatattactgcggatgggcagcttctctcgaagaaccacagtatgatcaatgctgtttctgtaggagcctgaatctaccattgcttgctcaaagaattatcttcttcccagttggatttcaacagtaagccatagtgtatgagacatggatattggaagagagggggacgcatatttgtagattggcccacgtggggtcccccttactggcaggcctggatgtttcccgcctgcagggcctgatgaggcttgacagggcaatctctggcaaaatgaccaggataaccacagtagaggcataagcggcctttgtgccaacggacccattcagcttcactgatgtgtgggcagttgattgcagcctgcataggttggttttcagctggtggactctcgggtccatctccctctgcagaggaacttttccctaatggattgggatcaggcttctcttccaggctgatgcactgagtgatgagatcagataggttggtggctgggcttgtgtgagacagttcatcttgtatagaactggcaagaccttcttgaaattggatccagagagtgctttcatcccagttcagctcttgagcaatgaggtggaagtgggttgctacatgaccctccccttggcagagttgatggatgcactggttggcatctttcatgttttctggattatcaaaagtatcctggagcacaggtatgaaactttcacattgctccagtaaggggctttggatatccagtaagagctggaaccaccatcctgccctacctgagaagcaattgccaacaaagctcaccagggctgcttcagtgggatacaggtgccctctgactctcatgtaactatacagctgaaccaggaactcaggaagcttctgggaatctccactgaaggttaaagtgtattgcagggggaaatctgtagcctctaacccaataggggcctgtggaaactctgaagctgctgatgtctccacaactattagaccctccagggactcctgggctgctgagagttctaggaattcctgggcatttgaaggctccagaggctcctggggaggtggaagctcaaggaactctagctgtgctgcagtttcctggtattctggtgcctcctggggcttctcaatatttgggggatcctggggttctgaattcttgggctcttgggctattgtggcatcctgggtgtttgcaggcccctggccctccaagactgttgggatctcatgggccattggaggtttctgggactcccgggttgctggaggcgccagggactctggggctg

SEQ ID NO: 8462 - DNA, 1563 bp, artificial
  synthetic oligonucleotide
cttttctgcacacactgaactcaagcaaacacacccactcccagaacacattccaactttcctctgtaacatagctttttaaagtgtggaagagttttttgacagtacctcacagttcagagctgcaaggaaagtaggatgctgtgctgatgtgaagcagcttcatgtactcagtccttggttactttaatgaatatttggccaggaaattgtgagtaataccactgcccttgtgaaaagttgcaaacatttttgaatgaccacagtggtttgggatgtgattttttatgtctgtctcatctaacctattcttactctgtccaaattgggccatttgtttacttctcactcagggaacagcctgcaaaccctcagccccttcccttgcttactacctattcagtccctagggtttttccttgcaatgttttcttggaaaatttgccacagacagatctagaaaaggtataaaagggtacaaatgtcagggagaccaattgtgttggtgggtacttatagcagtcttacagagtccctggctctttctgaatgtcctggaccaaagatctcatgcttccctgaactgatcaggtgctccaggtagcactcaggacattcactaaagactggcctcttgggaagtaaccctgctcagaatctcactttctcttctcatgccagatcacagttatgccttgggtatgggctatgtggccattttaggcaaggcttaggggcaactatttttatccaagtaaggagtggggttgaggtttgcatttggccatttcaaatcacacatcatgtcaaccacagtcccatgtctccttcacaaatggtcagttctgcattagtcagcataatgggataaaccctagtgatggaataggcccaaaacatagcaaattgacagactgggctacctgaatccgaatgcagaagctttgaaagtaaaaacaaaatcttttgcaaatcgagtttattctttccttacctttcaaagttttatttttctagaaacaccacacatataaaaataccaccatcatcagggatgatgtgatctatttatgtgaagttttcagataactgaagccttcctgccctccaagaagccaaaacacacagttaacatttattttatccagaaagaaaagagaacttccaacacctgaatttgtaacgggcttagttagggaacaactattaattgaaactctttcctaatgtttagcaatttctgtaacaatgagtttgaaggttcaatactggacatcaagttgaaatttaataaagagtatttcaatttaaaaaaatcagagaaatatttatagcatatgttatacctctttgtccattcttaagaaatgattttgcatataatttaatccagttttaatggtttggattcatacttacacaaaccagctagtttaccctgttgtaacacagtgttgccctctgaaagctactgagaggtataaagtggtctgtcttcaaattaaaaacttccaaattgctatgttttgcgacttcttgtattttcttttcctttatattttt

SEQ ID NO: 8463 - DNA, 819 bp, artificial
  synthetic oligonucleotide
atatattagatgaagtagaaagggcccaggctttagaatcaaagagaccttggtttgaatcccaggtctgccagttacgagctgggtgacattgtcagtcatttaaacccctgagcctggttgtccttatctgtaaattggaaataaaaatacctcacagagttgcaataaggattaaataagatgatggattgtaagtgtttgaaaaagagaaggtattaaatgcatggtaactgttaaaattatatttgctgatattattgttattattgaaattttaacagatttgggagatagggaaaatattaacatgaagaatatacttctagatttcattgcttcatgattcctacccctgcttagtgttgactctacatggaggtggccttcagatcaattttacagagtagtcagtatgcttttccacttctgagctagtgttcatttgagtataggaatttagagacttttcaacagtttcaaaaaatactaagtttctacttgtgcatgacattgtaaggaatgaaaaaatcatatggtctagagagagataactgccattgatcaatttatatgttatcccattttatccaataaattcacttaacaggaatttaatgaacaaccataatattcaaggcaatgtgctaattgtggctgaggtagaaaataaatagagcagatatatgacatcttggcctttgttttcatgcagtcctatactctaggttgaaagtgaaaagtgcctttagagaggtctataaatggggcaatggaaaattagaaaaggaaataatgacttcttgctgggactgagtg

SEQ ID NO: 8464 - DNA, 1200 bp, artificial
  synthetic oligonucleotide
cagtactttacacagctcttgaacatttgctctatgaacaactgatgttggctttcaagtctctctctcattggatttttgttccagttggatacataatagtaaagttgcaatatttaggaaaaatactgaggcttcaatgggaatggaatagccaaacaaacattcagaacttttatgctttggggcgtaagaacagagaaaggctgtgttaaggcaaatgatacagtatcaatttctgtgaaattcccatttgatgaataatgtgcagtagcacagataatctatcaaggagccccaacaagtttacgttttccaatagtaaggagcaggagaccaatataatggactctaattatgttacaccttctgtgagcataaactttatttccatgagaatgtaaggtacgtcaattaaatgttttgttgccttctatcgtagctggtaatcttaaaatcactggtaatattttccccacaaaaatatttatcttaagtaaaccatttaataatgaataaattaaggcaggaggtatacgacattttcccctaactaaagggaagctaaagaagttacttctacacttttcattagctaggggcaattactattgatgcaaacatgtctgaatccacaactttgtggacttaagtaaaagtttctcttaaaaccctggtgacattatccagaaggctagaggaggcctgtatggattgggaattgacaggccttacgtcttctgtattctctggtgaatgaatacccaccacccaccaactcccacttccctacttgtaaaatgggaacctgcaaatggtgaacagccatctgggcaaggagctgtgcttccaaactgatgaaggaagcagctgccctctagaggaggactgaaaaagggattagccagatttctttgcagggcaggccacacgttgggatgctcagaaaatcgatagcttccaaatgttctttgtgttccctacagtaatgggtctctgaggcagagccagacttagagccacatgtgaaaggagattattaaatacatacttctcctcattgtgcctcaagattagttgagagaaatacattaaaaataatgggaaaactggatcaccacagtgaaataactcatggtagaaagcaatcatttgaacctaattaacagtgcacttactggaaaatcaacagctatccag

SEQ ID NO: 8465 - DNA, 1622 bp, artificial
  synthetic oligonucleotide
cttatcacttgagccttctctttacaccaaaatgcgcttcacattgctttatgcaaacttttagcagaatatgaacgttgaagagcaaagtgttttcattttacaatacagttggcaaagtacatacttaatttcctagatggctactttcgtcacactatctttttttactttggggtattttgcagattataagggttcccaaatatccaaatgttcaaggaagatataaaagaaagaagacagaccttgaacatatttgaaactcttaaactatattcaggtcccaagtaaaaaactccacttttccttttgcagtttcctgtcatttaatttgtgccctctggtatttgttggcacttttgagttatatattagagctctcggtccatatggcatgtcacacagcacataaagttgactacaaagaagtatcttgttactggtgattctgaaaaatatgtcattcctttcagcacacattcccctggttgatttgcagtctacttctttactagaaaccactgtctagccattgaaagaacatgtttttactaaaaaagaaaaaaaaagaaaaagtgagcaagaaggaaggagaaagtgctatgtgactggatgtcatccaggaagtgcttacatagctttaactgtaatggagtataatggcagcctttttctaggaggctctggggccagtcctcacagttttctgtttgcagttttactaggagaagtctgtgctggcttctcaaataaaacgtactgctatcattatctgccaggatgctaagtgaaaagatccattatttttgatatttaataccttataaattatatggagattgtgttgaccgacagggacatctggaatgatggtcagggatttttttcctaggtcagatagactgagtgtctgtttgttcatcaatgaccagttatgcattcatagagaaaaggtctcttctcagctgctggtcagctaacctcagaggaattggaattactgagtttgaaggaggagatgcaaatgagcagtggctagctggaatttatatgggatatgtatagctgcctgtttcctaacaaaggtgaattgtgagagcagaccagggcttgaaggacagagaaattctgtgttggttaagcagagctggatgtgtttttgttattttttcaccttccatattggctatctctgtagacagttgaaggtgcttggcttttgaatattggccaggagttaactcatttctgactgtagtctccaaatttgctcccggattcattctcaagaagaaaaagatgaaaattgcaaacccaatagtagtatcttcttggtcttgaagactttttattccactgttaattcaccagtttttttcctgctgaaacacttgctgttatgtttctgtccacagttttggtttgttctggggcatttttggcttcacatttaagccttaatatagggagtgcctgacacacccctccctaaagcagggcatgcctggggattagctgttctcacaagctgagatggatttcaatgagctgttcactctgtcttgcctggccccctgtgacaaatggcatgcctttgctaggcagcaagctggggctga

SEQ ID NO: 8466 - DNA, 1075 bp, artificial
  synthetic oligonucleotide
tagcacccataaaactacatcataaatatgcagtcacttagttcaaggaaaaaacttctacagggtagattctgcaaagaaattggtccagaaccagtgtttctgctgagctgatctattaaaaggactcattaaagggtgtccattctgtatgaatgccaacatatttactcttttgcttgtcaaaataaaccttaatgatgaatctattcctgaattaaaccaaggtaaatgtttattctggaaacttcttaaacatacttgtttttctaaaactgaatcaatgagaggacaatgatggggattcagaaactttgactcccaggtttgtactcagtacattaatgtttttctcaccacctttgttttctctctttttggaaaaaataatcttcacatttcctgagataaattgataactcagaaatttagcctttttggagttcatgcttgatgaccagtctgtgcatacggtaagacaaatggaaaacagccttaggctatactgccaagcataagctctactaaatgagagaatccagagataaattacaaagagagaattctctggagctagacatgaatgcttctgtgacttccttagtcatctggcattaggaccctctgaaagataatatgaatcaccttactgagccaatagtcacctcgtatttcaccttccattttctgtatcttgcatatatttgtttggaacaagcaatatcttcagtaatttgcactaaactaggctttcctattttctccatctgtttccttggtacacatctatccattcatttctttattgggtgggtttttgaagatgtagatcaatctagtagggcattttttgggtaggtggccagaagaccagggttcaagtactagtattgccactagctgtgtgaccctgagaaagagacagaactgcacaattatatgactcagtggctcctaaagtgtgaaatgtgtaccactgataggtttgtaagttgattatacttggtacatggatgaatacttttaatttgaatattaatttgagcatgtcttcaactaatattataaaagctgt

SEQ ID NO: 8467 - DNA, 433 bp, artificial
  synthetic oligonucleotide
aaaaatttcttctttacaatgtgttgacaaaacccataaagaatatataaataaaatgggaatgtaactagggaaaggggagaatgcctttcagtagaaagcaagaactaagtcttccttcctgtggatagcaataaaataatcttgatctgttattttatttgatacccaggcaggcattgagttcaaaagtcaccaaacctgattacattattgaatacccaggtaaagctacaaatgattattattataaattgtcatgaaaacacagtactgctatatgatattttcacttctttttttaagagaatgactaatatagatgggactgctggtggcccagtagactaagtctctgtcagtggttgctgtgcctgcaagaaagcaagcaagtgaccaaaggagcacacagtacacctttttttcctttaat

SEQ ID NO: 8468 - DNA, 4237 bp, artificial
  synthetic oligonucleotide
ttggggctcaactgggaaagttgtagagttcaagttgtacagactactcaaatctgaagacatcaaatgaataaacacatttatgggttgttttggtttgaaataagtgagttggggttttaaaagacaggccagcctgctgggcttggtggctcacgctgtaattccagcattttgggaggccgagacaggtggatcacctgaggtcaggagttcgagaccagcctggtcaacatggcgaaaccccgtttctactaaaaaatacagaaattagctggttgcagtggcaggcgcctgtaatcccagctactgggcaagctgaggctggagaatcgctcgaaaccgagagatggaggttgcagtgagctgagactgtgccattgcactccagcctgggagacagaccaagactctggctcaaaaaaaaaataaaaaaaagataggctgcctatctatactatagctctctgtcatggctcaagcaaagagaacaaagctgtttatagtaaaatgagactttctaaaagcactaacaatcagggcaatggttccccggtggtctatgatttattttaaaagcttttggcaaaaaggtttatttattcttcagatcagtatattttgtggagaagttttctcctagtatcagttcatatacatcacaggtagagtgatcaaatagatagatcaatacataaggagtcagaagtctgtgttatagttcaagttctgccaatgactggtgtggccttcggtgagttatttcatttctgtgcatctcaataatctcatctattataatgggagagggcttggaatagatggttcctaatttccttcctagcaatccaatgatttgagttagactgttagatacctaagaatagttaaatgttatggagtggtgaataatggggccataatagggaaatctatctagagaggacattctggaaatgtagttcagatctccaagagaactgagtatcctttcccaattgccattatatttctttcaggtaatgttatcatgacagcttcaacttttagaccacaggcaaatgctttgtaagtaatttcccttttttaaaaatgagaaaatgcaagacaaaagataaaactttctgaaatctaatttccacagtgacaatgacactcagttggcatttctcaatcttttaaacccaaggttccctttgagaaacgtaaacatttcactacaaggttactgtgaacttgccttcctagggaccagaccctggacttgtagaaaaatctgctccatcacattgacattttccaagtactaagtgcccaacagttaagaggattttgtagatctgtactttcacagtttgtattgtagaaacaataatgacattttttattttgttttccaaatatatttgttataataaggaatatgttttatcaagtaacacttattttctaccctttaactttaaaaattactgctctagatattctagtcctctgctacaactacacttcttaggggattttctaaatccagaaatgtacaggatccaaccaaaggcccttggagatgactctgtgtacaaataaagaggaaatgaactcacatttatttaatacttattgggtatcagacatgaaaataggtacttttacacacattttctttttttcatttctatttcaatattttttgaactacaagtgtttttttctgttgcatgggtaaattatatagcagtaaattctgagatttttagtgcacccaccacctcagtagtgcacgttgtacctaatgtgtaatatttttatgcctagcctgtctcacccaccctcttctgagtctctagattccattatatcactctgtatacctttgcataatcatagcttatctgtcacttataagtgagaacatctattttttttatttttcactcctgtgttactttacttagaatagtggactccacctccatccaagttactgcaaaaatacattattgcgatcctttttatggctgaggagtattacatagtgtatatacaccacatttactttatccactcgttagtcaattggcacatagattcattccacatctttgcaattgtgattagtaggattgctgtatcaaatggtagatttacttgtagctctttaaggaatctccatactgttttctatagaagttgtactaatttacatttctaccagcagtgtagaagctttctcttttatccacatatctaccagcatctatttttttttcactttttaataatagccattcttgcagtaacgtgctattttattctggttttaatttgcatttctctgacgattagtgatgtggagcattttttcgtgtttgttggccatttgtatatcttcttttgaggaatctctatttatgtcctttgcccactctataatgggattatttctctttctattgctgacttgtttgagttccttgtagattctagtttctagtcctttgtcagatgcatagtctgcaaatattttctctcattctgtgggttgtctgtttactcggattattattttcagacacatttttctttaatgctcaaaacaaattatgtggcaggaaccattctaattttacaaaagaggaaactgaagcctggtgatatgaagtgaattgtttcaggccagagaaccgacaattgagacatgatatgataccaggtcttccaaagaacatgattatttccacccataaaatgctgccacagctgcaaaaatgatatctaattaggccgccttcctaaatgattgaaagtccaatacatattcctgcatgaaagttcaaattcaaactttaagttgttgttttgttaatggtctaattgctttaattcattttaaggataaaaataattttcacttcctctaacagaagaaaatgtctgtacttgcagaatgtgtccaaatttgtgtgtatctcatgtcaaccaggcttatttggagttgatgtagatttattcaggaaacagcagagtttccaattctagctgctactctttggttctggttgtaagcggctgaatgaagaacaccggggtcatggagatcagattggcttggataattcatgtgaaatttagtggttaaaaaataaaagaaaaaggtaagatgaggcaaagcaagttaagttcccagatgacatgtaaaagttatcctctagagagtgggaggggcccccatcagcaacttgttttctctgtttaattttttcttcccctcccaggatgacaagcccacagacaggcttcagcatcaaataaaatggagaagtaaatttgataaacatgtttacttagtggtgccagtgacttactgatgagtggtgaaaagacagggaagattgagagtgaagatttatggagttggtaccagctgcataaatggtggcagtgtcaatggtgatgatattagttaggagcagggttcagagggggaattctcatgaaatcataccaaatgagagctagaagggagttaaaggtcatctagttcaaatcatattattttaataatgaggaaatgaaactcacagaagggaaagagcgtatcagagcagcacaaagagtatataaaattactgaaatccaagtatcttagctacaaatccagtacacctttctatatattatactgcttttgagtcttctgtatcctacagcaagtcttgtcctattcagatcactcctgttgtaaagaaattgttccattacttctatctacagatttgttataatttgaattcataagcacaattccataaagaacgttggttttgatataatcctatcctgacacctggtgggcagcaatttgccatatatgcatagtgcatatgcataaaactgctagaactagaaccgaaaacaatagcttttttatctctgaggaacagtcttatccacagaaataccactttaaaatatgtttctgtccatataataagttattcagctaaaaataactttagctttctgggcttatgaaaagccttattaaagctgaaatcataactctgactgcagaaagtcacttactcctgctgagactccattttctaatctgtaaaggagtataatagtaattaactcagaattcttacaaagattagaggtaacgtgaatagcacttagctagttactgacaggatgtggaaatttcctcactgggacttaggaaactaatata

SEQ ID NO: 8469 - DNA, 748 bp, artificial
  synthetic oligonucleotide
taagcaaggcaacttgtattcaaactcaggtctgtctgattccaaagcctgtggttggaagcactatgctgcattgactgtcagaaagaaaaataaataaattcagaaaactgaaatcaaaatatattagaatcaggtaacaaattctaagttgggtatgggagaaagtttataagcctccacaattttgtggaaaaaaataaaacaagaaatttttctttaaagataaaaattaattaaaaattaacaaagtttgtaccagctagattttgaaagctaatgaacaattttaagaccaatgccttttttactttgattgaacttactgtttttaggtttctgatacccaaagagaagataggaattgtgagatgacatcattcatttatctatgatacatgttttgtcttacagtagttttgaatttttggaaacgttttttatataagtaaataagccataaaacagcagttattctgagaattaataatttttaaattgagtctgctagataagaatgttttagttataagtttattaaactttgtcaaagacccactgtggtaaaaatatctattaaaatcttaacttgtcataatggcattgaaagagctgtcacactcatccaattgcagaagtgttttttttttttaacatgagatcttgaacagttttttttctaaaacctaaacacaatgcaatatttttgtcattatctttgttctgttttattatcacttttgtccca

SEQ ID NO: 8470 - DNA, 1786 bp, artificial
  synthetic oligonucleotide
ccagcatgtaaatcctcaagtggaatgggagggcctatgaagacttgcaaaagtaaagaaagggagaagttctcagctgtgggagaaatgcagggtgatgcatcaacgctggaattttgcaacactggggccaaatttgctgaggttgtggcccaatgtgggtgatgggagtgaagcatgggaaatgtatgctttaggctctatataccactgcaaaaaaatttttcccaggtggaaagctcttctaaacaaaaccaacccagaggatgcagctgaaaaaaaaaccaaacaaacaaacaaacaaaaaaaaacaaagaaaaacaacttccaaagatttactcttagacttcagaaatctgtggagttggaagtgaccttagaggtcatccaatctaacaccttctttttatagaggaagaaacaggcctaaatggatggagggaggggtaaatgggttacacaatgagttagtgagagagctgttgtcccagctcagcactccttttctgtagttatttctatttcaccctgtttaaagacagctatatctttgtagcaagaaaatagcagtctgagtagaggcactgtacagttaaagggaaagagcaatgaaagatgctactgtaatttcaggtttataggcaatctaaaaaatatgcttctccggtttcccagaaagcctgaaaagtgaatgatataggtatgtctgtgtgcataggagatttaactatggtcacagtacaactatctaagaggagggtaagagggctttggataacaagggaaacagtggatcatagctgtgggataacagaagagttacaaaacgtgcttgtaatttcacagttttgggtcaaaatttgcaaaagctatattcatcctgggaacggtgagctgagcatgggaaacatatactactgtgggtctagagcttcaaggcagagaggactagggtctggggtggggaataccttctcaaaatgtaataaacatctgcttctgcagtgtttgctattttccagtcagatccttaaaagcatttatttttcttgtaaattgcctcaaggcaggaagcacaatgttgataatttggaggtccgcaagaaagagtgatttaaagtttatcaacggatcctgggtgcaggtatctctcaatgtgctttaggactccagtgaatcctctcttccatcaattcttcgacactctgtatcttcattttgccatttccctagtcccgatttccttcatcagtcctctactcaggcctgtcttcctctaaaaacctctcgaatccgtatttacttctcagataatagctctcggcccccaagtggaacttctattctgtcagagcagctgattatactaacttataacatggtttggatcactggtcaaccctactatacctgcatagcccactgagatgtttttgcatctttaaacaatatttatattatttttgtctcaaaattattaaaatgacatgaaataagtgttccagaaggcttattaaaacaaaggaatgtctatttaaggcaggggcagacaaactttgtgtgtgaagggccaaggagtaaatattttaagttttgaaggccatatgatcactgttgcagctacttggctctgtcattgagcacaaataacattatagacaacacatgcatgaataagtgtagctgtattacaataaaactttatttataaaaacaggcaagcagtgtgaggagctcagcagaccctctttccaagagtaacaatcatgtagctgatgaaaattat

SEQ ID NO: 8471 - DNA, 2202 bp, artificial
  synthetic oligonucleotide
tctctctctctctctttctttctttctttctttctttctttctttctttctttctttctttctttctttcttttttttctccttttgctagtgaaggagaattggattggttattttcagaacaggcagcctaaattgatgcacaaatcagtagcatcctttttggagtggccatcacatgaattctttggagatctctgaagaaaacagaaagaaactgaaatggtaggttctaattatttatgcataattagctctcgtctgtgcgtttttcccttagtatctagaactggactcttcacacaaggaactgtacaacttgtcaagtctaagcatggttatggatataatgaacttggaccatccttaaatgtcatttcgttggtatttgaacaaacaaaaataattgtatgacgggctgccggaggagggaggcaactttaaacttgggaaaatataagtttgacatggagagatttttaataatgtgtttagctcatttgatattgagtaaaatagtcctgtgaacatttgcaatttaacctgttttgtattaagtagagttgcttacataaaggtgcaggataatttttatctactctttgctataactctttgggggtgctatttttatctgctgcataattaaactggttaactttgtgtccttttcaaaatgaatggttatttgaaaaatgagagatacaatatttcaggaccttagctaatataaatgcatgttcctatcagcttgtgtaagttacttattttcactgtaaaagttaattattgtaattaatgatagatataaagattctgttttcaaacacgtttaagaaaacttgtttataatgagagaaagaggaaataagaaagataacaggcacagttgctctgtttttcatagataagctctatttacgatagtaagtaatcagcacattaaaaaaatcaacaatggttaaaatgattttgaatttaatttacatttctagatactcaaaattgacttattttgacaaaatgtaagtgaaattatttccttgtttgcgtgttgtctctgttttgtgctccaagagaaaatgtttaggacagtgccttttgactttaaaccatatgatgatactataaatggtgtgtaactgctaggagctgcattcagagactaagagaaaaaagtcatgaattcctatgtgagagagagatagaaatgaggagggatgtggtacaatatgacccaggattaaatctcaaataactttgctgctcctttgtctcctgtcaacagtaatgtacatggactttattttatactgctcaaaacttttcataaaagaaaatgttatagttttattcaataagcagaactatatgctttagagagctttggatcattcagcaaagagtattttgtttttcctttagcttctgtagatatcagatataaacacaaaaacattaaacttatagagaggattaaagttcttccacccacggcaagattataccagtcacactggcaaacatttggatatgccaagaagtttgtgtccaagaaggatatacttttaattacagataatgtgctttgcacttgtgaacacatgtactgctttgctttgttatatgtttgtaataatatttgtgtgagacaggaaccacctagtgtacttattttgttggggccagattaatacgatgctgaataatgtaaagatgaataaacataaaatgagtcatagactgctcccaatatgtcactgaatttcacctgaagacccctaggaatgaatgcacttcattatgcccctttgtactaggtaactgaaaggaagaggacaaagaaacacaccttctgcattccgctcatagatactttaggcaccaatcagctacccagaaccaaaaagggaagtaaactccttttcctgatctccacccaatcctgatacaagcagggcacagacggtgcctcttcccttgcccattaaagtgactccccacccaaaaccttctttttatgctataggtctcaagaatcagtctctagatccctagtcagagaataagaaattgtcagaaacagattcagcccttgtcactttcagagcaatggcaaacatctgagacctttatgctttgggaagtaaagtaggttcatagtgcacattgtgcagttggaaaaaatgagactcgtagagg

SEQ ID NO: 8472 - DNA, 1134 bp, artificial
  synthetic oligonucleotide
tagtcacttctttcaacacaccgatagacttgatgatcttttttagtgttctcacatgcatggataaaagtcccctaagactctattctcactttttctctctttgagaggtgcagtctattctcgaaaggaaagacaaaccacacccccaaatttaccccactcttgccactcactctgtccatagatagacgttttactattcatattctgctaaaaattattccccatcttcactgtggaccaagtttattagaactacttaaagctctatatttgtaatgatggaacagagagaatcttttcttcttagtcttaagggttgttaagatgtggcagtctgattttttctctggattgtcaggggaaaataaaaactcatcttctactgtccccctctgctcttctcaaaacagatccacttaaataaaaaaaaaaagggtgaagtcaggaaaattgtctctgaccctttcctcagcctggctctctttcttctatttcagtaactccctcatcatcttacctatatccctagcactttcaggaccccaaatatcttctataataaccaaatttttaggaattatacattttggctgttgcaaaaatattttcctaggaagtggtgaagggtttcccaaggaagaatttttgatgctttggtaaacctaaataaaataatgggatatagataccagacatgccctatgcttcaaatgccctcgcgttttatagagacctgttctgtgccctcctaaagtccgtccagaaacaacttcactgtctttaccaccatattttgatggagtggtggaggtaagggaggagggagtgagagataaactctcaagcaaatgtggctattttcacttgcttatttcttggttattaaaggatgtggtatggggagggggagagcaaattgtaattttactgaacttcacagaccatttcctcttcttcagaacttattcagccttaaccactacttgattttgccaaataactcaagtaatagaaatatgccaatactctattttttctattgtttggggaataattatcttcatcctacttcttactgcaatgcatatcttcagattcagctacaggcatagccctattcaaagcctt

SEQ ID NO: 8473 - DNA, 343 bp, artificial
  synthetic oligonucleotide
aaagtaattggcttttgtttctatcatactgaatcttctcattaatttttaaagttttgattattccactaatatcttatatgtaaaaatctatctagtaataaacataattttaaccctcctttaaaagttatatttttatttgttttacatattattgcattggccagaatgtctggaacaacactgaatagcttcaatagccaacatcctttcctgtgttgtaccattagttgtgatgttatttaagataaatttggaaatagtgtatttcctttttcctaaatttctatgcatattttaagacaagcaatgggtgttaaattttatcagactcttttta

SEQ ID NO: 8474 - DNA, 3033 bp, artificial
  synthetic oligonucleotide
aacaactcaaaataatctataactgtttatatgtccatgttggaaattcaaagaagccaaaaaattcttccaccaaatcaactatgcacacgattttttctctctctgtctctctctctttcaatctctttctctctctttctctctttctgtgtgtgtgtttgtgtgtgtgttttaatgagcatattctcttgagtcctgtttctctaaatcacaccaacagattgagcatccaaagaaattttaactggaaccctccaaggcacatctattgtactttgtattgaaggtatatagcataggatagtacagttcttcccattatacactgcactttaaactaaaaaaaatattaatactgttcttagtccttactagtatcatcttcatttttgtgttttgtatgtgtgagggtgtctgtggagtttgcagttctgacttgctttcctgatgaaaaatggacagaaccatttttttaaatttccaacttttaagtttaggggtacatgtgcaggtgtgttacataggtaaacatgagccatggtggtttgctgcacttcccactacccaggtattaagctgagcatccattagctattctttctgatcctctccctcctccaacaccataccttccaacaggccccagtgtgtgttgtcctcccacaatgtgtccatgtgttcttattatttatctctcacatataagtgagaacatgctgtgtttgtttttctgttcctgcattagtttgctaaggataatggactccatctccgtccatgtctctgcaaatgtcatgatcttgttccttttttcatggctgcatagtatctcatggtatatatgtatcacattttctttatccagtctatcattgatggtcatttgggttgattccatgtctttgctattgtgaatagtgctgcaatgaacatatgcatgcatgtatctttgtaacagaatgatttatattcctttgggaatatacccagtaatgggactgctgggtcaaatagtatttctgactctaggtctttgaggaatcatcacagtgtcttccacaatggttgaactaatttactctcccctcaacagtgtgaaagtgttccttttcctccacaacctcgccagtatctgttgtttcttgacgttttaatgatagccattctgattggcatgagatggtatctcattgtggttttgatttgtatttctctaatgatcagtgatgttgagctttttttcatgtatttgttggctacatgtatgtcttcttttgaaaagtgtctgttcacgtcattttcccactttttaatgggattgtttgttttttttcttgtaaatttgtttaagttccttgtagactctggatgttagatgttggtcagataaatatattgcaaaaagtttctcccattctgtaggttgtctgttcactctgatgatagtttcttttgctttgcagatttttagttaaattagatcccttttgtccattttttctttgtcgctcttgattttagcactttcgtcatgaaatctttgcccgtgcctatctcctgaatggcattgcctaggttttcttctagggtttttatagttttgcgttttgcatttaagtatttaatccatctggagctgattttgtatatggtgtaaggaaggagcccagtttaaatattctgcatatggctagccagttctcccagcaccatttattaaatagggaatccttttccccattgcttgttcttgtcacgtttgtcaaatatcagataactgtaggtgtgtagtcctatttgtaggttctctatctgttccattagtcaatgtgtctgcagaaccatttctaagagacaaattgaggtcccgtgcttttgcagtgactgcagagattctggtactcacttttgccaagaaataatgaagtaggtttgtatgttgatgctattttaaataatgtattgttctataatcaattctatatatattaattccttacctctatcagcccctgtcttttttttattgtttagagaaatttttattacaaaaacaaacagggaaatacaggaaaagcaaattttacatccatgctttataaaagtaaatacaacgccctaagtaaaatattaactaagtaaaaccaacagtaaatgtgtaactataggaggaacaaatagcgtttatcccaggaatgcacagatgtttcacattaaaaaaactctcattataactcattatattaggagattaagaaggaaaatacatacaatgaaataagtcaattctggtaaactattttttttagcccctgtctaactcacctttgcatccttggcagtgcttagaccagtgcttagcctgttacaaagaggagactcaatataatttttgaattgaattgaacccattagtcattagcaattgtttatctctgggaagaaacaaggagaaaaataagtggaaaattaaggggaaactattctgcttatgctacttcattattttaattcaccaatcaacaaatctccattgagctttttttatgtgcccgactctctgctatgtagaacatacagaaatatgaaggataccatctaccctaaagatgtttaaaatcttctgcaatagaattatttgttcagtctacatagaatggtgttagttttacactccctatttaatttgatcccataaagcctctatattcatctgggtagagttctcagctcctactgacagatgaagaaactgagattctaaggggttaagacttacccagtcacacaccttgggaggtagcagggcttgggccagaatgtaagtctaccttaactctaaatttagttttctatccaccgcaccatgctgcctcagtatataacaggtgtcccttgcctttcactaccagtatcatatattatcagtaacagtctgaaaatgtgaccttatagtgcttgccatttgaggcctccatctcactaaggtatttcatgtaaaccaataccaacgccatgaaattttccaaa

SEQ ID NO: 8475 - DNA, 2781 bp, artificial
  synthetic oligonucleotide
tgctctttggatgttgtagacaagtctcttcctgaaaaaaaaagaaacttgtatattcattttaaggaaaagtaaaatccagcccaagaatatattccaggagacactggaatcaattacttaatccgaacattttgagttgtgcacattcttgggagcaaaggcccttttgttgccctgctggtggacctggagtttttagactgtgtttgctgattaagtactgtgagaaaaaacaaagactatgtataggaatattgggctccagcagaggcagggcttgaagatccaagttttctctgatgcttgacagtggcattgggagactcctgcctgccctcacctcactaacagaagagagcggataaactggcacaactgctgctcacctaatttgagactccaactgcagagccaactggccccaaaagcttgtactcctttctgtttcccagtgccttcactggagagcaaaagaccctgatacatctctccggatctgcttaaagtggtccctcgtgggcaattatttcgcatgtctttgagttttataatttaatgtaaagctgtaacctgtatctcccttttctcctctctctacttccctatctatagctttttttcaacaagctccaaaacccccctccctgttagactctgaagtgtcactcactgtgttttttatgcttccaatagtttccaaaacaaacagtggaggcagtgaccggctgggtattcactggatgcaacagtaactcccaatccgagcaacctgagccgccattggcggcaggtctgctccctaaaaggccagcacttgccaatctctgctctgccaggtcctggaatcagggatttgaggactaatggtctgcacatgtgcactgggaggaagggagactagactttgaaggacatatacactagtttgatcttcctctcctttcattttgtctattcaaacaaaaaatatatatgtatataaaaaaattacacacacacacacacacacacacacacacacacacacacaattattttctttgaatacagatccagaaattgtttttcagatttgggttttgggtttggggttttgttttgttttgttttgtttttcccgctttccctccttccttcaccctctgtgccctccgcctgtgtctccccctccctccctaacccagttcaggttgaaactttgctgcaaagaatcccttcaccccctccagggatggctctgagctctcgggcgcgtgccttctccgtggaagccttggtggggagacccagcaaaagaaaactccaagacccaatacaggcggagcagcctgagctgcgggagaaaaagggcggagaggaagaggaggagagaaggagcagcgctgcagggaagagcgagccgcttggtaagtactgccattgccctgagcccgttgcctgagcttactggttccgcatctctccgcctggctcgcgtcccgacgcagccagacagccacattaggagccgcgagacacctcgaccacctggtgaaggggaagtttcagcgcctccgaatccatcccggagtacagcagtttctttgcggtaaaggggagggtccctacataattgtgaagtgagtctctcctacatcctcctcctaccttcgcggaaagctctcaccgccagcgggtggctgctgtatcctgggatgggaagcagggcgagttcccaaatcccgagggcatccagtctcggttatcaacgtctccaggagagtgaggattggcaaatctaaaaaaaaaaaaaaaaaaagctggtgtgggcggggggtaggtgtcgggtgtcgcacctttcactgcccctctctctccattaagcggccacagagggtgttatgcggagcttggggaatctgtcgccaaagttcctggggaagggacaaggccctgtctgctccaagataggcaccagcgagaagtgggcatgtgaactgtgacgctctctcaaaccctgagcgcctttctgtgtccagcagaaaaacaacctaagacagagccctcaacatctgcttcctctggctgcggcagcgacagcggctacggcaacagctctgaaagtctggaagagaaagatattcaaatggagcttcaaggatctgaactgtggaaaagattccatgacatcgggactgagatgatcattactaaagcgggcaggttcggttctgcccaagctgttcacaagggtcacacacattaggcacttaatttaccgctctggtaagatgaggactctccagttttatgctctggtactcctctgtcccttttccccaactccctgacatacagtagaaagccatagcccctcaattgatagggctcggacttacctggccccatgtaagtggctcattcttcctttcctgtacactgtgactccaataactcacttccccgtctcctgcctgtgtagtataagacaaaaatcagactttggtcttagactgtggccagacctctcagttaaggcctctaagataaccatggacagtatcccatgtcacagttcctcgcgcccgctagacctggcccaggttattttgaggtgagccattcccatagccaccttttggcatgggacagccacttcactgcagctggttattttgtgagtctaactaatttcagccttccacaaatctgcctcacagaaagtacccttgaaaaggaggttgggacacagctttttctctcatactttctcttctatagctttttattatggttggg

SEQ ID NO: 8476 - DNA, 500 bp, artificial
  synthetic oligonucleotide
tttgctaagtcacctacattaattggataataataaaaagtctgaatgtctctttaaaacattaatataatttcttttatttgtagttacactgttgatagagaaagtgtggaaatcagctatgtcttagatcattgctttgaaatctaaataagaatcattaggtttcaacatatttattgtacatatagaaggaagccttgcttttagaattgaatgcaactattttcctgaataaaaattgttatactcagtttaccatagaaattcatagtagaaatatgtcccctctgcctctctgaaatggatggaaaaacaccaagtgaaaataagttatccaaacacagcatggcagaagctattttattccaagtgtcaaaagcaggatgatgcaatctcctgggtacacagaagttggataaaaagcaggtaagagaaagaaaataaaaatgttccactagcagctgccctagaataaggcagcggtaccaatactatag

SEQ ID NO: 8477 - DNA, 1122 bp, artificial
  synthetic oligonucleotide
aaaaattatttatttctttgtcatatattatactgccaggaaaacattgagtaggtatcttgttttacctttggcccctccaaaatgtatttagtcttttctatgttttactggaaaatgctataaattatctatcttaaaaatatcacatggatcactggcttagccagacaattttcttcctatatctacctatttgcctatctttgtaatcttgatattcttattcaaacagttatgtgatagtttctataaattggacatactgtaacaaaacattattttgagaagaactctgtcttttaaatgttctttttaaaaattagttgttggcactcaaaacaattatacttatcaaccataatacttttttaactgtttctttttgagacaaaggcttgctctgtttctcaggctggagtgcagtggtgtgatcatggcttacttcagccttgaccttctgggctcaagcaattctcctacctcagcctcctgagtagctggaatgacagatatgcatccccacaccgagctaatttctttttatattttttatagagtcgaagtctctctatcttgcccaggctagtcttgaactcctgggctcaagtaatcctccagcctcagccttccaaattgctgggattacaggcatgagccaccatgaccagcctctttttaattgtttaagaattttttttaaaacaaaaacatgttcacttgggggtaaaaattaaatagagaatattttcccaaattctgtatttcagaaattacaacttaattttgaagttacatgtaggcagttacaatacttacaaaacaaaaatgtttgcctatctgtgtgaatctgcatggtttaactggttattttcactatttttttctccttcctccctcttcactattttttaacttaagttcaagtatcttgaggaacctgtttttaatctttaatatatctagtataacattgtcttttttgagatttgggactcagaattgccctatttaaatttattttttgaaaattcccccatctataagagcattaatgatgcaataataatattccttgtctcctggcaacagtaaccctggaattgcagcaagtgaggtgta

SEQ ID NO: 8478 - DNA, 672 bp, artificial
  synthetic oligonucleotide
gtgtcctgggaagataattatcatattcttaggggtttctaatgcctgggtagattctaaaaaagactcaaactcctttagttcacctcacgtgaacaatctttgcctctgaaaaaaaaatgctttttttcaaaactcactgagtgaccactatctctgaagaggtgattttcttcacccactccaatgcctaaatgaagtaactttgaacagccccacaggggaaacccttagagaaattgctaagtgtggcattgtttactcctttccaaggactcaggctcctgtgcatttgactgtgcatcctagcaccactaccacttcaaccccatcattttattcagctcatacatgtgtatatcctgatgtgattctcttccatgggctgtactgagtaaatccctccatgaaagtattaaaagtgaattctgctaatggctttcttttcttagatcatgtgaaatatccagagtgaagtcagtaaaactggtggagtaaagacttccaaaaaaatttttttgaaaagaacagatggaaaaaaatgttagaattaatattttccaaactctgaaaattatccaaagtcttgcaagaacacacagagaaaatgtggctgaattttagttagaacagcaagctttgtggcattttcagagcagttggaggttcaca

SEQ ID NO: 8479 - DNA, 3121 bp, artificial
  synthetic oligonucleotide
taagaaagaagtgaaatgaaatgaaataaagaaaacaaagatcaccttttataaaacattgtatttgctttaagtaaaaatgttttaaaaatctggactagccatgaaactcctcaggaatgtaaacagtttgtttatgcttccaatttaattttggtacctatttttgtcttcctaatgagttcaggaaggaaagaatcaacaatctgtttataacacacaggtatattactcacccacatttggaggtttcacataatttacaggtagttctggaggtctgcctctatgcagagccgcaaaagcagacccattccatagtgtactcttacagtctatataaaaagaacaaaggttgctaaggaatagagcagttttttttttaaccatgtctcagaagcaaatgtctgattttaatttaatttgttggaatacatttttaattattaaaccaaaatgaaaataataggcatatatttgaacatgttataaactaaatttataactggtaaccacccaacaccttaacatatcatctggatattttatttctaagctagtcttgaactaaagctttttttatgcacatatttgaatcttaaataaatatgtcacagattaataagctttaaagtttacatcagttcttcttgatctttaggcttacacgtctattcatataaaaccgtataagcaaggatataactatagcacaagtatgccagggaaaattcaggcatatttatacttgggtacatgttcgtattatgaaatacttgccagttgtgtcataacagataacagcactgcatatcagatggtaactggttataaatagctgtgtttttttctctttcatgtttaagtcaaaaaatgtaaggaaatattaaatattactaataacttggctttaaaacaaaaacccaaaagctctcttgaaagtttccaaataaactcaattaagaatttccttaaattataaaatgagatgcttaaaatctggtatcattacacaactatttaccttggagaattaggattttttaaaatagtatgctaattaaacaaaacatagaaataaatgggctgctataccttaagtatttattactccaataggcatctttaatgcctaattttacatttttatgtttatcaaataccactttatgtttgacatattgaggttccaggtaaaacttgggaaaaatctgtaaaacactgaaaatcagctgagtagaaaagcttatttaacaattactgaggcccggcgcagtggtttacgcctgtaatcccagcactttgggaggctgaggcaggcggatcacgaggtcaagagatcaagaccatcctggccaacatggtgaaaccctgtctgtactaaaaatacaaaaattagctgggcgaggtggcacgcgcctgtagtcccagctactcaggaggctaaggcaggagaattgcttgaacctgggaggcggaggttgtggtgagccgagatcgcgccactgcactccagcctggtgacagagcaagactctgtctcaaaaaaaaaaaaaaaaaaaaaaaaaaattactgataggttgatatttttgcttaaatatgttcaaatattaaaattgtacatataattttgatttacctgttacgaaaagtacaatatcattaggatgacattatcaaaactaataaagagtaagaacattataatgaaagaatattgtaagtatttatactgtattaatcaaagcaggaatctttgagatctctattccatgattacaaaggtattttatattctttacctatatatattcacttttacacaaaaggactcctttttaggtctctaaaaatttacttgtacactaagaaaacaaaaacaacattggcaagataagaaaaactagtatttagaaaagcatgggaacatttactcaatctaaaaataagctactctccactccttcctctgatatcacagtcctaaattctgaaaatctcacctttggcatcccgtagcagagactgccgaccaacacctaataatgtctgtaccccaggaacactctgagggatctctttatctagtaaaggaccaattctctcacaaattttaaggaggtagtctggaggaatgtgtgcatttgctgccacctaaaaaagtataaataaaacacaggaaaaacacatttatttggtttaaaaatataaatctattccactactaaattgttccattcattatagagcaaagtacagttttaaaatatggaatcaggcctgggcgcgatggctcacgcctgtaatcccaaaactttgggaggctgaggcaggtacatcacttgaggtcagaaattcgagaccagcgtggccaacatggtgaaaccccatctccactaaaaatacaaaattagccaggcgtggtgctgcacgcctgtaatccccgttactcaggaggctgaggcaggagaatcacttgaacccaggaggtggaggttgcagtgagccaagattgtgccactgtactcccgtctgggcaacacagcgagactctgactcaaaaaaagaaataaaaaaaataaaaataaataaaatatggaatcagagccgggtgcagtagctcaggcagataatcccagcacttttagaggccgaggcaggtggatggcttgagcccaggagtttgataacagcctgggccacacaacaaaaccccatctctacaaaaaatacaaaaattagctgggtatggtggctgcacctctaatctcagctattcgggaggctgaggtgaaaggatcacttgagccccagaggcagaggttgcagtgagctgagattgcaccaccacactccagcctgggagaatgagagagacctcgactcaaaaaaataaaaataaataaaaaaatatatatatatctctatatgtatgtgtatagatatatattttccatatatatatattccatatacatatggaatcaggaagagaatttttaaatatttaataattgaccaaatttaagaaacagtcacaaaatcagcacatttaaatgatatgacaacatttacatggcatggcactctaatatacatttaaatgtcttaatcaagtca

SEQ ID NO: 8480 - DNA, 823 bp, artificial
  synthetic oligonucleotide
tttttactctgaaaacacagtgacttctaattttcattgacaacttaaaaattagtaaagtaaaaatcttcctcctttttaccttctatttctcaatatcacttatgcgtttcttctaattttgaattgatttttgaaatacttttgatcaatttctaattcttttctgagttttattgtctcatttttctgagatgtcttatttgtattttatattttctataattttcttaatgtattttagcttatcttgaaatgttagattataattttaatctgttttgtgggattgcctttctgatatacttttttctgtcagttcttattctgtttttcatattcactctttatttctctgtagcaatcttgtatgagattcagccacaatacttttctgttgcttgttttaacatgccattacttttttgagctttagataggaagggtgggtagcaagagcttttctagcttcatagctgtagagttccttctgttgttttcacaaaattattttcaaaaatggccctttctttgaaaacttctgcttctttactctaacctcagtttagtttagattttctctctttcgctcagtttggagattcttctgtctttggaatatctcctgatcaattttggggattttactcaatgtgggccttgtcctgggagtttcagatgattactttcaagaattgttagggtgcagactgcttcaactcctttaacctttttacagatcacttaactcacctgaaaattggaagcattcccattctcagctgctttctcaaattagtttactaaaatttccagtgagtaa

SEQ ID NO: 8481 - DNA, 709 bp, artificial
  synthetic oligonucleotide
tctttttcatcttctcctttctcttttccatcttctccatttccttttccgtcttcacctttttttccatcttctttctcttttgcatcttctcctttctcatttccatttttatcctcttttccatcttcttcccctttttcatctttgtcttcttttccagcttcccctttctcttcgttttgatcttcttcatcttctttctgatcttcttcttcattttttacttctgctgccactgcttctttcttttctcctcccttttctgtggcatcttcaatattttcttcttttacttccacaatttctttttcagaagctggtgcctgtaagtatagtgaaaagaaaaacaagattctgtctgtaaatttagaaccatttcccctaaatatttacactggattatatctatttcacagaaagactaatacttcatttaaagaaagtaattttcctgtgaaagaagcctgctaaatatcacattatgagaaaacattctaagaaatgagattaactaaaatatgtccacggaaatatctacaaatagatatttgaaacaataaatacagaaacacttataaatactttttatttcaaatatgaagaagcacaaagtaaatacttaaaggatgacatatatttattctgtatcagcaattcttaatgaggactatgcatgtaaacaaaatatagtccttggaaaataaca

SEQ ID NO: 8482 - DNA, 1889 bp, artificial
  synthetic oligonucleotide
gacggttccccgagaaaagccggtggcagaggaggaaactgaagtatggttgggagaagtgttctccaatagggtaagcggaggaagggggttggggtaggaagcgacagcccagcgctatggctgtttgtaattcagcatggagacacctttcaagagattctctccttaaacagaacactccaaaagtgaactaccagttgcatgcaagaccatcctaaaccttacaccgactgctctttgcccttctacccctttccgtttcattacatcacaaaatggaagaagccaaaaagctttaaaaaaaaccaaacaaacaaataaattcttcctattaggaaataggtaactcagcagctcattccccgtctgtctttccatttcacttacctttcttttgggcattgttgtagctctctataggagatcttagtcagcagaaaaaaagccgaaggcagtcactgcctgactgctccaagagcaaatgagttttcaatgaactaactgcagcacgacctgtactctcctctggaaaaaaaaaaaatccctcgttattggcaacattaaacacgccaagacgcaaccaaactacgtgaatggttaaccggagtgggagccacattggagtgacaggctctcaggccaataagaagaggcagccggctttgaggggcgtggcccgcgaacttgcccgaagccctcgttccctgtcggctctaaccgctggtgtagtggcggagcacgcgaacttagcaagggctaagcgatcaggaataagaacagcaggaaagccagagctgacttgatcagtttttttttcttttatgttataatgacaggcgaaagccacaacagttgctttcttcacagcctccaaacccgccacccttccctattcctagcgggataagtgcttttaagaccagttgagtctgggctccggtctttccctgccacctttggcgggatggtgttgaaccgacaagaacattcattcagaaagcgcaaaagagtggagatgtttctctggtgtgggaacatcctgccaaagcagaactgtggtgctggcaagaggagggtgccaaaatggcgtgttttccgcaggtgtagagtagcgacaaaaccgggagctataccgttatcccacttggaggaggtatacgaagaattcagcgggactccgagggaaatgtgtaatagcagaggtctatccaaatgaaaaacactgagaatagatttttaatctgaaggttgcatttagtgaaaggactcaagaaggtgctatccacgaaagtgtttaggactcagaacctagactagcataaagccattgaggtactcgcctcaggcacaaaatttaagcttgtgacaaaaacccaggagactaggatgaggcgagtgaggtgagtcacgcaagtgcagggtatgatcctgtctttatttaaatttttgatattttgttcatcatggacttttttgcaagaattttgatatttaaaaagattgtctaaaaatattaagtatcttcattactgagtttctaggcggccctttaaaatttttgccaaaggagaatgtctccatagcgtcactctagtcccagccatatttaggtgactttcgactgtaagagaggcttataggtgcctttcagtgtcagtttctgagacctaaagttttcagggttgaggtggagattgatgaataaattacttgggaataaatatgattaaaatagaggatctaattccccaccgccctttctcagaggcgccttgatgtggttgttgtaagagctacctgtgtataaaagtgctcccaaacaacaacccaaatccttatcctggagggttaatcaaaaaagaaatttaaccttttgaacagttact

SEQ ID NO: 8483 - DNA, 1314 bp, artificial
  synthetic oligonucleotide
atttattttggtttcaggagtgagtgggggatacagccttatttttttgaaaatataagccagtgtcttggcggcatagaacttaccatcttcaggtaacgaagttgaggctagagcagttaaacaactcacctaaagtttctaagtgagttattagcaaagtagagactagaaatctggtctcctacttaaacttttggcctgtaatttttccaacaaagtacgctgactcattgtcaccttctctacttaattaagtactttcctggcttgacagcattctgatttactctaacccagtagaaattagatgaaaaaactttttaaatttaaacaattatctccttgccaccaggaaagtatgaattagaaaatgatttatttccttgtatagggaagatttataccaggaactttggagagagagaccaggtgtgctttaaactggtggttggcataagtctggaaggtaatgatcataatgctatcatgagagagggttggagtaagaatggtaacaaagtaagaggggagaactggacttctttatatttttctcttaggctagacctcacagaattactagttgtatgtaattagtaagatatgctttaaattaataataacagcttgcacttatcaggatcttaccatgtataaagtactttgttaggcttcatatgaattatctctggtcctcagtatacagatgataaagctagtaattgttgagtaagaattcaaactcagaacagtttgattccagagcctctgctctcttaattaaacttcagttctttcaacctttatttcttttcagtaattctgcttttgaatcttagatcagaaatctattattataagaaaactcagcatataaaattttgctaatgtaattaatcaaatagagaattaattatgcttggtttcctgtcttgtagttttaaattttcagttctccctgagataccctgccatcgtgcctccaactgagaaatagctactagatcaatgcttgtagaacgtaattatcctgaccacagttgtaattcatatgcattaattccacaaatattaattgagcactacaagggtccaacctctgtatcaggctctaaggatacaaagatttgactctgattcttgagaagctcacactctaataaaaataagtgtgcttataaaaattacactgtaatctgaaatgtgatataaatgagatatgtgaaaaacattatggggaccagagggagaaccaactaaaactgtctgaaagttgggtcagggaagaacttactcatgaggcaaagacaa

SEQ ID NO: 8484 - DNA, 418 bp, artificial
  synthetic oligonucleotide
ttgtttgttttagtctggaaacagtactgatatagaaaactcactactgctggaactgggagtttgttagagagatgtatctatggaatatatttaaaaatgtcaaacacgtcagtattcttcaacctttctaccttcctaacctaaggaatgaaaccttttctcataagtaatattgtctctctatagaagtaacttttatgtgtaaggataagaggtatacataataatctacaggggataggatgggggaatgtgtacttttaaaaagtccctaaatcctggagattcttatgcgatctccatttgagattcactgatttgtacactaatatcctcctgagatctgagacaggttatttattgtataggccttcaattctaggcagtcaggggcatggcaaagaactaaggaaat

SEQ ID NO: 8485 - DNA, 1179 bp, artificial
  synthetic oligonucleotide
actttgtcttctctggccaccatgtgtggatatgtttatgcaattttggaatatcagaaaatttaatcttacattttttgaataagtttaggttaaaaaaaagaacaccttttatatttcctttggacctaattttatgagcctcttgctttattattttccatacatgttgtctaatatttcaaagtaaaatttgagttgctcagagtctcaactcaatccaataattgtaaagtccaacttaatgcctttagttaaacccctaatgagactgaacagatcaggcagttagttttgctttgggagtcatacagtttcaatactgttatttattctttgctttctccttcctctaccccttctttaaaagtagattcaacaagaaactgctttcagaatttctattcaagtaagaataactgcacctctctttgttaagtcttaagtttccaagagccttagaaatggctgctgtcttctattatttcctttattggactcctttttttttttatttagatttcaacttttattttagattcagagggtacatgtgcagatttgatgcatgggtatactgtgcaaggtttggggtaccattgaacctctcaccctggtagtgggcgtagtacccaataggtaattttacaacctttgccttcctccctccctcctctgtagtcttcagtgtctattcttcccatctttgttggactttattgttgaagaccatgcaaatggcagatgtttatggtatttgtattttatttcaattttttgtcatgagtagttagaaatttattagaaatttatctactgtagtaattatagttcaatgaacctgttatcaaaattctacttcataatgccaaaataaatccttgctttattatactattacaacacttttaaataataccaaaacagtgtaaagtgagtacttctttgtaacatgaatggagtggtgattatttacttcagaaaggcacttttcagtttgctgtactaaagttttcctttaagattgatgccctgtttgttttaatacataagttagaaagttttgagcaaatatcctgatggagtcctacaattgcacatagtgagatacttcaataagtgactaagtttagttgtctgaagaacagttaaaagcttctttgctttggattggtggta

SEQ ID NO: 8486 - DNA, 1072 bp, artificial
  synthetic oligonucleotide
caccacttgatgtcatacactttcttcaaatatttgaagttggaatggtaggcattaatttgtgtatgttttagtaaaaatatatagcaatttttatttcatatgattaatggtgagtcattatgctaggtaaaagcatatgataaaaagatagatggcatgttgcacataatagcgttatgcatttttcctaaatatttccttaagctttagcaattgcctcttagcaactgtttcaagttatataaggcagatttctgttcctaatgaacagattttgaggcaaggggtatattgttacagttttttttttaactttcctcctcatttattaatggacccgtcaaaagttaaaaatactttgtagaactctactgtagaatagtactatttcaaaattcaacaaagtgatgagtagcaacttatcatctacctctttcacttcttattacacagaatataattataaactggtaagtttttaaataaatattttttcacatatgagtggatggcctgttgaaattcaagtgcaaaacaggccacccaagtggagatttgcagctgctagatggaaacgtgtgactagagtttgggaaagatggtggacggagagtagatatgggagtcatttatgtataggtgctacttcaaactatggaaaagaatgaactcactaggaaaaaggaattatggcatgagatgagaagagagctgaaaacaaagacaggactttgctgaatgttcacatttcggaggaggtgaaagaaacaggaacagcaggaaacacgtggattcattaggaaagatcagagtagcatcttgtaatagaaaccatggtagggaagaattttcaaggacaatgaacattgttagttccatacaggaattttgaaaactgataaaaggtcattgaattcaaaataaggaaatgattagtgaccttggagaaaagcggtttcagtagattggtgaaaacaacagcctgattgggaaaggttaagaaatggagcaaataatgaggaagagatgagtatatagactaatatttgactagtttggtgagaggaaa

SEQ ID NO: 8487 - DNA, 694 bp, artificial
  synthetic oligonucleotide
ccttctccacatttaaaagaaattattaagtatagttgatgaaattatgccttcattgatatacagtagcctgatttatataaagtttaccaacttcaactattttttttctcctcggaacaaactttcaaggccaaattcttgttcttcataaagcacccataggtgcaataaaaatgcagaatttagaccttagtttaagtttttctttttctcagcaaatactattcacagtcatgagccacgttttccttcaattgtactggtagataataggcactaggcagtcattgaatgtatccaaatatacctggtccccgtgttggatggaaaagctagagagcttcattttgtgacctgatatgaaatatattcataaatacaccatcaggtagagagttaaaaaaatactgctttaagttataccatagcttctaatcttaaatttgtgatatttgtaaaaaatcctgctgatttttaatgaagactgcataattaaagaaacctcctaagacttttcacaagtcaaaggacacccagctctctaatcattatcataaactaaattgggcaatctgagacgttttatgaaaattactcgtattttaatggattttatgcaatatcatttaaaatatattttggatttcagttctagacttgaatgctggaaaatgtattagacaaaaatatt

SEQ ID NO: 8488 - DNA, 1760 bp, artificial
  synthetic oligonucleotide
gaagtcagcctcaaacagctagtacttggttaataactgccagcttccctaatttttgtccctacttccaacttaagaccaattggagaaagccaactatgcttctttaatcaatcatgtaagatgccttgcttctagttagcctgaattcagcttccccgtgccaacagcctccaatcagggtgtatataaagcttttcctttttttatgccataaagatttcccagttctttgccttcttttcaatctctgcaaaatgcaagtgattgtggctcactcctttgctatagcaaactgaataaatagtctttaattgttctcatttttggtggttttcatttatttccacaggaggcatatgaaatttggaaggctgtctcactcaccgaaatggagccgtagggctttgtgaggcttccctgaaccccatcatcctagactctcacttaggcactgcaactctgcagttgtgttgcaatgagaggctgccagtcttctctggctagactttggaaatgagatacaacagtcatttctgctttctggtcctcctaaaattagctgagagatttttgaagagtctattcctccatctccctgggggttttgggttttgggttttaaccataagaagggacttttttttttttttttttttttgatacgggactctgttgcccaggctggattacagtggcaagatctcggctcactgcaacctctccctgctgggctcaagcgatcctcctgcctcagcctcctgagtagctgagactacaggtgcgtgccaccatgcctggctatttttttttttatatattttttgtatggatggggtttcgccatgttgtccaggctggtctctaacttctggactcaagtgatccacctgtctcgacttcccaaagtggtgggattacaggcatgagccaccgtgcccggccaggacttcttttttagggacccctactactgactcattttgttgctgtcttctctcttttcagatcctccctcctcttcctgtaaccccattgtgtaggaaaggccttttattttgcgtctgtaatgggttcaagacctgacgttatcacttattagctgtgtcatcttgtgcaaattactaattggcaactcattttcctcctccatgtagtggggctaacaaatagtacctgcctcatagggttgtgaggattacatgaggtatattcatataaaaaaactttagtaaagtgccgggcatatagtaagtattcaaaagtgttggctttacttttaaagtagacaatagttctaaacttttatgagggctgtgatagaagaagtagacaattaatgtcatctaggtcataaagaggaatggagttacattcaattagagaaggaagatgtcaagaaaaaccttatagggaagttgtacttcaaagatcaatgattactgtcaagcagatggtgggatgaagcaggactacaagtgtctgcaaaaaggcaaggaaatgcaaaggtgatggtgatgcatggtggagaaggatggatgtaacggagaggtggaaaagaatgatctacagatgccgatttcagcgaatgagtatagaggcatattgatcaataggtttcaaaaattactgtttaagaagcacctggagctactcatttaaaattcaactatcttggccccagctttagggttctgcactccagatgattctaaggaacgtgaatttcctacaccaaatgctgagaaactttctgttgc

SEQ ID NO: 8489 - DNA, 523 bp, artificial
  synthetic oligonucleotide
tctgctcagggtattacgagtctccaatgtaggtgtcttccagtgctgcaatattatctgaggctcagagtccccttctgagttcactggatgttgacagaattaatttccttactgttgtatgactacagtagcttttttttttttctagctgttgtcaagtgaacattctcagctcctatcactattcttgggcctttgccatgtggatctgtggattccctttaaaggcagttcaaaatgtggatgtttgagtattcaaagacagcagagagtcttctgctgctgcttcacgtcagttttaagagcttatgttgctaggctaggcctacccaggatagtctcccttttgactaactcagagtcaactgattgggcaccataatctcatctgcaaaatttatttaccttttatctataaggtagccctaaaaatacactaagccagtgtgtgaggtttttatgttgcattgtgcattatcatgaacttaactgctcaaaacaatgaacattcattgtgttt

SEQ ID NO: 8490 - DNA, 315 bp, artificial
  synthetic oligonucleotide
atatttagtactttgaaatatttaaagtcctcttttcttacctttttataaaatttgctgttaatgctgaagtgagctcatgaattctctgtcagtgaattattgactttatgaaatatccatggacaaatttagggtcccatttcagctttcctcatggctttctttgtacttttttttagccttctgggtactcataggatgtaaacataaaacctctcatacaaatgtttcattcagctattgcatatgctagacttgtgtcccttatgtataaatggcttccacaaaccctgagttgccattgtaagagtg

SEQ ID NO: 8491 - DNA, 1126 bp, artificial
  synthetic oligonucleotide
gtttcagttataatttgtgccactctgcaaactcttacctgcctaccatattgtcagttacagatttccaaaaggaaacatccacagcaattctgttttttaaccaggggcttatgcaaaggctaaaaatgcatgaagagattaaaacagtacaacagaagttatgacacctgtctctgtcagtgtggaagacggtggaaaaatagctataagctcttatccaaataggatagttgaaagagtgcatgcttctaactggggagagattcatgaataaattaggaggaattcaaattagtgctaatgtgtgcaagggctgtgattgttgcctgtagtagttgaaaatacttgtgtctgtcctatccatgccctcttcctccaaatgattgctttgcttgagcttcaccagattcagggctgcagtaattctgggacctaaaaatatatgttagtaagttttactgagaatagattggaaagattgaaactataattattctacataagagctttgtggaattttagttaaatacattttgtcctgtatacataatgcacttagtaatattaacaagcaaataaaatatcagagaatttacagtgcaataaggtaatcctgaaatgttttgaaggtgatgatggggagatgggacattaagaagacatttctaaggcattagccttttctagatagatattattcacctcctctagaaaactcccaactctttcgtggctatgaatgaaaaataagcacttgaaaaaagtcatttctggaattttggactcaaagagaaaatatgaaaaaaaaagttgttttaggaatggttgaatgatagttcagtatttcttcctcaatttcaagtaaaataaatctgcagagtagaagcctacctttgctatattgccttataataggtcagtatttgaagagagttaaaatttttagagtaagataatgctagaaatcttacacaatccaattatttttatttgtttataaataactagtttgcaattaacagaacatttttgcgtgtgtttaagtacacttacgtaaccaaaattgaaaactaatttcttttaccctaattttcccaagcatgatcatacacttggatataat

SEQ ID NO: 8492 - DNA, 395 bp, artificial
  synthetic oligonucleotide
tggtttaatttatatcttctgaaacaaaccataaattaaaccatattcttcctaatttcaaatttctccctaaaaatgtggagattttcatttaatttgtctactatctagcacaataatttaataggtgctcaaaaaatgtttacatgtgtgcttatgtaggtataagttcaggattccaccatgatctttaattgaagacttaattttattatttcattaattcattcaatattgaaaagatagtcatttacagctttttcattaccagacacttctagattctagtgataaaaacatgaaaatataaatgtcctactattgtgccctttaagacatcacagtctagtaaagaagacagtcaagcaaacagaaaatagtatcaagaagcatat

SEQ ID NO: 8493 - DNA, 439 bp, artificial
  synthetic oligonucleotide
aacttttctcagctctatagtatgattaataatggtatcattttcatatgattattatgattattacctgagttaatgcatgtgaagtgctttacacatgttaatggcatgttagatattagctgttacttatataataggggtataggtttatgtgtttgagtatacgtgtgtgtgtgtctatgtttttcatagctttgtatattaaaataaaaagttagcaaacatatattggtcctcttggtatttcgttgttgtttcattttactgatccatgaaacacacaaatctttgtatcaatgaactaacttttaacctcactgggatgtagtttcaggaccttaatactaaatagaatacagggagtaggctaaatatgtattggaccttcagtttgaagctgaaggataggctaaaaagtctgggctaggaagttcaa

SEQ ID NO: 8494 - DNA, 2674 bp, artificial
  synthetic oligonucleotide
agatttgttttttatcttctgacttcctttgtggttctttttgcctgtataatgtaaaacccataaggtaaaagtaaataattccaactattttattttattttatttttcagacagggtctcactccgtcacccaggctggagtacagtggcacaatctcggttctctgcaacctccatcgcccaggctcaagtgatccccccacctcaacctcccaagtagctgggattacaagcctgcacctctatgcccagctaatttttgtgtttttagtagagacaaggttttgccatgttggccaggctggtctcgaactcctgacctcaggtgatccaaaagccttggcctccccaagtgctgggattacaggcttgagccaccacacctggccaattattttattaaggtaatggatatctcctttgaattgatagcttttgcctcactcttgactttggaatatttagagattcttattttatgttgtaaactatagtgttattgctaacctttcatatgaaagttgctgagtaatgctaaaaactcttgccaattctataattaagtcatagttatccactttaacagcctaaaattcaattcttatagattatcgggggaacccacccccaatatttcaaaataggttctattttccataagtgtcggccagctgagaaataaagagaaagagtacaaagagaggaattttacagctgggcctccgggggtgacatcatatatcggtaggactgtgatacccgcctgagtctcagaccagcaagtttttattaagggtttcaaaaaaggggagggggtgtaaaacagggagtaggtaaaaagatcacatgcttcaaagggcaaaaagcagaacaaaggtctcatgcttctgaaggaacaggacaaaaggcaaaacaaaactactgataagggactatgttcagctgtgcacgtattgtcttgataaacatcctaaacaacagaaaacagggtttgagagcagagagccggtctgaccacaaatttaacagggcagagtttttccccaccctaataagcctgagggtactgcaggagaccagggcatatttcagtccttatctcaaccgcataagacagacactcccagagcagctgtttatagacctccccacaggaatgcattcctttcccagggtattaatattaatattccctgctaggaaaagaatttagtgatatctctcctacttgcacgtctgtttataggctgtctgcaagaagaaaaatatggctctttttgcccaaccccacaggcagtcagaccttatggttgtcttcccttgttccctaaaaatcgctgttattctgttcttttttgaggtgcactgatttcatgttgttcaaacacacatgttttaccatcaatttgtacagttaacacaattatcacagtggtcctgaggtgacatacatactcagcttatgaagataacaggattaagagactaaagtaaagacaggcataagaaattataaaagtattatttgggaactgataaatgtccatgaaaccttcacaatttatgtttagagattaaagtaaagacaggcataagaaattataaaagtattatttgggtactgataaatgcccgtattaaaatgaaactttcacaatttatgttcctctgccacagcttcagccagtccctccatttggggtccctgacttcttgcaacaatagactaatttataaagaagtttattgtaagtggcaccaaagatcacacaataataagactcttaaaatataattcattttagataaatataaattcaacaaacttttagtaataataataatgattttatttggcaatacaatagtagaactggatgcatagtttgatgaaatgaaaaataaagttatctattaatgtattcttcctcccttctagttctttccctgtttccttttttcttttttcattctctctttctctccctcccttcctttttccttcccttcttccttccttctctttttcacttcctttaatctcccccaccctctttttaatctatatttctgttaattctgtatgtctatgtttttccttcctttatagtctcactttctttctctctcaattttgcaatttttaatcttcctttgtcttcctgttacttaatttgcaaaaccttttttgatttacacaattactttgctcaaactataacatatgtccagacttttccagactctaaatatataaattcatgaagcaataaagatacaaatagcaacagcatctgtcttctcaatcttaaaattgagattttaagatcaagaatgattctctttgacatatagggaaagcttctgtattgaagaaagtgatgaattttagagatgaacatgacaactgtgcaactactgtttaatcaatcctggccaaagtaaattttgcttccaacatattaaagaaacaaatatctccagtcaggcacagtcatattattaaattctaaaataaatgatgcaaagattattttgtctcaatttttaacacaaaacctgtgtgtgagtgtgtgtgtgtgtataaactgaaaactatataaaatataagttttctaaatttccctctcaaataatttatatataatacattgataattcaaaattatag

SEQ ID NO: 8495 - DNA, 1647 bp, artificial
  synthetic oligonucleotide
gggccctttcaacttgcatcctgtagacaggtcttaattttaatttttatatttttagaaaacaaaaagcagttttatttaacaatctttacatgccagcatctatttctttttaagatggggtctcactgctgcccaggctggaatgcagtggtttgatcatatgtcactgcagcctcaaactcctggactcaagtgatccccctgcctcaacctcccaagtagctaggactacaggtgcactaccatgcctggctaatttgttaaatttttggtagagacagggtctcactttgctgcccaggctggtctggaactcctggtctcaagtctcctgccttggcctccaaaagtgctaggattacaaacacgagccatcatgcccagcccctatttttaatagggttattttcaggtgccacaagtaaggagagatgatgcttttaactatgagccaagcaaccaggattccatcctgagcttatctaagaacaagctgtcagtaaattatttcccattccttcacctcaacagattttttttcaatagcaagtgggtattggacttttaacaataggggtatttggtatccaaaaattgttgacctccatctgatgaaaagcagttctggtcatcagttgactgatttatttttctacaataacttgattagcatacaagctataaaaaaaagtaaaagaatggttctattgggtatcacatgtaaagcaaagttaacccagaagtacaaaagcaggaataacaagacttacaaaggaggattttcagtatatttctaatttagaaagagatagagctcttggcctttggtggcttgtggtctcctgtaaatgttacattacctcaaaaagacaatattaataaaattatgctgttctgcttaggaaatagttgtaatgttaccaatataactaactattccttcatatacagaaccaaagggaaaaaaactcttgaattcaagaaaaaatgtatcattgatgagttgcaaaagtgagaatgcctgaacacttctcaacaggtgagtaggatttaagactgacagatataaaaatctttttaaagtaatgctttttctggttacttctcatggaataaactttacttatatttttggcatatgcccttcaatattttcagttcactctcaatgaatgtacttttattctgttcttacccacaaagtatttttagcaaaattttaaaatagtaaacatacaaaaatatgttaacaactttagcaccttgtggaaaataataacatcatattacttgtagaattatgattttatttcaaccaagatactatggttccgattcataattggtcaactttacttgtaaccaagacagcctttcattaagtcacaaaatattttcttcattattggattcagagcaaaaacttcttaaattatggcctaacacaacaatttttattattaaaattatttacatcagagcaattaattcttcattggttgtcagaatatacacacacacacaatttgtagatttttctttttcatctattttaatgattataaaaatatcaacatcaattgttttaattaaagtgcactctacaatgttctccttatattacaatgaaggtaacctataaga

SEQ ID NO: 8496 - DNA, 924 bp, artificial
  synthetic oligonucleotide
cgtgggataagatgagtgagtagaggtaggcaaaggacaaattatgtagggggccaggtgcggtggctcacgcctgtaatcccagcactttgggaggccaaggcaggtggatcacgaggtcaggagattgagaccatcttggctaacacggtgaaaccccatctctactaaaaatacaaaaaattagccaggcgtggtggtgggtgcctgtagtcccagctacttgggatgctgaggcaggagaatggtgtgaacccagaggcagagcttgcagtgagccgagatcgtgccactgtactccagcttgggctacagagctagactctgtctcaaaaaaataaaaaaattatgtagggctatgatatgctgtttacatttaattataaatgcaatggttttaaaggacagtgttttaaacagaggagtgaaaaatattatttacaattttaaaatattgggttgaattctttgtgggtaggagactgcagggagaagaacagaagcaggaataccagttaagaggctttacagccattctggaagggatagtggtagtcatagagatgataacaagttttgaagttaaagccaattaactttgtcttagtccactagacttaggcttttataacaaaatatcttacactgggctgcttttaaacaacagaaatttattctcatggttctagtagctgtgaagtccaagatcaaggtgctggctgattcaatctctgatgagggtccaatatctggttcagagatggtgctttctagctgtctcctcacaaaagaagagaagggtctctctcaggccttccttaaaaattttagttttttaattgacaaatattatttttctatatttaagaggtataatgtgatgttatgatacatttatacattgtggaataattaaatcaagct

SEQ ID NO: 8497 - DNA, 144 bp, artificial
  synthetic oligonucleotide
aatccagaagatcaaacattctgtagaatcacggttcccatctctttaaaaactcatttataaagaacaaaaaaaggtgtgggtctattacattagacaaaaattattcatgatatttgattgaatcctgatttgaataagcaa

SEQ ID NO: 8498 - DNA, 579 bp, artificial
  synthetic oligonucleotide
gttctttgaatgtttgaagacctctattctgctttaatcccccaacccccagcctgcattaaacaaacagaattgtctcttctaaaactaaatatcctccaattttttttcatgtgatgtgggctttcttcatttttatcatcttagtcactctcctactatttcaagtattttttataatggctgacttgactgattgaatgactaaaattatgtccccctgaatagacttcagtttttcaataactcttttcaaacgtggcactaatatctggattgagacctttagaggtcttacatatcaaaaagattatgatgcccttcctttgcacctccatgtgtaatgtaaaataaaacataactgaaaaccagatgaaatatattgcttttcctgaatgacacaacattacaggaatgctgataatggaggcacctaatattaagaacagaactcgagatgtacattgatgcacatggagcaaaataaagctctcattaactcccttacaaacaacaccttgactacaagagagctaaaacatgttgccttaaccagtaaatcaacagaataatcaactc

SEQ ID NO: 8499 - DNA, 6368 bp, artificial
  synthetic oligonucleotide
ctgtaagtgcaaatataattaggcagctaggttacctccaaaattattcaacgaaaggtcatttttttaacttcaaagaccatgttgggtatctggtgttgccttttctcagctagaacaaatcaaatctttgcctttctccccactctgcttccaagcactgcctttgcgccgggctgtggagcacacggacttgtcctttcctaacttataaaagcttagaaggagcacaagtgtttcacctcttttattctatccaaaatgtaaaagcagtcctatcttttcaagctgaaagcaaattcaagcttgatggggactggggaagtgggggcggtacttgatgccaaacatcccgccatttctctctctctgaatttcctgggcacattaaatgcagggcgggtgaggagggtgggggagcggtgaaggttaaaaacaattttcctaggggatggcatcggggcgcggggtcacgaacgttttcctgtatacctattcgtagtgggtctgcagagtgttttgggtgagtgtgagggctgcccgcttcagcaagcagaacctttgacagaagttgtgggatctgtgatgggaactgatatggagcagtgagaaagcaaggtttccaattgaccagctagattgggaagcaaacttcgaaataactgaatattgtcagtatcacattagattttactttcccagaataattcagttcttcgtgacctaaaaaatttttcagaaaaattgaaagaacaggatatctcttagaagctttcagaccttgatatcgaggttcttaatacaatgaaataaactgaaatgttcttattggaatcattggtttcaactttattggtttagggtccaatcgaagacgttactttgctcaaagtttgtagcgacgttttgttttgcagtcctaggcacacaactagcccgcccagacagccgagtgagtctgaaaaatccctattcactgagatcaaaatgacatttaaacttgctttactttttctttatttagattaatctaaataatcaaaaaggagttctacaaccttaattttccacctcactccctgactgccccccaacaacacatccctcacatcttttccccatcaacataaaccccgcggtggggggggtagtaatcaaatgtacggccgccactctgcgctaggcagccaatggagctgaaagattgattcacttcctgcttgggtctcattgaaactccggagcttcaccagcctaatttggaaagcgagcccgacctcccgcaccgctattggccgggcttactcctggccaggcggagacgcgctgcgattggccgtggtgggtgccggtaacccgtgctagcgtctttggctccccgcaccgtagatgtcaaaggctgaagctgctccctttgccacattataactagtaggggatcctcaccgaccatggccacagctgcctcgaatccctacagcattctcagttccacctccctagtccatgcggactctgcgggcatgcagcaggggagtcctttccgcaaccctcagaaacttctccaaagtgattacttgcagggagttcccagcaatgggcatcccctcgggcatcactgggtgaccagtctgagcgacgggggcccatggtcctccacactggccaccagccccctggaccagcaggacgtgaagcccgggcgcgaagacctgcaactgggtgcgatcatccatcaccgctcgccacacgtagcccaccactcaccgcacactaaccaccccaacgcctggggggccagcccggcaccgaacccgtctatcacgtcaagcggccaacccctcaacgtgtactcgcagcctggcttcaccgtgagcggcatgctggaacacgggggactcaccccacctccagctgccgcctctgcacagagcctgcacccggtgctccgagagcccccggatcacggcgaactgggctcgcaccattgccaggatcactccgacgaggagacgccaacctctgatgagttggaacagttcgccaaacaattcaaacaaagaagaatcaagttgggcttcacgcaggccgacgtggggttggcgctgggcacactgtatggtaacgtgttctcgcagaccaccatctgcaggttcgaaggcttgcagctgagcttcaaaaatatgtgcaagctgaagcccctgctgaacaagtggctggaggaggcggattcgtccacagggagcccgaccagcattgacaagatcgctgcacagggccgcaagcgcaagaagcggacctccatcgaggtgagtgtcaagggcgtactggagacgcatttcctcaagtgtcccaagcctgccgcgcaggagatctcctcgctggcagacagcctccagttggagaaggaagtggtgcgtgtctggttctgtaatcgaagacaaaaagagaaaagaatgactccgccaggggatcagcagccgcatgaggtttattcgcacaccgtgaaaacagacacatcttgccatgatctctgactggaggaagcgaggaggcggccggccgcactgggagcagcgcggatttctctttctctctcactctcttcctttcattctagtattctttattatttttctctctctctcgttcgctcgctctctcgtactctctctcttttccctcctttcctttttctttcctttcccctttttctttcccttctttttccctttcctttcctttcattttctttcctttccccttcccttcccttcccttccatctcttcctttcctttcctttcttttcttttgctttcctttcctttttttcccttttctttccttttcataagaggttctaacttctgttgacaaaggaaacacatactctctcattcaggcttctcaatgctgatacacagttacattaagcagtccaagctgggatctcatattcctggctccccgggcaacagttccctttagccttttctgctgatcaatacatattgtttactcagagtaaggtttgtttggtcgctcctctctaggaagaacaaggagtgggataacgtgggggcggggtggggcgggggagggattgggaagacagatgtgtgcctctgaataacctttcagcgccttggttatagcagctgtatttcaggtgaaatttgttttacaatagactagttttgcatttttaaaaacttctatagcgtttctaaatgtctgcggtgttttactacaatctgtacacaatatttgtgagataatttgtatctaatcgaccactccatgttattattgctattattattactacttcgttgagctgatggctttttaattgcttagaaaagggaggagatgaatgggaataggcggggagagagatgcctatctactcaccgcccccccccttcccaaatctctatgaggaggagaggatacaacgaagagagttattgatgatgatattggttatattttttttccggggtggagtgcctaggaagggcagaatagggaagcctattaggtttgcaaactagtgcgaagtagcagcggcgatttcgcagctttctgccctccctcctggaagtgtggagcccgcgcaggctaccgcagcatagatcgaggtatctgagaaggattcggcggcaactctgggccaaagaggtggcctgacagtctgggagggctccgcactcaccggactccaggattcctgcgcgcagaaatccaggcccccagcctcgctagggcgaccttccgcgcgacctcacttcggccctcctagaggaaagactttgccttcacacgcgattactttcactggagatcacgacccggagacgctggcgactgggccagcgcctcccatttcggttcacctccagttcaccgccccctctgagtaagaaacccttggggaggggtggcgagggagtgggggataggcattctctgctcagtgcagaacggcaatgaaatgattggcaaaggtcacagggattctggtccatccgcgtaccacctctccccccatgtatataccgctgtctgtgtgtgggctcgtggggagctgtctcggcgtttctgataagcacagctggtggaagcccacagcgacgatccagcgagctagcgagcgcccgggaggctgggttcctgctttttaaaatataaatatatatatatttttaaatctctgtgtgtatgtgtctctgtgcgtgtgtgtgtgtgcgtgcgcgtgcaaacgtgtgtgtgtagatagctgtgtgtatcgcgttactatgtacaaaaacaaaaagtacaaaaaaaaaaaaaaacctggctaggctgtgtagagatcccaaaaatatgcagttgctgtggctttattgctagctagtatccacacaccaggtccacaggcgaacctcattcccaaggagcacacacgtgtgaggccggccaagcacccaacacccagccgccgccggccagacctggctgggggcgctgcacgccactgctggccgcctagtccggcctttaggcgcagctgctgtagacaaagcttcaaactacctaaggaccagaaagcccggcccggttgtcgaggatgcgttagtatgagttgccaggcctctggtccaccacactgtgtctccctcagctgcaggtcgaagagcatgtgttaattcaaatcccggacccttctacttttttgtcaagtctctgcattctgttggtagttaggttttagttctgggattttatttttttttcccccacactgagttcatgttttacaactgttgggagttttttgtttgtttcgattttttttctttgcagttaattgctatggttcgaacctgagttaacccaaatatttctgccgactttataactgtacagttttgtatattaaacgtttttgaagttattaatttaaagaaagatcatttagtttattcatttagtaactgatgtataataaacgctattttcattaagagttgctttttcaactattttattcaaattgcctattgcagttgccaacaattatttattttcaataaattctgcattgtgtttaaaaggaaattctttcacagataagttggatgtcaaaaagaaaacaattcgctgtaatgtttgatgtgaagttttagtcaaggggtttatattgacgcaatattttattgttgtaaaagattaaaaaggtttaaataaaacatttttccaaaaaaaaagttttcttctcctggtcttattgtgtgctgtgtgaggtggagcgtttaaacagaggcacattccgggtgaacagcacttctgctttgcttcagcttataaatcattagtcattgttttgactcttgattcccttcctctgactttcggcctttcagctcagctctgaaatacactggcgcacacggcacggcctattctggagcccacgctcacgcaaagcacagcacaaattgtgggaacccgcatagggaaggctcgaggtgggttttattttaggaggtgcaaccttactaatgttctccaaaaagagagtctctctctctcgctcgctcgctctcgctttctctctctctctctgccagcagatagacctttctccaaacctgcctctcctgaaactgagctcagatcttctataaggctgtcatttcgcctcactgcacccatccttcttcttcctctccattctgttaggttcccttttggtacctgatccctcattcccctgaggagggatgggaggatgataataggtaaggagaagcactctccctcttaaggctcttcctaggcccagaaacgcaggtaaactgtttatcccaacaatgctgaactctgtccattcctatctgagtatggggggaaggaaaacataatacaaggagatattttgggggtgggagtttgattacactcttcttcccactcccatacacaatttcatttgttttattttatttcacaagaccctccataaaataagtgactgttacctttagtgatagttgaggagtaaattaccaaatctgaaccagttctgttttaatgttttgtatgtacaggcatgccttattcaactttttttggtagatgcatatgaagcaatgaacaggacattcaataatttcccagcagtaaacccccctcaattcatagtctgaagtaggtgtttttgttagaggacccaaaatgatttaatcatttgaataggtaatgattacagcatatgatgtcttgtatttttcaaagtgcctaataatttacagctccatggtgcatcacacacgattgttgtgtatgaaatacggcacatgctgtgtgtatagtcatggg

SEQ ID NO: 8500 - DNA, 924 bp, artificial
  synthetic oligonucleotide
atggagaagtaggcaatattggctctatagatgctccccagcagcctcctcagggcaggtaaaggaagttagtgtagaaaggattgcaagacaaaggatctgctgcctacactgagagctccagcctctcatctacagtggaaaatcaactgataaaatacagtcctatagtctcttctactccttaatgatctgcttctgcatgtcctactatgatgttttcgattgaattagaaaactaactagctttgttttcaatggattaaagttatgtctaaacaagtaatttcaaaattgctgacttgaaatctttttattttctagagctttctctgcacaattatttgcactttgtattactgtgttcctttatgcatgattttgagaactcacaatagaaaaatttaagttaaaggcaataataatcttttaaatttacatactgtctttcctccctaaagattcctaggcaatttggaaatgatgtgcacactatactttgcaacaatcaatatgcaaagcacaacaaaatgaccacttcaggccacacaaaatgatcacactaagaccaggcaaaaagatcattaatatcaataggcatcctgtgcacaactaaagagcagtatatgccatgggtctcattcattgctgtgtgagagtatgaaagtgcttgtactcacatctcaaacaaatcaagtccaacattttcaactcgtatcatataagagataataggcaaataaagtgaacacaaaaacatttgaaaattattgattaaagttgtctttgagtcttctggagaaaaacaagtattttggtaactgaaagaccaacaatactcaaaggtaattgtgcctttaagatatgtgatattgtaaattaaaattgttgtaagcatttgtgaaaaacgtaatgacaaaatag

SEQ ID NO: 8501 - DNA, 833 bp, artificial
  synthetic oligonucleotide
acacatcatttctctttggctgatcatttggcaactggtctctgtgagttatccatgagtgctttaatatttgttcagcagtataccgctgatgtgggtccatatgaagcatatgggaaagcaaatcctaaattaaaaaaaatgtgtgtgtatatatatatacatgtatacatacataattttacatttgctgaaaatgtgacagcatcaatagccttgcaatctgtttatttcacctacatttatgcaaagtaaaatctatactctacacagttaactctcaagagaatcttgagagatatttttcaatatatactaaatccttatacaccacttttaaatcggaagatgccaaatctgtggaattggatgtgtgattagtgacggaggaggaaaatgtaaaatggcagaagttatcctggaatatgctaaatgttcagcaggagacaggagctattgaactttgctgttaagctgggccccaaggtgtaagggtatgtgtacacagataaaacatagaagggagggtcccatgtagttaatccattcaataaatggtggcttactatataacatattaagaaagcaaaccataaatccaatgttagcaagtggcttctatcatagtagtccccagtgcattttaagtttttcatcaaagtaagtgtacgtttgcttatgttatctctgttgcaattaaaaaagttgtaaatttaatataacctcacaggaaaagttttcaatatattaagagatgtaatacttttaaataaactgtctctcccaagtatcttttagagaaatgagaagtaaactccttaataagcattttc

SEQ ID NO: 8502 - DNA, 1677 bp, artificial
  synthetic oligonucleotide
tttaaaaagttgtttttggccaaccaagatctgtcctgctataaaactaaggatttttttccctctgcaaattttccatggtcatagaagataagtgatgagtctctcctttttctttacataaactgccttcattttcttgtggacagaaattccttatccttctcttcctcagacagaatagccttaattatgttagggctagtctccttcttgatgagtatttgggtccattttcaggaaagttcctccagttttcccaagtcttaaaccaaatagaatgctattttcaaaaagtaaatgagctaaagagccatttgataataataaaagatatattcagcttagaagatgagaacctgcattttaacaaagcaccaggaatgcttttgttttttacaatcctctgttcaggaccacacagaagcaatgtccttttttccttgttaattcatgcctgaaaatgaggtgttcaggggttaaaaaacaccaatgaattactcattgtatacaatttccagctctttatcaatgtcactctttttcacagccagatttcatgcaaagtcaacattttaaagtttaataataatagatttctgcaagttaatcctgctgattcactctacttggttgaggctgatattttcccctcaatttccatagctacctagaccatagagacaaaagtttctcatcatttcataaactctcttacacatggcttttcactaagcagtctgctaacccaaagaggttgataaaattgtttccaattaatttatattatattatactccactcattctcaagacttctccttgaatttatattcaatgtccacaggagaggacaaatgtctttgccttctgtaagccaggctgttttctatctttttcccctgtctataaccctgaaaacaagtggactcgaaagggagaggaggtggctatgacagctaaatgtcatcttttactatcatggccatcctcttctcaacagacactgaagaaaatagatgccataaataaaaggacagtacattagaaaaaggctactgtgctcagctaagctataaatgaagaagacaggctttttggccttgtgtatgtgtcttctttctctccctcttctcatctggaccatacccctatgatgcctaggcccagattgcctttgcatcatcctcccaaatgcccaggtttccctcccaaacccatttggctgaaagagccatctattatctggacctttctcctcctatatctcattagtaacactcaattatagtgttctttcctcccaaggccttgctaggcgattgaaactgatctgagaaaataactcgggctaagatattaataaatgataatgacctaatgagtttctgttctgaggtagcaaatgaggtccattacaggagcattccacatcttcttaactccaaagtgtgacacttttaggcactatggaagattttgagagataaatttggggcttgctccagtaccctttaaatcacatgccacaggcagcagcagccagaatctctggagcttctgttacagattgatagcagtcacacactctcatttttctccccttttaattttaacctatcaaaccccatcccctgtcagatatgatcaatgacagaaaagaacctttatagtttat

SEQ ID NO: 8503 - DNA, 1584 bp, artificial
  synthetic oligonucleotide
tatttccaacatgtgtagaagtttcataaaatctcagtaatgaaaccaagatcccatcttactactatgaagttatttgtactcttcaaggcctaaaacttcttaacaaacacgacacttgtagaaatttgctcatcaatgagaacacatggacacagggaggggaacatcacacaccggggcctgtcgggggtggggggctgtgcgaaagatagcattaggagaaatacgtaatgtaaatgacgagttgatgggtgcagcaaactaacatggcacatgtataactatgtaacaaacctgtacattgtgcacatgtaccccagaacttaaaatatataaaaaaaagaaatttgttcatacatctttgtaaaaaagctaagctaattctatgttcaagtacatttgcccgagttaaagttcaggcaacctgttaaaataaaaaacttcaatagaaagtatggaatgataataactatacagaccatcacaactccagagaataccttactcaactggcaatacaaagcagtagaacaaaggcaaatcttaattcccacaaattagaagcccgtgaaagaagtgcctttgggattttatcagcttgaaatgaccaaaggaacatatccttttcaacagttaagtattgcttggaaatttgctacggtaactgctctgagatgattcacaagtaacctatattaagtagaccacacagtatgttataatttctgcacatattaagtgaccatcaagggaaaatgaatgtagatagaatacatcatctaatcacatgggtgggcacactcatggattatacccaagttcactaacgatttttaagatatctgattgatgtggcagcttagaaagcaattgtatccttgtagcttcaagttgcagaaatcaattttgcactgatttaacagatcgctttggcatgagaaaaacagagcaatcaatggtgatatcagcagcctttttgtcatgctgacctaaaggagttggctataatcagtctgaagcaaaaaaaaataataataataaaataaaataaaaaagcatccactgctgccaatatattagcattaggtactcagctcaggtgttttggtgttgaaataatctgataaaaacaaaaggaagaagcttcaggccttgaaacacacagctagaaataaagactgtatatattaaatatgttagtgaattggttcttaaaatgaaaatgagagatttatagaatgaacatgggtttatattctaaataacatatgaaaatgaactggaattgttaagagaaactcaaagggaaatgttagagcttgtggccagagaggtggagggataatgttcaataaagaatatttctgtaatagatatttggaagaattgtgaatgcaagggaggctcacatgctcccttaaactacaggtgggaaagaaaatgggagaaggagaaaattatttttatattaagtgcttggtagaattcaccaagtgtacttgtaatataaatgggaaagaatataagaattactatctattcctttaatacattttttacattaagaccacttgatataca

SEQ ID NO: 8504 - DNA, 971 bp, artificial
  synthetic oligonucleotide
tctgtctgttggaatttgagttccacttctgcgtatggtcatgaaagtacaactactctgaagtctgaggacatgtaattactcctggttaaattcaaatagcttaaactggcaacacagagactatttcatcttcaatacactagcatgggttcacagacaacaagtcaggccaaactaacttcatttccttttttaatagcatgaatagcctgaaagatcagatgaatgcctcatcactagtatatctgaattgaacaaaatgtaatctccttgttggtaggatagacaaaatgtggcttcagggaataggagaatttatagttaggtgactaaccattctcaccaaatatattaattaattctgtattgacaacggtggaaaattataagcctctcctattttattcacattgttattagagtctcaaataaaaatagaaaaataatcatttttaaattggcagatgacaaaactgcaggggagagaaactttgtctgatgccaatctgaaaagatgggtaaaatctagccacatgaattctaagaagcaattaatacaaaatgtctgaatttagtttaaaaaattaactatagaaagatacctttcttagcaacagtatgtataaagatatcactggagcttttttgttgaacatgagcacagagcgccagtagtgaaaggtagctgctgaaaagcaaaacccaaaaatagaaaacaccaccaccaaaaagcaaagccaatgaaattttaaaaccaggataatgccatttaaaacactacagtgtctggatcaaattgttatacatttttcttaatgaaacataccatattcagtgtgcaaatatctggaagtatgggcacatttgaagaaggacattgacaaactgatatgtgaaggaaggcagaaaaccatccttttgcaagagactgttgggttatataggacccagtagcaacattcaaaatt

SEQ ID NO: 8505 - DNA, 3127 bp, artificial
  synthetic oligonucleotide
cctgtctgcttgtttctcattgctttagtcattccagcaagatgtgactttccctgaaagttggaaattgcagttccttctataactgacgtttttgtcaggtggatttgtataaccaagtctttcactgtcttgattcaggcagagtgacaacaacaacaacaacaacaacaacaacaacaacaaaagcggccaaggggaatggacataccaacaaatagactgagagactatgaagaagtattatctgttaccatttcaccatttttccacaatgagtttaaattttgcacctgaaccaagaaccaagaatagcaatgtgtccttttcctctacaaaactatatttggtctaatctattctctgaaaggaagtaaccattggaaaatcaaaataaaattaagggactttaaattcatttgggtttctcctgatttcaggagctgtacagcaagtaaaaggataaggataatcctatataatgtcatttcagagtgtgatttcaagtaccattcttccaaaacgtcttcctctgctaaactgctaattcccaaatatctgtcattcattaactcaaaagacacctgtgtctaccatgtgccaggcactagtagtggaagatggtacaggagaaagtacgggaaaggcgaatgaaaaaaggatatcaccaagagaagaaaaggttcagacaggagaaacagatttttctgtttctcaagtgtgatgctaatgtcactgttaatatgtttgatttatagctccaattagctagttcagtataggtgattggagcttttgaccaactagtaccctttttagttgtggaataaaattatcctgaaaagaacaatattttatatttaggttttctttctttacttacagctttggaatgattatggaataggcattgcattaatttaaagtacataaaatttaattcagtaagtcaatatctacccatattgttagcatctaactgattcagcactcttggtttgagcataagagagcagaaaaatagtttgtcactgcttataagggttttttttccaggactcatttgtttctagttcctgaaaaggattacctagagtatatatattttttgtgaaccacattgtataagttcgaagatcactgattatatgttgttggcatctacagttccacaaggacctacattggttttgccagtattttatataatattcctgaaaccagtaggcagtgataccaagaatattcctgggctactattcaaacagtaattaaacagatttctttcaaatgttcatataggaaaccaagcaaatggctttgatttttattgaaagagcgctatttctttagagaaactaagaaattaacattggtacaatactattaactattctatacaccttattcaaattccaccagttttctcaggaatatcctttttcctctccatgatcccaactctccatttagtcgtcatgtcttctgtgtctcctctgatctgtgacagttccttattactgccttgtctttcataacctggtcatgattagactgagattatcaatttgttgcatgaatactacagagatagagtagccttcacagtgcaccatatatatatatatatatatatatatatatatatatatatatgtatatatgtatatatatgcacatatatatacacacatatatatatataatatatatacatatatatataatggttggtcatgttaattttaatcatttggttaaggtaatatctgctagatttttacactgtaaagttataatttcatctctgtaattaccatatgtattgtgggggagatactttggggttatgaaaatatcatgtttcttatcatattttgtccactagttttaacatccatgatttttacctgaaacagttattactgtgtaactatctaaaggtggttttctattttcctcattccttctactcatattcattgaaattttttataagaaaaagttatttcttctctcccatttatttatacattcaatcatgtatttctgtaagtatggacacagggatatttattttattctatgggttataatccagtactatcattatttatttatttttgttcaaattgttccagctttggtcattggaatcaccttcagattggctcctttgtccctctaacatgttccctccttttttgagtacttcactactctctgggactataagatgtcccagactcatttttatattatctgccctagccctagaatcaaacattttatcatggagtattggtcccttttataagataatgataattagaaactaagatctgaatactaggtgtactcattgctacaaggttttcactgtttctaggctctcttggtgaactgagataagaagtactgatgctccatgacttatggtggggccacatcccagttaacctactgtaagttgaaaatgccttcaataccctgataagcccattgtaaagtaaaaaaattgtaagttgaaccatcataagtcagggaccatctgtatatgtgtatatactaacaaatacatacacacatccatgatttctatatttattcatctgcatatatattacattaagcaggagttcatactgatgtttttgacttacatctctaattccaattcagcacaacaagattcattttagccttccctcttttcccatttgtaacttttctctgacagaatgaagcctggttctttgtatctataatcttagttagtacatacataaagcactttcagactatttctgaactttctattctattgtatagattatttttatgagtacaactgataaggaaaagaatggtttactttaaaatatagtgtaggaaaacaagattgggaaggaggttttcatcctgactgtatgaattcacatagacaaatgtcccatgtgttatgaactatattctctcctttacatccagtggagcaattagtaagtccctttctgttttcacaggaaaacaatttaggggagttctttgctctctcattcatcaattatggtaatcagcctaccagcaataataacaattacaactaacaagctaacataagatt

SEQ ID NO: 8506 - DNA, 1169 bp, artificial
  synthetic oligonucleotide
attagtggaaccactggtgaaatttaaggtctgcagattagatattactattatatcattaatttcctcttcttgataatcataccatggttacataagctaataatgattggagaatttgataaaaagtatttaagaattggttgtataatttttgcaacttttttataagcttgaaactgtaagatacaaagtcaaaaaagtaaaaaacaaatgtaaatattggcttatatttttcaacacaacagatgtgtttgctctgttattaacttgctctcacaatgcttcctaatattggctaggggaaattcagtatatcatgtattgaacccatctcacatgctagctatgaaaagatgtggaagaccctaaaatgagtaaagacctctactcaggtctcagtgtaacagggaaaaaagacataaccaactaagatgaacagctgtgatcagtgttgtaagagacaggcagatagtgtgttataggcactcgaaaaaagtttagttcctgctttgaagtgttagggaaaatgccattgaaaaattaattttcaggctaggatttgaaggatggtaggattttgacaagtacaatttgaggtaacgggcatacaaagctaagagaatagcatgaataaaccttggaggagaaaaaaaaatgaaagaccacccctccccatatgtcccaatagagcaaatttgtacatcttgttacaggccatattattgggctataatttgattattataaatttttattgttcattaaactgcagactcattcccacaaaccactcaatttgaaagatgccttagagatcttacccaaccacctcattttggtgctggaaaaaatgaagaggctcttctaaggcctcacgaagttcgcagcagcagtagggccaaaacccagagctcttgtctcccaatttagtgctttatctactctaacactgtgaaacttttaaataagcattgtaatgtcagtcaggcacattactgtgcagacacaggaatcttcatactggcttcttcagactcctatcttcctagaatttagttgtactgcaattctgctctcctttccctgtgcccctcctatattcattataaagttttacattgaagatgggtagaggcacagtttcaaggcactctgtgacagccagc

SEQ ID NO: 8507 - DNA, 940 bp, artificial
  synthetic oligonucleotide
ttggggacggaatgtgtctgattgctcttcacatcaccacatggagcttgccatatatttcaccctatgggtaaggttggcctggtataatagagcaccacttgaatagtaataatagcgaagatgccctaaacagcttcctactgtgtactccatagatatagtctaataagttaataatgcagagcataaatatctaaagctgagttgctaatatgtggtcgtttcactgagaagaaagttactaatttgagttttacttgaattatcaccatccttccaacacacatacctccttgctacttcccctaggattgctgaaatagcctctcctcaatcatttattatctatcttgctcattcccaccccagtctggatgctgctaattagctgtctttatggatggataccatctgaaaattaaataacgagaatactaacaaggtaatctttatcttatgtagctgctttgtagactcttctagccattctgagccagggaatgtcttcataattcaactgttatcataagaatataattttctgctttatatcttggctacaaaacagtatttgagatggcaaattagaaattgaaagccacttcaaataaacagcaccatagtcaatatgttactcattcctttatacagttcctgtaataggttcaatgacagagttgggcttctcagccctggggaggcaaattttctccagggacagtatgacattctgcaaagggaaattatctttaattattaactataggaaataaatataactcagacaagcatttttaggaagcaggtgggtcaaagtcaaactgatgacaaggttgtcctgactttccccccaaatcagaaataatgcaggagtgtatatgtaaagtatgtaggtggttagaaagccaaagacagagtactctcaaataagtgtctc

SEQ ID NO: 8508 - DNA, 1075 bp, artificial
  synthetic oligonucleotide
caatcattgacaaggtcaaagaaaaagtataccaagtttgcttcctatacttcttagaagtacaagacattaaaaaaaaatctgaaactttcaaattataccgtaagtaatggttaactagacatcctaaggtgaagttcattttggtgattagtaattagaatgtatattagacttaaaaacatataaatagtttttcctgaaatctcaagaatatatttatgttgcaaacatattctcccttagagtaatttaccatatgttacagaagaggtcctcttaaaacatatcacctccaaattttctctctgccatgagcattctagtatgttggaaaatcatgagaaacaaaaggatagtaaacagttccttattctttcatctaatatgagtctgaacaaatattaagcaagaagaaaatggtaaaattcttcctcctttttcacagattacgatctttgtgtaggaataagaaactctgtatatagtaatgccaaagggggaactgatgttaatagttttggccatttttcacagtaagtgtgcctaaaatctcttgatatcagagagaacactagccaggaatcctgtggatatcttttttttttttttttttttttttttgagatggagtcttgctctgtcgcccaggctggagtgcagtggcgcgatctcgcctcactgcaagctccgcctcccaggttcacgccattctcctgcctcagcttcccgagtagctgggactataggcgcccgccaccacgcctggctaattttttgtatttttagtagagacggggtttcaccatgttagctaggatggtctcgatctcctgacctgtgatccgcccacctcggcctcccaaagtgctgggattacaggcgtgagccaccgcgcccggccctcctgtggatatcttatctttattttgggagtgtatgtttttaaagagattctgtccgtgtctcctctcttgcagtatggctgtctcaaggaggctctatggctgtccatagaacctgaacactgttgtcatggcacaaggtacttattagtaccagaggcatgatgaag

SEQ ID NO: 8509 - DNA, 921 bp, artificial
  synthetic oligonucleotide
gatttacatgttgttttatttcaatgaatcctcagtatccctaggaagtaagttagaaacatgatagaataatgacctctactttgctgataaggcatcaggaaaagctaggtcaaaggactcattcaacagggcacagagagtccatggcagagctataaatagaaatatctgagtttttctagttgtttttttttccagtgatgcctcaaattattttcagaggtggtggaaaaatctaaacacaggctttaattaaaatatatatatcctgcaaagccctgtgtgtgtgcttctgatgaaatagggagagaaaaaaatgagagagacagagagagagagagactgtgagagtgaatctgggacaactgttgcaattcctggcttgaggtatggggttctgttgcgttcttctgcctaagatgatatgatcaagtcccacacagaggctagtcctcaaatactccttagacatacaatgttttcaacatttcctttctaactgaaatttaaaatgaaacctcctaagttagattcaggaaacagtggaaaataatatacacaacatataaaacatgacttaataaaaagggttaccatagctaaaactgatgtaatactaaacaacagttgcaagcatgtttcttttaaagttacaagcttttgaatagtaaattcagccaccgaaaggaaaataaatatatgaattcttggtttactaccaagaaagtgaagttagattgaatatttaaagcatgcttcttcataagatatatcatattttgtgtgtgtgtgcgaataaatttcattatcacctaaatcttttctctcctacttaaaaaatccctgatgagtaacagttattgtaagtactaatactaaattacgtttccaataaatgaatcaaaacatgccatctaa

SEQ ID NO: 8510 - DNA, 515 bp, artificial
  synthetic oligonucleotide
ggtctgctggagctaacggagaattgcaactttaaaagtaaatgaaagaaagtgtacttactgttggaaatctgcatctcatggctaagagtggatacacaacgaaaataatgcacttatttagatgtatactggagtcacatcaaatgtatacttaaggttcgtgaattcaactataacacacttgccagtctcatgtaaaatcatactttaaatagactctacatatcaagatatcaattatatatgatatgtcttcattactgtacatggttgtacattcataagaaggcatgcaaatagttaagttttatagatgatttaggtattcttaaaggaatttttgctgttttattttacacaatttagaccccacatatgaatccgctttaatgtttctgctagattattagattgtcaagagcaaaataccaagttttaaaaatttattctaattattttatgtagtcacacagagattatatgttaaaaacattcatttgatttcaaaaata

SEQ ID NO: 8511 - DNA, 1049 bp, artificial
  synthetic oligonucleotide
gtcattttcagtcctagctaatggaagaaagttgaagagccaagatttgacaaggcaagttaggggctcaaggaccagatctaagtaaaggtggaacaaataatctgaaactatgtgaatagaccaaagtaggtgtatatagaactgccaatagtcaaaactagagagtgatgcccaaattattggtagttggaaaaaaatgtaaacacatagccatgtagcaaaagtcagagaaggcaagattctagattcagaggtgttcaaactgggtaacagaaatcaagaaccagttaaaaagaataagtatcagaaatcaccaaaaatattgggaaaacaacattaggatctaaattggcaggccaaaaatgttggacagatggaaatacaaaggtcaagttaaagaagaggtagccaaggaccaaacaaaataaactcaggccaggtcaatttgatttatcaaacaagtaagtgagtagtaaggagtcaaggcaaatcaagaaataaggaagtcacagaagcttaaagcacagagcatgggtaagttaaatgacagatagaaatgccaaggtggatcttgataaatgagagagtccttcagctttggacttgagctttaataaacctaatgtggccagactgggccctggaggtgagagcaagtaattgagaacaactccctgccatgaattttgtgtgggtaaaatagtactttctggcagtcagattccaacaacaaaacccagaggaaaatatgaagtgttttgaataccttaagagtttttaaggcaacagttttctttcaaacttaaacgaatatcatggtttccagttgagaaaattttctaaatgacatagcaaaattatttggtagtaaaatttccatgattccttttcagagctttataccatattgtactactgacttgcattacacagaatatgtgaaaatgttatatcataattttttaagcttgccctataaaaattattttaattctattacttttcctttaataaaaatccccaatgaacttcagagtattgatcca

SEQ ID NO: 8512 - DNA, 2494 bp, artificial
  synthetic oligonucleotide
tgtagcaataccaaaagcacagttctttgcagctttaatacctggaaaatctgttacattgaccttccattttaattactttaagttacattgacctttcattttaattactttaagtttttagtattagcatagagtctttatatccttccctacctgcagcccttcttcctgttgccaaaagcattatatataaatatatctgataattttaaaagcaagcacatcaaatattagtcttccttggaataaatgggggaaagagaaataggtgaatattgatagtggtgtgctagagcccgtcagcacttgctcaggagagctgactgtgcagatctcctcccaactccgcattcactgacctaaaactagtggcttgaagcctgccgtggtggggtagtaacaacatgaaaattaacaaatggtacaaattagggcttccatttcaccagagagccaattgttaaacatttactagcacactactgagggtataggaaagcagaatatgagaacagagtatagagaagtactttgaaattaactaggaaggaatgattaactttaatttgtttactactaaaagatgaggtctagctgaaaaaatgagttttcatttgaaaggagtgaaaagatttcactatgtttgcacagtaaaaattcacttttaaaatttaaaatagaataatttacttagctaatatattgaatccaattcattcttggaatattgttattggatagctaagcaatttggtgataatagtaattcaccttatcctaagttttacctttaacgttataaaaaagaatcaaaagtacccttaaataatatgtcggggctagcaggtgtgtcttttaagaaagtttatttgataggtaatggcggaggatgttggtgaagagagttttaaatataagctaggcttggtaaggactacatcaaataggttagtgttctgactgagatttttaagcaagacttggaactcagtgatcagttatggaagcaggatctgaagaaaaagaaggtgcgtgctgaaatgatgtgtgaaatattgcacaactgaaagtaacgcttggcaaaaatgagcgttaatactgcaacagaagtcagtatattgaagaggtatctgcactcccatgtttactgcagcatattcacaatagccaagatatggaatctacctaagtgtccatgaacagaagaatgaagaaaatgtggtacatatacacaatggtgcactattcagccatcaaaaagaatgagttccagtcatttgcatcaatatggatggaactggagatcattatattaagtgaaacaagccaggcacagaaagacaaaacatcatatgttctcacttatttgggggatctaaaaatcaaaacaattgaactcatggacacagagagcagaaggatggtaccagaggctgagaagggtagagggaagttgagatggaggtggggatggttaatgagtacaaaattacaaagaatgaataagatctactatttgataggacagtagggtgactatagtcaataagaacttattagtatattttagaataaattatgtaattggattgtttgtaactcaaagtgtaaagcttaaaaggatggataccccgttttacatgatgtgtttatttcacattgcatgcttgtatcaaaatacctcatgtatgccataaatatatacacctactatgtacccacaaaatattttaaattataaaaaagaaaatgggggctacatatacaaaatggcatattattcatccatgaaaaataaaattctgtcatttgcaacaacatagatggaactagaggatattatgtttaattaaatgagccaggcacagaaagataaatgtcacatattcttactcatatatggaagctaaaaaattgacctcatggagatagagagtatagcgatggttaccagaggcttaaaagggtagtagggaggggggaaagaagagagtttggttaatgggtgcaaaaatacagttagatagtaggaataagatcgagtattcagtagcacaatagggcaactgtaattaagggtaactatagttaacaattttattttatatctcaaaatcactagaggagtagatttggaatgttcccaacacaaagaaatgataaatgtttgaggcaatggatatcccaatcaccctgttttgatctttatccattgtatgcttgtatcaaaatatcatgtgtacctcataaatatttacaacttttatgcatccattaaaattaaaaatagaaataaaatataatttaaaaaatgaagaaaagattgcaacagaccataggaacttcattttaaagactcatggattagatctatttttacatcagtgccttcttttagtgaattactctggatgttctgaacaaattcacctggaaacaatggccaatagcctcaaatattaaaggcaacctctattttatctggacaaag

SEQ ID NO: 8513 - DNA, 1267 bp, artificial
  synthetic oligonucleotide
acatctgatggaggaagaaaaataccaggagaaggctagatctaaaagatatatgatggactttagctctgaaccatgtgggatggacttagattcaggaagatatgggctaggcttagcagctttcaaatttctcatgaatgctaatacattccatttgaggactgacactgaagggctctggatgaattatgggtctgaaagacgtacaatggactcacactctgaaagcctggggatgagctctgattctggaaaacacatgataaagtctgaaaattgccaaagaacctctgaattggaaagatgctggacaagactcaagtctgaatctgaaagatatcagatggactctaataaaatacagtcagattttgactatggtagattctgggattgttctataacatagcagcataggtctgcaagacttttgaatagctctggaagatatcaggatggccctctaaaatatttggaaaactttgaaagacatcatgtagactctaattctaaaaacacacaaattctaaaaaattaaagacaacaacattgagtttgaaagtgaaagacacctgatgaggatgcagagggaacagtgtctgacacaatttgcaaatgagagacgtcaaatggatgaagagaaggaaaatcatcttatggagtctgacagtgaaaatgaacacagaattgcatttgactctgaaccaggggaaagatatcaccttgactcagaatatgaaggaaaatgccttggtgttcatagaaaggataatcatcctcaaggtaagcttacatgtgtggtctttgaaagcagtttgatttacaagtttaattagaaatattatgacacttccaaaatgtcagtagctttgacaaatttgggcctaagatcattttatcagaaattcagagaatgggcatcttaatcccagatttccaatttacctttaaaaattaggaaattatcttgctttagttaaattttatctcctcaaaagggggaaaattaattcttagcaaagatggttattctggcctaagaaacacaatgatgaatttagctctcatcattctggaatgggtgaatacagattgcccataaactttttctcattattagttactgtggaaacaggtaaatatccaagcctaactctaaaaagtttcaaattatcttgcttctctcaaaaagttactatccaagctccataatttttgataaatagttggcatttaccttgctggtcatttttattttattaca

SEQ ID NO: 8514 - DNA, 2733 bp, artificial
  synthetic oligonucleotide
tctctacgtcaagtaaattatctaaagtcattcaataatcatcataattctagaggaaagagagagtaaagaacatggaatatacggaataagaaattttcctcacaaatttcacataaattgaacctgaggccttcatggaaaaaaaaaatgttaaaattgaaaatctaaaggcataggattgaagaaggaaaatgatgagccatttctaattctcttactttttccaaataaatgacagattaaaattacctacatgtaatatttctatattttaatatgctcctataaaataagaagaaaattacttgctaaaattgatgatagcgtaggatgggagaaagaactctgaaagtgtcctgcatattttactatgcaagaaagaacagttaatcagaaaacaacaataaatagttattggttaaccaccataattagccatattgtttccttctaaggctctagaaaaatgtaaagtgtgcactgctcagtgtgagtaacagatgaattcttctaattttacagatgttttacatacattcccctaattatactaaaataattttaatttgtaaattaaattgtacaatgtgcattcagataagttgaaataatttttaattcacaagttacttagcagaagaatgaaagagttttctttactaaataatatttcttttatgtctgtttaagtcttcaaaaattaagcaaatgaaaaaatattttcctcaaaggttaatatgatggaactaaggagaaaaatatttgacacaaaaacacttatctaagaaccaacaaaatgtagtattcaaatatcataactgctactttcatttcaataaacacagcgttagaaaaatatttctcaaaccatttaattcaattcaaaatatttttgaagcattctgaatagggaaatcattcatacataaccatgacctgtacattagaacaaagggacttcaacagtttgtaacattaaaaaatatatatttcagatggtctgtttgtctataattagaaggtaaaatgaagaattgaggctttacacatgtagtgaagccttaatttatttcagaaaaccacaatatcaagaatcattataaaattacaacacacaactatgaagaaaatttatccaaaaaatcaagcaagggcattaattttgaacattaaactcatggtaactgaatgcacaacagtatttctttttaagaatgagacagtatagacggtgtgtataatttatattaaaatccattaactagcaagaaagcttcatttattgcatgtggcgtttccatctaatgattaagtatgttttagaagtgaaaactcaaaatattgcaaattgcttttagtagatcatagggtataaagtgcatatgactgttcaataaatcttttaagagcaaagagcctcattgatgtgtgataatcttgtagaaagtggggggataaaagaagagcaaaacagaaattagaataaaactgtagcaaaccaccatggcacacatttacctatataacaaacctacacgtcctgaatatgtacccctgaacctaaaacttgaaaatcaaaaaagaaacttagaaattaatgataaaatattgtgagcagtcccagatcatattttagcattcttttgccaagtgaatggaatgattatgaaacagatatctcatttgccattagaaaaggaattagttgcataataatagacgattatattgtttgtctcactgtcttcccacttttcatgtgggcagcatctcattttttttttttttttgtatcctttgctggtgtgcaaaatagattgatacattagttttaaaaaaggaaaaaaataaaatgatgtattttgaaggtttttacgaacttttttgcacgtttgaacttgtcattttactttttattaatatgaacaaataagccttacaataattaaactttagcactaacatccctaaagtttatgctaccactggccgggtgcaggggctcacacctataattccagcactttgggaggctgagatgggtggatcatgaggtcaagagatggagatcatcctggccaacatgctgaaactcagtatctattaaaaatacaaaaattagccaggagtggtgatgtgcgcctgtagtcccagctacacaggaggctggggcaggagaatcgcttgaacccgggaggcagaggtgcagtgagccgagatcatgccactgtactccagcctgggtgacagagcaagactccatctcaaaaaaaaaaaaaaaaaaaagtttatgctaccaccgatttcctaattcttatgatatacatcatcaatttatgaatttgcctacagcatatttttgctattaaaaagtaatatttaagagtttatttttaaagctgacttacctccagtagatttgattatcttatgcgactagtatttacctacaaactacattttctattcttatactagagtaaaataagagatcatcttcaaaataaaactttagaaatgcagtgacattcaaaattataggtaatataatattaaattgtgttagaattattaacagttaatattgctgattttccccaaagcccaacaatactgaagatcatcatgaaaatactaattttcataattcttccataagtgtatctagtcattcaaaaataaatacacatacatttcagaattttaaagctgcagaataataatggacaa

SEQ ID NO: 8515 - DNA, 782 bp, artificial
  synthetic oligonucleotide
cagaataattctttcatacatcataattaaagtaacttagttcttgaaatgctttaccattaatattgtataatttcataatacaaccacactgatctagacacttatttgttgtaggaaacttaagattggtcttttaagtgctagagctctaattttgatgaacgttatatcttgaatgtactacgtaactcccacctatgttaaacccgacagttgaaccctttcttcgtaactcagtatctttagtttttaactttgccaattgtaatatgttgtgtttgttatctaagtgaaggtatagatagtggacctgaatgggtattgagcccggaaatagtcttagaaagtgctatattgaaaaagttgctggtgtcatttgctttttcttccataattgtgaattgaaatatatacaacttcttggctttgtgggcagggtgacatgctcagtgaatcaaaggcagcctttttccaagtgtttttctgttctccaaaggccactgctggtatttgtgttctttacttgtatccaaatactttctggtgcatagtaggcgttcagcaaatgttaattaccccttttccattgctattatattagaccacaggtgttattttgtcagcacattcatcttcagagtatttgacttttagagctgtgttacaggtcactcctttctcttagtattcttaatatttagttttcaagaaaacaccagatgctatgcatcattttaaatggcactttgatgtgggcaacagcgaaaaatggaagaacc

SEQ ID NO: 8516 - DNA, 1343 bp, artificial
  synthetic oligonucleotide
ccattggattatattatatttggcatcttttaatttctgggttttaaacggtctttataaacagtttaccacatcattcctgtatttaagatggttttttaaaagtattttatcagcatttttagttgtttttagaaagaaggctgatgaggattcctgttctgccataccgctgttatggacagtccagctattttatgtttttgacatgaacattttttgcctgtagctccccatatatactgcaccaccgctccagtctaaatatgttgaagagcagcctggtcatttacaaatgggctttgcttccatccgcactgcaactggttgttacattggctggtgcaaggtaagtcaattctgatagtggtttaatatcagagatttctgattaattgttccagttacctactgatgtgtagaaaactaatccaaaacttaatggcttaaaaccacaaccattatattacatcttatgattttgtaagtcatgaatttgatctgagttcagacaggtgatttgtctgttgcatgtggcattgacagaggtggcccagtggggttcatctggcaaatgagctgatctagacagtccaagacagctttatttgcatctctggcaccttgttaaggatggctggatgactgggttcagctgggattattgactagaacacctacacgtggcctctcaagcatggtgatctcaaataggtcagatataacttacttgggtaattcagggctcctaaagacaatgttacaagtggccctaggcagaatttgccaggctttttgcctatcatcagatatccaagaaagtcacttctacagcattctattgttaagtcactaaggccagctcagttttaaagggaagggaattagatgccaactctcagtagaagtagcagcaaataatttgtggctatattgaacctactctaccactactgcatagattaaagtagttcagcaaggatttatgtcacctagcatgtacacagtgtcactcactttttatgtgaagttctgagattacttctgaatattttcttctttggctaagtaaagtgttatttacttgttggcgttagctcataagaccattctaactacagtaagctattgggcaaagtagaatacacgtgactttaatgcttagccttcaatcagcaatatccatcagcagagtggtggagtaagctgatgcaacactaatgtttcattatcatcacataaacatcattgtgttagcatctccagtgtcagtatcttaatgttggtaccagtgttttcatcattctaacctagtaaccatgcgacttttccccaaatatagc

SEQ ID NO: 8517 - DNA, 695 bp, artificial
  synthetic oligonucleotide
agaatacttttgttaaattggacatgacagctaaggggctattggcttgagatccttaagggcattttagcttccatcttgattggtataattacctaaaaagtaatttaacagagggtgatggcttaccaggagagcaaagaaagcattacggtataagaacatcaagtctctggtggtatatatttggagtttaataatatatttgcattttataggttccaagtttaagaaaattacttatcctctgggactggccactttaggagcaactgtttgctacccagttcagtccgtaataattgctaaggtaagttctttttaaataatagcaacatttcagtatttgtttaaactctcaatgtgacaatatttaaatgttacacagcacctgcaacatttaattttaagagacatagttggtatcaactcttatgttggccaaatcacattagcatctcagtatggtaaatgccattgttaataagatgaatttgtgtaaatataattcaacaatgtaaaggcagatttgaggattacgttcagagacactgaattagaatttatggggagaaatactgctccattgttgagatatataaacttcaatttttatttaaaagaagattaaaatgctagcagctgtttggttcagcagattaacctgacataagaaacaaccagttgatagattg

SEQ ID NO: 8518 - DNA, 921 bp, artificial
  synthetic oligonucleotide
caagtaatattttacaaattcaaatatatgatttttttttaacctgagatccatgatggactttagagagtctatagcacaccctcctatccaaaactttatgaaaagtcacgtatgtacaagaaaaaccttcttatttgacataatcaggaccagtagttaacaattaatcaaaaatgttaaagcagcgagttgtaaaaatatatataaaaatgtatacccacaattttacttgaaattaaaacataaatgtctttcttcggcatgaccaatgtgttgaaaccccgtctctagtaaaaatacaaaaattagccaggcctggtggcaggcgcctgcaattccatctactcaggaggctgaggcacgagaatcacatgaacccaggtggcggagattgcagtgagccgagattgcaccactgcactccagcctgggtgacagagtgagacgccatctctaaaaaaaaaaaaaaaaaaaaaaaaaaatctttcctttttctctattttgaagtagggcttttctttgagtattggtctcctggttaaagatctataacatctttccaacagtaagccatatctgtagtatgtcttctacaatttccagattaggttcttttaaaatagaatgaacagttaaaaacattaaaaaaaattgagtgcagaatccttttagatgtttatttctcccagctgttataattgtcttgctcacctctaatttcatagcagttatttttttagccattcacatttgagtctttacgaagcatttaacttaattttcctagaaacaataattctttttaaactcatattttatcatattaagttacatttagactgtttaattataagtaaaactgatgcagcaacttggggaaaaaaggaacttaataagcatactaatcaacttgtgaaa

SEQ ID NO: 8519 - DNA, 903 bp, artificial
  synthetic oligonucleotide
actatgtttttacctaaaaactgtgttatattttctgatgttgccttttcactccttttagcaatatgtttatgtagtagaatcagtgtgtcatattttacattaggaaaaaaatacgctctacaaagggcaaacagcttccttttggattctatgtacctaatctcatcaaagaagcttccccttcttgcctatcacctccatccccaaacatactcggatactcagagacctgggattcagacaatctgaactctgactccatggaatctcttctttgtgtttaggctggaggaaggttaaaatagttttccttttcttggaattgcagtttctgtgcatgtttataggtcctgtgacttgactcgtaagaaaggttcctactgagtttcagactttagaaaactttttctcagttcagatcagggaggagacactgcagctatatcctgggcaaaatgactctccacagttttcttgaaattatcaaaacatcattaagagttggggctgtctgggtgcagtggcatatgcctgtaatcccagctactcaggaggctgagacggctgggtctcttgagctcagaagttcaagaccagcctgggcaacacagtgagacccagtctcttcaaaatataaaataataaaaataaaagagccaagtgtggtggtgcacaactataatcccaggtacttggggggctgaagtgggaggattacttgagtctgggaggtagatgctgcatgagccgtgattgcaccattgcaatccagcctgggtgacagagctaggccctgtctcaaaaaaaaataaaataaataaaataaaataaaaaagagagcaagagatgtggctgagctgcctgctacccttagtggcctactagtagagtgactattta

SEQ ID NO: 8520 - DNA, 295 bp, artificial
  synthetic oligonucleotide
aatttactaattatgcttatttttatgtctgtctttctcttgtatattgtaagctatttaaaaacatagatctttgttttaaccatgattacctatcaaataactggaatagtacttggcacatactaggtgcccaataaatcttgttgaatgagtgaaatattactgtataataggccatttttttgtgattcattcctaggctaaatgagaaatatactcttgtgaaagtccttttccaggaagaaatctatgagtatgaataagatatatttgaaaaatatactttggcctc

SEQ ID NO: 8521 - DNA, 6795 bp, artificial
  synthetic oligonucleotide
ttttcctacatttactaactgtatttcttgcaaaaagaactttctcttatcaaactagggctttcttgttgttctgaaagtttgtacaaaaaaagcagaataagatactgattttttttttcttttgactgctaattgtcagaataaggagtcaatgttctatttaccttaaatggtattcaatgaggtttcattctttgggagtagggggatccctctctatcggtatcattaatcaactcatgaatttttatatagtcaatgtgttttcatcattcaaagttactattattgtttgaagctcctatgtacttttttttttttttgtatttttaatagagacggggtttcaccgtgttagccaggatggtctcgatctcctgacctcgtgatccgcccgcctcggcctcccaaagtgctgggattacaggcgtgagccaccgcacctggcctcctgtgtacttttgacattagactttgatggtacccctgctctctgacacaatatgtcacaatctcatcttatttgtttttttttatctcaaacttggaattagctattccccccaaggagtcctggtaccttttacgtgggatagtatttacggactttttgagtgtcattttgtattttttattagactattttaaaggaaaaattgtactcccaatgttcatttaaattatggtagttttattataatgttacttaaatatgaacaacagtagagccatatatatatgaatgctttatttgggtacacatggacataaagatggatacagacactgaggactactggagaggagagagaaggagggcgggcaagtgctaaaaaactacctgttgggtactatgttcactacctgagtgatgggatcattcatacaccaaacttcagcatcactcaatatacccagttaacaagcctccacatgtatctcctgaatgtaaaacaaaagttgaaattttaaaataaaatagaaaaaaatgaatgctttgggcttatgatgcctatataattataaatacaatactattttccaaaatagcataaacagccagctctaacagttttttttcccatttattagtcagtttcttcctttaaataagtattggccaaatatctaaaggacatatgttgaatggtctccccattgttccctagccaggattaccaaaactctctttttgtacttgtctgggtgttatcctagacttctagtggaaactgatagcaatgtttaagcaggggagtaagataatcagttttgtttgttttgttatgcaagtgaattcagtgatgatgtagactctacactgtaaaagatatcaagtggagcagagaaataagtcaggagactattactactgtcccattggtgagggcctcaactgaagtgaaaatggaatggggagaatcgatttgatatatttttctgattttgtcatttttgatttgggaatttggtgagtaaatggacacagaggaactagttagcaaggggttgcaataatccagttaagaaggcatgtgaacctgaacaaggtaatgatgttaggtaaaagggggattaattccacggatattaaagaggaagaattctcaggatattttcattgactagatgtttggagaaagagggaagagcaggatggccttcaggttttaaaaattatctcccacagtgtaccattcacaaaggtgattgatgtaaaaaccccacatctttctcagctttcttctttgagtgtcctgttggaattgccatgggacaagaccataagtagtatttgccagactatccaacatagaaaaatgtcatgtatgaggacacactcataaaaatatctttcttcttctagaatggaaaataaaagcttaagtaaatgaaacctacagaggtgggcaaactatggcccacaagccaaatctggactgctgcctgttattctatggcctatgactaagagtgatttttacatttttaattgttgaaaaaattcaaagaagaataatttttcactgcgcattaagatgaaataaaattcaaatgtcagcgttcataaataaagttctactggaacacagccatgctcacttatctctccctggaactcaaaagtaaggaaaacaaatattttaccatcattacacatgcacatacacacacacatcacatgcgcgcacacgagcatgctccttctctgtgcccactgtgtacgggctttgcagaaattgcatttcttgcagagaaactttgaacctcacaatggaaggtaatttaccaatctcttatctatctatttatcatacttcacgttttagtaataactgaatttcacccttttcaagcttggaaattatatctcctcattctgctgaacgtgtctatggccactttggggctacaatggcagagcagagtagttgtgacagagacgctatagccctcaaaaaatattttgcttactactatttatttacaaaaataaaatatttactatccggcccttcatagggaaagtttgccgactcctggtctactatgagccaggtactgtgctaggactttcacatcttctataattctatcaaaaactttagtggtatattaggttatagagacctgaagaatgtatctagaatctagaataataacatgctttatttgtaaatattcaaatgatttgcaaagataaagagttactttctttaggatcctatcctttccctgcttaaacactgttattgattccaaatgcttatagaattaaagctaaaataggcaaaacataagactctttgcttacgcaatctagtccccacctacctttcatcacatctcatcactcttttccccatccctcacccaatgaatttctcactgtcctcccactttttgcagacagaagctgaaagtgacacattcatgagatatttagtgtccacttcattgaggtcccttgttcaccttttcctttctatacctttcttcactctccttcactttcttcatcgaattgtctaccattacaaaatagaaaagaaatgaagggagggaggaagggaaactgcaacacacacaggttttattggggtgaggcatacctcttattactctggtcagtctaatttgtcaaatcctcgagggtagggccgatacattttttttttaacgtcgtccaacatctattagaggttcagtcattgattatcctcctccctttcttcgtttcccttgggaaacctggaaaacagaaaatcttcccacagaaactcctcaggggcgcgccgagatctgggcttgcgcacttggacttggccggcgctcagcccccgcctcaagccggcggggtctcgcactaacctagcgcgggcgcctcgatctcccgcgcgcgcgcgtgcgcgagacccccctttggccccctaccctgcagcaagggtagcgtgacgtaatgcaacctcagcatgtcagcagcaatataaaggagaatgaggcggcgcgcctcccagacgcagagtagattgtgattggctcgggctgcggaacctcggaaacccgaatgtgaggaccttaagggatccacagctgccgccccccgcagccatccagagcgcggtcacagtccgactggcggcacggaggcggcggcggcggcggcggcggcagcggcggcggcagcggcggcggcagctgtagctgcagcagcaggtaaggagactcctgacgagaaactagagggacgtggatccaccgcgttcagtgtttcttgtctgaggggaggagaggctcacacccagcgtgtagcgtagggcgaagggaacaatggaagtggcgtccagtccctgagctttcctcccgcctcgggcggagttttcctcttcagccgcagccgggggctggaggaattgagggaagtaagggttttcccccttagccaacctcctctttccctaggccagagccccagggagctagagccgtcgttgagaccgtcggtggtttagggtgacggtaaaatggcggaaaacaaaacggtgaagtgaagaatgcagcgtccccctggcagtttctctcagctctccctccaccccatattcttttcactggcgccccagtcgcctcgcccccgccccctgaccgagctaatagtaacctttggaatgcgcgagggatggcggcgtgtgcgaggaagtggcaccgaatcggcattttaggggattgggagccgtcagagcctgggagttggggggagggggggggcgtgtgcgacaactgtcgcctacactaaaacaccaccattttggttcccaaccgtctcccacgtagcggggcagaggaagctggaggaggctgaggggctgggcagcacggcgtgggtagcagcggtggcgaccgctgcaccaagtgagaggagggaggaggggaaagggtattcttgtctcatcggtctcttcctttctgctgcgaaggttctcttgttaggtttaagatctagtcagatgggtaatacctcagagggcacgtgtgtgcattctgctcgaaatgattgaaacttggcatggtcgtgggaaaaggagacttatgcgggaagagggctgcgtccaaagctgcaatactgctacttgccagggctcctttgtctcccatctctgcaaatactactttcgcattctcttgttctgccgccttaccatttctcatctatccgtcaccctattgacatcactaagaagctaggtcctgaatgagctatgttagaagagacagattttctttttgtgatttctactccccatgcattaatggaaagatgtttacttgagacgtacttggtgggttatctccattcaataaggatgtgagatacacttagagaagaccaagaagcctagctatctctaatggttattaaatacttaacacactgctgttttcatacctcatttattattgattttattgaaacttcctatgtggggaaagatactccggtttatttatttggtattcacacagtgtaatacttttataatagttgcactatgtgttgtaatttttacacttcattgagtgctagtgcagacttttcagtatggatttggcaaggataaagcttgcccttgattctctttcactttctaaaataaggtgttgtttgtgatttttaagatgtgctttagagaagattttggtttaatcaagtggtagcattctaagtataataacgttgctaatgtagtgagtagttgtttttgttggaatccgttgggttgcttttaacattactacagatttgagcatatgaacccttcccagcctcactatgcaagttcaggtgtaaagaaaaatattaagttgtgtaagaaacttagtttaaaatattttaaagtatctgattttgaatgtatttttataataggtaaagagagcgttttcccaaagaaaataacatagcacagaaggaaaaataaaaagaaattgctgcagattttactttatgtgagaaaatctacaatttcttcgagacactcatataaaggtgactaacaaattacttattgttttatcttatttaacagttaaataaaattaagtttttaaaaacattttcagacatttgtagttgttctattagttatgtggtaaagaaagtaattactctaattaaaatccaaatagtacactgttttaaatgttaagaacatgtccctttcagatttattttgttaacacacaggtagtttattgtgaactctcttggccttggacctcattttgcataatagcaaagcagaaaacaatggcatttgaaaaaagatacacaactaagaatttctaaaattgtgaagtttgctcatacataaagtaattctgtctgaatcgtttgttatacagaaatgtcacctacttctgtagcatatttatgtatatacctgaaatggtgataggggttcctctgagactctcctgcctcctgaataccaatttagccatcctcctttatttaagaatatattaagttgtattacgtgtcacctttctgaaactttcattaaggttgcagctttatctgttgtgcaatatggtacaatttattaagcagtcctacgtgaaaaggagataagtgccttataaaattgacaggtttttgttgatttacttagaatcttatgtttgaagagaaaatgcacatatatgtgtctaagaaatacattgagtgacagcatctgactttatgttccatactatcaaatggtcgtaaatataggataagtcatttgaaatgaaatagattgagcccttgctttcaaaaccaccttgaagctagcataattttattaatcactaataaaaagtcagttgtacaattacaagtaaatgaaatgctgagataaataatttgctaaatgtttgtatgtgatcgatcttatttttaccatatttaggaagcagtcatgtttcatgagtcctcaaaactgagacaagagaatgtagtagagtgaggccagaagtccttactggttcaaagaactccggggaaactgggatagaacattttacattataagtagaaccctgggagccagaggtgaatacaagtttatctgcagagctccgctgcagggctgatctgggtctggaagaaatggatgagagccagtggatgaaattcactaatactagacatctgagtcctctagtaatgtataaatatcctaactattgtttgttgtcatctcgttcttcttttataacctatgttttaactggaacttttagcac

SEQ ID NO: 8522 - DNA, 958 bp, artificial
  synthetic oligonucleotide
aaccaagtccccactagcattattctacccttctttccttccctatggtctactttcaagaaccagactaatcttcagcagtgttctaaaataaatggaatttcccatattttaaatctttggtttgtgaaaagatttttgtgaattagtaattttattgtttagatatatagaattccagtacagttaattttacaggattaatattttaattttttccttgctaaaaaaccacatttctagtctgattaaatgctaaatttgaacccccacctcctccccatttctgaaatgcccagtggagtaacaactgaattaaaaatacttgttttatacatactcccttcgtgtaccagacttccaggattgtggctgtgtccttttggggtaatttagtggtttgggtgagagtttgagcggtgagaaggatttaaaagggttgaaagtaaagtatcccaaaaacgctgttgaaagctcagctttcccttttcaccttgttctttgatgtgttagtgtccattggtctccatcctaacttggtaactaacttccataatgaattgattaaaaataatgaacactatgtgacaaataacactctttcaggtactactttatagaaagtgatcaaaaggttttgtactggatgatttcttgtagataatttattataaccagatccacaagccctcttaatttgtttttgtaccacctcagggagcagaacttagcagaattcctcatgaagggattttacacttgtacaatatttacagggcaggtaggagttggtgtttaccatgccgctcaagaaaaacattaaagctttattcctacagatttactattatcaaaccaaatattagtctaagatgagtacagagtttttccccctaaatcaggtgttgaaagatgccttccaattttggatacagtaattattataagttaaagaagt

SEQ ID NO: 8523 - DNA, 1732 bp, artificial
  synthetic oligonucleotide
tgctttatggaacaagtgagttatggaacttagaaatctaagtttgaaagcaaagaaattctaatttaaagaagaaacttgcttcaactggaggttgaactatgttaaagtagtccacataaggaagttttctgcttttgttttgtttttaatgagagtgatgcttgttagctccaacataaacattcacatgatgataatttcctgacaaaaatatacagctaagctaaaaatccttctgcatatttcctacttggactttcacacaaaccatgtaaatacttcacatattttatttagacacataaacagattactttgcatgtcattgcgcagtctccattttatgtgacaaatctaaagtgaaaacatactggaatagaaattagataaataggcactcctcacctgacaactttgaagttttcagagataagcagtgtgaaacttatgagagggaaatatatcactactacctctattgatcttaatcacaaattggaaaagaaatacatatatttaaatagtcatttaaatatatagaacagctctttatatcatcacattttgtattacaatttaaaaaattgttaagtatgataaggacgttgttatgaccccaattcactatccatggatcaagtgagccaataaagtgctggcttcttactttttaaaatctttgtggatatataataggtgtatatatttatgagatacatgagatattttgatacaggcatgcaatgtgaaataatcacatcatggagaattgggtatccatccactcaagtatttatttgtgttacaaacaatccaattatactcttagttatttgtacaattaagctattattgactatactcacccggttgtgctatcaaatactaggtcttatttatactttctaactacatagtttttgtacacattaagcatccccagttcccctcgcacaccccttttcccagccactagtaaccatccttctactctctatatccatgagttcaattgttttgacttttagatcccgcaaataattgagaacatgcaatgtttgtctgtttctggcttatgtcacttaatatagtgacctctagttccatccatgactccttaactgcccctgaatttttgacactattatttttaagtattttggaaaactcacacctgttctcatttttaaaccttaataataacaatttcctactaagctaataaaacttccccttatattatttgtaatgtgtgcataacatagtacacttttgttacagttacatatatgaatagttagcagaggagaaactcctccgttgttcctacaccaagggaaaaaatgtaaggactgtatagctcatgaataatattaacatttttctatcacaaaatattgataaaattggaattgtatcaattcatgttatggagcttaacattttagccgaaatattaagataatataaataaggcttttagcttcatatcaagacctatttgaacacttctagaaaagaacattaaaagttttttcctcatttatggtttgatttagtgtagtgcctcaactgttcttaatggtgtcttagtataatgcataattattagaatataattataaggcattacagaattttatgtggatacttgcaaagatatttcagtccaaaacttcaaattacacacccaaatatgtttgttgccttaatctatacttggacaaag

SEQ ID NO: 8524 - DNA, 1730 bp, artificial
  synthetic oligonucleotide
ttattttaatccattttttctctctcacattttttctctctcatgtatacagctgctctgtatgcatgaaaaatacctcgaacttcatgaaaaccttaattagtggaaggaaagaatgttagcccaatgagtaattcatatcaatgttgctcatttaaggcatttcattttgagttaatgatggtaggttaacagctaagctttgtaaaagattgaactaagaatttttgttttactttaagcttctagaactctatttatttgcaagaccacattcagttctaaaatgcatctgagaccttgattatatctgtgtttgactatacgtgttcatgcagataaacccagtaattttaattctaccattaatttagaaaatttcaccagcaactggtttctacacttaattttctctgagaaacactctatcaatcaaacaaaataataaccaaaaaacataaaatatatgtttaattaaagaaacaaagtaacattatatatctagataaatttaaaatatgtttatatccataaacaccattttagtgcacaagaggttaagagaataaaagcatgtactcaaaagctagaaatggaaaataaagtgctacagaaaacatttgattaaatcgaaaatgcctactacatgacctaaaattatgattcaggaagcaaagcagagtagcatcaattttggtttctcaaaggcaacatattttactactggtaatatttattttaaaatctcattaattccctgaatgtcttccaaaaaccaaaaggcaaaaaacaaaacaaaacaaaacaaaaacaaagacaaagtaaaagtttaactgaattcatgatgatcaaccattgattgtaaaatcaatttttcttgctgccatggtcacaaactctggtattaggctaattgctacacatcaactcatctgaaacgtggtttattaaggatagactttattgaaacataaagtgaattaagggtttttgagtaatatgtactgcttgctcatgcctgtcatggtacattatacataccatcacattatactcatttcgttagcataaaggtaatttcagatcaaatctaggtcctactttacatgatgccacaatgccattccatcaataaacagggagaaaggaaaataaaatagaagagtttcctcatcatattctttgtgacagctatctaaaagctgtcttgccaagttctcttttagtggatttgtgaatgccctttgatatccaactcagtttgaaaatttatagtcaaatattctttcttcttgtttcactaaggaattaatacttctttttttccctttaccacatagcttaactttcacttttctcattttctaacagcacttacttttcttccttttcaataataaataacttcagacttcacagagccctccattctaatcttttatcccagtttctgcagctgcactttctagccctaagttgtttataaactcctgtgtggcgagctacattttaggaaggagatagtccatttttaaggatcactttggcaaatgccaggtaaaataaggaaaatcttgtaaaaagctcaaccaacttgatcctgagttattgaaaggggaagctgaaccaaggagtaaataataaaacatactcctaaaaattgtccggtagccaatatttataatttgtcaaatttcagcttttaaatatctatttatgtttcttttact

SEQ ID NO: 8525 - DNA, 1317 bp, artificial
  synthetic oligonucleotide
aatgaatggagatttaccaagaatgtattgacacacaagatacagttaaattacaagcaattttaaatggttgccttctattctctctagacccaataaaggaagaaagggaagaatccatagttcagttaaggtttatagtccttacctctccagattggatataggacatcttatatgaaaaacaatggtggagggattttttttttctgatagctgacagtttccaaggtgattgagccctttcatatccagttgggagagaaatagaacctccactagggatatatagcagccacagtagattcattagctattgccccaagttgtcataaagcgataaaaattgagcccttatatttacagggtcactgggggaagtcttgactattagtgacttttaatgagagtgcccaggcaataagaggcttggctgccagagtaaaattacttactaacgtcttaagccatatagctagaagtcaagcacaaagtttgatctcaaacttaacatcagtgcttaaattcaaacttctgtatttaaaacaagttgcgttagtgagctttatatctaaggaccataccttaaattaactcatggaagagtctgatgactaaataaggaaaatgacattatgaagtaacatttacttcaggaagcacagggcccataaaagaagtctcagggataccttactaagatgtaattcaaaactgttagttgccttctcatatcaagcaaaccacggaacacatgagagaccggtggagattcaactttcttatcttattccactcttaagggaagtatttaatttgtatatcccggatccaataattggagatatggtccaagagaatgggaaggaaatcaacattctttgaaggacttactgtgtgttaaactagcccttttctagccaggaaaaatatattaccactttttaaaatctgcatgaatcctgttttcacatgatcctgaattatttctcataataaccttaaattgatctctctacttctaagttctaaattcatttcttcttcactcttacccccttaccctcattcttaccaaccatccattgtaccaaaaccaaattaatcttctgaaacactgtgtttcgttggctaggcctctattccaaacattttagtgtctcaccaatcttttgtgtaattaagtctgaccttcttagcattaatttcaagtactttgtactttgaaatctatctccatctttacccccatatacccactttacctcaaagtgaggtagttggccttctccacatgcacccatacccattgaacct

SEQ ID NO: 8526 - DNA, 1249 bp, artificial
  synthetic oligonucleotide
acttttaaacaataagaactaagacctttccaataccatcttccacctccacctcctccaaccccaaaaccacagtctatcttaggttgattgtaaggtgtttgtgttgggttagctagtggttacaagcaaaggctggggaagcaagcaaagaggtgcaggttttgaacaaattgtccttcaattgaactgaaactgtgataggttaaacccatcttaaatcactgtagcacaactaagcgtgtgtgaggaggggtggggattagcagagaattagagtatcccctgatatacataattcaggctaggtgtggctagctttagattcaaaccagattaatgaatgaatgacaagttccaatagttcttgttacttatgataatgccctttcctcaaaaaaaaaacagaggaattttaaactttatgatagtgtcaaaatgatacatcatcagtagaaacaatacttcaagtactcatacaaccattctggttttcactttcagtacgttattcaataaattacataagatattcaacactttgtaataaaatagactgcattagatgattttgtctagttgtaggctaatgtaagtgttctgagcatgtttaaggtatgtttggctaagctatcatgttcagtaggttaagtgtattaaaagcattttcaacttagtatattttcaacttacaatgagtttattgtgacgtaaccccacagtgagtccaagagcatctgtacaatactactgaatatagtagctcctggcctcacttgcttgccttatacaaggtaataggaacagctaagagctgttaccctacgaatctcccagaggacaatttgtgattatgggtataattaaaggacattcatttcagccaactatatcactttggtaaagtttatggggaaaattcaaaatagttttattaagtttaaaatgaaaccacagcattactaactcctgttggagttaacttgtgttggaattattaactttattgttttaattgtcttctttatctctacaacttcttataaatatatacttgcttacttctcaggttgcagtgtagggtggaagagaatggatttggaagcactttgaactctcaggaggaaaagtgcttaatgaatataaaacattgttatgtatttattatctcatttttatctgtcaggaaactttgcttgtgaatggaattaatcttggaggaagactacattaacatctgaggctatag

SEQ ID NO: 8527 - DNA, 18908 bp, artificial
  synthetic oligonucleotide
aaataaattgagaagttgttcaagaccagatatttccagaagatggcagtataaggaaggtctgaattcaaagggaattgaaaattagatttaaaaatgcaatgtttcatttcataagtctagttttaagacagaaccatgcaactaaaacttgtataaaaacaacaggcactgatgtgacaaattaacataggtcaccactgtgagatttagtaggcaatggctatatggcattttaaaagaaatagtgatacaaaatacaccctgtaaactttgttgtaaacacttctaagaagtcaatagtgtgtggttaaattaacagtaagatgatttaaattttcagaggaaggctctaaagttattatatgtgagtagacatgcacagagttcataatgacatccaactttttttctttgaagtatttctaaaaataattccagttgtattttagattcagaggatacatgtgcaggtttgcgacattggtatattgtgtaatgctgaggtttgggatacgaatgattccatcacccagagagtgagcacagacccaacagttaatttttttacccttgcccccttctttatttccccctctattagttcctagtgtgtactgttgccatcgttatgtccatgagtaactaacatttagctcccacttataaatgggaacatgtggtatttagatttcttttccactgttaattagctcaggataatggccttcaggtgcatccatgttgctgcaaaggacatggttttgttctttttatggctgcatagtattccatggtgtatatgtaccacattttctttactcaatccagtgttgatgggcccctaggttaattccatgtatttgctattgtgaatagtgctgaaatgaacatacaagtttatgtgtctttttggtagaatgatttattttcctttgggcatatatatagtaacaggattgttgggtcaaaggtagttctgctataagttctttgagaaatttctaaactgctttccacagtggctgaactaattcacattccaaccaacagtgcataagcattccattatctttgcaaccccaccaacatctttttttgtctttttcttttactatttaatagaagccatactgacaggtgtgagatggtatttcattgtggctttgatttgcatttctctgatgattagcaatgttaaagcattgttttcatgtggtttttggccacttgtgtgtgttcttcagagaagtgtctattcatgtattttgcccatttttaatggggttattggggttttttgattgtcgaattgtttaagttccttatagattctggatattagacctttgtcagatgcatagtttaaatatattttctcccattatgtaggttgtttctgtttattctgttgattgtttcttttgtggtgagaagctctttagtttaattaggtctcacttgccaatttttgtttttcttgcaattgcttttgagtatttagttataaattctttcccaaggccaatgtccagaacggtgtctcctagattttcatatagaattgttatagtttgaggtcttagatttaaatcattaatccatattgagttaatttttgtatatggtgaaagataaggatccagttttattcttctgcatatgactagctagctatcccagcaccatttattaaatggagagtcctttccccatggcttactttttcccaactttgtctacgatcatgtggctataggtgttcagctttatttctgggttctctattctgtttcattggtctatttgtctgtttttatagcaggatcatgctgagttggttactgtggccttatagtatagtttgaagtcatgtaatgggatgcctctggctttgttctttttgctgggaattgctttggatttcaggctcttttttggttccatatgaattataaaccaggttttcctgattctgtgaaaatgatgttggtggtttgataaaaatagcattaaatctgtagcttgctttgggcaatgttgttattttaatgatattgattcttcatatccatgatcgtggaatgcttttctatttgtgccatctataattttcttcagcagttttctttggttcagcttgtacagtcctttcaattccttgggtagatgtattcctaggcttttttttttttgtggctactgtaaatgggattgctttcattgttatcgatttcagtctcagcttgaatgttgttggtgtataaaaatactactgatttttgtacattgattttgtgttccaaaattttacagaggtcgtttatcttttccatcagttccaggagtcttctggcagtcattagtgttttctaggcatagaatgagatcttcggtgaagagatattagatttcttcttctttttttttttccagttaggatgctttcattttttcttttcagatgccagtaggctttcaccatattaacatttattgcttttttctgtgattattatatatggttggtttgttcttttctttctttttttaacttctaaatttagatgtcagagttacatgtgcaggtttgttacgtaggtaaacatgtgtcgtgagattttttggtacagattattacatcacccaggtattatgactagtacccattagttatttttcctgatcctctctctcctcccaccttccaccctctgataggacccactgtgtgttgttgccctctatgtgttctcatcatttagctcccacttataagtgagaacatgcagtatttggttttctgttgctgcggtagtttgtggaagataatggcctccagcttcatccatgttcctgaaaaggaaatgatttcattcttttttatatctgcataatatcccatggtgtatatatgccacaatttctttatccagtctatcactggtggacatttaagttgattccatgtctttgttattgtgaatagttctgcaatgagcatatgcaagcatgtgttttcataatagaacaacttatattcctttggatatatacccagtaattagattgctgggttgaatggtatttctgcctctaaggtctttgaggaatcaccacactgtattttacaatggctgtactaatttacactcccaccaacagtgtataagtgttcctttttctccacaaccttacgggcagctgttattttttgactttttaataatagtcattctgactgatgtgagatggtatctcattatggttttgacttgcatttctctaatgatgagtgatgttgagctttttttcatatgcttgtttgcctcatgtatgtcttcttttgagaagtgtctgttcatatcatttgcccactttttaaaggggtggtttgtttttctcttgtaaatgtggttaagtcccttatcgataatggatattagacctctctcagatgcatagtttgaaaaacttttttcccattctgtaggttgtctgtttactctgttgagagtttcttttgccatgcagaagcttgttagctttaactatattccatttttcaatgtttgcttttgttgcatttgcttttggcatcttcatcatgaaataattgcctgtgcctgcatcctgaatggtattgtctagattgttttcagaatttttatagtttgggatttatatttaagtcattaatacattttgagttaatttttgtatatggtgtaaggaaggggtccaggttcaaccttctgcacatggctagtcagttattccagcaccacttattgaatagggaatgttttccccattgcttgtttttgtaacgtttgttgaagatcagattcttgtaggtgtgtggtcttatttttggtttctctatactgctccattggtctatgtgtctgttcttgtaccagtatcatgttgttttggttactgtggccctgtagtatagtttgaagtcaggtagagtgatgcttccagttttgttctttttacttaggattgccttggatatttgggctcttttttggtttcatgtaaattttaaaatagtttttctagttgtgtgaagaatgtcaatggcagtttaatagaaatagcattgaatctataaattaatttgggctgtatgaccattttcattatattgattcttcatatccatgagcatggaatgtttttccatttgtttgtgtcatctctgatttctttgagcagtggtttgtagttccccttgtagagatctttcacctcccttgttagctgcattcctaagtattttattctttctgtgtcagttgtgaatgggaattcatttctaattttgagctcagcttggctgtttttggtgtataggaatgctagcaatttatgcacattgattttgtgtcctgagactttactgaagttgcttattagcttaagaagattttgggctcagatgatgggattttctagatagagaatcatgttgtctacaaatagggatagtttgaattcctctctttctatttggatgccttttatttctttctcttgcctgattgccctgacgagaacttccaatactatgttgaataggaatggtgagagagggcatccctgtcttgtgccagttttcaaagggaatgcttccaccttctgaccattcagtataatgtgggctgtgggtttgtcatacatgactcttattattttgaggtatggtctttcaatacctagtttattgggaatttttaacttaaaggaatgctgaactttttagaaagccttttctgcatctattgagataatcacatggtttttgtctttagttctgtttatgtgatgaatcacatttattgatttgtgtatgttgaatgaaccttgcatctcaagaatgaagcctactttatcatggtggataagctttttgatgtgtggctggattccatttgccagtattttgttgaggatttttgcatcaatgttcatcaatgatattggcttggagattttcttttctgttgtatctctgccaggttagggaggagtccctgcttttcaattttttggaatagtttcagtaagaatggtgccgtctcttctctctacgtatggtagaattcagctgtgactctgtctggtcctaggcttttgttcattggtaagctatttatcaccgcataaatttcagaactggtctggtcagggattcaattttttcctggttcagtcttggaagggtatatttgtccaggtttatcaatatcttgtagattttctagtttatgtgcatagaagtgtttataatattctctcatgattgtattttttgtgtgtcagtggtaatatctgttttatcatttctgattgtgcttatttgaatcttctctcttttttattagcctaactacagtctatctattttataaattttctcaaaatgccagctcctggatttcttcaaattttcaatagttttttgtgtgggtctctacctccttcagttcagctctaattttggttatttcttgtgttctgctagctttggtgtttgttttgtcttggttctctagttctttttgttgtcacattaggctgttaacttgaaatctttctaacattttctgctagctttgaaatcaggtttttgtttgttgttgttcctctaggtgggatgttagatggttgacggttaatttgagacttatccaacttctttaggtaggcttttacactataaactttcaccttaacatgcttttgctgactttcagagattttggtatgttgtgtctctgttttcatttattttaaagatttttttatttctgccttaattttattgtttacccaaaagtcattcagcagcaagttgcttaatttctatgtaattgtggggttttgagagatatttttgcaactgaattctatttttattccactgcagactgagaatatggttggtatgatttaatatatttttttaattttttggacttcctttatggctgagcatgtggttgatcttggagtatgttctgtgtgcagatgggaaaaatgtatattctgtggttgatgggtggtgtattctgtagctgtctattatgtccaattggtcaagtgtcatagttttgtccagaaatttttggtagttttctgcctcagcaatctgtgctaccctatcagtggagtgttgaagcccccactattattgttttgccgtcttgattgtctgagtgttttgtaggtgtagaagtacttgttttatgaatctgggtgaccaaatgttggctgtatttataccttatcttatataagagtggaaactcttgcttctttttgtttttggtttgcatgatagatctttttccatctctttagtttgaccttatgggtgttgtaactcgtgagatgagtctcttgatgataatagacaaataagtcttgttttttgtccaatttacccctgtgtcttttaactgggtcatttagactctttacaatatgggttattactgatatgtgaggttttgatcctatcatgacattgctagatgattgcttcgggttcctattagtggttgctttatagggtctgtgggctaggtacataagtgtgcttttgtagtagcagggatctttctttcaattccatgttagaacccccttaagggtcttttgtaaggctggattaatggcaacaaattcccttagcgcttgcttgtctagagcaggttttctttatcctttgctcatgcagcttagtttggaaggatattaaattctgggttgaaatttcttctttttaagaatgcggaaaataggcccacaatctcttctagcttgtaagttttctgctgaatcatcctctgttcaccttatcagattccctttgtatgtgatctgacctttttctctagctgcctttaagattttgtctttggcattgaccttagacagtatactgactatatgtcttggtgataatagatttttataatatctcaaaggggttctctgtatttcttatatctggatgtctatcaccctggaaagattaggaaaatgttcttgaattatttcctcaaatatgttttccaatttgtttaccttttctccttctctttcaggaatgtaaataattcataggttttgtcactttacataatcccatattgcacaaagactttgtgcatgttttaaattcttttctcaggcagcccccactcctgctgacctcaggcttaggaggaagtgaggagcttagggacaatcatgggcctccagcacagtgtacctgccttttggaaaagtaatcagactattttccacatgggtccctgcctccactacttctcactgggtgggacctcctggcctgggagcccagacacctcgcccccacttgagctcttgagccagtataagctctgcatttccctgggacagagatcccagaggtagcaagcaggctaccactccatagcccccatccctgcttccattaggctcaggagggagcgaagagcttaggactactgtaggcctccagcacagtacagctgccctatggaaaagttgccagactgctttccatatgggttcctgccttttttattcctcactgggcatgacctctctacctgggcccccagcacaactgccttgtccccacctgaacatttctgttggtgggagctctgcatttctatgaaaatgaaataccagagacaacccatagcccctctgccattgcagccgcagcagtaccacctttactgctattggcctggggaagaaacaaagggtctggttgtttttctggcacatccagcatgccacaacctcccatggagagtatctccatttttcttctctgtaggtccccaccccctacacatcaacaggcagagctcctggttcagactcacagagcagctgccccactctcagctaaacattcctactggcagtggctctgtgtttccctgtagtggagcttccagaggcaactgacaacccctctgacactaccactgcagtggtactgcctttgctgtactcagactgaagaaggaacaaggagcctgagtgccttactcacacctccagcatgccacagaggtgagctcactcatcctctctgccctgtgagtccctgaccccctactcattatcaggcagggccccaggcttgggcccacagtgcagcttccccatcccccagctgaaaattctcattggcagcaactttgcatttctctttggtagagttcccagaagcaactgaaactcctctgcctctgccactgccactgcagtggtactgtccttgttgccctcagatttgggaaagaatagcctggtttctttattcacacctccaacatgctacagccaccctaaggaaaagaggccagtctgtctctttgtaagcctgccccctgctccctgctagtcaccaggcaaggtctcccccatcccccagcttgggccagcaatacagctgccccaccctgggatgatcattgtgattggccgtggctctgtatttctcttgggtagatcaccaagaaacaaataaaaggccatctgccattgtcattgccaaggtttctgcccctgctgctcccaagtgtgggtggtaacataaagcctgagcacaacctaaggctgcagtgtgcagctcaggagtgccaagccatgatctgcagccaacatttgagtgagagaagagcccacactctcagagtactgagagggagcacagctgtaattgtgaggaaatacagaggagcgacatggctcagcaagtctgcctggcagccattatgcttaagtgtcatctactggatcacaccccaaacttcaacaccaaaaatactttcttaatataacgccctgtgaagccaaggacaagaattaagccacaaataatgacctcacacaaagccaaagccctctgaaaacatccagaaataaagtcaattgattatactcaaattacaccacagttaaaggaaaatcagcccacatatatgagaaagcaccagtgcaaaaattctagaaaccgtaaacgccagagaatctccttacctcctaatgaccacactacctccccagcaatgtatcctaatgagaataaaatggctgaagtgaaagacagaattcagaatttaggtggcaaggaagattattgagatgcaggagaaagttgtaactcattctagggaatctagtaaaacaattcaagaaatgaaagctgaaatggccattttaagaaagaacaaatccaagctgatagagatgaatagttcactacgcggaagtattaacagctgaatagacaaggctgagaaaagaatctcagagcttgaggactggttctttgaattagtaagacaaaaataaatatttttaaaaaatgaacaaagcctctgtgaaatacgagattatgtaaagacagcatatatatgacttattggcatccctgaaagagaaatagagagagcaagccacttggaaaatattcttgagttatactgttcacaaaaatttccccaaccttgctagagaggtcgacatacaaattcaagaaattcaaagaactcctgtgagatactttgcaagatgaccatccccaagacacatagtcatcagattttccaaggtcaacatgaaataaaaaatattaaatattaaaggcagctagagagaaagggcaggtcgcatacaaagggaactccatcaggctaacagtagacatttcagcagaaaccctacaagccagaagagattaggagcatacattcagcatctttcaagaaaagaaatgccaaccaagaatttcatatccagccaaactaagtttcggaagccaggaagaaacagtatccttttcagacaagcaaatgctaagggaattcattaccaccaggcctgccttacaagaggtacttaagggattgctaaacatggaaacaaaagatcgttatctggcaccacagaaatacacttaagtacatagtatacccacactataaagcaaaagacacaacaaaaaaagaaaacttcaggccaggttgctggcaagatggctgaataggaacagctccggtgtgtagctcccagcgagactgatgcagaaggggagtgatttctgcatttccaactgaggtacccacttcatctcattgggactggttggacagtggatatagcccaaggaaggcgagccaaagcagggtggggcatcacctcacctgggaagcataaggggtcgaggaactccatctctgagccaagggaagccattagggactgtactgtgcaccccagcccagatactgtgatttacccacagtcttcacaacccacagaccaggagattccttctggtgcccacgacaccagggccctgggtttctagcacaaaactgggtggctgtttggacagacaccaagctagcagcaggagttttttgtccataacccagtggggtctggaatgccagcgaggcagaaccattcactcccctgaaaaggaggctgaaaccagggagccaagtagtctggctctgtgggtcccacctccacagagcccagcaagctaagatccactggcttgaaatccttgctgccagcacagcagcaatctgagctctacctgggatgctcgagcttggtggggtgaggggcgtccaccattgctgaggcttgagtaggcggtcttaccgccacagtgtaaacaaagccactgggaagttcaaactgggcggagcccaccccagctcagcaaggccactgcagccagactgtctcctctctgggcagggcatctctgaaaaaaaagcaacagccccagtcacttagagataaagcccccacctccttggaacagagcacctgggggaaggggcggttgtcggcgcagcttcagcagacttaaatgtccctacttggcaactctgaagagagcagcagatctaccagcacaccgttcacactttgataagggacatactgcctcctcaagtggatccctgacccccgtgtatcttgactgggagatacctcccagtaggggctgacagacaccttatacaagagagctggtctggcatctgacaggtgaccctctgggatgaagctcccagaggaagaaacaggcagcaatctttgttggtctgcagcctccgctggtgaaacccaagcaaacagggtgtggagcagacctccagcaaactccagcagacctgcagctgaggggcctgactgttagaaggaaaagtaacaaacagaaaggcatagtatcaacatcaacaaaaaggacgtccactcagagaccccatctgaaggtcactgacttcaaagaccaaaggtagataaatccacgaagatggggagaaaccagtgcaaaaaggctgaaaattccaaaacccagaaaacttcaggccagtattcctgatgaatatagttgcaaaaatcttcaacaaaatactagcaaactgaatccagcaacccattaaaaatctgatctactgttaagggaggagaccacccctcatattgtcttatgcccaatttctgcctccaaagaaagaaaaagtaaaaactaaaaggcagaaatgaaatccacaagcagacagcccggcgccacaccctgggcctgttagttaaagattgacccctgacctaatcggttatgttatctatagattacagacattgtatagaaaagcactgtgaaaatccctatcctgttttgttccgatctaattaccagtgcatgcagcccccagtcacgtatcccctgcttgctcaatggatcacgaccctgtcacccacacccccttagagttgtgagcccttaaaagggacagcaattgctcactcgggaagctcggctcttgagacaggagtcttgccgatgcccctggccaaataaaccccttccttctttaacttggtgtctgaggagttttgtctgcagcttgtcctgctacaccgtgattaagtagattttattcctgggatgcaaggttggttcaacatatacaaatcaataaatatgattcatcatatcaacagaattaaaaacaaaaactacatgatcttctcaatagacatagaaaaggctttttacaaaattcaacttcccttcatgttaaaaactctcgacaaattaggcatcaaaggtacgtacctcaaaataataagagccatatacaagaaatccacagccaacctcatactgaactggcaaaatctggaagtattgtccttgggaaccagaacaagacaaggatgcccactatcagcgttcttatttaactcttatttaacatagtactggaagtcctagccagagcaatcaggcaagaaaaagcaattaaagacattaaaatagggaagaaaggaagtcaaactatctctcttcacagacaatatggtactgtacctagaaaaccccacagtctttgctcaaaggcttctagatttgataaacaatttcagcaaagtttcaggatacaaaattgatgcacaaaaattagtagcattttatacaccaacaatgtccaagttgagtgctaaatcaagaatgcaatcctattcacaatagctacaaacacaaaaatacatagtaatacagctaaccacagaggagaaagatttctacagcaagaattacaaaacactgctgaaataattcagagatgacacaagcaaatggaagaacattccatgctcatgaataggtagaattgatattgttaaaatttacatagtgcccaaagctatttacagattcaatgctatttctatcaaactaccaataacatttttttttttttttgagatggagtcttgctctgtcgcccacgctggagtgcagtggcatgatctcggctcactgcaagctctgcctcccaggttcatgccattctcctgcctcagcctcctgagtagctgggactacaggcacctgctaccacgcctggctaattttttgtatttttagtagagacggggtttcaccgtgttagccaggatggtctcgatctcctgacctcgtgattcacctgctttggcctcccaataacattttttaaaggactagaaaataatattctaaaattcatttggaacaaaaaggtagctcaaatagtcaaatcaatcctaagcaaaaagaacaaagctggaggcatcacacaaacttcaaactatcttacaaagctacattaactaatacagcatgatactagtacaaatacagacacatagaccaatgtaacaagttagagaacccggagataaagctgcacacctacaaccatctgatctctgacaaagtcaataataataaataataaagaaagggctccctattcaacaagtggtgctggtataattggctggccatatgcagaagattgaaattggacccctacctttcattatgtacaaaaaccaactcaagatggattaaaaacttaaatgtaaacttaaagttataaagactttagaagtaaatctaagaaataccattctcgacatcagtgcaggcaatgatgaagactccaaaaacaattgcaacaaaaacaaaaattgacaagttagatttaattaaactaaagagcttatgcatagcaaaagaaattatcaacagagttaaaaacaatgtatagaatggaagaaagtatctgtaaactacacatccaacaaaggtttaatatccaaaaaatcaaaaagcaaaaccaaccccatttaaaaaatgggcaaaggacatgaaccaatacttctcaaaagaagacatatatgtggccaacaagcataagaaaatatactctccatcactaatcattagagatatgcaaatcaaaaccacaataagataccatctcatacctgtcagaatggctattactaaaacgtcaaaaattaacagatgctgatgaagttgcagagaaaaggaaatgcttatacactgttggtgggaatataaactagtttagacactgtgaaaatcagtctggagatttctcaaagaatttaaaatagaactgctattacatccaatgatttcattactgggtatatacccaaaagaatagaaattattccatcataaagacacatgcacacatatgtttatcgcagcactcttcacaatagcaaagacagggaattaacctagatacctatcaacagtggactggaatgtggtacatatacgccatgaaatactacacagctatttaaaaatgagattatctcctctgcagtaacatggatggagccagaggccataatcctaagcaaattaatgcagaaacagaaaaccaaacaccacatgttctcacttataagtaggaactaaatattgagtacacatggacacaaagaaggaaacaatagccactggggcctatttgatggtggagtgtgggaggagggtgaggattgctacccgggtgacaaaattatctgtacaccaaacctccatgacacacaatttacccatataacagtcctgagcatgtaccccttgatcctaaaataaatgcatgaaggtggtataaatacttcctaactacctgtcacctattcatgtcagtatttataagtcaacagatgtggttttcttgtgatgcctataggtttatcagttaaagtgatggagagaaaccaggcacaactgaatgtagaaaaccaatgtgagggctttatgtaatgtacctaactttaatgtagagatactaatggatatgtgggaacatgatatcagacagtagaggttcgtaacccaagcctttgtgtggtttgtggatggaagagaagcaggcacaagaggtaacaaaaataaataaataaatgcttttttctttatttttgtctgactgggttagtttgaaaaaccagtcttcaagtttggaaattctttcttctgattgtttgagtctattaataaacttttccactgtatttagaaatttaataagtgagtttttcaattcctgaagctttgattgatttccttttaagatgttcatctcttcctttatttcttttagaagtttcttttgttgattttcaaccttgtcttggatctcactgagttcgttgaaattcatgctttgaattctcttctgaatttccattttggttaaggaccattgctggagagctagtgtgatcctttggtggcatcactacattcaggtatttcatggtgccagaattcttgtgctggttatttctcatctggggacactggtacttctaattttcataaatatttctatgggggtaggatttttttctttttctatataactttttttttttaatttcttctgtccctttccattacccaccctccctagcgggtgtgattgtagagaatgttgggtagggtcttttgatttttcttctatagctctatgggacttctgtcagcaggttttatattaggctgtgcagtttgacgtaccatccagtagatggtgcttatgagtaagagccggctgtagccaacaaggcttggtatatactttaaaaagaacaaaacacacacacactttattgaggtatacattgacatgaacaacacatgtaaagcatatagtttacaatgtaggtgaaaacactgtaaactgtatgctttacatgtgttgttcatgtcaatgtgtacctcaataacattgatggagttggaagccattatcttcaacaaagtaacgcaggaacagaaaaccaaacaccgcatgttctcacttataagtgggagctgaatgatgagaacacatagacacaaggggggaacaacacacactggagcctgccggagaatgggtcaggagagggagagcatcgggaagaatagctaatgaaagctgggcttaatacctaaatgataggaagatctgtgcagcaaaccaccatggcacacatctacctatggaacaaacctgcacatattaaaataaaagttgaaggagaagaaaggcttggtatatacttaatccttgtttactgggaggtactctcttttgcctttggcaatggtttgatcggcgaagtgcacagtggtctgagctccctcctcaacctggggatgatggggaggaagttaggcagggcctgaccaggcaagtccacctacaggctccctgatggcaggcacacacatcagcaccaagggataatccactgggcaaccaccaagagcccagaggtgtgcctaggcatgaagctgggaaacctctttatccccgagttatcccctgcatggggatggcaggcagcctaaactcttaatttaagagagtgagtgctactgatgcctggagatctgcctggatgtcaagaggagatggcccactgcaccacgatctctgcacaggaagcgtgaggcaagtcaggctgccactccaggtgaactagtggcttgaatgcctggagatatgcctcagtgtcaaacagagagggccccactacaccatgatctatgcacagcaagggcgagacttctcaggctgctggatccaggcaatgaggtgctgtgaatgcctggagagctacaagaatgttgagcagagatggccttgctgcaccattatctatgcttaagaagggtagggcagcacaggctgctggtcctggcaagcgggtgctccaaatgcctgaagttctgcctgagggtggagtagaaagggccctctccacctttacctctagggagtaggctggagcactcagcaatgacacacacagacttgttccaggtcagcaagctggccccacatgcaagtctcattgcccagcagaaactatagctgtggtggctcccaaacaacctcaagtctgtgacaggggagaatagagttccagcgtccactgctgaggtcctttttgcaattctggctgtggaggcccctaccctgctccagaacatgtgctctaatttctggcctgaaactaaaatgcctgaatggccatgctgccaggtcaccaaagaatgactgactttgtatgcacctggatttagaatggcatcctgctcttggtcccagatctggaaaaatgcctgcagcttttccccagtgtctttccctctctgcacctccaatcctctcctcaagttagctccaaggcttggctgaaacaaagtgctctcccttgatctgggttgcttagatctccagtgtaaaggtgagtaacagagagatctctgcctctctctggtactgaggcttcattcagttttatcagctggacactgtcatgggggctatttgccactcacattcttctccccattatttgagatttccttcatgtttccaatggattcaagttttccatcttgaattagagcttaggtagttgatttttatgcactgtgttgctattttcaaaggactgaggcatgcttaaaaagcctcttcttatctgtcatctcgaaaaaaatagcttttattgcttgtttgacatgtttcaggtactgtgtgcttgatacttatatccaaaaaatatttcattcaatctctaggctgtgaagtaacttccattttcccagttttatagaggagaaaacaaagggttagaaagtctaagtttccaagcagtcaatatttataaataagaaacaaaatctcatttaacattcctttgtttttcttaataactttagatcttttcccttggtacttttgtttttgattcttgattacttgaaagtatgtttactgaagaaaatgtaatagagatggcatagtgttttgcagcattgcttgccaagagaaagctatcctcttcattctctgatgaaaagaaaaacaactctgagctactcaattctccaatcaacaatgacattttcttcagagcttcaatcctttgtggtttacctttctctgacctgggctcctgacttttcaatctgaatgggggctaattgacagaggaaatgaagaaaatgcaaactatgtttgccaacactgagtttgctctttgtcaccacacgcggttggctctaaatgcagtaattgtaatataaaacagttagctttatttactgaaccaaagcctgacttcttcctcaccttgtgtaaatcctcgtgagcaaaatcattgtatccaatgagttccacatgtagaaagctgcgcccatatctctttcatggactgtttttttctttatcctgcttctgcagtaagaagttcaaaaaaattatatcaagatatcaggacctaccagaagaagcctttttgctgcctagaggcatcaccaggtaggatttatgctgagagttatcacagtataggaacaggcagtcaccattttaaggccaaatgttcaatcctatctgtatttaaaagctggttagtctccaaaaagctgacttatactctccaatctcaccaaagactggcatctaaacaagaatgttggctcattattttataatgataactataattgtcaaaagaattataatcctcaatcctctgaccagctgattttctcccagtcgcttatgtggaaagtcaaaacataatcagaaatttgcctggtgagcacagatatagaacaagcggagtaggctgcatgatgatttgactggttaataacatcaagctctgcttcttcttcttactagctaagggacgttgggtgagctacttaacctcttggtacttcagttccctgatccataaaatggtgataacaaaatgcctactattttgtaagattgcttttaggattgaattagttaataaattcaaagttcctagaacagtgcctggcacataacaaatctccaaaatgttagctattggttatcttttatagttcttctaaggtatgtacttatatattcagcagccaactaagcaccatcccttag

SEQ ID NO: 8528 - DNA, 1100 bp, artificial
  synthetic oligonucleotide
agggtttcacagaagcatgaaaatgcaggaaagaaaaactttagttatcttcaaatttgatcctcccacaaaaataactaccacttatttaatgttaatgccaggcactgtactgtgtaattatttctattttatcatttatttctcacaataaatttcttcaatatatatgacatttttgttattgttattgaagttgttgttcccagttacagatgaacaaaatgaggcttagagaagttaagagacttacctaagttttcacaagtaagtggcagagatggaattctcaggcttgcctgaccacaattcactcttaaccactgctagaaagcctttctgacagaattggtcattgttttctttcaagaaatgtttgttatgactaaaaaaggaattacttacacttattcaaacttacttactatgtcatttttcttttgtaaggcacattcaagctaaatattaggaaaaatgctcaagttagatgtattagactgtgaaattacctctcactggatgtggtcacaacttcatgcccttgatattttaagtagaggatacagagcactgggtcatgtactatctgaaacaatttaatatgagcaaggagattgacctcataatctttcgatgtttaatttttaatagataccttaatatttgatttcttttgattctagtttcacatttgtttagtcatttccagtatttcttcaatggtgaacaaatgtttgctttggtctgacccattattcacgggagattcacactagaaaatgtggttatgggagccccactcaaatgccaataagatgtatctgcgtatcttcctcattctccttatgaacactatggacactggacacaacataccatctggcagtggggagagaaacagcataaaaatgagatatgcgtgtgtagacaaaatatcgatgaatgaatctctgaaagctaagatgaaggtgaagcaaaacagtcaggtagatcattctgatacttgtgttagtgctaaaattatgttcccctactttctttttttttttttttctgatgacagcagtgcaggtgacgaaaaatactttcaattttgctgc

SEQ ID NO: 8529 - DNA, 895 bp, artificial
  synthetic oligonucleotide
ttccatttttaatagagattttttaataattaaaatttaatttaaaataaaaatatctctctctgagatgagagccggtgataaaagaaagtttaagccttattctgagttattcttacatagaatgctcatacgttttacataacagttatttgccatttaataccaagataatcttcatacttttcagaagttttggagagttctgaaattaacactatgggaatactaatttgaaaaaatgggcatttatttgaaattaatacctgtgtctgactactgaccaagagtaaagacaattttcctcacttgtaagcatggttttcttttgtaaaaaattagttacaaaaaaagaaaatgtcactttcaactatacaaaataaattatactgcccagtaatttaaaaattgttttctaagttagtacagtcttggattttttttaaaaaataaatttactttaataggctctgacaagagtataatgtttgactgtacaaagctgtggctgaaacttgtagttagtatcaccagctagcttcacgattcccatacgattcctgtatatgcaactgtaaaaaaatacaaaactcagcagcaaggaatttcccatttgtcccattttaattgaagttaaaaagaatatgggaatccatgtaaatagtttctgagtaatgtgaagtactaagtctaatgagatatttttcctgcttaagtttcaattattaaactgccacttcaattacttgtttacaaactcgagaaacattcactaaagcaacttaatatctttacagtatattattcagataattgcgtatatctggagtataatctaattctttgatgttattaaccccaaacaacagacatttaaatcaatataactctaatt

SEQ ID NO: 8530 - DNA, 3118 bp, artificial
  synthetic oligonucleotide
ccaatcactggaccttcaaagccaatggaagaggaaggaaaatgcacgttcaagaatgcaaaccctcgccctttcctcatattccgtgatgactgttttgagtcctaaacaaacatttcctatcaattttagcggggagtagggccagggcaatctcgacactaagggacggggacacagacaagtctcttccaggacagtggcggaagtgccataaaatgaggtgtccatctgccacccacagagcaagtctctctgtttcccaaagtgttcacaggctcactacgcttcctgaatgtcagtgcgagttagcaaccagaactctgatctgagtatgatctcggacgcttgttcctctgcgcgctgggtaggggaaaatttacaccaagcgcacttaggtgggctaaagggctgagctgtttacttctgaactcgctagcgtctttctcccggaagctaggcgaagccatctattagcccccgcagagtttgggagagatgcgcaagtggaattggagctgccacctcactttccacgatctaacccggtgtaaggtggcggaaggggcatggggaggcacgttcaggagtcgcgctttgcgtttccaccccgacaccagcggagcgcggagcggatgggttcacagcataggccactttgagaactctgcgtgacatctgggagttctctcgtctggcagagaggcaagaagcagaggcaccacaccgcccccttctcggactggatctctgttcttggtcgagcctggacccactcaggtagtcggacgccggccagggagtctccacctcctcaccagcggcagccattcggagcgctcgggcgcagaagggctggggcccattggctgtgggacgctgccagtctccggagggggtgtggtgggggtggggtctggggccgcagcgggtcggggctgctcactgtttgttgagcttgagcgtgagccggctgctgaagacttgcgaacagttcggagccagcgagagcgcgccagagagagcgagagtgagggagtgagtgcgaggggatctagaggagtcagggcgagaaagcgagggccggaggacccacgatagagacagagtgaccatggctgtctccgcatctccagtgatctctgcaacttccagcggcgccggcgtcccggggggcttattccgggccgaacccctgtactcgactcccagagagccccctcgtcttactcctaatatgatcaatagtttcgtggttaataaccacagcaacagtgccggaggcggcggcaggggcaacaccaacaccaacgagtgccgcatggtcgacatgcacgggatgaaggtggcttcgttcctgatggacggccaggaactgatctgcctgccgcaagtctttgatctttttctcaagcacctggtgggaggcttgcacactgtgtacaccaagctgaagagactggatatatcccccgtggtgtgtactgttgagcaggtccggatcctccgcgggctgggggccatccagcccggggtaaaccgctgcaaactcatcaccaggaaagacttcgaaactttgttcaccgattgcaccaatgccaggtgagacactcgtttcttggctctcccacttctcttacccctttggcctcttctgcatgcctcaccaccctcatccaactttgtttgtagagtgagtcttaactagtttgcctctattcttcacgctgtaaatcggtggggaaagaggactagaagctttcattaatgctggtgccttctagtccacgctcagtgcaagggcttcggtctaaaaaagtcccgcaaacttgagtttgcagtcctctattgaaactttccagccttttgcccatatcttgcatggcttttggctgttcgtggttatttgttaatttctctatttggttttctttcctgctcttttgtggccgcacgggtcggataggttttcttctgaacacggataccaagggctttctctgggggctggctgagctgtaaactgggctcctaagctggcaagccagaacacagcatttggggcatgcagggggtgggaagtctagaatccatcccagagggtgattcgatccccatcccgtgtgtttgttgtgagaatgtgtggggtgtgtggtgttgttgtttgtggtggtgttggtgtgtatgtgtgcaagtgcgcgtgagaacgtatgctcatgcttgctgcgcaaagctccccagtacacgatacaggaaagtcgatggatactatttttacaaaaggacgacgacaaatatcactttcctgggatcgtccgttttgggttatctgcagagggcaatgtggggcatgaaccactgtggctgggactggattggaggttggtgtacaagttggcagatttctagagaggatgctctcagctcttccaggcgaacagttggaaggatcccattcccttaaagacaggattccttaaatgatgatggccagcttccctggttgtaagtgtacctccttcatatcacagtttagaagtacactagtgaataaatgtccatttgtatatgagaagcaaattgtgttcaatgtttctgagtttaaaaagaaaaaaagtatactcaagattatctgactttttaaacgcctgtgaattagtcttctagtgtttattccatctccagtttggtaacatctcaggaaagcacagatttggcacaaaaatcaccatcacgtggttaaaaggagcaaaggattttgttgtaaaacagcactactgcttattattttgcaaaaataaaataaaaaaccaacaactttctcaaaatgaactttaaatcataaaatctctgggtctgtgaactaaaactgtaacagtttgccacatctgttgtaaaatccaaattgccatgtatagttgaatgatactgacaacttgtaggcaaactgttgcttactgctgcaataagataatgctgcagaacttacaagggaagctttttccttcttcttttttttcttcaattgagcagtgtttttctgtgttcaagcaattaaacagaaaactatttatgtgagaactcctacctgattcatatttagggcttacaaagctgg

SEQ ID NO: 8531 - DNA, 4129 bp, artificial
  synthetic oligonucleotide
taggtgcaattacagagcacctattttaagaatcttgagtttaatgccatattaaagcatactaaattcacagaaactatataaaaactttaatatgataaaaaagatcatccataaaatattatatatgtagtcaaagccttgatcattctaaaatgatagtaaatgcgcagacactgaagacttgctctatataacactactgatgataagatgggatgcattatgatatggttccccttttgggttcaatccaaggaagtttaattaccaaaccgcaagttgacctccccagaggacataagttagacgtcagtgagtatgggttttttttgtgtatgtgtgttttgtttttgtttttgtttgggacaaggtctggctctgtcacccaggcaggagtgcagtggcaaccagtgagtatgtcttttgctgtattgtctttaagctgtagacatttggaaaattcatgtctatctatttaattattggaatttaaataaaaacttcttcacaaccattttgatcgctcatgattagatttgttatgatagcctgtgcgtgtgtgtgtgtgtgtgtgtgtgtgtctatccagtacttattaagggtattctttgtggtgccaggcagtggtctaggtgctaggtgctgtgaacgaaatgaacaaaacggtctgttctttcatggaccatacagactaccatcatcctatcattagcttggggtgtataagctgtattatccctcctagtatatttactaaattatgaaatatttgagattacaaaattttgccacatctattattgaataatccttaaatttcctttcctatatctgcctcatgcattatatcagtaaacattagacttttttcagtcttcggaattataccagaaaagtccaactaaaaatagttattaagatacaaaacaaggtattttagttttatgagtgcagaaagtgttcttatcttataaagtacacataaaaaggagcatgaaataaaacatgtatttccacttaagaatgaccatagttaattgaccttagtaactttttatgatatatatttgttaaaagggatatgaattcttaaaattcataaagttaatcaatccatgagacacacgtttttgttataaaacatgcaactgtggatttttaaaaaaattatgttaaaaagcttgctttgatttgtgttaagagttttaaactagtaagatcctcaatcttagagcatcatttgctttgcatgtggtcctatacaatattatgccaaaaattaaaacagagatgagagttgtttatttttgttcatccagagtacattgacccttaaatatgttatatttaaatgtaaataactttacaaaaccagattatttgcaaacatgtataattaaatgtttaatgttactgttaagcttgctgctttgaaaatatcctgtaatctgctaaacttctaaatttattttgtagaaaaatctgtgagttccctctaggtttttatctgaggtatgcaaaaggggaatttgttcatagaaaaaaaattactccatagtacattttatgcaaagcatacaatctttaggtctcactttataagccaattagcatattcactttaaacatgatattttccaattcaattcatttcaacaaatatttagtaagcacctactatgtgcaaggctccttatcaggggaagtggtgatactaagaacttgccacattcttattgtctcatctccagattatctaggttgagttttattgtttcatggttaactctcagctaacctacattagtggaaggaagagtaaacaatacatataattcaaaaacgtggaaaattaaaataacattgatttggctttgcagtgcattataaaatgttctcagcatatttacctgtctaaatatattttacttattctaatattaaattttatttacttttttctgattaaactctcttttaatgggtctacaaaattgtgtgacagattttgatcaagttgtttccattaaaaagtactgattttaaaaactaataacttaaaactgccacatgtaaaaaaaaaaacaaaaaaaacaaagtgttccacaaaacattctgccttccttctaaagattttacaatgcattgttatcattaaccagtcttttactattaaacttaaatggcccattgaaacaaacagttcaaagattcttcttccaccactgattaagactagggtggcaggtattagggataatattcatttagccttctgagctttctgggcagacttggtgaccttgccagctccagcagccttctgatccactgccttgatgacacccacagcaactgtctgtctcatatcacaaacaccaaagtgacccagaggaggatagtctgagaagctctcaatacacatgaggttgccaggaaccatatcaatgatggcagcatcaccggacttcaagaatttagagccatcttccagcttcttaccagaacggtgatcaatcttttccttcagtacagcaaacttgcatgcagtgtgagccatgtggcaatccagtacaggagtatagccagcactgatttggcctggatggttcaggatgatcacctgagcagtgatgccggctgctttcattggtgggccatttttgctgtcaccagcaatgttgccacaacgaacatccttgacagacacattcttgatattgaagccctcattgttcccaggaataaagctttatttcatttcactcgaagctttattttatttcactcaaagcttcctggtgcatttcaacagactttatttcagttgtaacatcgactgcagcaaaggagaccaccataccgggtttgagaacaccagtcttcacttgaccaccaagtacagtaccaatgccaccaattttgtggacatcctggagaggcaggcgcaagggcttgtcagttggaccagatggtggtaggatgtagtccagagcctcaagcagcgtggttccactggcattgccatctttacaggtgactttccatcccttgaacgaaggcacgttagcagttgcctccagcatgttgtcatcattccaaccagaaattggcacaaatgctactgtgttggggttgtagccaattttcttaatgtaagtgctgacttccttaacgatttcctcatatctcttctggctgcagggtggctcagtggaatccattttgttaacaccaacaattagttgtttcacatccagtgtgtaagccagaagggcatgctcactggtctgcccattcttggagataccagcttcaaattcaccaacaccagcagcaacaatcaggacagcacagtcaacctgagatgtccctgtaatcacgttcttaatggatacagtagtcattacaggtgttagcagatcaaaacctggcaaattacatgaggccagttactgactttaacacaccttcctgtgttcagaacccctaaataaccatcttccttcagttaaataaaaatttcttgacaccagaggaattatagctttggattagaatgcattgatgagtataactctaaatcagatttttgtgaagcgtttctactctgtgaagagaataattaattgattttcagcttgcaattaagaaaaggaacattatatagtcttgatgctgattatatcctgtcaagagcagtcattttcatgatgggcacatatagaacattgtgacctctaaagagagtagtaactgctccagtgtttaattggtatacgtacatttgatatagccacattcttaaatttgcagttcttttgcgttgttccttgtcatgctagaggactgacaggtttttgttattttaggggcatgttcttttttgtaaagtcgtatgatgtttacataatccctattctgccacaatctaaagcttttattattcttccttgttttaaagtgaaagcaagtttatcaagaaagtaaaggaataaaggaatgactactccataggcagagcagcctaaagctttcattattctttacagttttgtctcattgaattgaatgacagatatgctgtgtattcagtttggtattttgtttcttttttttttatttt

SEQ ID NO: 8532 - DNA, 7442 bp, artificial
  synthetic oligonucleotide
atcagactctgactataaaatgaaatagtgattgtcatattgtataatgaatatgaatttattttgaaagtcacttatttattgaacttatcaataaacattccaaaaatgaagaatattatttcaggggaaatagaatcattgagcctaccattgttctgtttcccttgtctactgcctttaaatgataaaatggagttttgaagacaggtagtaacaatcctctaaaaaataattaaggctgttgaatgttaagtaggacgtttataaagagctataaagtggaaaaagtcttacatctcggctgcacaggatttaattatgcaaaatgctgtgaattcaaggagaatgagagatgagttttcacataatattgcaagagaagtacattggaaaaagaaaggagtaatgagaatccatacaagctggggtccagaccccagacaaaggtatacaatatgtcaatcaattaacatttttctaataatagtggtgatctaaattttaggccatatgtggactttcttctttatacatatattttcatgacacctttgtcaggttggtactatttcattttgcagatggagaaacctagtctcataataactaaatgtcttattaaagtcaaattggcaatttgggtagaaaagaaacgggaatttatttactttgagtcttctagtcattggataatgtttcctataatattattttattgccatataactcagttttctttgtgatcttgaaatagcttaacagtagttaatgaagtattacagatatataggatgacaaaatttaatgagagatattatatgagtggagtgagatagatatttaactggatattgagaaaatatggttagaggtgtcacctacttgaagattataattgaacgccaccagaggaaattgttagcacggcacaaaccactattagagtgcacagagaaaggtttagatataatctctatttcaataacttattttataatatagaaactgtaatatattttagttgagctataatttctattcaataattacaaataaggtagcttgctatctgacttagtttttttttttttttttcgagatggagtctcactctgtcacccaggctagaggacagtggtgggatcccagctcactgcaacctctgcctcccagattcaagtgatcctcgtgtctcagtctcatgagtagctgggggtacaggtgtgtgccaccacgcccagctaatgtttgtatttttgaatttttagtagagacagggtttcgccgtgttggccaggctggtctcaaattcctggcctcaagtgatctgcccaccttagcctcccaaagcgctgagattacaggcctgagccatcaagcccagccctgacttagattttatttttttaaacacttctacaaaacttttcctccaatttgagactatgaaggtaccagaatgtatctaagtctgagattccactataagaaaggaggaacctctaggacatagaatgtcagaaggatagtaataaggttagaagaaagatataaaaagacataggataaaggaaataataatgaaatcttagacttgatttattgccatatacttttataatagtttgtagagaactactggtcctatcttccagtgactactgatgtggaaatggtacaccagtaatgaaggaggttattttattgatcggatagcctctttaacccctaagaaagtgagctttaaaaacttcatgtggtctgacatatctgtacaattgatgaaaggaacgccaagtagcaattgccaaataacaattccaggacagccaacctctgctaatgatgtaactggcaggagtctctaagaccattttcttttcactggtccccagtctaattgctgtaaattaaaaactaagggaagatagagacgatagtagttgaaactcagggtgaattagcagctgggaaaagttgtgctgccctctactcctaacctttggtctagttacaggcaaggaggtgttctctgttgaggctttggataaagtatttattggtggctagaccaccgatcttatcaaatagggtgtttgatatcagttgttatctttaaaaaatgatgtgccctgtggttggctcctcaaagttgtactaatccctggaagctgtgaatattaccttacatgataaaaagaattttgctgatgtgattaaggttaaggactttaatatgaaagattatctcagattttccatgttgacccaatatgatcaaaaggggccttttaagaccaaactaggagggacagagtcagtagcaggagatgtgacaatggaagcaagaggttggagtgatgcaaggaaggggccattagccaaggaatgcagagaaggactctacaaactgaaaaatgtaagggaacagattctccccgaaaggaaccatccttgttgacaccttgagtttagacttgagtttagatttctgccctccagcactgtaagagaaaaagtttgtggtattttaagccactaagtttgtggtaatttatttcatcagcaataggaaaacaacacataccttaagccccattttccctccacagcatctagcacatgactgaacacatggtagacagtcaacatttattcattgaagatcttaccagaaaagctagtaaaagattaattcgaagtgactcagtatttatatagagaatatctatataatcaatggacagttgttggaaaggatttggaaatgctttaaaatttctataaaatgcttgaatttgtcttgagcagattaaggaccaaggtagctaaattgtatgcaaagcactataggtctccatatttagaaagtgtgggtagttagtagtccttagaaaatttgacattgtatgttatttttcagctctagcagaaatatcttgagtgcagtaggccatccacattactgtttgtatcactggaattcaaatctaattataataagtaggaagaagatagtttggtgtgtttgggggtgtttggttacattcaccttcatcaaccgtgtcagtgaacaaatgtaattaatttaattgtttaagactccatcatattgataggttcaaataatggacaagagcatatgcagataggcatgtttaaaataatagcctacatggtgctataatagcctcagaatgagttatataaagtagcgtgtttgttagtttaagttgaaggccctgaagtagggtgcatttgttactaagtgagtagctaaaccaaaataatataaataataccttttcttaggctatggtacaaaaattgactgtaaaaatattatataagttgtagctgattagtaataaacaagatattaaaatagaaaatactcattttaatgtctttctggtattgaaacatcttaaaaatgaaatttatcatcttgtcattaccagatggccactctttttccttttttgagcttgttaatagtgtcatgtaatcttataataattttttttacaacttcacttcctggctgggcacggtggctcaagtctgtaatcccagcactttgggaggctgaggtgggcagatcacttgaggtcaggagtttgggaccagcctggccaacatggtgaaaccccgtctctactaaaaatacaaaaattagccaggcgtggtggcatgtgcctgtaatcccagctacttgggaggttgaggcatgaaaatcacttgaacctgggaggtagaggctgcactgagccaagatcatgccactgcactccagcctgggcgatagagtgagactccatctaaaaaaaaaaaaaagtaaaataaaaacttcatttcttttgtcttttatatgtaaactgtaatactaaatcctgctaattcttacttgttaatgtctctgagactgtcccctttgtactctcatccaattctctacaattttgttcttttcgtggttacagaaacttctatactaattcctcctgcttttcatctgtcgcatattcctatttcactactcatttctctctatcagggatgcttttcagcagacgttttaatctacttcaattttcctgaatcaaggtgtgttctttcttggaacgccttcttcattcatttccactaatgcatatctcttactccttcaacatgaacagacacttttcaaaagaagacaaacacgtggccaacaagcatatgaaaaaatgctcaatgttacttatcattagagaaatgcaaatcaaaatctcaatgagaccatctcatatcagtcaaaattgctattattaaaaagtaaaaggccaggcgcggtggctcacgcctgtaatcccagcactttgggaggccaaggtgggtggatcacctgaggtcgggagttcaagaccagcctgaccaacatggagaaaccccatctctactaaaaatacaaaattagctgggcgtggtggctcatgcctgtaatcccagctactcgggaagctgaagcaggagaatcacttgaacccgggaggtggagtttgtggtgagctgagattgcaccattgcactccagcctgggcaacaagggcaaaacttcatctcaaaaataaataaataaataaataaaataaaaagcagatgctagcaaggttgtggagaaaagagaacactaatacactgttcatgggaatgtaaattagttcagccattgtggaaagcagtttggtgatttctcaaataacttaaaacagaactgccatttgacccagcaatcccattcttgggtatatactcaaagcaatataaatcattctaccctaaagacacatgcacgtgtatgttcattccagcaccattcataatagcaaagatacagaatcaacttcaatgccaatcaacggtggactggataaagaaaatgtggtatatatacaccatggaatactacactgccattaaaatgaacaagaccatgtcctttgcagcaacatgatgaagctggaggccattaatctattagaactaacacaaggacagaaaaccaaatactgcatgttctcacttataagtgggagctaagcctcaagtatatatagacacaaagaagggaacaacagacattggggcccagtgtagggtagcgggtgggaggagagtgaggactgaaaaactgcctataaggtactatacttattatgtgggtgacaaaatctgtacaccaaacccctgtgacctgcaatttacctatataacaaatgtgcatgtgtacccctgaacctaaaataaaagttaagaagaaaactaattcaaaactttttctagccgcggtggctcccaggtgtaagcctagcactttgggaggctgagacgggcggatcacttgaggtcaggagtttgagaccagtctggccaacgtaatgaaaccctgtctctactaaaaatacaaaaattagccgaacgtggtagcgggaacctgtaatcccagccacttgggaagctgaggcaggataattgcttgaacccaagaggcggaggtttcagtgagccgagattgcgccactgcactccagattgggtgacagagcgagactccatctcaaaaaacaaacaaacaaaccttaaaaaatctttactgattagtcttattcaactttagttcctctttattcttattgtgtttccctgcatctactgattctctgacttgtgcttggtaggtgaggcaatgttggttcatatgcactctgtcactcttgttaggtgcaggccttatctctgtcgatgtcccagatgtgtatactatctgttcggtgttcttcaatgcagattcagctttatacacaggcaagtttcacagaacaaaggtcaaaagccatagctaaagaaaatggcattttgtgcttgtgactgctgttttctaggttattacctccttgaaatcagtaacaagccttgtttgttttgattcttccacaaaacagttccttacaaataacaggtgctcaatcagtattgagcttgactgaaacattataattaattttctattaaatattaaatcatgcaaatagctgcttttaactttaactattcaatctatttgcaattagcatgactttagtgtatgtgtatgtgtatgtgtgtagcctaacatagggccagctacatagtgaatgtttagttgatggcaattaacaacagtaatatttgaaaaagatccagtcttcctttacaaatatgcaatagagatttggggcattgttgctataaattgttaacttggttaactctatgtaaccgtctaaaataaatttaacaagtagtgttcactaatgtatttaggattagaacaggaatagtcaattgccagtaagtaaatgatctactcctgtttcctatcttcaaggaatactgtggggtaatcaaagtgtgcacacatgaaataacaaaataacataattacttgttccacaacttgtgacacaaaatcttaagttctgtagaagtttagaaaaggaagggatgtcatcgttttcaggttttttgtttaaagtaagtctgctttttatttattttggaatgatttggagaatcacagcctccttatccttacacatttaaactgtatacactatttgcaagaattttgcttttctttttttatgcagtatagtgccctctggtgaatgttcattcctgcataagaattctatttcacttattaattttgtaaattaattattgtatgaaacataactagaatataaattctatttacttattagtttctagaaaatagtgacatgttgaattagagaaagataatgttctagtttataattaaaaattttaattgattgtaacttaagcccatgcagttttcttttagtaggtgtaaggaaaattttcctgccttctttctgcagttactttcctttgtgagaagtagattatctctgtgtttattaatagtgttgtcagttgctatttttgcatttcttaaagataagcaggttttacttaaactgatgcctcaatgaaatacaacaaagtcaagggcattattctgaaggggaaaccatttgaactgtaggctcaaatatcccaggtcaaactgggctgcattaatttttccccttatttaaatcatgaattatctcttaaccctttattaacaacatgcttacttaatgagatagcatctagtttttctggacataactgaaagctagtgtttaaaatggtttgtaacagtatagtgagtcagggcaaatagctgttttagttagatatattttaagattttgaatacagactatgacttcagtccaattcttgacttttctcaagaagtaaactaaacttcaccaaaacaaaaaggtgagtatcttaaaagaacagtaattgcccttaccaatttttaagttctaggtact

SEQ ID NO: 8533 - DNA, 796 bp, artificial
  synthetic oligonucleotide
actcaatgctttaggccattatttcaaaatccaatatattcaaactttggcctctgagagcaataatatcagtacacaagaacaacagagtgataaatatagaaatttcatcaaggaaaagactatatcctgtcattctgaatcaatgtttagaagatgatctcagcattcaccacctactatgggctttagctttgtgcttatgaagaaaaaaaatcattagaaaagaaggtgactgtgcttctttcaaatattatgatggcgtaacgaaataagtttaatatatgccaagagtgagctccactaacactgtgatgataatttgatgtgagtcccttttgagccttgcataattgctgccatgataggtagtgcagtgcagtgaagaatggtttgtgcatagccacccaaaatttggctgactggcataacacaactgttaaattttctagttttatttttcttcacagtattggttcatttgttaccattaaaaatgcccattttgttcaaaagcatgattactatctctatttttttgaattacatattatatcatgatcacaaaagcgattttgtattaaaatgcatgtactttttcatttaggatgtgtataatttttctgagtgtgattatatccttttaagaatactaatttaaaaagctccctcatttaaccttgtgagagtttaatttttaaaaaaatctcaaaaagcaaaggaatgaattagtagtaactttattgttgttagtctatggactttggttttgcaaacttctgtttaagatttcttt

SEQ ID NO: 8534 - DNA, 676 bp, artificial
  synthetic oligonucleotide
ctattagatagggctttttataggaaggcttttacaaaaggggaaaatggcagaaaaatgtgcatatcatatcagggaattatagaaattctcaacacttctattgattgatattttactgtcagatatatacttttaagcataatttcaaaaattatagattaatattaaaaatacactatacaagtgtcaactctttcaacttgcagtgtatgtgatgggtttgatatggggaggaagattagagacgtgacccaattctaggatgttacccttcagcaacctgctcatgctagtgatgatacatgtacagagtgagtatatcaagacactgggaggttctgagccattggaaaaaaataaaagttgaattatatttcctatctgcgtttataagactcagtttgaaaagatttttcaccgacatggagttttctgagttttctctttaatacttggttaacctgaaaattaagctaagcaaaagctcagatttgcctgaacagtatagtgactgaggtttcattacgtattgaagatagtgctttaaatttatggttatatagtcactaagcttggaatccagaaaacattgtatgtggtaggtaaaatttttatggcatgttgatatatgtcccttagtggtcggagctatttatttctcactttattttgt

SEQ ID NO: 8535 - DNA, 1385 bp, artificial
  synthetic oligonucleotide
ttaataaattgtattcttttgtaaaatatcttaacatggtgtgcagtttgtgttaaacttacatcatttgacagaattacaaatatttcgaaatgaaaattcagttgaacaggaggaagtagaataaaatatatctatttttctcctctgggtattaagttcaatatggcagatgcaaagttatttatcttgcaacctttataaataatatattggagacctccaaactcatttaaaattcagaaataagaaaattaacttatcagttgttattttgacagttacaattgcaataattattaaatagtaaaatttcatctatattagtaaatctctttaatacctataaatgattatgcctgtagaaaaacatactgagattatatcccaaaaatccttagattactgtccctcttcactcagtaagtatttactcaatgtttagcaaatgttaggatttagaacaatgctagatactgtttaaacctaaatattcaaacaaaaagtcagtcagaagtgggacagttattatggaccaggatgaagatgaatgaggaacttttagtccaggattttagttctactctaaggtataaattcagagagaaaatgagagcctcttagtggcattaattttataaattattaaactgcacacgcatgcacacaaaactgagctgacggaaaaagcagatggccaaaaaataaacttaaaaaaattggctaaaatgtagaggtgattagctttagccaaaaccattgaaagaaatcaaaacaaatttaaggtgataaactaaataaaatagaaaactttaaaaaggaggattgttttgaaaaaagttcacaggagatccacaattaaaacacaattccacaattaacttgggggaatttgtttggaaatgacagcagattcctaattccatggcattcccccacacattataataattttcttaagtgaaaggaaaacatacacttaatgttttcttagacatttaatctctcccttttctagagccggtgcaaacagaactgctaattagtctaacatgtcaccaagctactgaactttgaaaagatagtagctctaaaatattgtagatgtgccagttgctaaacaggtgatttttcggtaccggtaccatattctagttttaacagatgggcttacttttaattgtgataatactagtagtctagatatcataataatagctttgagaggagcagttcattagtagcaaaaatcctttagtaaagtggcataggcttgaaactcagtgcttcaaagcactgtgggtactttaaatataggaaaataatgccagaatctagttcataatattgaccaattttcaatcaaaagaaaagttgattttagg

SEQ ID NO: 8536 - DNA, 275 bp, artificial
  synthetic oligonucleotide
tttaggaaatgccatacgagtggtaaaaggctggaatttgtctttggaaatcttgtgttcagtccctcactggaccatctactagctctatgatcacaagcaaatcacttaacatctagaagtctctatttttttaatccataaaatgaacctaggaatttctcttccagggttgttatgaaaagcaaaaatgagtaaaaccaaaacttataagaattctttgaaaatgcataattcaatgcaaatttcctaagcactgtaaaggtcgggaccat

SEQ ID NO: 8537 - DNA, 1335 bp, artificial
  synthetic oligonucleotide
gggtatattttctctgttacctgtggaaaaaatattataggctcagaacttcttagcaagaagataattgttttggaatgtatcagcagaaccttgacctgaaactttatgcacaaattaaaggagactatcaacagagaaatgtcactgaagggttaccatctacacttggatacagaaaaccgttgttggttttttatttacttgaaaaccttaatgataaaaaacatgtgctataagatacagaataaaagagaaggatgaaataacagattcaactacaaatatcatataagaacaacaccttattgctcactctgaactgaagagtttctttatatttctctttgatgcatttttatataaaacaaatattattgttaggctagagcacattccttccttgggaattacgttgtacaaagcagaatgcatacagtgaaataaatgcaaatgatgatgggaaattaatagtagataataaaaagctaaaatttgaaaatctgtaggtactagtaaagtttccctattgaaatgaggaaaattttacagttggcaggggcaagaggtcttgtacatacattgttcatctaattacacattcttcattcctttttgcaaataattgcaggagtccacaattactgtggagaattgcagaatacctaatcatcaatacaggctgttttctatcacaatgattatatatatctttgcataatatatatttggtgtttggatgccctgctcattcttcagagcaggtaggaatgcttggtaatggtacaacaaaaccatgactaattggaaaacaactattttagatcctcaagtatacaaatttctctcaggagttatacctacctttgaggaagtcatggcaagataaaacaatacaagaagcatcttgggatcagtgcacatttctttccattttctttgctgtctgcatctctagaatggcacaatgattagttatgttcacagttatgacactaagttatagcaaggtctctggtcctgtgataaagatcctattttatttataaacttatatttataaaagtaggaaatagttctgacatattttgtaaaaatattaaaccacagggctttgagcataatataaattgaaattttggaacagattctgattgcaaagcactacgatagaaactaaccataatattcaattccatgaacattcctgttaattattgtactttgagaaagaggttagctatttttcaacctattatgtatgtattattatattttcttgtataagatgatattgaaaaaactgtactaaaatcatgagaatatatgtaggca

SEQ ID NO: 8538 - DNA, 3663 bp, artificial
  synthetic oligonucleotide
tgcattttactatctttgttttatttgtgtttcaaattggggatcagatatatatttaatatatatttttctaaatttataaactattcattgtagcatgaaggaattataagaattgaaagttacattgttaaaaatattaacaaattcaagttaattttggtttgtgctatgtagcatagctctgttaaataaatttatccagctttcaattacattaagaaatgatccccattttacaaaggatcatccatagctcaagcctcagtatcatgcaatattttcatgtgaaaagcctgcacttgtacccccaaatctaaaataaaagttgaaattattaatataaataaataaatggaatggaataattctgcttttaggtataacagctgcagcgatggctgaggcgatgaaacttcagaagatgaagcttatggctatgaacactcttcagggaaatggaagccaaaatgggaccgaatcagagcctgatgatcttaattctaacacaggtgagtgtcttccagaatcccagaccaatgactcttactgttctattgtggggcaggagagaggtgggatgaggatggaggagagaataataagtctactttggttataaagatactcaagagggatgattagctctattgctaacatttgtacactgaaattagaaaacagttacaagtcataatctcattttggaaacatttagttatcttcactgttttgctgtggtagaattgtattataattcctataatgttagccattgtgctctctgcctgacaaagactggtccactcagcatcacctcaggtttcttattccatcctattctaaataatttaccactgaaaggcaatgctgacagtccaggttggctgggctgaagtcttttcagctggagtaccacttccttagctaaaggaaagtgctggctgactccaggcattatcaacagggactaatgaaaagaggtagaacagggagcagccaaagaagaaaagatggatgaaaggaaaagaaaacagaggtgacttgtagagtggaaagtcctctcctctcatgttacttgtttctttcttttaccccgtgatcattgtaccttggccttgatcataagacccttcagatccctttggaaagtaggtgggattataactatcaacatacatgaatggatggatggacggatggaaagatggatggatagataaatggatggatcaatggatgatggaaggatggacacataaataaaggaaagattgaagaaatatttaattttattttaggtttaggagtacatgttcaggtttgttaaatgggtaaaaacatgatttgggggtttggtgtacatactgattattttgccacttggatactaaagatagtacctgacagttttatttcttttctgaacttctccctcctcccacccttctccctcaagtaggccccagtgcctgttgttccctttttttctgttcatatgttctcatcatttagctcccacttataagtgagaacaagcagtatttgattttatgttcctgcattagtttgccatggataatggcctcactccatccatgttcctgcaaaggaaatgatctcattgctttttattgctgcatagtattccatggtgcacatttcccacattttctttatccactttctcattgatggacattcaggttgattccatgtctttgctattgtgaatagtgctgcaacgaacatatgtgcgtgtgtgtcttcatggtagaacaatttatattcctttgggtgtatacccagtagtgggatggttgggtcaaagagtacttctgtttttagttctttgaggaatcaccatactgctttccctaatagttgaactaatttacacttccatcagcaatgtataaactttcccctttctctacaaccttgccagaatctctattttttgacttcatagtaatagccgttctgactggtgtgagatggtatcttattgtggttttgatttgcatttctctaataatcaatggtgttgagcttttttcatatgcttcttggtcacatgtatgtcttctttagaaaagtgtctgttcatgtactttgcccacatttgaacagggttgttttttgcttgcacatttgtttcagttccttgaagattcttgatattagacctttgtcagatgtatattttctcccattctctaggttgccttcttactctgttgatagtttcttttgctgtgcagaagctctttactttaataaggtcctatttctcacgttttacttttgctgcaattgcttttggcatcttcttcatgaaatctttgccaattcctgtgtccaaaatggtatttcctaggttatctccaaaggtttttacaattcgaggttttatatttaggaatttaatccactttgagttgatttttgtatatgctgtaaagaacgggtccagtttcagtcttcggcatacagctagccagttatcccagcaccatttattgaatagggtgtccttttccattgcttgtttttgtcagctttattaaagatcagatggttgcaggtctgtgactttatttctgggttagctattctgtaacattggtctagtgtttgttttgtacctgtagtatgcggttttgtttactgtatccgtgtaatataattcgaaggcaggtaatgtgatgccttcagctttgatgtctaaaagcgtggtggaagggtgcgggggagcagggtgactccccattcccagtcttgcacaggtccctgtggggagcatgaacctccctgggggctctcattcactcaccctttccatgtttgggagtttctcctggctattttaacaatattgattcttcctattcaagaacatgaaatgtttttccattcagtaatgaattccctcagcatttgcttgtctgaaaaggatcttatttctccttcgcttatgaagcttagtttggccggatataaaatccttttttttttttttttttttgagacggagtctcactctatcacccaggctggagtgcagtggcacgatcttggctcactacaacctctgcctcctgggttcaagcaattctccctgccgcagcctcccaagtagctgagattacaggtacccatcaccacacctggctaatttgtgtacttttagtagagaaggggtttcaccatgttggccagcctagtctcgaactccttacctcaggtgatccacctgccttggcctcccaaagtgctgggattacaggtgtgagccactgcgcccagccaatattttttaagatgctgatacctaacaggttggtggccagctttgttcctctctgtcctctgtttctgactgctgccttgatggatcccgacatgatttctctgttgattggcctgcacggcagtggtctctagccctttgctttcttctccatgagagccgtgcacatgaactgcttctagttcatcatctcggccctgtctcccaaacatttttagtaaaaaaaaaaaaaaaaaaaaaaaaaaacgcaattaaagatggttttaggatccagagatttccaagctaactctgcagttaaattcaatataatgtgataggtaaattggcagcagctttacatctctttt

SEQ ID NO: 8539 - DNA, 2875 bp, artificial
  synthetic oligonucleotide
caatggactgtgtagtctcgaagggctttgtggaagaggtgggacctgagttaagtgttggaggaagaatatgttgtgtttaaatagagtgaagatatgaggtgttttagttcaggggtccccaacctctgggccttggaccagtacaggtctgtggcctgttagggtccaggctacacaacaggaggggagctacagacaagggagcattactcctcgagccccacctcctgtcagatcagaagcgacattagattctcataggagtgcaagccctattgtaaactgcgcatgcgagggatctaggctgtgggctccttacgagaatctaactaatgcctgatgatctgaggtgaaacagtttcatcctgaaactattttcccccactgtcagtgggaaaattgtcttccatgaaaccagtcccttttgccaaaaaggttggggactgctgttttaggtgacatgaataaatgttcagaggctaataatgtgctcagttcatactgttattaagcagaacaaaacaatagaaatttaataccaatataaaacttcttaagtactgtgtttctaccagggaagtgttgtatttgcatttacattttgttcttatctactctctcacatcaaaaatgttttttaaaaaatgtgacaacaatcaaaatctaataagatcttatcttgggccaggtatggctctaaggactttacaattattaactcatttaaacttcaaatacacattatcaggtagatactattgttaagtccattttaaagatgataaaactgtggcatagagagaaggaatttgcccaaggtcactcagtaagtggtggaaacttaatgtgaacctaggccatctgacttcagagcctgcctgcttaataactataacatgcttttttccagactatctgtcataggcactagatataggaggtaaaggaaatcacatactactttcataaaaactccaaaagagcatgtctgaatcagtttagactgctataacaagaataccataaacggagtgacttaaacagcaaactttttattcttagagttctagaggctcaagagtccaagattaaggtgccggcagattccatgtctggtgagagcctgtttccaggtttgctcatttggtggagagagagagatattgaatctcacttgtaagtgcaccaatctcatctgaagctaattacttcccaaaggccccacctccaaataacataacattggagattacggcttcaacatatgaattttgagagaacactaatatttattccatagtaccacatatagtttaagtcaactgagaatggtgtacaaatgggaaagctctggttttccttgaacaagtacactttttagactttaagagtttacccattggtgaaggagaatgtctgggacaaaagtttttattattattattattacattttaagttctatggtacatgctcacaacgtgcaggtttgttacatatgtatacatgtgccatgttggtgtgctgcacccattaactcgtcatttacattaggtatatctcctaatgctatccctcccccatccctccaccccacaacagggcccagtgtgtgatgttccccttcctgtgtccaagtgttctcattgtttaattcccacctatgagtgagaacatgcggtgtttggttttttgtccttgcaatagattgctgagaatgatggtttccagcttcatccatgtcccgacaaaggatatgaactcattgttttttatggctgcataatattccatggtgtatatgtgccacattttcttaatccagtctatcattgttggacatttgggttggttccaagtctttgctattgtgaatagtgctgcagtaaacatacgtgtgcatgtgtctttatagcagcatgatttataatcctttgggtatatacccagcaatgggatggctgggtcaaatggtatttctagttctacatccttgaggaatcgccacactgtcttccacaatggttgaactagtttacagtcccaccaacagtgtaaaagtgttcctatttctcacatcctctccagcacctgttgtttcctgactttttaatgatcgccattctaactggtgtgagatggtatctcatggtggttttgatttgcatttctctgatggtcagtgatgatgagcattttttcatgtatctgttggctgcataccttcacacttgtccctgcacatcaaaaaatccctagagaagagggttatcagtggtttcagggagaaaggaagcttaccaaattttgaaaatttattggaagacacacttcctgatattaagtgactctctattttctggttctgtttcacattatgtcctatatcctaaaacatcactgttttgttgagaatacaaataactatacaaataaatatatattttctatatttatttattctgcatttataacattcatgtcatttaaatagcttaaataaatcccctactaggtgatttttgtctctctctaaataaaaatgttatatttaaataggttactaagaaaattttcagttttcctttctgaaataaatagttcgtcaacaccactttctgctgtcatcccttgccacattcctttgactgtataaactgtgatctgcaactttaatgacaatagtatctattttagtataaataaaaataggcaatgtctatcaagatgccccaggtaacatatatacatttcatttaaagttttttaaagggggaattaaaataaaaaaatatggatttgagtaacctttaatttatatgcatcatcaaatagtcattaagcatggtgtacaaagacatcaaaagtataat

SEQ ID NO: 8540 - DNA, 1630 bp, artificial
  synthetic oligonucleotide
tttaaggaaaattgttaaatattgtttaggcctgttttctcaacactaatttgagcaacgaagcttttcttgttagaacacctaatatcacgtggaagttctgtggggctttagtctaaggacagtgggaatgcctttcagctagagagtgaacagattattaagggttcattccaaagtacagtgatctcttctttgaactcctagaggcaaataacaatctatgccacatgaacatgattcaagcttaagtgtccactgttttcctaaataatgtatccgctccttaatgacaagaactgggtgtcatacttcttccaaaccttttactggacataatatttgttattggaataacattttgtctgaaagatgactgaattccaatacatgatttataaaggagcctgttatgtgaaattgctaatctaaggatccacagcaaatgagcataattggttttagagtatctgtgtcactttctcaggctggtacgtcttcattcctttgctactagctttctgttttcatttatctgtattatttttatttcatctccttaaagaaatacaacaatttggggatcaagcttttccacatttgatgatggcaatacttgaggagtcattgaagctatgtacacttccttatattcacacaagtcacattacacagcagttggtcattttattgttgtaattgttcctcagtttgttagagggaagcaggtgtctcacttgtcctgaatgtaataataatgacattgccaaaaaaaaaaaaaatgggtcacctgggacaatagtatttagggaaaagatctcaaataaaataataaagtataatttacttgataacgaataaaactgatgacctggtaggtagctacaattttctactgctgagttagtcagctgtgttgtttatattcctgtatcacaatccttaaagcccagaggagacacactccatgcaaaatgggaaaataagcattagagtcatgtagagagcctctagcagcctggacttaattttctgggtgatttttctattttgagtattcactatatatttatctttttttcctacaaaagttcttgtcaacttttatatctattcatctgggctctacgaaataagttaaaatggagcttattctctaagtggatgcccaagtgctattacaaagtatggcaggtttaacaaacaggcttaataaaagtggtttccactttgctttaataagtgaagagatcactcatgtccttgactagatggcagttctcctattcttactttgtagtttatactattatgttctatgtgctgataaaggttttactatttacattttgaataccagctttttaaataaaaaaaatcaaaatcctttttcctgggtttaataagagatgctcttatttaaccaatagcctatgtttctagaacttgcccatttaaaattgtattgccaattaggatttttcaaccctatctagtaaactcctacataacagtgcacttatttaaattctgagcaaaattcagatgctgttcagatgtaaaaatatattacaagattgaaattgatttccagttcatttaccattcatttttgtagcaaacgagttaa

SEQ ID NO: 8541 - DNA, 311 bp, artificial
  synthetic oligonucleotide
ttaaccagtggaaagaatataatatcaaaagtatacatactgtattctttcaactgtatgacattttagaagaggcaaaactatagagatggcaaaaagatcagtggtttccaagggttggggaagggaggaatgaataggcagagcacagaggaattttaaggcagtaaaactactctatgtgataccatagtgttggatatatgcccttatacatttgtttaaacccatggagtgggagatgttaatactagggagattatgcatgtgtacagacagggagtatatgggaagtctctgcactttctact

SEQ ID NO: 8542 - DNA, 503 bp, artificial
  synthetic oligonucleotide
ttttatgtaaatgactgctaaccctctcatcaatttccagtaaaatggcctcacttacctaaaagacatcttcacttggatgttttgttagctcaactcaacatatctaaaaattaaattgaatttgctttattcttttctcttcaattggctcactttcctattgttgttagtgttattaccatcctcagttagcaaaaaatctatttatttgagaatttttcctctcctacaattctcaaatatactcaaagtgcagttaatggttccatcagaaagacttacttatcaatagctgccttgacatcctgcccatcctttaagaccaagacaaaaacctcagctttttctggtatgtgctgaaattaatggcgtcaggatggctggtgaactccaaataaccacactgatagaatttattttttaaaaggtgatatagtatgaagttttttgaagaataaaataggcttatgcctgagaggaggaaaagagaaaaatcgtat

SEQ ID NO: 8543 - DNA, 1935 bp, artificial
  synthetic oligonucleotide
ttactataatgttaatgagaaaattgaggcaaataaatcaagcaaatgattcctagttactctatgtgggaaaataagaccatgactcattctcttgacttcaggctcaatttcatttccactagaatatacatacttacattcaaagtaaggggagacagaaaagcaaaagagaaacaagaaagagaagtaatgctattttaatttgaatatgcggtgactacttttgtcttttataactgctcctgtgtatctttacagatgataaccatattaccaattagtttttcttcaaaagagtcaacattccccaaactcctcttcttaatcaagcagtatccagataataataatgttagccagattttgagcattagtactatgcccatgcagaaaagtcttgggtctttggatgcaaatttatgaggaaatccttctatgagttttggttcatgattcatctgtgtgtgtaccctgactgtcagctgagtgaagcatcaattaacaatagcaattgttttgaagatttggcttagccagagcatgcagctatgaattttctggctctgacttttaccataacatctgaatttaaagtgatatgctacatgacactcaatgatatagaatttaagttgtctgagttattgctgatttcagataatatttttaaaattgtagatgtgagagcaatttcagatggaaactgaaatcagatgatttagaatatcattaaagagatacaaacagtggtcagagggggtaatacaaatatatcagtggaaagtgataaatgaaaatcttctttgtaaaataaatatatttcattaggcttttacaaataggccaatataaagtcagggagcatttttgtgtgtaattttatgagttttcttcattgttcaccttttagattttagtgttatatatttttaaaaataagcttcaaaggttaggaaagaatttctagaaaatatgttaatattacttactgaattatttttcattttgcttactaaagaggtttggggataaggagttaacttcagattaaaatagaaaacaataaaccttgactccactgaagataaataagaactctcagcagggaaaaacacaggataagtctatgaccattctatctgcaaatagtattaaaaccaaagtactacatttcatacagcaaaaatagaaaggcaattatattcaggtttactttaaaatatgagttctcatataaaatggatcaggcatcttatgtataacttcgacaaataaataataaaagaaaaacaaaagcccttcaatcagactactaaatgagaggagacttttttatataatgccaggatcacaatatgtgaaatttcctcaaagtttatctgagcactgattaatgaagtgcatggtatcttggaaagggaaactttttcaatatgctttgagagacacctagtggctgaaggtaattttgtcacgtacatatccttaatattatccaatctacatttgatatttgtatagtgtttttaatcctatgtttcagataggtatacattttaagaatgtctgttattttcagttgtaactctattggacttttcctcccaattatctttctaaatcctttaaggtatgatccaaaaggtgattcatggtcaactgtggcacctctgagtgttcctcgagatgctgttgctgtgtgccctcttggagacaaactctacgtggttggaggatatgacggacatacttatttgaacacagttgagtcatatgatgcacagagaaatgaatggaaagaggtattcgaattaaaatattcaaattactatatttcaggttttaaaaagaagatattaaattatatttttgaaattagttgtattctcttctctaggccctaacaagatcttttagtgaaatttatagtat

SEQ ID NO: 8544 - DNA, 799 bp, artificial
  synthetic oligonucleotide
ttactcttcatttgacattatattttaaaaatcataacacaacaaactctgttgtttcctttaaattattttacatattaaagaattttttaacaaaaaagataaaaccatgactctcaggcatggaataaacacatattaaagatctaatttaacctattaatgaaaaactggtaagatgttacaactaattcaaagaagaataaaacatacagacacatttatagatcaacagttttaaaatgaatagacaaatgggggcaaaactaacttctacaatggaaaaagaaattgaaatgcaatctttataagtcataattttcatgtttgtagataataattatttctattttatcagttatttataattgccacagttgtaatatagctgttgttgaatctgaatcagataagtcagaaagttgtactctttacaatatatcattttccactgaaacacattttttttcacatatcctttagaatttggactctagtttcaagatgtgactatttaaaaacagttttataatctttcctttagattgcttaagaattcaaagaaaaatttttagagtaccattgataatgacatacttacgtcatttgagggtttacatggtaattgcaaaaagtaaagaagtacaatgccatggtttttgaaaaatgtgcataatcaagctcaaaatgccactgtgtctcattataaagtaatgaattagggtgttttgggtcacctatgcatttgtttaataggaagtttcaaatgaagactataaaaatatttcaatatgtttat

SEQ ID NO: 8545 - DNA, 473 bp, artificial
  synthetic oligonucleotide
attttgaaaagctaaaacaaaaataaaaataggaaaaaatatatttcaaaaatgcaaacattatcggcattctgacttgtccttattttttttcaccttcatggacatttaaaaaaatttgaaataaaggcataaccaaatcaatgccataatgcaatctctacttatatagcttgtggttcatacaaaaatgtccttcccggtaatcataggaattgcctgagtatagttcaatttttaaaggtattagcatccttcaaattgacatcacttcaaaaaataaaaataaaaaagatttaagctaacacatttttccagtgtaatatatctatacattaaggcatcaacgtagcactaaggttcccaggcattaccggaactagtacagatggacatttcttgtcaatagctcacagaatgtcaacaagcccaaaactgcttatggtaataaagactctgagattgtggaaggt

SEQ ID NO: 8546 - DNA, 1227 bp, artificial
  synthetic oligonucleotide
ctccaaaaaacattttttgttgtttttgatgcaatcagcttttataaaatgtagcttcacttgcctagttgtgcccatccaaaacaaagtggaaagtaagagaaggaggaggaggaagaggaagacaaaaagaagccgaaggaggaagtagaaacaaaagagggagaaggagtaggagagcaataacagtagaagaaaagcagccaagttcttttttttttttttttttttgagacgtagtcttgctctgtcgcccaggctggagtgcagtggcgcgatgtctgctcactgcaaactccaccctccgggttcatgccattctcctgcctcagcctcctgagtagctgggactacaagcgaaaagcagccaagttgtaattgcttttcacttctgcgactggtattacccattataactacattcttctgtccctgtacagtaaggaagatttagacataacatgtgattataaattaaagaaagcaaattaaactttctaatcatgaactgcatgcttactccctatttgctcattcttatccaatgactcacagtatctgtaagattactttaaaaaaactatagttgaaaataatttaaaataaaacaccaaataatgaaatacaacattaaattgaacatgtctgaatattaatttggtgtcctacacaaacgtttaaataataattcgaagatttgaatgaggcacctcgtgtatgtaaaattcaacttcctcagtaaatcatctataaaatgtattatgttttctttaattagttttgtttgctgccatctttcataaaacaagaaatcctggtagggtaacttactagatattacttgtttaatacacagtgctcatatatgctaattttcatttgtgaaaacttaatgatcaatctctaataatgtcttgtggtaattcattttacggtacaatttaaataaacatggatgaatttttctaaacaaacctttgtctcatattgaataggtattttaattctctataggtacaaactaatcattttttcccatgaacataaaaatgtggtggcaaattaaagatttctgattatagagtttcattttgagaactaataattcttttaaatattaatagattatgttaattttttaattttagaaaaattgaaccaaggcactcattgtgtaagataaaaggacatcaaaatgtttttgttttctaatttttaaacaaatat

SEQ ID NO: 8547 - DNA, 1434 bp, artificial
  synthetic oligonucleotide
aggaagcccagaatatatcagtaaatggtcttgttgcacaaaaatctatcatatattaatatttataaataaagaaataagaacctactttagtctttttgtctcagaggacagttttattacattaaagatgattacaaagcaacgcaagtcagcatgaataatttgtttccttgtttattgctgaatttaaaaaaaataggggagtggcaaattaagtcaaaataattaaaagaaaggatgtacagaaataaatgtaatttaaatgttagaaatataaattaatactataaaggcattaaaattctgcctattttgatacttaattgaagataaaacatcacaaaccgtttgtattcaatttgtatggttatttttatcattgatatgactactacagtgacactaagcctcaggagtatttcatttgtaagtgaaattgcttaaataattattggtgctaatctacttccttctactctcttacctccctcactgaatctcaatcctatccttgctgattatgcaaaagtacatgagatatttctggtttatgtagtctgtctaaacatcacctcagaaatttatctgtaactattagatgtgcatgtgtttgatattgtacaatttggtgagataaagcttcaggactttcacgttacattgtacatggtgggaaacttgtctactgtttagatgtgagtgaatgtatttagctaaagatattcttttaaaaaatgtaaatttcataatgatgctaattaaaccaatgacaaagccatggggtctgtttggaattgtggtttcataatgtatacatgcgctggagcatatgaatatcaaagactagggaatatatctagaaatatatattgctaatgtgggataaattttgtggtatgaaatcatactgcaagcataacaagagataacgctaagagaaactgcccaatacttctgaagtgtaacataggcaatgaaattatctagttgtttcatggagacatattacaataatgtgagccctctcagttaaagagtaaaaatgtgtaggaagatgcagttttctgaaacttgtattatattttgatataagtgaaagaaaccatgaaagaatgaaaaagtataaactaggtatgtctcttactttagtctccaaaatgaaaaacagttttacttcaggcagaataattttctcagactactgagtactgtttgtattatctttagattgtgagagatgcaggtatatagtttattgtaacgctcaagtataaaaatatctcctgagtacattttaaggtaatatataaactgggaaacaggactacaacctcccctcagcagcaattctcatcataaatatcatttaagctgagtttctgactcaaataattgcttgcttgaaattttaactgtaatctggggctgaga

SEQ ID NO: 8548 - DNA, 8418 bp, artificial
  synthetic oligonucleotide
aaaatgggggaaaattttcattattttcagatgtggatttctgtcagtcttttcaacagactcaatttcttaggtaattttctggattgcttagttcaactagtagagtctccttggtctgtaagtaatgtttctaatctattcagatcatttcctattggactatacacctaaaactaaatgctctgctccatattatatatagaagaattcagattaactataaagtaaccatgtagctgaatttatgagttatataccctgaatagaaatctagagtctgttactctttagcgtcatggtcttgtgcaaatcacctgtcctctatgaatttcagtttcaggaattgcaaaatggaataataatattaacctcataagtctgtcatgataactttaaatactttaaacggtgacaaaatagttctcttctcctgcctagggattaaatggaaatcttcagaaatcaattaattggtatctaatgtggatgttatgaataattcttagtatttgaaagcactcccatagcatgcctgtgccacactgtccctggatcaatcagtgattttatttgcattgagttcctgccatctcccatgacacagtctcatccagtattgcaatccccaagagtcagagctgtaaccatttagcagcttctgatttcccctctcagacatttcctagctcccaagaagagtgcaatgcatgtgctggatactgtgaataatgaagggacggttacaggaggagcaaaatgtaatagcgaagtgtctcctcacacctgtgcaagtaaatatttctctgttttctttcatgcagacctgcattgagctgcggtgctgatgtttctcctagtagcatggctttcggtataaaaatatgcaaaaaagtgacgtgaggaatatttgaaccaaggttttaaccttcaaaatatcaggaatgggaaaggaggcagctaagaagatggagaaggatatactggggaaacaagtcataaggatttgcctttcagttaaaaaactttccctgaagcagctattagagaaaagcaacttattataattctgaaaatttttccttcttgatgttctatctctatgcagatgtcatctcctcttccattcagtagacaaaaaataaaaaatggatactgtgttattggtgctctgaaacattctctactttttctccttttatttcaggaaaaagagccacctcctttcaaataattgcacagcaccagaaagataagtttttctacaggataagcacggaaagtggattttccccataaaatcgtacacctttctggagagaggaatttagaaaattcacctggttaattttctggcgtctgggtaaatttaaggagttgttccttgaaacaagaataagagttgaccagctggggtggttttgatgttgttactactggttttttaatcacatgccaggaacgggggaattggcccctacttccttatatccacgacccttcgaaggcataaaccagccacattcctcctggtacctttagtggtccttggggacctggcacccggatgcccacccagccgtcgcccaccaggcagccagagctggctggcaagcaccaggcatgaggctccgggctggtttcctccctctcttgccccctttcctaccttggaaaagcgccgtccatgcccgcgacgctgcctggtctctggcagcaatgccacctgactcactcctgcttgctgtctggggtagccaaatgctaggtcgctagaacttctccttccctccttcacacacacacacacacacacacacacacacacacacacacagcccttcgctgctgtcagaggattaatctggaaaggcgatcgaagtaccagaccccgctcacagttgagtatgatatatgcggacagcctctcagctccaactgtgactttgccaggcttctgcccctactacccctagtctgccttaagtatcctttgtatgagaaaatggtgctgtgggatgcttgttctctagctggagtcggcagccagcggtatcacaagaaaaacacacaagaaaaatcaaacttctctgagaaaatgtgaatgggtgaaacttaaagggaagcctaagagaagagtgagcagaggaccgaggagaacattgtatgcccagggttttgctcaggaaagctagcagcccgaaagcggcgcgttttcttcagcagcgggtcccgcacgcgagagtgctgccagcacgctttctgcctccttctccaggaggcgagcagtaacttcctaagcttacctccatctctcccccgcccttcttgctggttctccgtcagcggggaggggccgcccccggatcgatgggggatgtgaggtgcagggagtggggaccagaggggggtactcagcagttggtgctgcgccatcccttcccagcaggcggcccggacactggttcacttctctccccacgccttcccctggttcaccccccttccttcccctttctccccctcggttaagtccctccccctcgccattcaaaagggctggctcggcactggctccttgcagtcggcgaactgtcggggcgggaggagccgtgagcagtagctgcactcagctgcccgcgcggcaaagaggaaggcaagccaaacagagtgcgcagagtggcagtgccagcggcgacacaggcagcacaggcagcccgggctgcctgaatagcctcagaaacaacctcagcgactccggctgctctgcggactgcgagctgtggcggtagagcccgctacagcagtcgcagtctccgtggagcgggcggaagccttttttctccctttcgtttacctcttcattctactctaaaggcatcgttattaggtaagtaaccggactgggtacctgtacagggtgctgtcagggaggcgtgaggtccacacttagtgcgcggacactgcccgctgcctgcccctgaggtctgaactatgacaacggggtggttttaaagacgcttctgctattctcccttcccccttctcttcccgggaggtaagagaaagagcaaaccccggaggtgagcgcagggagaatatctttttgcactaccaccgctgcgcttggttactttgggaaaactctcacttttgtcagaaatgtgtcggcgcatgaatttccccgacattggctgtgcaaaaaggtctctccctttaatgggtacagccagcttcagcgaggctgagggaaactctaagattggggcgggtgttgacaaaagagcacgtcccggactcccagactcgcccggctgagagattggagctgaggggcgatgcctctagctgagaaactacccctggcctccctgcgctcctctgggggctcgggtttggatccctgccaggctggctccaacccttgagggtacgacccttggcgcagagaggagagccaggagagccaggagcgcacagggttcccggtgctgtttctcttggcgctcgcctccccgcccttccttcccgccctatttttatggggctgtactcagccagcacctgctggatgtggagatggtaggtgtgagaaatactgcctattttttaaaaatcaacttataatctagccgaaaaacggcatcattttctcatttaaaaaaaatgacttttctaagagtattgccagacataaaagggttcctctttctctaaagaaatgacttgtaatcccttagccaaataaataaatcaataaaccgcccacctatcccataaataggtggtgttttctaagacagaacccagaaacagttcacgtcctcacaaaggaattctttttcttaaagcgcgtagcgataaaacggctcttttttttcgagaaaagtaatgtaccttttaaaagaggttcatcggaaaatgtgactttttaaaagcgagcagccgcaaacgggtgtattttttagactttagaagagcggagcggcagtccgcccgggttgcggctgggactcgcatctgagcgcttagtcgcaaaaggactgaggggtaggaggagaggtcactttctcagagtgtatagccagagccgcttccttgcctctcccagggaaagacttttagagcttaaccgaagatgggcccttttgcttcagaatgatttattccgcgttcctctgcttcacccgcctgcggcttagggtgtggggcgctaggctgctcatgtgaagcgcttacgggtgagccctagcctctccgatgcaaaatgtgggctgggggctgggaattgctatttgcgccactgcggcacacacccacaaagcaaaaaccgtggggaagaggggctaggacaaaagaaaaagaattaaagctcagcaacaaacaaaataaaaatttttaaagtgtccttttcttgtgtggaaacatcacaaaatgggatttaaacccagcctaggatctgtttgtacgaagaaaagtgtgtggaagaaactggttgaaaatccgggtagaagggggagggggggcagcaaagatggggaggaggcgatggtgtcatagcagtcgcctgtgcgctcttagcgctgcaaccaggaaacaacctgaggagcatgcagagaattccgaacgctgagcacacctgagaacatagaggtgctttgtgacttaaagcgacctaggccccctaaaaagtaaaacaggtgtgactcaaaatagaaaaggaaacggtacttgcgggcacccgcgcaacttggtaaagactgacggaattccacttttaatcttgtttgaaacaaactctcgcaatcccagcaggaaattccagcgccagggctggcctttcctctgtgggtctgtgtgtgtgtgtgtgcgcgtgtgtgtgtgtgtgtgtcgcggcggggctgggggtggggaagcaattcgaagcaagtcgaagtaatagtgtatgtacacgtttccccctttcttgcctttgtctggttcatcatagagagagcgcggaccgtgtgcgggcggtcttgacgaaagaaccgagagatggatgcgctaaggtctaaagatacctttctccctcgactaaattaagaattgccgcgacagttcccaaaagctgagtcccgctgcagctgccaggtcgccacactcgccaagcggcgagggagcgcctttgcctaccaggccggagaaccctgttcttcagtcgccttggcaggggcagcccctccttctggcaatgatgtcagctgcagagaggcttggcccggccgatgggaagccgagcggcgagtccgacccgcaagcacgagcagccctgccccgcgcgctccctgcgcgcagccgccctcgtgtcccttcggcctctcctgggtcccggctcgcagccccccccttccagtccctcgctcctcagaggcgcgctaaggcgccagaggcgggggtggccactgctggcggcccgccgccggttttaaacccggggttcaaacccagatttggggtcttccctcctccatttcctcctttcctccgcgccccagctctctccctttttcagcctgcaccttcactattcacagtgactttacttatttagcaacattttagagggcaagtgttccagatgcaataatagtagtaactggtgttaaatttctgctgttttctctcccctcgggtgataaaaaagatgtgaagaacggcctctttaaaaaaaaaccccgtggctgctgcttcgcctgtcacagagcaagctctctagaaggcggggagggtcatctttcccacaaaattgtgaggtgggggagggtttgtaaccttaggcgaaagcgcaggctggggaatccccttcacagaaagaagaaactgcaaattggaagttgcggaaaggctctatccactactgccataggggagagaccaccatgctctttatttagagacacgcgctccaaattgggatgatgcaggaataggtttctttaagacggaagcccgctgcggcttcccttttgagcttgctcttatagtcctaaggagcaagcccctgctttgccaaatttgaggctaatctgttttcctgattgcggacaattccttctttagctttggtagaagggccgcagaatgcagttggagaaggttgcacagggcaagagggaggggcagaggcagggcgtgtagaggcaactggcgcctggagcagaattaccttccaaaggaaaaaaccttcaaggggtgtcgcaacaaactgcttacttactgtgttttggtttggacgcaggtgagagatgtgggcaaagggagcagaagcaaagaattactctgttttgtaaaggtaggattcttcccccttccttttcttcttccctttgatgaaaagcttccctttcatgacgtatagctggcagcaaacttaaagttgctgtgcgtctgaaatacaggaatgggaaagaaactccgaccaagcataaaacacactcattttctagagctcagtcatttgctaagggttgaaataaactgtgcacccccactccctgccccttccccctggctccttggcctttttgtcaccggactggattctgaaggacgtccaggtaatgctgggtttcagcagctgaaagccctggcagaagggattgcaggtttcacattcttccttctcttggtattcaaaactttatttttttttttgcgagatagaaattcttgatagagagcttccagactgctggtggcagggaagaaatctggttaagagattcagaaagcagaaaattctttttctctgcgcaagcagtccacaacagcatttagctaggatttataagattcttggtggagcaaggggaggcacatcgacaaaggagagtttatataagccactggctttgagctacattgaaaaaatatgtatggcagccacgttttcttagtgggaaagaaaattattcagggaatgaaattttgaaggctaattctctccaagaatcttgcttcacataatttaaaggaggtgtcatccctgtatttgttcactgaagagtccacgaactttaattagtcacctactgtgccagacaatgtgataaatggtgtaattgaacataatggagagaggaattaatttttgttaagaggttgagaagaggttcataaaggagagagaggtctgtggctttaaaaatagtcattcctagtcagtggctagccaagaaatgtatctggaaggtcatgccctgtacagaataagtaaggaagggcatgagggcttgatgtcttgttacaaagtttagaggtatatgtgtgttttgtagacctagaacatctttgaatatttttttccagcaaattcgttaaagtaacaacaacaaaatagcctgagaaaattgggcaatagatagcacacagtagaaatattattgttgtttgcatttaaatgaagaattgaatacattgatgtattacagtagagagtggaagcaaatatgttaagaagataatgtaacatccagaaaagaggactaatgaaagaatagggcctaaagctaatcagtataactaagaaagaaaagaaggctactttggggaataaaatttctctttaggcatcatcatctatccactcagatctttttactcatctcagtttccccatccagccttcgaaaaattccccatcttccatctatcgagtaaactccgtttgtcctggggagacccccactccttcagccactttcaagcacattcatcttcacctcaccccattttctacacacatccctgcatcatctctgaaccttacatcatgtaacattttacccacttcagccttctttctacaaccagttagagcctcttaatcttgtctttttcctccctttaggcactaacaaatagctctatctcgcttctttttcctcctctaagtcagctattccccgcccctttcccatgcattaattatcctgctaatttgtccactcatttcccccttttacatcctcctccccattagccaccttgcattctcctatctttcattgacctcaaagaagctaaggggaaagaaaagccactctactttaaacttgcttagatttgccaaattttcgtcatcaaggtttcttcctttctgtgtcttttgctgttttagttcacacaagacttttagtggaattccttcaatttgttatatatttttattatgcctgcaaatgtctgttttcctttggttgtggctggggattcaaatattttactttggggagtatttccaacctttctgaagttctcactgacacactcctgacactgtttcgctgcatcccatcctttctgctgtattctcttcccatgggtaattccttttatattttcagtgaaattctttcttatttttattccctcctc

SEQ ID NO: 8549 - DNA, 1108 bp, artificial
  synthetic oligonucleotide
cttgtgaacagacagcatttgatctaacatagttattggtctattaatttttttgtgttcttttctaccagagccatgtattcctactgcatagtatacatttttagagtaaattcttttaagaaataatttgaacgtctttaattttcagagaaaattttaggtgtagtttttttaattgcataactattttgaaactactatatagataaattttgaaattttagtaatgtggtgaaaaaattcaatgagaaagaatatccttgattcagaagctactgaagacaaataagtaaagttggaaactgttaaaggactaaaagggcagaaaaattgtcaatatcattttcttatctcttctagatatagctgacttgataaactgattattaaaagtaacaagttcacaataactgaaaaacccaagttcattttgaaccaaagattatggttaaaataccaatgccaaatttaccaaaataattacattttgcatactggataatcattatatatatagttggtacaaattaatccttagttatctatatcttagatgtctacttctgtgcctctgtgaagtaggaggtagtctaattatttccatggtatgaatatagaaattgagacttgcctaaatgtacaaagacagtaaatggccccatcagggatcacactcacatctttttcacttcacagtccagatttttaaccagaatgcgaaatataaatgtatttttgtttatattttgaaatatcatttaactatattaataattactatgcacataaacttttcaatttctttttagataaatgtttcatattatatccatttctcagctttattaactgtgttaggagtgcagaacaccgtgccttgaggaaacataaaagtacatcagttaaactgaatattaaggtttttcttctttcttctggacagcttaattgtaggagaaatattctacctataaaattgcctgtcgttaacaattcagttacagcctggtgaatgtgaacacacacactttaagtgtctaatttaaaactagattttctcctttgataattctacttttgttgtagattatataatgagtttaag

SEQ ID NO: 8550 - DNA, 107 bp, artificial
  synthetic oligonucleotide
aagtgtctttcaatttcccagtgcaggtagatgtcactggaggaaggaaaatattgagtctaatttaattaaataacgcagaacttaattttcttaattatttttga

SEQ ID NO: 8551 - DNA, 494 bp, artificial
  synthetic oligonucleotide
cccacaatcacagtaaactttgaaggtaacctgatttttttttcatagccttcacatgatacccggaaagtagtaggcaatcagtgtatacctgttgcatgaatagaggaaaacacagtatagctgaaggaacacccgagcagacgtaaggaaatattaatcctagctttaactctattgttgaatgaccatgtagtatatgcaaaattgtttccacttcatgaacttcagtttgctttaatgtagaattagagtagtcaacattatgaaatttatttcatgctacttccaacaatatataaccatataatactgaaaatatcattttaaatgtttgaataaaggcatttataattgcttctacagcaggcctcattcctgttagctgcttatattaaatgtttcaaaaaagaaggaaggaagggaggaaggaaggaaggaaggaaggaaggaaggaaggaaggaaggaaggacagacatcaagtacaaacaaa

SEQ ID NO: 8552 - DNA, 4027 bp, artificial
  synthetic oligonucleotide
aattaagaaaataaataaagcacagtacctcaagcaacagtaatagttattattttccaagctcacaaaagtagttagtggcagagttagaaaccagatctcctggtttatgtgagaatttcttttgtatatttttctctttttaagcaaagtatgtcctaatcaacagaggtgcttcaatatctgcaggaaaagtcttaaattgaaatagatcaatttttgattcagttgcatcatccttagaatttttattttggggaacaagtatgagagcaaaacattaacaatcaaaaactattcttcatcttcaggtatcgaaaggttatttggatgcaaaattcagactactacaaaatattctttggggaatattaaaacacacacacaatttgtacccttatgtagggacagaaaggggaggggatgatccctttcctcctcatcgtaagtgccttggccaacaccccaataacaaaagacagtttaacaagagaaaagcataacagatttatttgattatagttttatgttacatggtaaccttcagaatgaagattcaaagatacagggaaaaatatccatttctatgcttagattcagtgaagaatgggcagctatgtagaactttgattgggcaaaaagggtataatttaatgttaatagatcgagtagagaaatctagcaaggcctatctgttcaaattcttcttgtcctgtctatgctattttccttccttttaggtatggagctgactgtctctggaatggggtgctatgacccataatcaaacaaggtagtatagcgaatttctttacggccagttcttattggaattaaaattcaagtattagttcctactggctgtaaagaaaagcaggagaaagttacagtaaaattaaactgcttaaagaaaagcaggaaaaagagtaatatttttaggtttaatgactagctttggggaagatgtttgggttattttggccccctttggagaagagggattatagtttctatgggtagtctagcctcagggagaatgaggctgccagacgggagggcaggagaacaccagagagagacattgcttctgagactgcatctggaggctttccgtgtatgctatccttttctgagtcccaatgcttacaattttttgattctgagctttaatcatggaagagcataaaaagttttagagataaagaggcagatggactctcaagtggcttgtttacttggtttgttttttaaattaatccttagaagaaattttgaagcagataaggaaatacccacattaatttttactgtgattataatttcagggcacacgtacttttagtaattaacagataaagtatacattctgagcattagcaagtttgccagtcattgtatatcattgtctcgtaactcacacactgtgacccagctgtaatagcaaatttcctctaaggagtgcacttatagtgtctgcatctgaatttcactccttgcctttccctgagcttccttcaacctcttttatttcattgccaaatgtaacaactgatctccacattgatcctataaaatatactagttttaactccctttttctgttttctatttttttttcctggcattgcttagtgtttcaagatctataaacttaacgcaaatttcagtacgttctagtcattaatatccacccaaatttcttttcattttagaaatatattttctgagatagatgtgacaatgttcctggttatgcctaataatcctaaagctgttgggtttcctggcaaatattattctattttcttaaagttttcaactaagaaatttgtgccttttgttcctgcaaataaaatctccttgtaattagtatgttttatctcccaaacttaaataacattgctgcagccctttacaaaatgttatctacaattcaatttgttatatttctgtgtttctattttccttagggacagaaacagatttgtaagtttttgtgggttttaacgagtaaaaccattagagtttcatgtttgtttttataatttcatagatactataatgtagtcactataaagatatactaggagcctattgaaaaattctgcaaaccattaaaatttagaaaactaaacaatcatatccatttaataatgaacatgaggaacattgctctatcaaaaaatgcaaaatagttgtatatattttatgaaaaagactatatctttgaaagtgaaacatgtatgcattaagtagtgataataagacaattttaagattaacaataaaatgaaatagaaattcatggaaaacagacagcaaaaactgtgttatacctgttactgaaagatcatcaattccttcaagtttctatttttgtgttcacagtgtttaagggaaggtagtcttaccaacaatgcagccaaaacatgttgatctgcatttttgtttttggatgtctactagttagttggacattgaaacttgtgttaaaacacctaacagattgtattctattacgctggactactcaagcaataaatgtatactgattaattgaatgacttagtgatctgaaagaagatagtgatgttttccatgttctctgacatatacttacacagtaatttaagtcctgacaagacagagaaaatgagtgcctaagtcttggaggttaagaccacagtgtatccctaaggtctgcccatgtcatgacatctacattcaaatttttcagtaagaattctacatttgtttcctctcctttgaattcagcttctcttttggggaggcagtagaacatacttggtgctttaaacgtatgggctttggaaacagtcaaacccgggtttcaatcttagtttagtccttactaactatacaacaatgggcaaactagttaattgctttaagtctcacagttttctcattggtaaaatgtagatgatactaccatacctgatgcatagggcttttggaaagactaagttcaataatgcatgtgaagtaattaagccaatgctgacagccaaagctgtaaaagggcagctgatattattacttgaaaaaaaatttttgatgtgaaagaaaggacattatctaggccacttgcactatttatcttcaaacagtagcaaaaccctttttctcccactgaaaagtggtgattaactttttcactatgtgagaccttgtctttccttatagacatcacaccaaaaacaattaatcatattttcaagtgtgcattgtataggctaagagatccaaagatactcaaagagtatttctttcctccaacaaacctatgtcttagattgggagaaaagattcacattaaaaatcgcaaatctcctttcaattaagtactaaattatgcactacagactttaggtaccctaagagtttaagaccagtgagaatgatgtggtctacagtactcagtaaacactttggaaaaggtgagatttgaactggacatttagaaattggtctgacttggatgggagaaaatagggagaatattcttttgggctgctaagtggggaaattgtcaacagcatgagtgaaggcatagcagggaaaacaaagatggcatttaagggggtaggagtatcaatcaaattataaggacaacatgcagtagtcatgaggtctcccctcattttgccaaggtctcatctttctcctcagacaatttatgaagatgattgagtggtgggattgcttgacacagaagagtttaaatttgttttcatccctgctaagtgattctgaaatataaatgccaacgcctagagagttgagttttcaacttactatgtgattccataagggaaccattaataatgccagaatgcattaacagcctagagagaagaaaaactctagacttaaaactttcatgacagcacctgaaataaatcagctaatatcaaaagagtggcagaggtgacatgagttttttctgggaataattataacttttccaattttatattgtcattaggcattcaggccattgaca

SEQ ID NO: 8553 - DNA, 2611 bp, artificial
  synthetic oligonucleotide
aattataactgtaaaattttcatgtaaattgtactgacacacgcccagtagtgtttgttgtgcaggtttattaagtacagtcatgtgtcatttaatgatggagatactttctgagcaacgcattgttaggtgatttccttgttatgagaacatcatagaatgtccttacacaaatctggaaggtatagcttactacacacctaagctgtattatatagcctaatgttctttggttacaaatctgtacagcatgttaatgtatatatttgtaacctgtagacacatataatatgatggtaagtatttatatatctaagcctagaaaaagtacagtaaaaatacggtataaaaaggaagaaatggtacactcatatagggcaattaccatgaatgagcttgcaggcctggaagttgctctgggtgagtgagtgatgaacgaatgtgaaggcctaggacactactgtacactactgtagactttatcaacactgtacacttaggatacactaaatcgaaggaagtctatttttctttcttcaataataaatgaaccttagcctattgtaaattttttactttatacattttgtaatttttaaatattttgaactcttttgtaataacacttagtttaaaacacaaagatatcgtacaggggcacaaaaatattttatttctttttattctcattctatagactttttctgtttttaacattttgattttttaaactgttttgttaaaaaataaaacacaaacacatatgttcagctaggcctacacccagtcaggatcatcaatatcacatcttgtctcactggaagatcttcagaggcaatagtatgcatgaagctgtcatctcttatgataacaatgccgtcttctgaaacacctcctgaaggacatgcctgagactcttctacaactaatttcttttccaaagtaggagtacactctaaaataatgataaaaattgtaatatagtaaatacataaactagtaacataattgttaattattattatcaagtcttatgtactgtacataattgtatatgctatgcttttatatgactggcagtgcaataggtttgttgacaccagcatcaccacaaacacgagtaatgcattgcactacaacattatgatggctacgaagtcactaggcagtaagaatttttcagctccattataatcttatggaaccacagtcatatatgtaatctgtcgctgaccaaaacattgagcggcacagggctgcatatcaacatagagcactggattgttttttgcaagttttgtgggatatctaaaacattgatatacaggatcaaggttaataacataaataggtcagtaagattgttttctagtctgtgaagatttaaaagtacaatgtttgaagaccagatgaagttaatattactatgcaagcctctacaggtttggatttcaatatgtttaaatttgaacgcttaacaatatgttatgatttgagtttccatttcatttatttccctttcaagttctagcatgaattttaagaatcttcatcaatgtccctgtgaagtaaatgccacaagaaaagtgcaatcaatatgtgcacctcccagagggccctaagcaagttgaaacactaaacaactttcaaatctttaaacttttacagatgctcatagacgcactgtaatattagccacatactctatgtcttattaagatattctgtaacatgtgctatttactcctgccagatctatatagcataaagtgcactggaggattggcatctatccattaaattttaatcaacacagagacagtttagatatttaaaaccttcttttatttacagctggtttttaaaattattgttgtttcttttgtttgctagctagattgcttgcttgcttatttattgactggagccatgtgaataattttggaagtcccatctcacttctctggcctcagaaaagtgaccttaaaccataacatccttgatagaaatgatagaaatgatcaaattatttaagttttttttgttttggagacagaatctcactccttcacccaagctggagtgcagtgatccaatcacagcttaccatagccttgatctcctgtgctcaaacgatcctcaacatcatcctcttgaatagctgagactacaggtgtatgccatgatgctgggctgatttctgtattttatgtagagatggggtcccaccatgttgcccaggctggtcctgaactcttgggctcaagggatctgccctccttggcctcccaaagtgctgggattacaggggtgagccaccacccctggcctgaattatttaatcttagagcattgttcttcacttattgcggctgtatgtttttaactgaaaccatatgaagagttgggaaattactcaattaatacaagtataatgaccaaaacaagaatatatttcatttttatatttttattcagatggacttggcaaatgaattcaacatgaatattacattaatagaacaaattatcagtgctcttctgaagtcaaggcaagtattcaaccccatatgctttaaccatcacattttctgaacaatctttgtgccgg

SEQ ID NO: 8554 - DNA, 933 bp, artificial
  synthetic oligonucleotide
tattaattttcacctagatcttcacctttaaagttttcaaaactcctattttgtttcaaaacatcatgagttgtttcatgtgtcattactgtgtgttctgagtatctgtttatacgtgtgtactgggatatgtgtccgggcatttacgtttttttttgtttttttttttttttttttttgtagaatgtgaatctgcaagtcattttatgcatatctcctgggggtttaaaaataaatctcttctttctgctaagtcaagttgtaaatatctcgtttagtctgctactacagtaactcatgaaaagagaaagattgcttttcaatattttacctctgtcctcattttatgtcagtgactgctgattatatgtagtattagtgaaacagaaatcagcatggagcacttaagttgcttttcaaataaagttcttctttcagcgtttagtttcccagaaggcttttaatcaaggttatgggaaagtccataaactttctgctgaatatttaacaagctggaggtcactgcaaatgtgttttttcaagggcaagggaaatgagattgcaatcaggaaaatagaagacctgataataagcaaagctttgtcttctggataaaatctaacaagaaaatcaaagtgactcacattttcaagtttccttgtaggatttaaaaattttcctagtttggatcatcattttcaaaatggtaaataggactgagtaattcatttgagtccaattactatcttatctttaagaagatggttggaatgagttctgcaaaatggtgatagcggcagaatataagaagacgtcactgaagttccactgtttaatattaaaagcataattcttttggataaaagaaattttataaaatttacaaatgtcatgtgattactatatattttgtaaatgacctagcccaccctc

SEQ ID NO: 8555 - DNA, 991 bp, artificial
  synthetic oligonucleotide
gttctccacagtagatatccaatatgtttcaccacatggaaaatgtcttttcttgtttattcctaaaatctgtagccaaattcccatatgtctggtttatccattgatacttgaaaatgtaaaactaagtaattctgtggataacaattatgcatgaacattgccattaaacagtaaattttaaaataatttatatttaaactaaaataataatcatatatctttcaatatcaagcaaacggatttgattttattccattcctttgttataatggaaaacaaattttctaatacatttatttttcattttttctttgatatgatttccctaatagttaaaacaatagcattattcagagactgtatttttagatgtggcctatgatttcaaggatccctcctttccccatgtgttacaatacaacatataaataaccagttggttccaagactaaaaatttctgccaaagcttgtgttcatacagttacaaagtcccaataagatatatattagagagaaaaaatataaatatagaaaataaatcaaagtctccaattctttgaaaatgccagcatggtactactgttaagctgtcagtaattcactgtgattacaagaaatcacaacttcagtccatgctaatatcacatgtgagattatgaaaacatatttataaagagaattatcaagtcagcttgcacttccaaaaccatactttcgtttcaattatttcatctccttaaatattttatatgtaaatattaagatctatataataaaataatcaatttatttggagttttataagttgtccatccagatgcatctctctaaactgatgtattaggaggaaaaatactgtcaatgaataaacatcactatctttctcattttgtagcacattttaaagtgaaagtaatagaacattactttgggggaacaatgcaatatttatgatagtgaacattattgaaataagttcaaattttt

SEQ ID NO: 8556 - DNA, 1150 bp, artificial
  synthetic oligonucleotide
agctcatgattctagaaccaaatatttctacttttattccacaagaagttttgtgtgtttgctgatctattgttaatttttcctcttcttttatcttgggctttaattggatcttaactggactttggcagtcaataaataaagaagagtacagcagtttatcagtttgggtatcctatgcttggtattcttcctggaatgtagaagttactgctctccattagacaaaggaataagtcaatactcaggttgaaaagaaagctcagtatttgactttataaacaaagttcttttttaacacagaaagagaaattctaatagaaatcatctgaatgattagtcttaatcattggaaaacacacaaagcaatattgccttgccaactgctaaagtacttagtacctaatgttttcatttattttaggagaaaattattctaaaacaaaaataaaggctgataatatttttgcactaacattttaaccattttataattctgcaaataattatgaattatatttcttttaatacattttcatcaaccactatttttaacctactagaaagttttaaaagaaaaatgaatttccaagcattaatgtgtttagctagaggcataattttctgtaacttgttgacaagataattgcatcagttgttgaatctttctgcttctgttttctgaatgtttcaatgtattcatttaggtattccaaagataaaatatttttaaataactttgattttatcagaaacagtgataaatttaaattccatggctcttttaaactattagaaactacttatatattaataaaaaatgtcaaaagatgtaggttcttgagttgcttcaaaaataagacactaaacttaaaaaagaattttactttacagtatattctaaagaacctctattgcttctatcaaacaaactaactacatttgaatctaccgtattaatttaccaataataataccattttttcagtattttcacttttatcttgataatttcaagaatcttcattttgattactacattaaatatgatatagtagttagtaaataataacaattaagtaattattaaacaataggcctttattattactattaatgggaatagaaaaaatctcaaattatcaaaaat

SEQ ID NO: 8557 - DNA, 421 bp, artificial
  synthetic oligonucleotide
aatggcagctttaactctaagattgtatagagattttacatcaagaactatgattatcatattattttcctattaagtcagtgggttgtctttgtgttaataagaagagccaacataaaaactttacccataatgactgcttacctttaataaaaaaattcaatttgctttgtgtaagaactaggagcagtgttaaataccctatgtgttgtcagagtaaataaaatcttggcttcatcattagtgatgggaaaatggctgattagaaatttccatgcagaattcactggcatttctctaattctgaacattcattgtatatgtctgtgacaaatgctgttgctgattagcttgtatgtaggaaatgagttaacaaactgcattaaagcatccaggaaaaaatcataatagaggagggaaa

SEQ ID NO: 8558 - DNA, 1433 bp, artificial
  synthetic oligonucleotide
caattaaccttgagcagctgattataattttataccttttttcggattcttggtatcttgtgatgcagtacccacctattagaaatggacaagctgctagatcagtggtgttcaacataggttgtatatgggaatcactgggtgaagtcctacaagcactatgtctcagaccgagccttagagattctagtttatggtgtattctggacattaggattttttaaaatcactttagatgtttctgaagtgcagatgaggttgggaaccatctgggcaccaaagatattgcttaatccagagattctcaaactgtaatgtgcatatgaatcacctgaggaaaactgtgaaaatatagattctgattcattatatgggaaattaggccctgcatttttcacatgcccccagatgatgatgatgctggttgttgagggctacactttgggtagcaagagccaagatcatcgcttttccatttatagaaagtgataatattagtaaagcacagtgaagactgtatataagactgctcttaacaaggaacaggggctctggttggtctgcggacttcaatggctctggctacctcaggcactacccacttatcccacgaccaggatcaagggaaatgatgtcctggctcatctgtgacccattttcctgaacatcactggcacattagttgcatatctttgcctcagacccacaatttcattaccaatatccaatacccatagataagacaaataccagaattacatacatagaagaatatacacactatgtgtgcattgccaaaagggatgcaggttatcatcaggtagctctgtccataagtaaggatatttaggctactcaagagctaaagaaccatagtcagcgtaaacaaacacaagaggaaaagatcaaaggaaatttgaaaaagttgctgaattcaaacaattgccccttaagctggcttcccagtactgttgaaaccagtttgtgatctccatttagaaacctaccttatttaaaaatacccagctatttagagaccagcacaaaagagctaaccaggaaagaaaaaactttagcaactctgcatctttgaaaggttcaccaatatgtgtatactctggagctagaagagagatgtaaatggttatactattgtttgcagcatgtacacagtggaatttattttattacttgttaactctcacagtttaaagtgtggttcaacatgatggagaaggaaaaatgttttactatatagttaataagtttttccaactaattgcctataaatattttgcttactttatttttctgaaagggaaaattaaattactgctgccgccaacagggtattttaattttcatttgaacaagatacaggtgaaatgctacagataaaatttaaaataaacagtgactcattctaggagtta

SEQ ID NO: 8559 - DNA, 390 bp, artificial
  synthetic oligonucleotide
acaatttagcacaaaaacccttcagtatggatatttgagtgagggtattaacccaagacagaacaactatgtattattctcagcctaatcacaagtaagagacaaagcttggactcaaacaaaagcgatataggctttttttttttcacttacagattttaatgtaatacagagttattatctcagagttaaacatttgaagttggattagtcacaccttctctgtctcatcaagataagtgggcccagtgcctatggtatctctgctaagaagcaaccactttgcattttacacagtagaatcagagccagccttccacgaaaaattaaaaaatgttattgactgcacagccccctccccttttttttgatagacttccttttaacctt

SEQ ID NO: 8560 - DNA, 301 bp, artificial
  synthetic oligonucleotide
atttgttttcatattcaagaatttttttacgcttttgaagtgaaataacctaatttacaataaagagaaaaagacattgaactttgagtggtgaagtttgatacatgtctctttatgatacaaattgccataagacaaaatttatcatggtttgtaaccaatgagaaatttcaaaagggtggtataatctgtaatgagaataaagatattaagggtcaatataatataagcaatagattttatgggtgccataataactttttttttcacagtactccttattaggtaaaatataattttg

SEQ ID NO: 8561 - DNA, 422 bp, artificial
  synthetic oligonucleotide
ttatttaaaagtcaagatatttttcccagtacagtttatctttgcaatcaagcaacaagtatctaataaggttaaaataatgagattcaacctatttttctaatgaataaatcacaaaaaactatgtcaaaattagacctattcaggcaatggtatcagtcatttgttatttttttctgaaaggtcttaatgagagggtaactggtaattggacaattgctattggaataagttggcaggcagtaccatttgggagttacagacttatttcctaaagtggagactatttcatgcatttttgtcctttacccttaaacctttctctgagttaacactgatgattacagaaatgatttgtttcattgaagacttctcccagagaggtcaaaagctgatcactcaaatagccttgagaaaccttc

SEQ ID NO: 8562 - DNA, 755 bp, artificial
  synthetic oligonucleotide
tccgcaggtgtgacaaccaaaattgtctccaactttgccaaatgtcccttgtagggcaaaaccgcccatgattaaaactgcaggcataagctaatgcaagagcagagactttatgagtgtcatttattagcaaactgaactgatgggcttagcctttgatttcttaacattcagactatatcatatacttgtatatgcatatgatttaatgattgtacaatctttttgaagtagtatagttaataaaatgaagtgttttttaaaaaatagaaaactggttctattgcaattctaaaatatttgctaattctaagctaataacatactttgttctgttatctttcagttagctatacttttattctaggtagctattttacaaataccattgaataggtgatttgatggaaatttacacacacatatacacatccatatccccatttgaaaaaatgttcaaggtgtatgatatatagaagttgcattttaattcacccagacgagatagttaaaagaacactccaggggtgggctcactatagtgtaaaaggaaggtactttgttttcattataataattatgcatatttaatatcaagtttccttaaggggtatataaaatataacaatttgagatgggatggggcaagataacttactaccaaccaaataaaataaaataaaaggatgagtcataatcgcattgccttctcttaatcatactataggttacactgcaaatatcagtatcgcctt

SEQ ID NO: 8563 - DNA, 3095 bp, artificial
  synthetic oligonucleotide
aaactggaaacaacccaaatgtccttaatttggtgatggactgcataaattatgatacatccatataataaaataacatacagctattaataatagaaagctgtatttacatgtaaatggaaggatatttaagatacatttttaatttaaaaaggaagatgtaaaacaaggtgtagagtatgcttccattatggttagaataaatgaagatacacacagatatcattgtatatgcatagaatatttctggaagaatacctaaaaaattgctaatataaattatacctgagaaacaggacagaaagcatgagaattagggttgggatgctcatttttcactgtaacttttagactattagagtacttgccatgtgcattaattatcccaaagaaaagtaaaattagaaacaaaagaacataatgtaattttcactacataaaaatgtacagtagaagaaatgcccactttttgatgggattgtttatgtttttcttgttgactcatctgagttccttgtagactctggatattagtcctttatcggatgaatagtttgcaaagattttcccccattctgtgggttgtccgtttattctgctgattacttcttttgctgtgcagaagtttttttagtataattaagttccatctatttatctttgtgttacatttgcttttaggttcttgatcacgaagcctttgcctaagccaatgtctagaagggttttcctgatgttatcttctagaatttttatggttttaggtcttaggttaaagtctttgatccatcttgaattgatttttgtatagggtgagagatgaggatccagtttcattcttctacacatggattgccagttatcccagcatcatttgtcgagtagaatgtccttttcctactttatatttttgtttgctttcttgaagatcagttggctgtaatatttggatttacttctgagttttctattctcagctccattggtctatgtgcctatttttatgccagtgctatgctgttttggtgactatatccttgtagtctagtttgaagtcaggtaatgtggtgcctccagatttgttctttttgctcagtcttgctttggctatgcaggctgttttttggttccatatgaattttagtattatttttactaattctatgaagaatgatgatggtattttcatgggaattgcattgagtttgtagattgcttcttgcagtatcatcattttcacaatattgattctacccatctatgagcatatgatgtgttttcatttctttgtgttatctatgattcctttcagaagggttttatagttttccttgtagaggtcttttacctccttggttaggtatattcctaagtattttttgagctgttgtaaaaggggttgagtttttgattcgattctcattttggtcactgtgggtgtacagcagtgctactgatttgtgtacattgattttttgtcctgaaactttactgaattcatttatcagttctaaaagtgggctaaggacatgaatagaaaattctcaaaagaaaatatgcaatggccaacaaacgtatgaaaaatgttcaatgtcactgattatcagggaaatgcaaatcaaaaccaaaatgtgataccaccttactcgtgcaaaaatggccttaatgaaaaaaataaaaaataatagatgttggcatggatgtggtgaaagggaacacttttacacttctggtgggaatgcaaactagtacaaccactatggaaaacagtgtggagtttccttaaagaactaaaattagatctgccatttgatccagcaatcccactactggggatctacccagaggaaaagaagtcattatatgaaaacgacacttgcacacacgtttatagcagcacaattcacaattgcaaaaatatggaaccagcccaaacacccaacaatcaacaagtggaaaatgaaaatgttatatacacacacacaccatggaatactactcaaccataaaaaggaacaaaataatggcacagcaacctggatggagctggagaccattattctagatgaattaaatcaggaatcgaaaaccaaccatcatatgttctcacttataagtggagataagctatgaggacacaaaggcataagaatgatacaacggactttggggacattgagggaagagagagagggaagcaagggatataagactacacattgggtacagtgtaggttgctcatgggatgggtgtaccaaaatctcagaaatcaccactaaagaacatatccatgtaaccaaacacaacctgttccccaaaaacctattggaattaaaataaataaataaataaataaaaatgtacactggaagaaataaatagttaaccaaattctttcagcacacacatcttagtataatctgggaataaatctgacaatttttacatcatttgagaatgtagtatagggctcccataatgcctagtttcttgctattcctgttctgcattatactttttcaagagtctgtccttcagtaacaatttactgagagatacagaacagattggattttaggtaaaattatgaagaaaccctaattaatctttaataaaatcttctcccctcttcacttctgtacagcttcacccaaggcctgcatgcacacctgtatcttgacttctaaaagaactcccatacaatatcttcccagaggttttgcaggagaggacaaatagtgtgtttcatatcctactaatgattaagtcagttttagtcatttgaggtccattaaaataaatggtataacctcaccccccataggcaaaattaaaaattaaagactaatatttagaagacaagaaatagaaataatccaactgtgtttaattatgtgcggcttgaataaataaataaaaataaaaacaaaaaagaggaaaataactcttcttcaataattttcatgagtaatccttttaaatcaatgtaaatttttttattttctattttttcttctttgaataaattacaaatctgtgcaaaaaaaaaaaaaaaaaaaaaaacacagtcccttctcagagtcagcatttatgc

SEQ ID NO: 8564 - DNA, 554 bp, artificial
  synthetic oligonucleotide
tttacacttcatcattaaggaaaaaatttagtactttcttttagcctaagttgggtgaatcatgtagcctctctgaacttctgtagcagtatttgtaaattggagatcacaacaacaataacaataataacacctcactggcatattttgatggttaccgacaaaaattctttgcttggtcagattctagtcaggcttctgcacctttacctaggcccatctgtacttcctcataaaatccagttttagcaaaaaaacccttctaagccagcttagcaagaacccctcaccttcaatttctgatcaccctgataactgatccagttcctcatcctccaccgtcccttaggtgatgtctgatctccctggcctgtcttcagcaaaagtcctgttaggttggtttagccagaatcccccttacctctgatgcttccttgtagtaattttccattcactgaccccctccctgcaccttggctataaattctcacttacccatgctgtattcagagttgagcccaatctctctcccctaccgcaagaccccattcaag

SEQ ID NO: 8565 - DNA, 10958 bp, artificial
  synthetic oligonucleotide
tgattggttgatgctacggtctgaatgtttatgccctcctaaaattcatatgttgaaagctagtcacaatgtgatagcattggaaagtgaggccttgaggagttgattaaatcatcagggcaaagtcctcatgaatggaattagttcccttataaaaatagacccaaaagattttatttgccccttctaccacgtgaggacatagcaagaaggcatccatcatccatgaaccaggaaaagggccctcacaagacactgaatctgctgataccttgatcttcccaacctcaagaacggtaagaaataaatttctgttgtttatacatcgtcactcagcctatgatattttgttacaggaacctgaacagactaagtcaatctttgtttggttgttattaatgaactaccaaaagctttttctgatattaacaaaaatgcttttaggattttattattgagtataatgctgactttggatttaaaatagctaatagtttttcttcattgtgttaagaaaaaaaatctttatatctctcttactcagacattttatcaggaatcaatattgaattacattaactatcttgtaatgattaaaaatgttgtctcttgatctattaatatgactaatcattttattacttaatactcaaccatccttgcattcttaagataaattgtaattattagtgatatgacatccttccaatctatttctagacttttttcaatagtctgttatataggattatttgcctcaacattcagaagtataatcaatctgttcaatattttctgatatttttgtcaggttttatccaaattatactatattaatgatatgaatagggaatctttcccttttattcaaggctctgaaatagtttctatagaaaataaatgatttgtacctgaaatatggaagatattccaatttaaaactattggggtaaagtgacttttttttttacaatgaaatctttgacagttcttgtggtttcttctatcgtcactgaattcttcgtttttctacatgttgagacaatttttgccatttgcgctttctggcccagaaaatcaataccctgagtttttcaaatctataagcagatagttgtataaagaagtctgttattttcaagagtggttctgtctcgttttacatgattttgtattgttaatatcacatattttatttctctttcttttgcttttttcttacactcttttttcttaattagattttccagggaggtttccttcttccaccttaattattagcccttgaatttattttattaattatatgtattcaattttctatgtattcataaattttcttcttcaattggcaattatcgagccattggttaacctaaaaaaaacacaaaatatattacttttagcaataacatgattttctttttttttttattacacgttaagttctagggtacatgtgcacaacgtggaggtttgttacatatgtatacatgtgccatgttggtgtgctggacccattaactcgtcatttgcattaggtatatctcctaatgctatccctcctccctccccccaccccatgacaggccccggtgtgtgatgttccccttcctgtgtccatgtgttctcattgtaaaattcccacctataagcgagaacatgaggtgtttggttttttgtccttgtgatagtttgctgagaatgatggtttccagcttcatccacgtccctacaaaggacatgaactcatccttgtttatggctgcatagtattccatggtgtatatgtgccacattttcttaatccagtctatcattgatggacatttgggttggttccaagtctttgctattgtgaatagtgctgcaataaacatacgtgtgcatgtgtctttacagcagcatgatttgtaatctttgggtatacacccagtaatgggatggctgggtcaaatggtatttctagttctagatccttgaggaatcaccacactgtcttccacaatggttgaactagtttacactcccaccaacagtgtaaaagtgttcctatttctccacatcctctccagcacctgttgtttcctgactttttaatgatcgccattctaactggtgtgagatggtatctcattatggttttgatttgcatttctctgatggccagtgatgatgagcatttattcatgtgtctgttggctgcataaatgtcttcttttgaaaagtgtctgttcataccctttgcccacttgttgatgggattgtttgtttttttcttgtaaatttgtttaggttctttgtagattctggatattagccctttgtcagatgagtagactgcaaaaattttctcccattctgtaggttgcctcttcactctgatggtagtttcttttgctgtgcagaagctctttagtttaattagatcccatttgtcaattttggctttcgttgccattgcttttggtgttttagtcatgaagtccttgcccatgcctatgtcctgaatggtattgcctaggttttcttctagggtttttatggttttaggtctaacttttaaatctttaatccatcatgaattaatttttgtataaggtgtaaggaagggatccagtttgagctttctacatatggctagccagttttcccagcaccatttattaaatagggaatcctttccccatttcttgtttttatcagttttgtcaaagatcagatggttgtagatgtgtggtattatttctgagggctctgttctgttccattggtctatatctctgttttggtaccagtaccatgctgttttggttactatagccttgtagtgtagtttgaagtcaggtagtgtgacgcctccagctttggacatgaactcatcattttttatggctgcatagtattccatggtgtatacatgccacattttcttaatccagtctatcattgatggacatttgggttggttccaagcctttgctattgtgaacactgctgcaataaacatacgtgtgcatgtgtctttatagcagcatgatttataatgcagttcttccatttgtttctgtcttcttttatttcgttgagcagtggtttgtagttctccttgaagaggtccttcacatcccttttaagttggattcctaggtattttattctctttgaagcaattgtcaatgggagttcactcatgatttggctctctgtttgtctgttattggagtataagaatgcttgtgaattttgcacactgattttgtatcctgagactttgctgaagttgcttatcagcttaaggagattttgggctgagatgatggggctttctaaatatacaatcatgtcatctgcaaacagggacaatttgacttcctcttttcctaattgaacaccctttatttctttctcctgcctgattgccctggccagaacttccaacactatgttgaataggagtggtgagagagggcatccctgtcttgtgccagttttcaaagggaatgcttccagtttttagccattcagtatgatattggttgtgggtttgtcataaatagctcttactattttgagatacgtcccatcaatacctaatttattgagagttttaagcatgaagagttgttgaattttgtcaaaggccttttctgcatctattgagataatcatgtggtttttgtcattggttctgtttatatgctggattatgtttattgatgtgcatatgttgaaccagccttgtatcccagggatgaagcccacttgatcatggtggataagctttttgatgtgctgctggattcggtttgccagtattttatagaggatttttgcatctgtgttcatcagggatattggtctaaaattctcttttttgtgtgtttgtctctgccaggttttcatatcaggatgatgatggcttcataaaatgagttagggaggtttccctctttttctattgattggaatagtttcagaaggaatggtaccagttcctccttgtacctctggtagcattctgctgtgaatccatctggtcccggactttttttggttggtaggctattaattattgccacaatttcagaccctgttattggtctattcagggattcaacttcttcctggtttagtcttgggagggtgtatgtgtccaggaatttatccattttttctagattttctcgtttatttgcgtagaggtatttatagtattctctgatggtagtctgtatttctgtgggattggtgctgatatcccctttgtcattttttattgcatctatttgattcttctctcttttcttctttattcgtcttgcttagtggtctatcaattttgttgatcatttcaaaaaaccagctcctggattcattgattttttgaagggttttttgtgtctctatcttcttcagttccgctctgattttagttatttcttgccttctgctagcttttgaatgtgtttgctcttgcttttctagttcttttaattgtgatgttagggtgtcaattttagatctttcctgctttctcttgtggacatttggtgctataaatttccctctacccactgctttgaatgtgtcccagagattctgttatgttgtgtctttgttctcattggtttcaaagaacatctttatttctgccttcatttctttatgtacccagtagtcattcaggagcaggttgttcaggacccatgtagttgagcggttttgagtgagtttcttaatcctgagttctagtttgattgcactgtggtctgagagacagtttgttataatttctgttcttttacatttgctgaggagagctttacttccaactatgtggtgaattttgtaataactgtgatgtggtgctgagaagaatgtatatatattctgttgatttggggtgtagagttctgtagatgtctattaggtccgctcagtgcagagctgagtttaattcctggatatccttgttaactttctgtctcgttgatctgtctaatattgacagtggggtgttaaagtttcccattattattgtgtgggagtctaaatctctttgtaggtctctaaaggcttgctttatgaatctgggtgctcctgtattgggtgcatatatgtttacgatagttagctcttcttgttgaattgatccctttaccattatgtaatagcctcctttgtctcttttgatctttgttggtttaaagtctgttttatcagagactaggattgcaacccctgcctttttttattttccatttgcttggtagatcttcctccatccctttattttgagcctatgtgtgtctctgcacatgagatgggtctcctgaatacagcacactgatgggtcttgactctgtaaccaatttgccagtctgtgtcttttaattggagcatttagcccatttacatttaaggttaatattgttaggtgtgaatttgatcctgtcattatgatgttagctggttattttgctcattagttgatgcagtttcttcctagcatcgatggtctttacaatttgacatgtttttgcagtggctggtaccagttgttcctttccatgtttagtggcaataacatgattttccttcttctttctaaattctaacctgaacacaaacacctgcaggcaccttctagtctttagactattgtagggaccaagggcttggccctctaaaggttcactaaaaaatcaactcatgacaggcagattaactggagaaagtcttacaaatgtatataacatgcatacacaggagcctttagaatgaagactcaaagatacaggggaaattatccatttttatgcttaggttcaagaaagtatggacagccacatagaaatatgattggacaaaaagtgtatgatctaatgctaattggctgagtggggaaacctagcaaggcctgcctgtctagattctacttgccttgagcactcattccttccttttgggtatgggacaggaatcttcctggaatgggagtcttagtgaaatgaggtacattagataatttctttatggccagtttttacacatataagatggagagaaagttagagtagtagttataggttttatggctggctttgggaaaaaactggttttggtttctatgacccaccttggggaaaagggattctagtttctatggctagccttagggagagacagggactgaaaaacaggaaggcaggaaaagttcagagaaaaacttttgcttctgaggatgctgctgaggccttcatttgggagtattgttttctgagcctcaacactatgcttttatattctgcaaaaagcataatggaaaatagtacaaaattgttgtaagaataaccagaaagagagttatgacagaaatttccaaaattaagaaatgctattatattttacaaaacatacaaacagacccactaatagaaaatgtaacaatcaactaggtaaaagacgtacaatttctctaaccaaaaattgcatgaaataaaagttaactttgctttatttgtaaattggtaaagattttcatttctaatgctaatagcacaaaatgctggtaaatgtctattaaacaggcacttttctgacagtagccccaaatccctggctttggaggccactgccttacccattaggccactggaggttcatttctgacagtagtgtaaacttataaaacttttgaggaaataattcaccagtatgaaacaaaagctttaaaagagttataatggccaaatttacttccggcatgcaatcttaagaaaatggtttcttatggtattatgtagaatatgaaaattcatatataacctaaaagtctcagaatagatcaatttttaataatgactaacttgatacaattgcataagatgatttaaaatgtttatagcacatgtttgatagcatgaaaactatgtatcatcattaacaggtaagatttaaaagccatgtaatgtatttacacctatatttccttttctactattatgtacaaagaccaaagatatatgtatttatatatatataaacatatacacacataccacatactaatacaccaaaatgttagcaatatttatagaagattacaaagttaattatttgtttacattttattatttgtgactttccatgttttttattgaggtaaaattcacatagcacaaaattcctcattttaaagtatacatttcaggggtttttagtatattcactatgctatgcagccatcaatgctaattccagaatattttcgtcaacactaaaagaatcctcgtaactattagcaattaatccagattcccctctgttcatggcaagtactaattaattttcaatctcatgaatttatatgcacatttatatgtgtttatatagatatttcatatacggggaataatataatatgtggccttttgtgtttagtttccttcatttagcataatattttcaaggttaattcatattgtagcatgtaataataattaattcatttttagtgctgaataatttcattgtatgaatataccaaattttctttgtccatttatcagctaatagtcatttcatttgtttccagtctttggctattatgaataaaactgatgaatatgtataagttttgtgtgaacatatgtttttaattctctcatgtgtatacctaggagtagaattatagggttatataataattctgtttaactttttgaggaacgactagtagctgcaccattttgaattcccaccagcaatgtatgagggctctgatttctgcacaaatcattgaacaaaatccctttcatggtaaaaatattcaacaggctagaaatattatagaagggaattttctctacatggtaaagggcacctatgaaaatccccatatattacattatattgaatgttgaaatattgagatctttcatcctaacacttggaacaagaccacgatgtccactcttgccgtttgtattcaacattatacattgtactagagcttctaactagaactgtatagtggtcactgaatgactgaacagagatttatttaaacatctgtaaccaaaattcttccaatctttgttcaggggctctgtgctggccacactttcaacactcagcccagcagttcatagctctgccttagcctttacttcttcctgcttccacaaagcctcaagatcagcaagagaagagagcttagcacgttctcaggtattcccttagcatgtgcatagcccttaccatgtgcacagccttctaaattcccaggaatacgatggagattttcaaatgcattaaggatttctcatttcccagcctttcctcccaagctttttgattagtttattacttgctccaactcttatctatcacctctggcagaagtaactaacacattagcctgtaagtgttttcaacaaatgtcccctgggaagtagttttagcacaaagccaattctgagttaaggacaaatcaagacaagccttttcagccagtcctctaggaagccatgagacaggtcagaacaaatacttaattacagttcttcctgggtatatacccaaaggattataaaacatgctgctataaagacacatgcacatgtatgtttactgcggcactattcacaatagcaaagacttggaaccaacccaaatgtccaacaatgatagactggattaagaaaatgtggcacatatacaccatggaatactatgcagccataaaaaaggatgagttcatgttctttgtagggacgtggatgaagctggaaacaatctttctcagcaagatatcgcaaggacaaaaaaccaaacactgcatgttctcactcataggtgggaattgaacaatgagaacacatggacacaggaaggggaacatcacacaccagggcctgttgtggggggaggggggagggatagcattaggagatatacctaatataaatgatgagttaatgggtgcagcacaccaacatggcacatgtatacatatgtaacaaacctgcacgttgtgcacatgtaccctgaaacttaaagtataataaagaaaaaaaaattacagtccttccaaatgagaggtactctgttccatctggcaccaagggctgttattttcatagccactgccaagtttggtagcagaggacaagactagactaagttaaaattttacaaagtttactcttcttattgaaaatccaccattttcatgaataggtgctctctgggttgctgcaagcctttggtttatttctacagttccgcaaaagttgattctgaccatttttaaccatttttcattgctttttcagaggagcagaatgaatttggtgctccttactctgccatttttgctgatatcattccgtattttttatattaatgcagcagttactttttatatttttaatttacaaataacagccaggtcaaaaaaatttttacaagtttaattgtataagatattaagtgtgtggattttgtgagagaaaagtaagtctgttgaataaggacataaaatatgaagctgctcttgtttgtacaacattatgctattattaataatagtctatatgtcaagtaagtcttttagagtaaaacatgaaacctatatgtcttcacagtattactccagaagtttcctgatcactaccatgatcattctccaaacaatttcagcagatcctgtgtaaccccatttaaaataagtaaaacagacttactatatctaagacttaacagcataagaccatgtctataatgaaaaatattattgtgaaaaattaatttatttcaaaatattaataatgcttgtgagacaaccagttttctaaacactggataaaatagctgttagctagatgtagaggaggtgggaaaggaagacacagtgatacataatgatccaacttgaacctgccattgcaaaattataactgagacagtgaaagagatctgacctaaccaactccatcttgcttctaacctccaagctgtccttgttcattcctgagcatagaccaaactaactttaggaggacctcagtttataatttagcttcgaaaccaagacaatagcagccctttcccaaaacaaatcccctttttcctggggactagactgcctttgcagaactaaaaaattagccacaagattagaaattatggtttagctggcaccacccagatcaataaactggctcatctcgtcttgtggccccctacccaggaatagactcagcccaagaggacagctttgactccctattatttcatctctgacccaaccaatcagcactcctgactcactggccaccttcccgccaaattatccttaaaactccaatcccctaattctcggggagactaatgtgagtaataataaaacactcctacacaggtagctctgcatgaatcactctttctctattgcaattcccctgtcttgataaattggctctgtctaggcagtgggcaaggtgaacccgctgggtggttacaaactaaaaaatgatcacttccctttttgtgagataagcagacataagagacaataatcaaacacataccttaacaaaattatgaaacatttattaccttaaataggcacctatgtgaattgcaatagtaaaataatgtataattagtaagatgctaagatcaaaaaactttgttgatttttttctaccattttaaaaagacttcctggacttctcttggtgatgggaagtagagagcttatgatgtcagaagactgtcagcggaaaagagtgaaatgtttcagatagagtctacaacttgggagaacacacactgaatacattttttggaagaaaatgaagatggaaaagaagactactagagaagtaaaatctgcaaagcattgggcaaaagacagatctctgatttaagtcctcaatggtcacaat

SEQ ID NO: 8566 - DNA, 2152 bp, artificial
  synthetic oligonucleotide
taacccagccccagttggtaagctaattgttctagtcattttagttccattgtcttcccctagcaatttatctagggttgggcctctaggccaagctatagcttggtgagttctgaccaataagatattaaagagagcatggtgggctcttgctagaaaacattttgcttcctggtaaaagggacagggcataaaaggagagcttgctgacactgtcttccctcttatttcagccttagactaagaagagaaatttggacctctgagccatcttacaaccatgagatgataatcataagacaaaaagacaatagaaaggaaataaaagacataatttctgggtctttgatggtgctgttgagcagctgaaccaatattagcaactgcttacctgtagaacagcagatctcaaactttttggtctcagaactctttataatcacacttattattgaggaatattaatttctcagctttgataaatgtgtaatgtttatataaaacgttaacagaggaagctgaataaaggatatgtagaagctgttatctctgtaactcttctgtaaatctaaaattatttcaaagtaaagagttttttaaaattattgaggattgcctaaaacctttctctaatatggaacatatccactgatgtttaccatagtataaataaaaatggagagattttttaaaattttatttattaatttatttaaacataaaaagaatatctattacatgttaacataagaaacattttcatgaaaatcatattttcaaaaaataaatttagggaaaggagtagtactgtttgacatttctgcaaatttcttcaaagtctggaataatagaagacagctggactcatctccttctgaattcaatctgctgtaatatgctgttctggttcaattatatgaagaaattctagccttacacaggtatttagtttgaaaaaggagtatgttaatggccttttcagataacgtagatatttctgcttgatactacactgaaatttaacaagcgatagttttttttaaaagatcaattgcaatatggaagctgaagtcatatcaatgagcttttcatactgtattatattaaaagctatttttcaatctttcattttgaatgggtcttctatccacttattagttcataccatgaggtattaatttattatttggaaaatactggcccactgagtgatgcaggacttctaattaatgacccattttataatgaaatatcgaaaaatcacatttgttaataccaccattgattccaccaagtctttaagttgggaagctgacaagctcatggtggcagatgtaagtttttccagaactctaattttcacttgaaagcttgaatgttattatcagcaacaaatactttaaattgttttccttaaaaatgacagacttattttgttcattttcaagaaaatatctgccaaatacccaagtctgtatcaccacagtaaaaatgatgtttcatgaggaaagcagacaattcagctcgttactcaattctgcaagttctttccttgagacaaccatcaaactccagtgtgcagcagaagtaccttattaaaactttccattttatcccacagaatgttaagaaaatgtgtactcgagggttgagatttaataaaattaacattttactgtttcttcaagaatgttctaaagtagaacttgctttttttttttttccacaaattcatggcagtgaaggataccaatgactactgccagcacagtttggtgtcacccctttgctaagatgccagcagttttagcctctgttgctttagcatcatctatacaaatgttaacaggaaaaaaggcaaataaaatcttataattattgttaaaaagatcttgaggacccacaggggtccgtggatcacactttgaaaaccacatttagacttaagtgagaaaaataaattcttatttgtttaatccactcttactcagattttctgttatttgcaactaaaagcattcctgatagatgcagcataatatattcttgagtattccttggtattcaaaacatccatgcttccacttaatgattgtggcaaaaaaaaaaaaaagctatttatctatttgagttgagtctcttcttgtgtgga

SEQ ID NO: 8567 - DNA, 2276 bp, artificial
  synthetic oligonucleotide
aggatggaagaaatacagtgtgggtactatattttgtcctgaggacaaaatgctaggtatgacgcaaggacttaagactatcgtcccaacagtgccctgctgctgcacaaaaacacctagcatttgtctagggattttcatttacaacaaagctttgacacacatgatcttattcactccccacaacaactctaaactagttcgggaacctgaaaatagcactcaattcaattgctagctgtatgtaagtgttttggttatagaacctaacaatcccctagggattaagcggtgggcgcctgctgcttcaacaaccctgcagcaagggaataaaggaacaactgtatttcttcggtcacaacgtaatcacgacaacagaaagcactcactctttccactctgacccacacacagtctgtcgaggcaattaatcagcactcccggtggttttcctataggatgccagttcccttgccaatcaagtctttccacagactgtagcaggaccacacccccggagaggcctcagggagggaaggtgctgtggcccacagaagtgaaagctgatactcaggttgacccgccagtgaaacttacaggcggatcttcccgggcctcagtttccccatctctaaaatgggctacccttcctttctcttgactagttccctccctgttctcgctgggccactaggaagtgaaatcagtgcctaaccgcagctgaaagtgctctgttaggctccagtcaccgcgccgggcatgctcagtagctggggccggctcggctgcgggagtaggaagcagctttgcgcgcccgggcggccgatgcgggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaatcggcagcttcccgggcagacactctctccctcaggaagaggtgccgccgagtcagcgcggggcagtgtgagcgccccgaggtgctttctcagttgaggagaggtggggttacagggcacaggtgacagggccggagaaagatggagcagcccggggcggcggcgtcgggagcgggaggcggcagcgaggaacccggtgggggccggagcaacaagcggagcgcggggaaccgggccgccaatgaagaggaaacgaaaaacaaacccaaattggtgagtgctcccgcagcccccgccggccttagggacagggagagccccgggatcctcctgccattgaacacgggggcacccggggccccctcccaaggatgaccgcgacctcgctgtgcaactcggggagccgctaaaggagtggccacgccgaggcgcggagacggcgtgggggcggaagagcacccccttctctacttaacccctttctcactcttgtcagcccgggaggcggtgcgggaaggagaaaggcccagccccaacttggggacaccccgagtactgggtagggctgttgtttgtctaacttgtgggcgcaaacctttgcgcgattccattctcctcccacttcttgttagttgctgttttgcctcctaacgcgtagggtccggggcaggggaacctccctcctttttattccaagtccttgggagcccacctacagcttcgcaaatcaagaagaacactatttatgctcccagtctttctactttaccagaaatctcaggaagaggcgcctacgtgcctttttcctcctccttgcctctctccatgtgctctcccaagaaatgtttctttggaagggtgggggcgcgtgggagtttgaggctgggtgaggtaccaccaactgtcgagtgtgtgtaataggcatagtcatacagtacttccacttagttgattaagaacgctcaaaagcagtaggcacaaactgtgcaaatctcaccgtgctgatagtgtgaaccgatggtagcagtccatttcctgccactgaatgtgcagaggaatgaaatcgatgaggcctggtattgcattgggaaatactggagtttcctcagctcatcagaagggttccgctttttgtaaactttctaatttgggtggtgtgaggggaaagggttttcctgtacaaattcagcagatactccttagagctgtattcttagtccagatccgaagcacaagccaca

SEQ ID NO: 8568 - DNA, 1202 bp, artificial
  synthetic oligonucleotide
aataggcaccaaaaatccacattcataattcttcactatacatgctaaatgaaaacatattttaaccatttaaaccaccatcaatcaattttttctttttagttatgcataagctttacataggtaaagtggcttatttttgtgttaaacaaacatgcttaaaagcacaatttaaaggtaatattcactgttatacctttaaagtgaaattaatattctttactaagtcattagtttacttttcctttatttttagatcaagtttttaattcagcttcagccaaaaggagataatataaaaataaattccatttaaaaaatggaaatagtacaactttcattgatttatacacagattctgaggatctaaatgcttaattgttttaatcagtccaatttccaaacccatcgtagtatatggtgatacttccgtttcatatatttttgtggataacggtaaacctgaatgagtctagaaaatttatattcacacacagagttttcagggatatttagcatattgcagaggaagtgttatttcacgtcaatacactaaacttctctgaacccccctattcatcgaaaacactgaacaccccattcattacacaagctagagctcttaagagctagaaagctttaacattctccttataattcagttatggttatgaaatatgaaaaataatattttatgatttattttaaaacactttgttaaggaaaatacatttcttcttagtctatcattaatctggctttacatatgggctggtctcacttatcctggaggcagttaatcattaaacatttttagtggcaaaagcctttccttatagaaagattttgtcttcctgtcataaatttctcatttttcttcctggatttttaagctagaaaacactgtaaatattttaaggttgcactgcaatttttctgccatattgaaatgatagctgtctgacatcatttttccttctttataagtggcatattgtttactagttcatgacgtacgtcttcagagatacttaggtactcaactctatgcaaatatacactgattacctttgccatagacactagatgactacttgattaaaataacattaagacgactagccaaaaccaagactaactgctagtgaaaagaagcagctatcagttaattgaagaacatctatatctttatttccctttaa

SEQ ID NO: 8569 - DNA, 1473 bp, artificial
  synthetic oligonucleotide
agtagtccagggaaaatttttggacagaaaactttggttgagggcaatttaatctgtcattttataaaatgattaagagaaaagaatgaagttggggaatcaccaattgggagtctccaggcttattaaaggaaagataactaggactaaaccagaatgttagcagaggcattggaaaggaagaaaggggccatttggaggaggcattctagaagtagaagtagaagtagaagtagaatatttgtgaataatgctctacattagcagtgtttcagccttctgccacacaggagaatttatgtccagccaatctcctaaacctgcgtactcagctcctgccacatgggtctcctcacagttcctggaacattctaaacacactagctaatgcctcatgacccaatttgcccttaatccttctacttggaaagtcctcactttcagagttctgctgaaatacctaaccttatcaaagaatctttcctgatcacacaatgaaaaatagcagcctgccactcctttcattctattttccaaggtttatttttcttcattgcatcaaagcaattattacatttattatatagttagttatttgttcactgtctccctatctctagatagtaaagtccatgaggctagttgcttagttttgttgcttgttatgtatctctctcacctagaacatgcttggaactttgtagacactcgacaaatatttgttgactgaataaatagaataaatgcaaaggtgaaagaaatgggtcatcaaataattatgccagtatttcaagtctgaagaattaaaagggtagtgatgttattaataaagtatcaaagagtggaagataagttgacttaggggtatggagacagaggaagatgaattcagcttgtgaattcatgcttaagtatgtcatgctggtgaaacaaccaaggcagtgctgtgtaatgggcaatctaaaatgtggagaagtctaggattgaggcaaagatcactgagtcatcctcatagagtcaatacttgaagcagtgggaattgaaaaaataatgacaagcaatattgagacagaattatcagatttgaaaattaaaattttattttggatatttaatgttttaaaattactaacttacttatacatctaattttttgtttatttctcagctgggttaacaactttggccatgaaggtcttggactcttattggatgagctggaaaagcttctggacaaaaaacagtaagaataaacactgaaattaaaatcaccaaagggaaaatgtttcagcacaacataatatacatttttcttttatttaggcaagaaaatattgacaagaagaatcagtataaacttattcaatgcctcaaagcatttatgaataataaggtaagtagtatttatttctgcccctgtcacaaaaggtgggaacttgcccaacactatgaaagtatgaaatgaacaaaata

SEQ ID NO: 8570 - DNA, 651 bp, artificial
  synthetic oligonucleotide
taccttttacaactctattacagttctcaaaaagatttacagtgagtgactaatttcaaaatccaatggcctctttccaatcttgatcacttggcactgttgatcaccttcttccttgaaaattttacttcccttgactttctaggcaccattctctcctttgttctctacctttatggtttttttttttttttctgtcttcctaatgtatttctcctcctcttacttcctgggtattttgttccctatgttctatccgtggtcctcttttagtatcattttatgtacatacattcatatgcacatacacgtatctacatgtacatgtatatacatacagacacatacttttttaaacaattttgtccatgaatgttctgaattgcttatctagttttacaatccaactgtggtagtgattcttcagatttatacatccagctcagtgactggtatcataaaattaagaaattaaaaataacatttacaacccatatgccggacagtgtttaaaatactttaatatgttatcccatttaaacctcgcagcaattgattgagagagatagaagtattatccccattttatagataattaaactgaggctcataaaggttaaataacttccctagggtcacagtgtgaataga

SEQ ID NO: 8571 - DNA, 5341 bp, artificial
  synthetic oligonucleotide
caaatggttgttaaaaacctgtagaacaaaacagatccagtgtgggcctgatttattaaatgctatgtttttctttcttagtcactcaaacaataaggattaatttactctgttacctaaatatcctgtacagccttttcataaacctgtttgtgaaaaatactcatttattctaaacagagtaatccttaaagctaaaaattccaaatcagtatgaacatcagtggacaaacccatcatctaaggattatagaattataacatccaatagaatgagaaaacttgatactttatgctgtatttatgctttgtttctaagtaaatccttgattttatttgcagcttagtctagtatgagaattatattgcagcactagattttctttttttgtgtgtcctatgctttaaagatttttaccattctaactgtggcatctcttttgttgtgtgtctgaaaaggaaatacaatatgtaagcaaataaaatttttcatattatcaggattgtatggtgagattttttttaataactcagtataagcacaaccttgagaattattttctgatggtccatgcaagtagaggaggataaaatgtgcttgctcctttacattaatttacatcaacaatggctagaaataaatataatctcacaaatgaatctaacttttaagaacatatttttgtaataaagcaaagaacagaatgatgataaaataagcacacagtaacttgggctattatcaatacttaaatggatgttcttctctcatgaaaagaatagttcattttgccacaataatttagacatttttgaaaatacagattaaggtttaatttggcacttttactggtcatcttacttgcttttaaaatatggagctccttttaaaatctagagcaccgctactagaccacattaagaacctaccccaaagttttaaaaacattttaaatgggttataataaattcattcatttcacttgtttaaaaaagtatttactaaaaaattactaaaaaatgtgttgttgttttctcccagatcagagatactaaatcagcggatcaaaaaacaacccttttgcattttattgccgacatttgtgaggaaaaatatcgagatatcctaaaatttcctgaagaactggaacacgtagaaagtgcaagcaaaggtaattgatttataactactttgagattatctcttgcctatatggtttaaatggaacaattaaagaatctgtaaacattattcataaaagtattttttgtttgtttactgataaaagaaaagcaggaaaatagtttccattagcttatatttgacagcatactacattttaataacctattttgtcttacatcattttttttaccactgctacgttattaaagctttcatttctctgatcagataatatgtttgtactttcatttgataaacatttaagtggatattgtttgcaaaggaaccatactatagggctcttggttatatgacaatgattgtgagagtttttgattgagtgtggttaaaatatagtaaatgagaaaaatgtgtgtatatatacatacacacaaatgtgttataaaataaggatgcatgtgagaaatgctgcaggaaaagataatgtcctatagttgagatgaggaggaaagtactcttgaatgggtgggtaagagaaggcttcatggaagaggtcaaaggtgaaatatgaggttagggttttacagacatggaaaagaggtttgctttccagagagaaaacaacatgagcaaggcaaagtggcagaatgttttaggacaagtgaagggaatggttgactctgaggctggagcagtaaggtaggtatctctgagacttcagtgtcaggctaaggagtctagtcttgatgtggtaagcagtacagcatcattgaagggatagaatagacaagccatggctcctgtgaggaacaggatgtttgaaacaaaaatgtctctgagattttaattcagggtaattagctttgtcagtaagtattatctacttttgcaagaggttgaaaagtgaaagaaaagaagattaaggaaacatttgctgaaggtgagattatgtgcgagaagaagtgcattttccctcttagataagagaagtacaccataaatcttatacttgaaattacgctgaagtaatttcattctgtaactctgaggacttttggtaaggacttcatatatgtttctcaagtttattacaaaccatataaacctgttagtttccttttaagttaaaaatagtgaatctataaaacccagaatattctttgaataacattgtgcagtggtcatctcagccagttgggtattgtcaatcaaatcctcaacatatttctttaattttaccgagtttgtatcgttttgtggtccaaggagcaaactaacacaaaaagacaaactatgattgtattgtattatttattttctttcgttgttttcaaaaaattgtgaaatatgatggaaaattacacaaattacaactataatggcaactttctggtaatagctcttctaaagaatttatctttggatttaaaaatacagctttctgactagaagcatatttactaacatgtggctaatgtgaaataataacattttaaacatttgtgttgtaatttgaaatgtatatatatatatagcacaaaaaagaccagttattaaattagctcattttgttgctattaatactttttgattgccttctaccagaatttttttctaagttttctttgttcaacatgtataatcaatttttacaacattttggaaagaagtatgtcaataatatatctatatatacacacacagtgccacacatgaaaatatatatatttatatgtaatatatttactatacataaataaatatgtaccacacacttatatcaatcaacaggtatttatataaacctcaatcaacagttatatatatgttatatataaccataggtatttacatgtgatccagcagttccactactaggtatttatccaaagaaaaagaaatcagcatatcaaagggatacctgtaccccatgtttattgcaacactgttcacaataggtaagatatgaaatcagcctagatgtctatcaatggattaatggataaagaaaatgtggtgtatatacacaatggaatactattcatctgtaaaaaagaaataaatcctctcatttgaagtaacatggatggaactggaggtaattaagtgaaataagccaggcacagatagacagatattgcatgtttttactcatatgcaggagctaagaaggttggtctcatagagatagagcgtagattgatgcttaccacaggctgggaaaggtgaagggtagggggatgaagagtggttggttaatgtgtacgaacatacagttaggtggaagaaataagttctggcctggtgcaatggctcacacctgtaatttcagctagttgggaggctgaggtgggaggaacacttgaggccaggagtttgagaccagcctgggcagcatagtgagaccacccccatcagaaaattttaaaaattagccagtttcatgctacttgcaggggctgaggcaagagcattcctcgagcccaggaggctacagtgagctatgatcacaccattgcactctagcctgggcgacagagcaagaccctgtctcttaaaaaaaattaaagaaagaaataatacgtcctaatgtttgatagcagaatagattgactgtgggtaggaatgatatattgcatatttcaaaatagctagaagagaagatttgaaatattcccaacacaaagaaatgataaatgttcaaggtggtagatacgctaaacaccccaatttagtcattacacattctatgcatgtagcaatatatcatatgtaccccataagtatacaaatattatgtatcaataaaaaacttaagaatatatagatatttatatatgtgtatatagcgtgtatatatatatatatattttatatagttatgtagtgagacattcaataatcttgtacactttagccactactgctactgacaaaagtagattgtagagcccagccttttgggttagacactataaatttctttctttctttctttctttctttcttttttgagacgaagtcttgctctttcgcccaggctggagtgcagtggcacaatcttagctcactgcaacatctgcctcccgcgctcaagcaattctcctacctcagcctcccaagtagctgggattacaggcgcacgccaccatgcccagctaatttttgtacttttttagtacagatggggtttcaccatgttggccaggctgttctcaaactcctgaccttgtgatccacccgccttggcctcccaaagtgctgggattacaggcgtgagccaccgcaccaggcctgacactataactttctaatcctagctctactacctattagttctataatttgagctaataatttaaacttctaagattttgtttactcatctgtaaaatgagaataataacagtgagattaaattagttaacataggcattgcatccagtaaaatggtatagtttatagtatatgcttgacacatagtaagtatgcggctgttgctgaactactaccagtagtagtagtagtagtagtagtagtagtagtagtagtagtggtagtagtagtagtattgatataccactaaggatattatagttctttcttttgtcttattagaagggaacaatcataaaatatcttatagttcctccagtctcagtaagtatgtattatattcaattctatttgtttgtttcctattcctgggcttttggtaaatccttttatatatttttttctttattttatttttcctttttaattttttgtatatcaccaacttcctttttccaatccatttcaagagcgaaatctctctgctctattttgatcattcctgattttgtgcattcttcctgccagtgtattcaaaagactgttgccaaaaatcctcttcttatatcactgtttgggccatatcaatccctactctcaaattattttgactagttatttttctttccctatgaaattcagactgagaattctcaactcaaaaagatcttacgcacattctgcctgcttgcatccctctttcatttcctcctagttctcatttcagtatacccagacatatagtctcctgagccatttttattcctttataataatcctgtctctgtgtacgatttcatgctgcatcctctggctggaaatttcacctgccctgtactctaagacaactgactgtca

SEQ ID NO: 8572 - DNA, 1411 bp, artificial
  synthetic oligonucleotide
agtgtttaggaataacccatgctcacagcatcattaaatgtttactgttaattctcactgctctttctcggtttcttgcaaggcattgttgcaaaactaatttatcacatacgttcctagttggggttcttaaaagaacatttctttttctagtatgacagtacagaacatgtgtgtgtatatatgtatatgtctgtgtgtatacttgcatatactatgtctgaaaaatacttttattctgattgaccctttgtacatttctcaaataatatagtttaactacccttgagccagaaactgtgtcagatgctagagatctaatggcgaataagtcatagtacttgtcctaaagattacagtataaataatgtattcttttgatcacaagaaagcttcgtccacaactttgaaggaacaagtactggctattctcctttattattttatgcaaattattatgtttcataaggactcattgccagcatttattttgtttatggactttgaaagtaggagtttcattaactctcagtttggacagtattatctttacatgcagttagtgcagtgactgtcatcatccttattagaataccaccaggacatctggcaagatgtctaatataaagcagctatgttatctatttccaatcaaatgattctttggtgcttcgatgtcctgtaacttctccacttatgtaattctctgccataatctaatttgtaaagtggggtgggagtaaaagaaaatttagaaagaaacacagagcacaaaccctttatcctggtaaagcatctcatgtttcaatttgcagttgttttggtaaagtataaaacaagaaatatgattataaatatagtttttattttttactgtgggtaggatgttttttgactaacacatgcttttaattgcctaatctattttggctttacctttagagaaaaattactgcactttgctgcatctgtcaaaaatgacacgataattctttgagtcaaaacagggtacatgaaatgtgatttttgtttattttctgaagaatagcagaactcattttttgacacatcctttactgtggttaagactccatggcatagaacagactgcttattttgaggttgcaaagtacagctaacctacaagaataagctctctaatatcttctatcaaaccaagaaatgatctgtttcacatgcacatagaaaagaattgattttcttacacaggatgctgccacttggactgtacatagagttgatttgtaatataaattaactcaccaattatcgattgttccatctgactttgaacacattaagaatctgcaaaaagtttctgagttatcaataataagaaagctgtgtatgaaatgtaatggggtgcgtcagctggatccgagttagatat

SEQ ID NO: 8573 - DNA, 2932 bp, artificial
  synthetic oligonucleotide
tggattatatcaaacccaggacttcagaacattatgaagctgtgcataagtgcaagcctgagtattgttaattagtaaggatgtggttttcagatcatgtcatccagttataacaacataccataaacactgtccaagcattgtcagtttgtaaacgtatcatttgctgtgagttacttaaaacattcaaaaggtgtttaacaacagtaatagttgatctgagaagaaatcacagtggtcgatcttgaataattataacagcagtattaaaaccatgggactgcagtgaagctgtgatcatgaaagaacctcatgttacaacataaaactctctgtgaaccattactgagaacagaacaacactgaaaaaggcccggatagatatattgctagaaacagttgccctagttatttagtttcaaaatgaagtagcagagaatcccatatgggaaaagtacttgtacatatctctgtgatggtgttcatctcacgatgtttgattccattttgatgggtttgttgatagcatgattcctgctgtcactatgatttgtgtttattatagctgtttcctttttaataaaggatgctgttgcatataaacactgacatgaagctatcttttcagaaattgcattctgtatgctgatatagtcattgcaatgttgtaaagtgagtattttgctaccaacagagttggattatatattttaatatatcgattagtgtattttgttgtttcaatataagaaaggacctatagttatatttattttgcatttgttcttaggtagtatacacactttcaaggagagatagcacagtaggcaatacaatgtggctgaagcacaccttgatagaagaacaaataaaggactgggcagaggtgaaaatgattatgtaggaagtaggagaaagtcagattcaccatagtcgaagagtcatggcaggagaccattgaaagtcaagaggcaccatctgtcctaagctgagctgaggcagtgtctaactgccatagccaagagtaggagctaagaaatctcagaccgagaaaatagccaaagattgaggggctaggttgggcgcggtggctcatgcctgtaatcccatcactctgggaggccgaggcaggtggatcacctgaggtcaggaattaaagaccagcctggtcaacatggtgaaactctgtctccactaaatacacaaaaattagctgggcgtggtggcgggcgcctgtaatcccagctacttaggaagctgagataggagaatcacttgaacccaggaggcagagattgcagtgagaaaagattgcaccattgcactccagcctgggcaagaagagagaaactccgtctcaaaaaacaaacaaacaaacaaaaaacaacaataacaacaaaattggctaggcgcggtggctcatgcctgtaatcccagcactttgggaggccgaggcaggcagattacctgaggtcaggagttcgagaccaacctggacaacatggtgaaacctcatctctacttaaaaaaagacaaaaattagctggacgtggtggtgcgtgcctgtaatcccagctacttgggaggctgaggcagggagaatcacttgaacctgtgaagtggaggttgcagtgagccaggatcatgccattgcactccagcctgggcgacagagcgagactccttctccaaaaaaaaaaaaaaaaagaaagaaagaaagaatgggaaatgggaggcaagaaggtagggaactgtcactagggcagttcagctggttgtgctgaatagtgtttttctcacctagagctgcttttaacaacctcatacctaatggcattttaaattttatgtctggccccagaaaaaggtttgcctgtaaaataaattgaacatgattgaatagaaagtataaagaaaaaaaaaaaaccttccgtacatctggtttaattaatttacagtcctctagcaaagtgtcattaaaggcatttctgatcagatccagattggcagcaaatccaaacccatcatttcctctctccttttttgcctccccgcatctctccttcttaggttagaaaaggatctgtttgaattagccaaggatatactacgttgtagatggtgagggcagaagtacattaagcagaattcagcataactctctttggcccccagagtagcttcagggggcagggccattggtggtggtgaggttgtggggagggtttgtggtatgtagggataaccttcctggcccctttctgtaagctgtcaccagatctggaatgttcaaatcttgctgtatcactgctctttttcatacagacctatcattaccattcaggaagaatttctgcaatctatatacgttctcatttaatgggatatttacaaattctgagccttccttatctctgaaccaaattcagcattaccaatactgccaggtatcctggaacaacatctcgttttccatttccttgcaatccgtttatcattttccttcttctccacatgccaatacactctctaatttctttgtatctgggtggttatgatactgccctgtttttggagggccacagtaacaaattcatttcctcgtgagtatttgttcttacttatccaaattagccttatggaagcacttgtaacagataaacatttgctttggaactttgtgctcttaccttaaaggaactagctttaagctttgaatctgaagtaggaatagagataagaaaaaaagactttccacactaaagagacagttaacaaaggctgagaagtgggaaactctgaaaggtaaggggcaccgaattgttacatttaattggattattggatagataatgaattgtgaatggggcagtttaagataagacagaaatgtctattgagaccagacccctctgggtcttgagtacctaag

SEQ ID NO: 8574 - DNA, 969 bp, artificial
  synthetic oligonucleotide
ttagacatctatttattaatgtgattaatttttattgagataatttacataccataaaatttaccattgtagtttatataattcagtggtttggccgggtgcggtggctcacgcctgtaatcccagcacactgggaggccaagccgggcttatcacttgaggtcaggagttcgagaccagcctaaccaacatggtgaaaccccagttgtcaccactggagtgggatcatactggcatctggcaggtagaggccagggatgctgctaaacatcccacaacgcataggacagctcctaccaaagaataatctagcccaaagtgacagtcgtgctgaggttgagaaaccctgctttaaaattatgattctagtatgccagtttatttttaagtggtagtctttgagttcatctacaatagccaggtacctttgtgctcctagcctattgctatggagtctaagagcacaaaaacaatgacaggagaaaggggaggtaccagtgaaggtaaaatcatttagattttgtaggaagaaatcaattcttgcaagtcaggagaattttgaaagtgtttttaaggctattttaaactgctgtgtcttttaacataaagaaaaaaattatttcaatataaacccctccaggcaaagccttgtagacgtattctcgttattgagtctttttctttagggtttctggaacaaaatagtttttgtcaaacagcttgtacatgctatgaagtatatttaatcaatcataatagaaaaaagaaacagagcagcttgatggagggaacttgtagttgatatgtctctgcattcgtgatttacctgaactcaaaggaagttgatattccagctgatcacattaattcagctttgtctaataccaactactggaatgtactcattcacttatgttccacaaataatctatccaaaataaaacagacaatagcttgaaatatgtttca

SEQ ID NO: 8575 - DNA, 1346 bp, artificial
  synthetic oligonucleotide
taaacatctttataaggaaatgtatgagttagctcttttaaaaccacagataagtataatcttaggaaaagagatcatgtgccctagactttagtagttaacatttcttctgaaggatgtgattttttttttttttttttgtgatggagtcttgctctgtctcccaggctggagtgcaatggtgcgacctcagctcactgcaacctccgcctcccgggttcaagcaattccaattctctgcctcagcctcctgagtagctgggattacaggcacccaccaccacgcctggctaatttttgtatttttagtagagacggggtttcaccatcttggccaggctggtcttgaactgctgaccacatgatccacctgcctcggcctcccaaagtctggtattataggcgtgagccattgcacccggccggatgtgattttttttaaagacaaagtaactaaagactaattgatgctgacataccaaagtaaaaccagaagtctgtattgaggagccatctcaaaaatttactttaagacagtatgtcttaaagaaaaaaatgtattatttaaatggaaagtaggaccatatgccaggttttgtttgttttgtttgttgtcatatttttgttgttgtttgagatgggacataagagactagttgcttgtctcacagatatggtagggaaaggaaaccttttggtggaagttagccatctcttcaatctctgatattcaaggagtacccagttttggttcaccaaatgtaagtcctttgttataagcatcctcttttatgttggtttgtttggcctgtagacagtttctgaaactaatttcttatttgcatgtaatgctttcatataatattcatctgtaaaaccatttggatttttcgagttgatacatttttatcattctgctgcacctctctcccctccttctttgggcttgttgcactgtcatgctcctcctgatgcattgcttcctggtgggtgacatcatgatttgtgagcaacccgatatataaataaggtggtgagaactgcctcagcaattcagtttctatttgaaaggcattaagcagcctctttctgttttcttacatttttctctactttgtgttttcacagttttattaggcactgtagaaggacctgtttttctctttcattacatttctgaaaatcattaggttgattcaaaatcttttggaaatgtaatgcccccttatgctataatatacctctcatactgtatacattttggtcacacccagatgtggagtttagcaataactaacaactactaatttttaggagcatcctaggaatacagatgctttcagcag

SEQ ID NO: 8576 - DNA, 792 bp, artificial
  synthetic oligonucleotide
taacaataggggtcattagaaaaaatatctaaaaagactcccagtgggaggaagacaataatgaaaaaaggttgagagacgttgctctagcataatatttcgacaagtatagtgaggtagcaactactaaattaagcaaaggtatttatttttattcccacttgactttatttattttgagacagggtctcactctgtcacccaggctggagtgcagtggcatgctcatggctcactgtaaccccaacctcccaggctcaagtgaccctcccgccccagcctcctgagtagctgagactatacatgcacatgccaccacacccagctatttttttttcttttgtattttttgtaaagatggggtttcaccatgttgtccaggccagtctcaaactcctgagctcaagtgatcctcccaccttggcctgccaaagtgctgggattacaggcatgagccactgcacccagcctcctctcaactttttgtcatatttgtttttccatctttttatctaattacaatataatagcattaaagaattttaataaaacaatatctataatgttatacatttttatgtttgcatattatttaggtaaatcataaatatattttttcagtaatttacatatatttacttttctacatagtctttataattatcatttttgtaaggatacataaaatttcacttgtgctgttgtcctcaccttcttgtacttatatatctctaaaaattccttccctgtcttctttgcaattctgcttctcctgactgcctgttaaaagtt

SEQ ID NO: 8577 - DNA, 3460 bp, artificial
  synthetic oligonucleotide
tttcctgtatttcttccatattgtcaagcgtgtattgttttatagctagaaaacctattatttaggtttgattttggtgtatttactgattgagcatgactagaagaatattcgaaaggtctttgtgaaaaaaaaaaaaaaaaacatcgtattacttgtaaaggaagccaagaaggtttggaggtgcaccgtttattaggttttgtgtgaacatttaacactaaaacattagttaatatatattaaccatttagatgattgtaaaacattatatccatgtggcaagtcactaaatcaaaacacaggtaactggaacagactgacagaaaacacagttggcctcatcagatacatagaaaccatagtaggatgaccaagataaacagtatagctatgaaaacatcaagttgatgatagcatagactctaattattatcatcgatagaatgtgaatgtataataaagtgaattatatagtttttgtttaactcttgttttaattagcaccagattcagctacagttgtatttatgaatctatgttaatttctaataattagaatgaattacttcttcctaagataatactcttcctagaatggaaatttagaaaatatactctattaaatatcagttgattttctttccaggtggcatccattaggacaaacattatgaaaaggccactgaccaaaatgttgatttcctagctgacacctggaagaaaaataaacttatgtttaatggaatagactgtctaaatccctgttttgagaagagttcacattcatgaatatgtattcattgctgaattcaatagattcgagtagtgaaggacatccgtatcatagaaagtcgcatctattcattaacttacaactttccaaagaaacaagcaagaatgcagcttgagatggagtgctggcaatacgcagttcattcctttattatgtgacacgtttatcatgacctgcatgataactaatgaaataaatatgagatttgtgtattatctgtggcctaatttgttgaacttctcattttaagttacagtagcacaatcctaaatcagtattataaatgagctgtttatggttttgtcttattcagtgttctaggtgcattatgtttttttatttatacatttcaaataatttttctctttatttcttcttttctgcagtggtaaatcatccctgtgcaacaagggctaatccaagatcagctacataaacggcctgagtgctgttttaaacaggattgggtgatggtacaacatgactttttaagataatcaagtagtaaaagtttctagtggaaacatgatattcattttgtctggtgctcttttctttctgcctaaggctttctgataaaatttatgctatatgccccttaataccgatttcatgatggttaaccatatctatgcctggaaagaaaatatagacttgggaagaaaacagatatatagtctacaatgaatatttctagcttgcattcaagatgactgtgttgtgcagaacattctgccaggcattaagtgggatacaaaagcagtctaacatatgatctctgtcctatgaatgtgtttttaaaatgtatactagtcattattggagtgactattatataaagacaaaagccactagggtagccatggttttttgccagttattagccatatatagtgcgtgcatgcacacatacacacacacatacatatatgtaatatataattttagtatatttaaattaatccatattttcaagaacttcattaacttgaacactcagaaataccctgagtgttttaagacataattgcaaataactcatgtaatgcgtatatttttatatctttgcatgtatgaagtttatacattcaggcttgtgcaaatgtgtttatatcatttgcctaagcccttgattatttacatgttcctatgtgggatcacagtccttcagatatgaatcatagcacagtgatttctttacatattcgtattctactattgagatactttaagaatcctgtgagttgtgtacctggaaatataaaattgatattattattaatccattcagaaatcatattgggcaatagcactactacatgtacatttagtagcaaacatagatagaatatttggagataatgaagatttcaatactgtgttaagaaaaaaaaaaaaaacaaccacgcaagagactcggctcttggctctcagctccaaagcatgtgaaatattcaacttaataagaacataactgcaggaagcacttctaggtcatgggagttgctatgcacaaaagaggtatggttgttctagctcagagaagcttccacatatattatttattgaggaagcctcattttaatgctgtatagagaagcccgaatgacatactcttcacaagtggcagtattggtattacagcattccaagggtgtgagacttagtttggaaatgaactgagaaaaagcaaataatatttcttaactattgtagaaaatggaggtgtcgctaggaaaattatattttcctctggtctttctcaccatttatttattccgctcaccaaggaccctggcttttgaggagaggtccatggctgagagaacattaaaaggaaagagtgaaagtggagaatgcagatgcatatttggattcaggaggaaggggaggttcaacaggtgccttctatagcagagttggttgttaagtcacactacccacaacatgctacccacaataaccacagaagaaaggttacacatacataggtctgttctcccttttatgctcacttaccacacaaatgacatctttgtgcctgttgttcggggtcattgcctaaaaaagttgagttgaaactggcaatgaagaaagaatgggccgggcatggtggctcacgcctgtaatcccaacactttgagaggccaaggcgggcggatcacctgaggtcaggagttcaagaccagcctggccaacatggtgaaaccccgtctctactaaaaatacaaaaaatcagccgggcgtggtggtgtgcctgtaatcccaactactcgggaggctgaggcaggagaattgcttgaacctgggaggtggaggttgcagtgagccaagatcgcgccattgcactccagactgggcaacgagagtgaaaatccgtctcaaaaaaaaaaaaaaaaaaaaaaggaaagaaaaacacagaaagagtggaggactttaacatttcttgagtacctattgttttcctggcatgttctaggtgtcatatgtacagcatctcattgcatcttcacaacattcctgagcattaggttttcttttcccaggtttacaggggaagaaatggaagattagagaagttaagtagcttgggcaaggtcgcagctggtgaatggctgaatcagaatctgaacaccagtttgtctaattctatcctgcatgcta

SEQ ID NO: 8578 - DNA, 743 bp, artificial
  synthetic oligonucleotide
ctgtgctaaagcaagagaagtacaaatgtcaacaagcagaataagaagagtataacaagaaatggtaagaagtcaaggccaaaatctagatactgacctgtggataattgagaggtgtcagcaactctcttctaacatcaaacagacataataaaaacctaacaaaagatgttgaagtctgaccagcatacctcttactttgcataggtgctgtttggatttctatgcaagcctgtgcttaaaatcagccttcagattgaatgttgataacctttccttttttacatgcctcatttcagtttatggcattccaaccttttctccctcgtgacgaacacttttttgtatcaatgtgaggcaagctctgtcaattcatctaatcctcaaagaatttttgcagaataagtatgattatccccattttatagatgaagaaatcaaggcccagagaagttcaattagttgcctaaggccatacatctggcaaatgatagagttaggagttgatcccagatctgcctgattctgaaccctttgtttgatctttgtgttgttccatatcatttccctatttaagaaactcatttatatttgcactccataaatatcaagcctgtcgggactaagttgtaatgagttcagcatcaattcctgtttactggtctgggctaaacagtgctgatagtaatgctcatgtgaccactgggaaaggtccaagttcatgctctaatatctgacaacag

SEQ ID NO: 8579 - DNA, 463 bp, artificial
  synthetic oligonucleotide
acccattgggtttgtttatctagctgtgttatttttaagttgttttgggattatagcatgtagagttctaaaatgtgtcctaaaaaatacatagtttaaatgaaaatatgagtaatggaggtttaactccaccagatattaaaacatctcatgaggctgaaataatgaaatcaggagctattggcacaaaaatatggaataatctcaatgtcaatggaacagaaacccgagtatagcaatttatatttgataaaggaggtaacatgaatcattatagaaattcatgattattcaacaaatagtgcaggaacagcccatctcctctttgtaagaaaaaaaagaaacaaactggtgtggaaacttacctgacattgtacaacaaaatgaattatagataatttaaatagttacatgtaaaaaaaaaaaacaagttaaaccttaaagagcaagaactcatatagtt

SEQ ID NO: 8580 - DNA, 1303 bp, artificial
  synthetic oligonucleotide
cagagagggaggagcccgagggagtttcagtggtccgggagacaatggcatcagggacctctgctgctgcctacagattcacatgcagtattggcaatctcaggtcggctgtcggtttcacagtaagtaatggcatgagggtaaaagagaggaagtggctgagacttgagctggaatcgtagggcttaaataacttaaaaacagccaggatgcacaaaacacttatgattttgcctcaggtttgttatcacatccgttctcaagagactcactagtgagattcagatctttctttgtgggcagctggtagaggtcttatgagccctaattcccccagtaatcttagagggggatgtctggccaacccagtggagaaccttcgagtgaactacaaagaatacagcagaggagggagagctttacttggctgtcagctttgccacctgtttattataaattgctgaccatgtagccaagagcgtgaattttgtcattagccagacctgggttcaaatcctaacttggacactttctcttgggcaagctgcttaacctctctaagtgtcacttttctgattaatatatcaacgtaaatcaccctgggattgttaggattaaactaaaaaattgtgaaaaacagtcagtagactaacacatactaagtgcccaataaatgggtattttattattattatgaatgaaaattatgtatcccctgtatcaactggggtaagcagtattactctaattcaatatcttgctctaggaaacaggaaatttttttgagagtagcgtaaagggcaacatgctgacctgtctttactgagagtttgaaacctctaagtggaacacaaagtgaaatagtttgcagggattccataacgctggtcaagtgagtgttttcaaaacacctgggaagctgtctttttttttttttttttttttttttgagacagagtcttgctctgttgcccatgctggagtgccatggtgcgatctctgctcactgcaacctctgcctcccgggttcaagcaattctcctgcctcagcgtcccaagtagctggggttacaggtgccctccaccacgcccatctaactttttttttttttttgtatttttagtaaagatggggtttcaccatgttggccaggctggtctggaactcctgaccgcaggcgatccacccacctcggcttcccaaagtgctgggcttaccaggcgtgagccactgcgcctggccggaagctttctaaaaataaatattcctgggacctgcctccagatgatctaacacaaaatt

SEQ ID NO: 8581 - DNA, 917 bp, artificial
  synthetic oligonucleotide
tgcagagatgtggtcttgcatcttccagtagactgccttgggctcattcacaccatggtgatgttccaggcccagcacgccagtaagcctcaacgcacaaatgctttccaatctgccttttcttctattaaaaaaaaattttaattttggtttaaaaaataaaacgtaaaataaattttaccaccctattcattttaagtgtccagttcagtagtatcaactgtattgacattgctgtgtaacaaatctctagaactatgtcatcttgcagaactgaaactctatacccattgaacaacatctccctttttccctcccccaaatccctgacaaccatcactctactatctgtttctatgaattcaactaatctagatacctcatataagtggaatcataaagtaattgtctttttgttattggcttgtttcacttagtgtaatgtcttcaaagttattccatgtggcatatgatagaatttccttcattttaaaggctgaataatattccattgcatgtatatatcacatttttttaatctattcatccatttatggacatttgggttgctttcatctcttgactattgtgaataaagatgtaatgaacatgggtgtgcaaatatctttgagatcctgctttcaatgcttttggatatatacccagaggtaggattgctttattacatggtatttttattattaaatttttgaggaacctctatactgttttctatagtggctgcaccattttacactcccaccaacaatgcacaagggttccaatttatccatattcttgtcaacacttgttattttctgttttttggatgagaaattagtggcccattagtggctatcctactgggtgtgaggtgatatctcattgcagttttgattttcatttctaagtattag

SEQ ID NO: 8582 - DNA, 1193 bp, artificial
  synthetic oligonucleotide
caatttttgctctgttaccccttactaggccacacatatgtgtggatgcccccctcatcttgttttgattctagcatctttctgtaggctggtaaaggagccatactatatacatatttagcacaggcaaatttaactataaacacttataccagaaaggaggagaaaagaggaagaggaaagaaagaggtgaggagggagaggaaaagagaaggaaaggaggagaaaaagatgtagaaggagagaaagagggaagagagagagagagagagacaaagagaaacaccactaagacagtgcagttgattttactcacctttgcacttaatgggtatatgcccttgactgaacattaaattattacagtactcttattaggtagccactatgtgccccaatttatatatgtgtcaattgaggcttaaagaggttaagtgttgcctcagttcacaaagctagtatgtgtgacagaacggggattctaaactgtctggctgactcaagagctacgcgttcctgtgtccagggacgtgaaacccatttcctgctgtggcagcccattccagccttgcattaccttgactatcagaatgttttgtccttttttacaattgaaaatctgtctccctgaagtttttccacccattggtgttggtttcaccccttggggatatataaaacaattctgattgctcttccacatgacagcccttaaaatatttgtggacagctctcatatcccctgagttttctgttctctaggctaggcatttttagttcctacaactattcctcttatgagtgggaaaatgtctttcttctagcttgttatactgcactaatcttctacggtaagaaggattcagttcatgccccaaacataccctattatattcaggacaaaaggagagtctgacatttgcttttcaattgaagtggcaaatatggaattcaacctgccttcccctgcagacgtttattagtatatgagacataagtgccacatcctctttttcacataagcctttctgtacataaggttaaaccattggtatagaccccattttttttttttttaggaaagttcaagaattttcatggactattactcccatccatatgtcattaggaatatgtagtattacaactagctcagtacatttcataattacctggagctcatatgtctgatc

SEQ ID NO: 8583 - DNA, 5169 bp, artificial
  synthetic oligonucleotide
ctccagtggttgctacatagcctttagccaagacctgtttagaatcaccccatttacaagaaggtaatctcaagttttactatcactttaactctaaattttgaccttagggttaccccagaaacttcagagaagccatgagttttaaatatcatccggtctaaatctttttattttatagatggagaaatgcagcaaagaggagagtgatttgctcacggtcacatagctagaacacagaagggccttcactagaatccaggtaccctaactccctatttaatattctctgaagtccccttaaaaataaggttttgcagcctcaccagcccagactgttgctttgattgtatgcaaacaaagcatggcttttttttttttaatttttttaattttaattttttttttcttttgagacagagtctcgctctgtcgcccaggctggagtgcagtggcgcgatcttggctcactgcaagctctgcctcctgggttcacgccattctcctgcctcagcctcccgagtagctgggattacaggcaaatccaccacacgcggctaattttttgtatttttagtagagatggggtttcatcgtgttagccaggatggtctcgatctcctgaccttgtgatccgcccacctcggcctcccagaaagcatgttttaatggttttgaggaattatagagagtactaaacacattttaggatggaaatgaagtctagagtattttgataaagtcgccactttgtttttccactaaggatttgcctctgcaactctctcaaggagttaaaattctctacagttgtcagtaattgtgtgtgtgcataaataggcagtacaattcaatagaggagttaaatatgtgattaagagatatcttgcaatcagtgggaaactgttgtagcttagcacaaagaaggccgttttttgttgttgttgggagagacttgttttcttttagtcttttgatgctttattaattgtgataaggatggttaaaaatgatattttcctcataggaatagcatagtcttagaaaatttcagcttgctcaacactcaaagagtttaagaatattatgtatgacattgagatccacattttgttcttatcctaaccttgacatgagttctgagtctagtaatttcttgttcactgtgatgttaccaaaatatgactctagaaaaatttcaaaaactatatgccttgtgaaaaaaaggaaagctaatagaaagtaggcccttagaaaatgaggcaattattaagccaggcatggcagagcatggttctcttacccaagtctaggacttgtaaaaacacagatggccgggcatggtgactcacatctgcaatcccagcattttgggaggccgaggcgggtagatctcctgaggtcaggagtttgagaccagcctggccaatatggtgaaaccccatctctactaaaaatacaaaaattagctgggtgtggtggcaggtgcctgtaatcccagctacgtgggaggctgaggcaggagaatcacttgaactagggaggtggaggttgcagtgagtcgagatggtgccgttgcactttagcctaggtgacaagagcgagacttcattgccggaaaaaaacaaaacagaacaaaaaaaccaaacacaggttactgggcccctccctgagagcttcttttttttttttttttaattttcttaaacatcatttatttattcattttaatccacaaataaaaattgtttatatttatcatgaacaacatgttttgaaatatgtatacattgtggaatggctaaattgagctaattaacatacgcattacttcacatacttatcacttttttgtcacttaaaatcttctctctgatcaattttcaagtatactatacattgttattaactatagtcaccacattgtacaaaagatttcttgaactatttctccaatctaactgaaattttgtatcctttaacaaacatctctcccgccttccactcaaagctctagtaaccactactttgatgaattcaacttttttagattctacatataggtgagatcacgcagtatttgtctttctttgctttacttatgtcacttaacacagtgccctccaggttcatccatgttgttgcaaatgacagaactttctttttttaaggctgaatggtactccattttgtatctataccacattttctttatccatctgttgataaacacttaggttgatttcatatttttactattgtgaatagtgctgcaataaacatgagaatgcagatatctcgttgacatactgatttcatttcctttggatttatacccagtagtgggattgctggatcacatatagtagttctagttttagtttttttgcagaattttcatactgttctccataatggctgtactaattttcattcccatcaatagtgtagaagggtttcccttgcttcatatcctttccagcatttatctttcatctttttgataaaagtcatttaacagaataggtgagatgatatctcattgtggttttaattttcatttctctaagaaatacaaggcatccaagtaggaaaagaagaagtcaagctctttctcttcacagatgatatgatcctatccctagaaaaccctaaagactctgccaaaaggctcctggaactgataaatgacttcagtaaagtttaagatacaaaatcaatgtacaaaaatcagtagcacttctacacaatagtaaggttcaagctgagagccaaatcaagaatgcaatcccatttacaatagccacacacacacacacacacacaaaaaaaaaaaaaatacctagaaatacatctaaccaaggaggtgaaagatctttacaaggagaactacaaaacactgctaaaagaaatcacagatgacacaaacaaatggaaaaacattccatgctcatgtaaactactgtcattttaaacagaagtagaaaaatcttttttttttttgtcagagtcttgctctgtcaggcctaggctggagtgcagtggcgtgatctctgctcactgcaacctctgcctcctgggttcaagcaattctcccgcctcagtctcccaagtagctgggattacaggcgcccgccaccatgcgtggctaattttctgtatttttttagtagagacaggtttttaccatattggtcaggtcttgaactcccgacctcaggtgatctgcccaccttggcctcccaaagtgctgagattacaggcatgagccactgtgcctggcaaaaaaaaaaaaaaaaaattaaatttcacatgtaaccaaaaaaagggcccaaatagccaaagcaatcataagtaaaaagaacaaagctggaggcatcaatcacattacccaactcaaactatactataaggctacagtaaccaaaagagcatggtactggtacaaaaacagacacatagaccaatggagcagaatagagagcccagaaataaagccatgaacctacagtcatctgctctttgacaaattgaaaaaaaaaaaggaatggggaaaggactccctattcaataaatgatgctgggatatctggttagccatatgcagaataaaactgaacccctacttttcaccatatacaaaaatgatctcaagatgtattacagatttaaatgtaagacctcaaactataagaatcctagaaaaacacctaggaaacaccactctggacttgataaagaatttataactaagtcctcaaaagtaattgcaacaaaaccaaagattgacaagtggtacctaattaaactaaagatcctctacgtagcaaaagaaactatcaacagagtaaatagacaacctacagaataggagaaaatatttgtaaactatgcatctgatgagggtctaatatctagaatctataagaaacttgaacaattcaaaaagcaaaaaacaaataaccctattaaaaaatgagcaaaggacatgaacagacacttctcaagagaaggcatacaagcagccaacaaactaatgaagaaatgctccacatcactactcatcagagaaattcaaatccaaaccataatgagataccatttcacaccagtcagcatggctgttattaaaaagttaaaaaacaacagatgctggcgaggctgcagagaaaagggaatgcttatacactgctggtgggaatgtaaattagttcagcccctgtggaaagcagtttggagatttctcaaagaacttaaaacagagctatcagtcaacccagcaaccccattactgggtatatacccaaaggaaaatacattattctatcgaaaagacacatgcactcatctgttcattgcagcactattcacaatagcaaagacatggaatcaacctaggtgtccatcaatggtggattggagaacgaaaatatggtgcatatacaccatggaatactacacagctataaaaatataaaagcctgttctttgcagtaacatggatgcagctggaggtcattatcctaagcaaatgaatgcaggaacagaaaaccaaatactgcatgttctcacttataagtggtataagtgggagctaaacattggatactgatggacataaagatgagaacaatagacactggggactactagaaataggaaggagggaggagggcaagggttgaaaaacaattgggtaccatgttcagtacctgggtgacaggatcattcataccctaaatcttagcatcacacactacacccaggtaacaaacctgtatatgtatcccctaaatctaaaatagaagttgaaaaaaattttcatttctctggtgattagtgatgttgaacattttttcatatacctgttgggcatttgtatgacttcttttgagaaatatctcttcaaatccttttccattttttaattgggttgttttcttattattaatgcagtttcagatctaacaagttcccaggtgacgctgatgctgctggtccaaagaccacactttgagaaccactaatgtagttcattcaaaaaaaaaaaaaaagtaaagagtacttactatttacagagtaccttgagaatcgcactgtgctgagagagctgatggaggtacatggtccaaagtcaaagcaacaggatccctgtgtgccatgaacacg

SEQ ID NO: 8584 - DNA, 605 bp, artificial
  synthetic oligonucleotide
agaacagcagcaaaaggccagatgccgtagttataaaagttgcaaaagtatcataaacaccaggtgtgccatataaatgcacaggttttttttacactgccacactattatcatatggttccaacatctgttcgttcctgtccgggcttcccacagacagtatttattaaaatcaaatacgcactaactctcacttatgtgccttgagcaggaagtgccacagtggccttattatggcatgtaagtgggccaataaaaattgatttttatcagtaaagttccaattatccttacaagccaatatagtatcgtctgtatgccttgtacttgctaatgactctgtggtttctatgacagtggggccaatacaaaagtttttgttactaattccaaataattggaggatgagaggagaggccagtttagctttgtaaagagtctctattaaaaattattacttaaaaaatgttattttctgattttcaactagaggacatattcgaaattataaatgaatgtaaagaagtaaatattttaatgaaagtattaaaaggcttcacgaatttatatcataaagtgatacattaaaagcaaccaacctagca

SEQ ID NO: 8585 - DNA, 139 bp, artificial
  synthetic oligonucleotide
tattctcttaacagtgtcttttgtagagcaaacattttcaattttgattaagtttatgaattgtttcttttaagcatcaggcttttgctgtcatatataaaagttgtctgtctaacccaaggggtattagtttgctagg

SEQ ID NO: 8586 - DNA, 1255 bp, artificial
  synthetic oligonucleotide
aatgaaactgaaagtaccagttgaatactgtgtgaaagagttcctttaaaaatgctcttgtggagtcacaaaggacaggataattaaaactccttgcagagtttagttctttgacctctcattagtttcagcattataaattgccatttgttagcagcctaatttgattattagcccctctgagcttacagcatgcattctgaagagtgttctctacgtgactcagaacgcacgctgctgctgcatactggagatggaaaatggaggagcaaattgccttgctcctgtgtgttcatgagttagtcatactaaagtggttaaacaaagggaaagcagtcctttccaacatccacagttatgagtttgataaaagaaactcagtgggcagtatgactatttcattctggaagcagctttattaggtgtcatggagggaggaggagaaagaggaaattttagtccctatagttttatcatttaaaaaaattggcatgtcatatcaccttatatcaccctgcatggtgaaatagaaacttacttcctcaaggtatttcaacaaatgattgcaaagatttagagcaggggactactagcacactcattctttgcctctctgggtaggtactgtggtctcagcattttaattaatttcttgatattgctactagggggcttagcaagtgtaaacaggcttcttgccaaagccaatgtccataaaacaacctacttctattatttttaagggaacaagctgaatcagagggttgtgagaaagcagaaaaatacaataagaagaatatggaaatgaaacacccccaccctctgtgcttgccaaatacaaataactgaaaaaattgctcccactgcctccattacactccagaagatcaattaaggcaagcatgaaagtcttcaacttttccaagtttgagattgtgaaagaggcttatatgaagtgagagttacagttcgaaaaatgtagaagaacatacaatcataatagtagcagtaatagtaagcagtatatactacactctctctctttgtgaacttctgcttaatcagccactgaattaattaacagtaagacccagcaaggaatggccatggtatactaactgcttgtggctaatagagtggttagaagtagtgtggctggaaatatctagttcgcccagacatttctgcttcaatcatttaagttgtacgcttaccaaacattagttgagcttgttccaaatctatttatgccagt

SEQ ID NO: 8587 - DNA, 302 bp, artificial
  synthetic oligonucleotide
ttttattgtattgggatcatttaaaattagcaggagatatttgacataaccaaatttgaccagttttttttttctcttccaaaccctgtggaaatatgtttgttaaagacggcatcactaggtttaacttgaaaatgttttatttttttatttctattatacacattgttttagtggtttaagttcaagagcaaaattgcagtgctctccctttttccttaccttgcagagatatttaatttctctaactatggtcccatttttcatttaggtctcttaaggctgcctggttttttaatgta

SEQ ID NO: 8588 - DNA, 1552 bp, artificial
  synthetic oligonucleotide
gtgtctcacccaaattctgagttaacgtgagaagaataaaaatggcaaagagaatttttgagatagttaagtatagcaaagataataaccaccacttttgaatttctggaattctgaaatacattcatagaagtatagctcaattattatttacacttagtgtaaatctaaggaaattattacacagatattgtcacattgcagatttccctttcagaataaggaagacttttttttctggacagaacttggcacacttaattgagtatgcatcctgacatgctaaaatatgaacactgatgacccctgaaatttttatcagatcagagcaaaaataaattcaactttcataatttatctttctctttctcaaacagaatactaaaatgccagtttcctgccttttgaactacttttagccaaattcttggaaggtgaagaaacttgtgtgggtttaaattcttttccattaacatgcattgttctcatttccaaagattattcttacatattaagcatttatttccctaagtccccaaaaagcatttttaaagcacttaagtatttgctaagatctgccaagatcccatccttttcctttggttgcttaatcaatatcttcttttgttcagtactctgattttcaccttcaaaaatctcttgatggcaatgaactctgctctccttagaagtcatatgcccttaatattcccaagcaacattttctcactggagaagctgtttgaaatcaaaggaaagcttttaaagatgtgtatcatttggtctccttaagctattctccgtgtgtggtagtttctttttaatctctaaggaccaacttgaattttggaagagagacgagtcatctacatgcttcgcatttcaccagccttaacaagtaaaacctgatgttattagaatcattgatatatctagtattgaaggtggaagagaccttaaatgtcatctattcaaactattcatctaacttttcattattcagacagttaggaattcatcgacaaaggcgttgaaaagaggcataactttatcctttataattaatgaatttagtaagacgcattcttgggtccctagaaatcatatctacagcagccaagagaataagaatatataatttcctttaaaaatgagaggaaaatctttgtacgcttatttgtaattgaagaatattttatttctcttttctgaccagcataatgtacagccatttgagaaaatattataaacagtaggtatgtctaaatttctattcagggtttggtgtttttatagtctgctcataaaatatcttctagaacctctccttctgtaactttttcactgaggtaaattctctcacctttttgtagcccacactatattttcaacatcttagcatttgtaatcattatcatgttttgttaaaacacatcctttcaagaaaagaattattctagaactgctgaatttcaggctttttacccctgccttgatggtaccagaacatggcaaatgtaattaatctgcccaaacacaaaagttgtgaatt

SEQ ID NO: 8589 - DNA, 19586 bp, artificial
  synthetic oligonucleotide
acattcttatgagtatagcagaagttggtgaggatcaaagaaaagaaacaaaggaaaccattctgtgatctctcctcagcaggtccactatcctctctaatgttcctggggttttttctttataatatatatcccagtttgtgaacacttgtttcagtgaattttagataccattaatataagatgcgccattatttgtatggattactgaaaacaaactaaaaatgctgccaattaagttatgacgcaacatcaattattagatgcctcaagatctcagagatgattaaatgtaaaaaaatatatgaatcaaagcattatgggatttacttacatataataatcatacatacttattgtctgtcttttccactagaatctaagatacatgagggtaggaaacatgtctaactttttttatcatatgctcagagaaactaatataatccttggtataaaatcagggctaagtatgaatttgttaaagcaatgaatgacacaggtaggctctaacaatatttcctatggctcaatgctaccatgtttattttgtgtgtggcatggtagggatggtggatatttatttaaaatattaaaagtacacataggaaccggagaaagagatctaagaatgaccaagaatcttagcactgaaagactacttgtgttatagactaaatcttgatacttaagaaggatccttatgagacggcacacaagaatattctacccaacattgtttctgaacatgcttttctggaaaaatgccacctgatatttgataggtggagttgttaagggctgaatgccaatcaaggaaatattgtccagctttctaagaggctaacagcattaaagaaagattgtatttgcttgagttaaaacatacagaaccactatttatacataagactcgatcaatcctgatttcaccaggtggagatgtttttcggctataaaacttctggataattctcaaacttcattgaataattataaaatggagatctgtggaccccactcccaggtattttctgaattttgttttcttattcaaatatatttcatgaaaattcttcaaagaaagcttgcatagaagtgatccattcttttttaatggcttcagaagatactattttgaaaatgtaggagaatttatttaacaatgtcctttttgaaacacatgcactttttacatttttttttgccacgatcaacgatgatatatgtatatgaaggtatatatatgtacatccatatatacacatatatgtaaaataagtgtatctaatagtaataagtgaacatagtagataaggtgtccatatctattttttttattttttactttttttaaattataccttaagttctggaatacatatgcagaacatgcaggttacataggaatacatgtgacatggtggtttgctgcacccatcaacccgtcatctatattaggtatttctcctaatgctatccctccccttgcccccacctcctgacaggccacagtatgggatgttcccctccgtgtgcccataagttctcattgttcaactcccacttatgaatgagaacatgcggtgcttggttttctgttcctgtaatagtttgctgagaatgatggtttccagcttcatccatgtccctgcaaaggacatgaactcattcttttttaaggctgcatagtattccatggagtatatgtgccacattttctttatccagtctatcactgatgggcatttgggttggttccaagtctttgctattgtgaacagtgctgcaataaacatacgtgtgcatgtgtctttacagtagaaggacttataatcctttgtgtatatacccagtaatgggatttctgggtcaaatggtatctctggttctagatccttgaggaatctccacactgtcttccataatggttgaactaatttaaactcccaccaacactgtaaaagtgttcctgtttctccacatcctctccagcacctgttgtttcctgactttttaatgattgccattctaactggtgtgagatggtatctcattgtggttttgatttgcatttctctaatgacccgtgatgatgagctttttttcatatgtttattggccacataaatgtcttcttttgaaaagtatctgttcatatcctttgtccacattttgaaggggttgtttttttcttgtaaatttgcttaagttttttgtagattctggctattagtcctttgtcagatggatagattgcaaaaattttctcccattctgaaggttgcctgttcattctgatgatagtttcttttgctgtgcagaagctcttcagtttaattagatcccatttgtcaattttggcttttgttgccattgcttttggtgttctatgaagtctttggccatgcctatgtcctgaatggtattgcctaggttttcttctagggtttttatgttttaggtcttatgtttaagtctttaatcaatcttgagttaatttttgtataatgtgaaaggaaggagttcagtttcagttttcagtatgtggctagccagttttcccaataccatttattaaatagggaatcctttccccattgcttgtttttgtcaggtttgtcaaagatcagatggttgtagatgtgtggtgttatttctgaggcctctgttctgtcctgttggtctatatatcagtttcggtaccagtaccgtgctgtttcggttactgtagccttgaggtatagtttgaagtcaggtagcatgatgcctccacctttgttctttttgcttgggattgtcttggctatttttggttccatatgaaatttaaaatatttttttctaattctgggaagacagtcaatggtagcttgaggagaatagcattgaatctataaattactttgggcagtatggtcattttcacgatattgattcttcctatccatgagcatggagtgtttttccatttgtttgtgtcctctcttatttccttaagcagtggtttgtagttctccttgaagaggtccttcacatcccttgttagctgtattcctaggtattttattctctttgtagcaattgtgaatgggagttcattcatgatttggctctctgtttgtctctgtttgtcgtataggaaggcttgtgatttttgcacattgattttgtatcctgaggctttgctgaagttgcttatcagcttcaagagtttttgggctgagatgatggggttttctaaatatacaatcatgtcatctgcgaagacaatttgacttcctctcttgctatttgaataccccttatttctttctcttgcctgattgccctggccatacgttgaataggagtggtgagagaggacatccttgtcttgtgccagctttcaaagggaatgcttccagcttttgcccattcagtatgatattggctgtgggtttgtcataaatagctcttattattttgggatacgttccatcaatacctagtttatttagtgtttttagcatgaaagggtgttgaattttattgaaggccttttctgcatctattgagataattatgtggtttttctcattggttctctttatgtgatggattacgtttattgatttgtgtatgttgaaccagccttgcatcccagggatgaagccaacttgatcatggtggataagctttttgatgtgctgctggattcagtttgccagtattttatttaggactttcacattgatgttcatcagggatattggcccgaaattttctatttgtgttgtgtctctgccagattttggtatcaggatgatgctggcctcataaaatgagttagggaggagtccctctttttctattgtttggaaaagtttcagaaggaatgctaccagctcctctttgtacctctggtagaattcggctgtgaatccatctggtcctgggctttttttggttggtaggctattaattactgcctcaatttcagaacttgttattggtctattcagagcttcgacttcttcctggtttagtcttgggagggtaaatgtgtccaggaatttatccatttctttgagattttctagtttctttgcatagaagtgtttatagtattctctgatggtagtatgtatttctgtgggatcagtggtgatatcccctttatcattttttattgtgtctatttgattcttctctcttttcttctttattcatctggctagcggtctttatattttgttagtcttttcaaaaaaccagctcctggattcattgattttttttgaagggtttttcatgtctctatcttcttcagttctgctctgatcttatttatttcttgtcttcttctagcttttgaatttgtttgttcttgcttttctagttcttttaattttgatattagggtgatgatttcagatatttcctgctttctcatgtgggcatttagtgctataaatttccctctaaacactgctttagctgtttcccagagattctggtacgttgtgtcttttttctcattggtttcaaatagcttatttatttctgccttaatttcgttatttacccagtagtcattcaggagtaggttgttcagtttccatttagttttgcagttttgagtgagtttcttaatcctgagttctaatttgatggcactttggtctgagagactgtttgttatgatttccattcttttgcatttgctgaggagtgttttacttccaattatatggtcaattttagaataagtgtgatgtggtgctgagaagaatgtatattctgttgatttggggtgaagagttctgtagatatctattaggtctgcttggtccagagctgagttccagtcctgaatatccttgttaattttctgtctcgttgatctgtctaatattgacagtggggtgttaaagtctcccactattattgtgtgggagtctaagtctctttgtatgttcctaaggacttgctttatgaatctgggtgctcttgtattggatgcatgcatatttaggatagttagctcttcttgttgcattgatccctttaacattatgtaatgcatttcttagtctttttgatctttgttggtttaaagtctgttttttcagagactgagattgcaacccctgcttttttgctttccatttgcttggtaaatattcctcctcccttttttttagcctatgtgtgtctttgcacatgagatgggtctcctgaatatagcacaccaatgggtcttgattctttttccaatttaccagtctatgtcttttaattgaggtatttagcccatttgcatttaaggttaatattgttatgtgtgaatttgatcctgtcattatgatgctagctggttattttgcacattagttgatgcagtttcttcacagtgtcaatggcctttacattttaatatatgtttgcagtggctggtaacggttttgtcttttccatatttagtgcttccttcaggagctcttgtaaggcaggcttttggtaacaaaatccctcaagcattggattgtctgtaaaggattttatttctccctcatttatgaagcttagtttggctggatatgaaattctaggttgacaattcttttctttaagaatgttgaatattggcccccactctcttctggcttgtagcgtttctgcagagagatccactgttagtctgatgggcttccctttgtgagtaacctgaggtttctctctggctgcccttaacattttttcctttatttcaaccttggtgaatctgacgattatgtgtcttggggttgctcttctcgaggagtatctcagagatgttctctctatttcctgagtttgaatgttggcctgccttgctaagttggggacattctcctggataatatcctgaagtgtgtttttcaacttcattcaatttttcccatcacctacaggtacgccaatcaaatgcaggtttggtcttgtcacatactcccatatttcttggaggctttgttggttccttttcattcttttttctctaatcttgtcttcttgctttatttcattaagttgatcttcaatctctgatatcctttcttctgcttgattgatttggctattgatacttgtgtgtgctccacgaagttctcacgctgtgtttttcagctctatcacgtcatttatgttcttctctaaactggttattcttgtttgcaagttcctgtaaccttatatcaaggttcttcacttccttgcattgggttagacatgcccctttagctcagaggagcttgttattacccaccttctgaagcctacttctgtcaattcgtcaaactcattctccatcaagttttgtttttttgctgacgaggagttgtgatcctttggaggagaagaggcattatggtttttggaatttttagcctttttgctctggtttttcctcacctttgtggatgtttctacttttggtctttgatgttggtgacctttagatggggtttttgtgtgggtgttcttttgttcatgttgatactattctttctgtttgttagttttccttctaacagtcatgccccttgctgcaggtctgttggagtttgctggaggtccactccagatcctgtttgctgggatatcaccagcagaggctgcagaacagcaaagattgctgcctgttccttcctctggaagcttcatcccagagagacacccgccagatgccagccagagctctcctgtatgaggtgtctgttgacccctgctgggagttgtctcccagtcaggaggcatgggggttggggactcacttgaggaggcagtctgtcccttagcagagctcaagcactgtgctgggagatctgctgctgtcttcagagctggcaggcaggaacatttaagtctgctgaagctgcagccacagctgcctcttcccccaggtgctctgtcccagggaaatgggagttttatctatcagcccctgactggggctgctgcctttctttcagagatgccctgcctagagaggaggaatatagagcggcagtctctctacagtggctttgccgtgctgcagtgggtcccgctcccagtttgaacttcctggtagctttgttcacactgtgagggaaaactgtatattcaagcctcagtaatgttagacgcccctcccccaaccaagcttgagcaactcaggtcaacttcagactgctgtgctggcagcaagaatttcaagccagtggaccttagcttgttggtctccatgggggtgggatctgctgagcaaaacaacttggctccttggcttcagccctctttccaggggagtgaatggttctgtcttactggcattccaggtgccaatgcggtacaaaaagacactcctgcagctagctcagtgtctgcccaaatggccacccagttttgtgcttgaaacccagggccctggtggtgtaggcatccgagggaatctcctggtttgcaggttgcgaagaccatgggaaaagcatagtatctgggccggagtgcgctgttcctcacggcacggtccctcacggctttccttggcaaggggagggagttccccaagcccttgcactttctgggtgaggcgaagccccactctgcttctgctcgcccttggtgggctgcatccactgtccgaccagtcccaatgagatgaagcaggtacctctgttgaaaatgcagaaatcacctgccttctgcagtggtctcgctgggagctgcagaccaaagctgtttgtatttggccatctttcctgggaatggtgtttttattttctaaaattgagatttctagattgaatatatatatcaaaaataatttccagaaaatctttattaattcatattttcactagatatgtatgagaacatcttttccactatacataaactatatatatctgttatcactgctttttcataatattaaatttttaagtggtctaatatgtctactttattttcttttaaaactcctgagtttccagtttaggttaagaagctgattatgttctctggtgcacaattttatatgtagacgcctatatagtcttacataaattttatttgttcacattcaagcctttaatccatttgaagcttgttaatgtttttgtttgctttacgtgaggggattacatttattttcttttatatggatagctagttatgccagtaaaatttatagataatccatcccttcttaaaggattaaaatatcaaccttgccatgttaaatggccatatatactggaatctatttcagttttctccattgtgttctaatgatctacttgcatattgatttgattaaagttaatttatagtattctctattgatgaagcaagtttcaacccatgtatttttcataagtttttggctatatttgtcatttaatcttcaattaattttaagatcattttacccaattatgaaggagcaacattgttgggattctaattggaattgcattgatttcagagattatcttttgttttactgatagttctataatatttactcaggacttgtttcaaattcttctgtaaatgcttatcattttcttcatataagttctttcactttttatttcaatttttatttttcgttattgtgaatgaaaaaaatttttcccactgttttttctaggttcttattttaaggataaagaacagcacttaatatttgcatatttatgtattattctggcaactcattaaattctacttctttctgtagagtacatttaggttttccagtaaacgatcctatactcatttttttcttctttttaatgtttatgccaattattagttgtctcaccttattgcagttgctagagtatccaagacaatagtcaaaataaacaagaaacacttgatgccttagttattgattttaattatattggttttagggtatgattgtttgagataatatttgtttggggtttttatagtatttattatatttaagtagttttattccttgccatcttatttagatactttactagagatggctgctgaactttattgaataactctttagcatttaaaaaaatttttaattttattttttttgggtacatagacgtgtgtatatttatgggatacataagatgttttgacacaggcatgcaatctgcaacaatcccatcatggaaaatggggtatcccaccaccacaagcatttatccccgtgttacaaaacataaaattataatattttagttgttttaaaatgtatgattaaattattgactatagtaaccctgttgtgctatcaaatactaggtcttatttattttttctaactattttgtttttgtacccattaaccatccccacctccccaccactccctatgcactaccctttccagccactggtaaccatccttctactctctgtgtccatgagttcaattgttttgatttttaggtttcttgaatcagtgagaatgtttgtttttctgtggctggcttatttgacttaacataatgacttccagtcccatccatgttgttgcaaatggcaggatttcattcttctttatgactgaagagtacttcactgtgtataagaaatgcattttctttatccattcatttgctgatggacacttaggttgcttccaaatcctggttattgtgaacagtgcttcaataaacatggaagtgcagaatctcttccacacagatttcccttctttgggtatatacccagcagtgggattactggattatatggtagctcaatttttagttttctgaggaacctccaaattgttctctatagtggttgtactagcttacatttccaccaacagtgtatgaggattcccttttcctcacatccttgccagcatttgttattgcctgtctttttgatgtaagccattttaactatggtgagatgatatctcgctgtagttttgactggcatttctctgatgatcaatgatgctagcaccttttgatatgcctgtttgccattttgtgtttttgttttgagaaatgtctgttcaaatcttttgcccattttaaaatcagattgttagattttttcctatggagttgtttgagcttcttatatattctgattatgaatcccttgtcagatgaatagcttgaaaatactttctgccattctgtggcttgtctcttcactttattgattgtatcctttgctgtgtggaagctgtttaacttgatatgatcacatttgtccctttttgatttggttggctgtgcttgtagggtataactcaagaaattttttgcccagaccaatatcctatagagtttcccgaatgttttcttgtagtaattttatagtttgaagtcttagatttaagtcttcaatccatttcaatttcatttttgtagatgtttagagataaggggtctagtttcattcttctggatatggatatccagtttcccagcacaatttattgaaaacaccgtcttttccctagtgtatgttcttggcatctctgttgaaaatgaattcactgtaggtgtgtaaatttatttctggattctctcttgtgttccgttggttcatgtgtctgtttttgtgccaggaccatgctattttggtgactatagctctatagtaaaacttgaaatcaggtaatgtgaatcctccagttttgttctttttggtcaggatagctttggctattctggatattttgtggtttcaataaattctaggatagtttttttctatttctgtgaagaaagacattgttattttggtagaaattgcattgaatctgtagattgctttgggtagtatggacattttaacaatatagattctttcaatccatgaacatagaatatattttcattttttgtgtcttctttaatttctttcatcaatgttttatagttttcattgcagaaatctttcacttctttgattaattcctagatattttattttatgtgtggcaattgtaaatggaatttttttatgtctttttcagattgttccctgttggcatatagaaatgctactgatttttgtatgttgattttgtatcctgcaacttcacggcatttgtttatcagttctaatagttttttgctggagtctttatgttttccaaatataagatcatatcatctacaaacaaagataatttgatttcttcctttccagtttggatgccctttattccttgctctaggtaggacttgctctaggtatgcttgctctaggtaggacttccagtaatatgttgaataacagtggtaaaagtgggcatccttgccaagttccagatcttagaggagagtcttttagttttttttttttttttttgattcagtatgatactagctgtggatctgtcatatatggcttttatcatgttgatgtttgttccttctatatccagttttttgagcgttttcatcatgaaaggatgtgagttttatcaaatgcttttgcaccatcaattgaaatgatcacgtggttattgttctttattttgttgatgcaatgtatgtatcatattgattgatttgtgaaccatccttgcatccctgggataaatccctcttggtcatgatggatgatctttttaatacattattaaattcagtttgctagtatgttattgaggttttttgcatcaatatttatcagagatactgacctgtagttttcttttctgatgtgtctttttctggttttggcatcagagtaatactggactcacagaaatgaattttgaagtattccttcctcttctattgttcaaaatagtttgagtaggattggtcttagttctcctttacatatttggtagaattcagtggtgaagctatcagtcctgggtttttctttactgggggactttttattacggctttgatctcatgacttgttataggtctgttcaggttttaaatttcttcctggttcaatctttgtatattgtgtgtatataggaatttttacatttcttctagattttccaatttattggcatatagttgctcatagtagctcctttgaatttctgcagtaacggttgtattgtcgcctttttcatctctgattttatttattttgatcttctcttttttgtggttagtctggctaaaagctggtcaattttgtttatcttttcaaaaaaaacacctaagtttttgtttcattggttttttaatggttttcttcatttcaaatgcatttatttattatcatgattatttcttttcttctactaattttgaatttggtttgctcttgcttttctagttctataagttgcatcattagattatttaaaaattttccaattttttggtgtaggcatctatagctgtaaacttccatttttagaactgcttttgctgtatcccataggttttggcatgttgtgtttcctttatcatttgttttaaaaaattcttcactttccaccttaatttcttcattgacccactggtcattcaggagcatattgtttaattttcatgtatttatatagcttcaaaaattcctcttattattggtttgtagttttatttcattgtgggcagagaagatccttgatattatttcattttttttatgttttcagacttgttttgtgacctaacatatggtctatccttgagaatgatccatgtgctgaggaaaagaaagtgtattttgcaacagttggataaatgttctgtaaatatctactagattcatttcgtctatagtggagattaagtcaaatgtttctttattgattttctgtctggaagttctgtccaatgctgaaagtgtggtgttgaagtctcctgctattattatattagggcctatctctctcttaaggtctatccatatttgtcttttatatccgagtgctctcatgttgggtgcatatataattttaattgttataacctcttgatgaattgacccctttaccattataaagtgacctcctttgtctcatcttataatttttttcttaaaatctatttggtctgatatatgtataaatacttttgctttttttgaattccattggcatggaatatgttttttcatccctttattttcaggttatgtgtgtctttatgggtgacatgtgtttcttgtaggcaacagatcattgggtcttgttttttcatttattcagccaccctatgtcttttgattagagtttagtctatttggagtcaatgttataattgataaggacttactcttgccattttgttaattgttttctctgtgtgtgtgtgtgtgtgtgtgtgtgtgtgtgtgtgtgtatgtgtgtggtctactcattcttctttctttccttgctgtcttctttttagtgaaggtgatattctttggtggtatactttagtttcttgctttttattttttgtgtatccattgtgtattttattttttgtgtatccattgtgtgtttcttggtttgaggtgtctatctttttttaaaaattagaaaaaaaattctttatttcttctaaaaaaaaccccaaacaaacaaaaaagggatacatgtgcagaatgtgcaggtttgttacatagctttatgtgtgccatggtggtttgctgcacctattgacccgtcctttaagttccctctcctcacccccaacccctaacaggccctggtgtgtgtcattcccttctctgtgtccatgaaaaacactatgttataacccatttttaaaagctgataacaacaccatttgcataaacaaacaaagaagcagagagaaaactaatactctccacctttactttgtccccctgctttttaactttttgtggcttctccttatatcttattgtactatgtcttgaaaatctgttgtaattattatttttggttggttcattgtttcacctttctacttaagataggagtagtttacataccacagctgcaatgttataacatctgtgtttttctgtatacttaccagtgagtttggcaccttcagataatctcttattcctcattaacattcttttcttttgttttgaagtatgcccttcaccatttctcaagggacaggtctggtgttgatgaaatatctcagcttttgtttgtctgggaaagtcttttttatttgttctccatgtttgaaggatattttcacgtgatgtgcaagtctaggttaaaagtttttcttcttcaccactttaaatatgtcatgccactctcccccggcctgtaaggtttccactgaaaattctgttgccagatgtattggagctccattgtatgttcttttcttcctcttttcttgctgcttttaggatcctttatctttgacctttgggagtttgattattaaatgccttgaggtagtcttctttgggttaaatctgcttggtgttttataaccttcttgtacttggatattgctatcttcctctgggtttgagaagttttctgctgtgaattttctacccttatctctttctcttttgcttctttaaggccaataactactagacttgcccttttgtggctttctagttcctgtaggtgtgctttattgctctgtattcttttttctgttatctcctctgactttttattttcaaatagcctgtctttaagctcactacttctatcttctgcttgatcattctgctattaaaagactctgatgtattcttcaatatgccaattgtatttttcagcttgagaatttctgcttgattctttttaattatttcaatctcctgttaaatttatctgatagaattctgaatttcttctctgtgttatcttgaatttctttgagttttgttaacacagctattttgaattctctgcacaaaagggcatatatctctgtttctccagggttggtcccttatgccttaattagtttatctggtgagaaaatgttttcctggatcattttaatacttgtagacattcatctgtgtctgggcttgaagagttaggtatttattgttgttttctcagtctcggcttgtttgttcccatcctgcttgggaaggctttccagctattctaaaggacttgggtgttgtgactgaagctgttatctccttgaggggttattccaagcccagtgacaatgtggttcttccagactcatagaagtactgctttaatggtcttgaacaagatctgagagaattctctggattaccagttagagactcttgttctcttcccttactttctaccaaacaaatgaagtctctctctcttttctgatccacctgcagctggcggttgagtgacacaagcaccactgtggccgccacctctaggactgtgctgagtcagacctgatgccagcacaccactgggtctcacccaacgccatctgtaactactccctggctaccacttatgtttgctcaaggctctggtgctctataatcagcaggtggcaaagcccaggcctgtgtccttctcttcagggcagtgagattcctcaggctctgggtgggtccagagatgccatctgggagccaggggagagtcaaaaaccttagatgactacctggtgttctattggactgcagctgacctggtactctagccacaaaatgcagtctttctcactcttccctcccctttccaaaggcagaggagcctcactccatggccgccaccactacagtcccaaggggagtgctgtcagactatcaccaatgttcccttaaggcccaagggctcttaagtcagcttgtggtgaatgctacctggcctggaactcacccttcagggacttgggctcccctttggcccagggtatgtccagaaatgccattccagaaccatgtcctggaatcagggaccccaagaatccactaggtattcctccctgctgtgactgaactgatatctgaagtcagcatgtctcagagtctcatttgaggccctcaatgtagcacctgggtattgctgctggttattcagggcccaagggctcttcagttaacaggtgatgaagcctgccaagactagatctttcccttcaaggcagcacattaccttctgtcccagggtgtgtgcagaaatgtcacctataagctaggaactgggaagaaagcctcgtgactctgaccagtgcccgatcctactgtggctgagctggtatccaagatgcaagacaaaatcctccccactcttccctctgctctcttcaagcaaaaaaaagtggtcccttttggagccatgagctatgcaccctggcgttaggggaggggggatgccagcagtctcttggctgcccttgctaatgtctcagaaggtcatagaccctcccagtccactgtctctgggcccagttcatcactaggattcgcctaggagttgctgtccttgtggcctagactgcctttcaagtttatttgagactccaaagcacattagcctgtgatgggatcacaaattccaaccactgagattggcgattcccttctggctaaggttggtttaaatgctccctccatgagctggtatcagctgagtttggtctggtttttgtttctgctataacaggccagtgctgagttcagtgccttacaattgctgagttcttctgctctgaacgcacaaaaatgctctctgcaccatgttgccactgctggaggatgggagaggggtggcattggtgattcaagactatttttcctgccacttcactgcctctttcagccaaatgtgcttaaaaccaggtaccgtgaatgctcacctgatttttggttcctttgaaggtgttttttgggtgcaaatagttgttaaactcgtgtgtttgcagggggaatgatcagtggagtcttctattctgccatcttactctgcctattttagtatttgttgtacgagtttttcaattctttttgggtcattattaaaacttgtattttgttagaagatcatcaattttttctctaggttttcaaatttgttgtgctggaattgtgtattaaattctctttagaaaagaattgtaatatgttaaacttttatgtatctgtaatgatgtttcacttatgactctaatttgtatttttactctcttttctttatctcatgagaccattaactattttattgatttttaaaaaaggtttatctttgtgtattatatataatatagtttttgctttccaattcactacttcagctttatctttattaaacattcctaccttttaggcttatcatatcattcttttccaaatattttaaatgagaaataatcatatattttcataattcttttttaatatctatgacatttaagcctgtatattttcttctaagtaaagaggcttctgcatcccatatgttctaattaaagaagtgctttctttttagttcattggagataggttttaatttcaattttgattgcctctatgatgtaagtgtcatttaaggttgtattttctagtttccatgtagtgaagatgttttttggttttttggggctttttttttggtcaactttttataatttctttctagtttgttggattatgacagaaaatgtagcttgaatgtagaaccttttgaatgtgttaagttttgatttttggatgaatacatgatttttaaaaatgttcaatgggcaagtgaaaaaagtgtctatttggggaagacaaggttctgtgaatgtttcacacagttaaattcaacataatttagtagtttacctttatccatggtggtgaatacattccaaaaaccccagaaagcacaggtacctatatacagtgtgtacccaaacctgtatatactatgatttttcctatacatatgtacatatgataaacttgcatgttttcacttaaagaaacactttatggcttttctttggcatatcaaaattgctggcatcactacgcttgcactttgggaccactattaagtaaagtaatagttacttgaacacaagcactgcaaaagtccatctgataatccagacgtctactaagtgactatcaggagggtagtgtatacggtttggatatgctggacaaagggacaattcacattccaggctggatggagtaggacaatacaggattctatcatgctactcagaattgcatgtaatttaaaacttatgaattgtttgtttctggaattttccacttaatattttcagaccatggttgactgtgggttactgaaggcaaaatcatggataagagggaactactgtattatattctattgttaacatatatttgcctgattcaatatgtccacctctgaaagagatatattgatctctcttaccataatcaaacttttaatcaatttcttctttaatcaatcatatcttcaatcaatttatagcaaacttttgcataataaatttgtcttttctgatgtaaagaactatatgactaatatcttttctgtaaattccattttttattttaataaatcatgccctttactatgcttaatgcttttatatttaaaggctactttctattgttttaataatgttactgttacttattgtggcattgtcctgatagcctctttcccagttttaaaattttcattatttcattattactttaagaatgttttctgtagaaggcacgctcgtcagatttttttgaaaaaaattacagtccatgagtctcagtcttttaatgcaaaaagtcacttcattcacacttaattcagtgactgatatgtttgatttcattgtaatcatctttatttttaaaatttattttatgttattttctcttttttagtttcctcatttttcctggtttgaaaaagttaatataaattttgggatcttcaacgcttaggctctgtttaaagtcatcagacaggatgagatgacccagaagtgagggagggtgataagagatctgaggactgagtcctcaggttcttcaatatttaaaggtcttaaaaattatagagaattaaccaagaagactataagcaatagtcattgatgtaagaggcttttcaaaagagagactattgcccaggagaccaagtaaagtgtttcaagaagaagagagtgataattatgttaaaatggtgctaataggtcaaaaaagattaggactgaaaattggatttaacaatatggtaaccattcatgactttgacacattttggtggagtagtgggggcaaaatcctaatgatttaaattgttgaagagaatgttagagggacttttgattacagagctgtgaagattttggtggcaaattataagtataaaactggacaaaatagtcaaaggcaaacatctcagggcactggaaattgagcaaaggctaacaacaaattgagaaatgtttattcttgaaaaactgcaagagcttttagtaagaacagtgaagatattatggtatccttgcctgaggaagttctcattatcctcacttccccaccaatttctgtggtcagcaagaatgatatatattttaccatttggtgacttctcatgaagaacagaaaatttgttgtcagaaagcaggacttaattgtgagtggtaaaaattcaatggcttttctgactaaaaattgtgtactag

SEQ ID NO: 8590 - DNA, 1998 bp, artificial
  synthetic oligonucleotide
cagactttacagaaaaactaacctttcagctaaaagcttgctagtgagtgtctatgtgtgtgtgtttttttcttcatgatttgagccaagtgcaaagacttacaaacttgttctgaacaggggaaaatatttcctttttcattccttaaaattatgcctttccatgtttttcactaagcaaaactctcccggttatctgctggcactagagggttaagttaaatagtgaggcagggagctgctataagatttttatagctgtattaaaatgagaaatggtaatgtggctaagcaatttctggtcaggtgatctcaaagatttatacatgtggttttaagatatcattcaccaatcacatcacactactaatcttgctcatttaataagcatgtctattttgttactttcattcagttgttgtctaatgaaataatgtgggtagtttgaaacaagcacagagaatacaaaattactcttctatgatgtgatctgatttggattcagagcaccactgagagacttatgtaaggtttcaaaaacagaaatctgtgcataccaagctttagcctagtggtttccaacatttttgtaatggcaacatcctgccagtaatttgattttgtgaaccttgcactccaatctgactggtatcaataacacacagtttaaaacaaagtaaattaaccacacatttcttttgaaaaaaattttactttgttggtaactattgagataatcagaagtgggaaattcatgttgaagtgttatagacaatggttgaaaataaccattatttatgatggacagtataaacataatatgccaactaacagaatacttttctttttccatcccccaaattttagcgtttcaattttaactggtttgctctaataaatttgtttacttctaggacaccaacaaatacgaattagaatatagaaagtcagtgattactatcacatctatttgtaacttcagtactttcacattttcattagcagtctgaatgctaagtaccacatttctatatttctctaaagccagtgattgcagtgtgcagcagaaaaatattaattattataaagcctaattaaaattgaaagcaaagctttaataagtataaataccattgtttatcaaatgtggaaaacacacattaattattattttgcaaaccctatccttagactcatatgtgtaactcccagatacaaagacaatagcattatgaggtggtgatgtgggtaggaatctaagctttagggacatcagtacgtctaaaggcagtcagcatattaggatttttgaggggacaaaaggctacttttttacacaagggttagtattttgataatgacaaaagaaaaatactgcatgtaaaaacatttgctctctatcttttttggtgactctaaatacagtaggacagggaagtaaaaagcagatagcaaaaagacagcttgtgaaatgcacacagtttgttatcagattgccagtagttgtgaagaatgggaaagtaaagggagggaagacagaaagaaaagaagatgtgagaaaataggatgctttccatttaaatgatgttttagcataaatcacacttctaaaccaaactgcagaaataattaatgaaactagtatcatttttcttgttttatgatatgagtttcgtatcaactgggtcaaatggtgctgttgagcagcaatagatcattgtgaaatctctcatggggcaggacaggaaatgctgaattgtttgagttgctcaaggtgcaaccaatacctagatttcccgtcttgtatgtaatgatacaaaatagatcctatatgcacaaattataagaaccagaggccaattaattcaagcaaaaatgtaactatgaataaatagggaccatcaagaaaggctgagttgaagacaatacattgaccaatagtcattggcatgaagtggatcaaattgttgaagtcaatatgtagtccagaggaggccc

SEQ ID NO: 8591 - DNA, 1229 bp, artificial
  synthetic oligonucleotide
ctactcctctggtggccaagctgaaacaaagatcacatttcaaacatgccatgctagctatgacatgctgagaactgtgcacaatttcatcatttccatccttttaacttaattcaaaaatgcaaagaatatagatcaaaagctttgcattctgttttaaattatatctttgttacctaaattgttattttgacatgtttagtactatttcctgtccagtagaaaaaaaaaaaaactatttgccaaaaattctacataattgttctctgttatgcaatttgaattcaaagaatagataaacctggttagtaacagatgctgctgcagtggttggcatttggccaatgcaaagcaaccttgaacatattcacatgaccaagtgagaactctataaaaattctgtgcaccttttctatctaattactctattatgtttcaagtaatcacaatgatgtgtattttcttttgagcaggagagaaaattgaatatgccttgttagagtaaagaaaggaaactaacaaccaccatactaggaaaaaaactgttaaagtatgaacaatctttataaatgttcaataatttttcatatcttgcttataaacaagcaagtttattgtattctctataaattatcaaaatataatgttattctccagttgaatttgaaagtgtatattcctgaaaggaaagacagtttttaaatagagaaaactagaattatttgatggagtactactgctaccgggtgtgtgtgtttgcctgcatatgcatatgagggaagtaagggggaataatattagcctctaagtcatttcttaaaaattataccccatttaattatcaaaaaaattcaaaatcttaaatcaagttgctaattagaactgtgaaatttggggcttaagtattatataatttgtttttggtattaaaaaagcacgtggtaagatttaatttggtaaattagatagcttttaatataagtaaaggttttcaacgacccaaatgcaaatatgtggccagtaatagaagcatttattttaggcctttgtcttataattttaaaaatctaaatgttatatattttaagaatgaattggcaatggaaaatatcagaaataaaattatctacggttgaccagtctaaaaatgacttagcattaatgctaaaaactagacactgcacacaagtagttaaatatggcctgaaatatgttttgtttgttctatg

SEQ ID NO: 8592 - DNA, 276 bp, artificial
  synthetic oligonucleotide
tatgagtttcccagtgcctaggtctcctgccaatgaatttgttgcccacaggtgcttccaaaatacctaaagaaaaaaaaaatgttaccgtctgcctgaattcccacttcttattcatttgttctgtgctttccatgctggcccgattttcagatttcagatcttcctttggattcatgatcccgtgtactcactgtgaaagtaaccaaaccctaatattattttgttgtttggatcttattttccatatcctacacttttacctcaacttctcct

SEQ ID NO: 8593 - DNA, 8671 bp, artificial
  synthetic oligonucleotide
ggtcctgccatcctcctttgagatcttctgaacatgttatagatagtaccagaatccacttcatactaccaaaagataaaagatcatctttgtcaaacccttctactatcttttgagagattttgctaacacttgtgaccaaacaattgccttatactagtaaggttctcaaaggattttataagagtcacagtgttattaatattttccacataattagtgatatgtgtccacatcacaccaactctttcaactattcaactatgaacaatattctctttctagtgttgacataatttgtggacccaggagaaaacaaaacaaataggcaaatatggcacacctccaaaacaaaaaaagaataattacccttttcctctgatgtccccttagtatcttcatttgaaccttggtttgtgaacaatacacaaagtgaattgctagcagatgctcagcttgtagtttctgtaaaccaaaaataaaatcctaagcctccaaaacaactgaatgtgttcccagacgaaaccgagggtcaagctccttattctctcagcctgataacaagatgcagatgaactgggaaagaagagtgtttttatttctgtaacagggtgcagggagaaggcttggaaattatcatcagaccaactcaaaattacaaacttttccagagcttatataccttcttagctatatgtctacgtgtaagtgcgcatccatctaaagacataaatgattaacttattctaatctataactaaggtctgagtcctgaagaacttcctctggaacttcagtaaatttactcaatctaaatgggtcccggtgttgtggtgattacccttatcttgtctcctactaaagcatggaggtttggggagttgcttcagacccccaataaacttgtttgtggaggcctggggagtttcttcagacacccaataaaacttgtttaatcctaaatgggtccttttaagaattccttcattatcttgtcatgctttaaggcccaggaaaggcttaggcaaaactcttggtgggcttttgttacatcccagcctttgtataagggcactggctctttcagcttttagtatctaacctaaccactcagtcagtgctgagacagttgttatggtggcctgcctgttcagccgttagggagacctcgcttgccacaaatagacatcctcttggccaaggagaccacagagaaacctgaaaaactgaattcccagccatgacaggaagggaggtcagacacacctcattaccctccctcccttttggagcttaagcacaactgaccggtattaaggttaaaatagagaacacaaaactgacaaaacagactgtggcaattagataccagattataacccagacctgaggccatgcaagataagggttaagtcacatcctacaaaccatacaattttgttagacttgttttttaattaacctggtataatgtggctttccaacctgactctggtatagcatcgcatgacagatagtagacctggaaggaaataaaaatattttatctcaaaacatatttctttgacacatttgaaatgaccctgcaaagccgtcttttgtggggaaaatttgcatctgtagagaaccttcaataatgtagccaggccttccctttctaagcatttcctggatctatagagattaagagtttgacaacttttaaagtctaaaaagagacatttaccatttattctctctgaaggttgctacctaagaggcttcatctacatcacaagaaccctggccttcaagaccccacttatcttaagtatttctttctactgacttcaaatctttagacaaagtttaactctttcaaccaattgcgaatcagaaaaatctttaaattcaactataacatgtatgtcccgtcttcaagatatcctacctttttgggggctgtatcaacatataccttccatgtactgatttatgtctttgcctgtaattcctgccttcctaaaatgtataaaaacaaactgtaacctgaccacctcaggcacacgttctctggacctccagagacttttccccaggccatggttactcatactggctcaaaatagtcctctttaaaatattttataggatttagttttttccattaatactttattatctagcaaactctgatgagcattcctgaaagaaacaaagagtgggtagttactatgctctatacagcaattcttcttcagacttactttcatacatgtccctttgaagagaccactaaacaggctttgtgtgagcaacatggctgtttatttcacctgggtgcaggcgggctgagtccgaaaagagagtcagcaaagggagataagggtggggccgttttataggatttgggtaggtaaaggaaaattacagtcaaagggggtttgttctctggcgggcaggagtgggggtcgcaaggtgctcactgggggtgctttttgagccaggatgagccaggaaaaggactttcacaaggtaatgtcatcacttaaggcaaggaccggccatttacacttcttttgtggtggaatgtcatcagttaaggtggggcagggcgtattcacttcttttgtgattcttcagttacttcaggccatctgggcatatacagtggaagtcacaggggatgcgatggcttggcttgggctcagaggcctgacattcctgccttcttatattaataagaaaaataaaacaaaatagtgttgaagtgttggggtggcgaaaatttttgaggggtggtatggagagagaatgggcgatgtttctcagggctgcttcgagcaggattaggggcggcatgggaacctagagtgggagagattaagctgaagggaggtcttgtggtaaggggtgatattgtggggatgttagaagaaacatttgttgtatagaatgattggtgatggcctggatacggttttggatgaattgagaaactaaatggaataacagaaggagaaaaacaggtataaaaggtctaagaattgggacgactcaggatatctgattagagagtgcctaaggagattcagcatagtcctgccagcaaatattatttatttacttgaagagttaagagtggcagtttggggatagcaccaggagatatcagctgtgatggcttggaaaaacagtgtaaaccagcagtgtaaacaagagcagggcatgtatgagtagttgagaacggtgaataggagtatgactagacagaagatagtagggatgacaagatttttggggggcacagtctaagttggtctggtgtctggaatgagactggggcctaataaaaaggagcgtctatacaggagctcaaatgggctgtaccctgtagcattccgaggacaggcctgaattctgagaagggcaagtggtaaaagtattgtccagtcctttttaggttggtggctgagcttggtgaggtgtgtttttaaaagacctttagtccattctacttttcttgaagacggaggaccataagggatataaaggtttcactgaatactaagagcctgaaaaactgcttggctgatttgactaataaaggctcgtctgttatcagactgtattgaggtgggaaggctaaactgaggaattatgtctgacagaaggcaagaaatgactgaggaggccttctcagaccctgtaggaaaggcctctacctatccagtgaaagtatctacccagactaagaggtattttagttatctgactcagggcatgttgagtaaagctaatttgccagttctgggtgaggctaatcctcgagcttgatgtgtagggaagggagggggcctgaataatccctgaggagtagtagaatagcagatggaacactgagaagttatttccttgaggatagatttccacgatggaaaggaaatgagaggttctaagaggcgggctagtggcttgtactatagcatagcctgcctttgctggtatgtggcgattaggcctggtggaaccgccatcaataaatcaagcgtgatcagggtgaggaacaggaaagaaggaaatttggggaaatggggtgaatgtcaggtggatcagagagatacagtcatgggggtcaggtgtggtatcaggaataatgtgggaggccggattgaagtgtgggccaggaacaacggtaattgtgggagactcagcaaagagtgagtatagctgaaggagccaggaagcagaaagtatatgcatcaggtatgaggaagaaaatagattttggaagttatgagaactgtagagagtgagttgagcatagtttgtgattttgagggcctctaaaagtattaaagcagcggcagccgctgcatgcagacatgagggctaggctaaaacagtaaggtcaagttgtttggacagaaaggctacagggtgtggtcctggctcttgtgtaagaattctgaccgtgctaaccatgcctaggaaggaaaggagttgttgttttgtagaaggtgctggggtttgagagatcagtcagacacgattggcagggagaacacgtgtgtttttatgagaattatgccaagataggtaacagatgaggaagaaatttgggcttgattgaagtaatgggggctgtctgtgaagctttgcagcagtacagcctaggtaatttgctgagcttgatgggtgtcagggtcagtccaagtgaaagtgaagagaggctgggattaagggtgcaaaggaatagtaaagaaagcatgtttgagatctagaacagaataatgggttatagaggcaggtattgaggataggagagtatatgggtttggcagcacggggtggataggcaaaacaatttggttgataaggcacagatcctgaactaacttgtaaggcttgtctggttttaggacaggtaaaatgggggaattgtaaggagagtttataggctttaaaaggtcatgctgtagcaggtgagtgataacaggctttaatctttttaaagcgtgctgcgggatgggatattggcattgagtggggtaagggtgattaggttttaatgagatggtaaggggtgcatgatcggtcgccaaggagagagtagaggtatcttatacttgtgggttaaggtggggggatacaagaggaggacacaaaggaggtcttggattgggaagaagggcggcaatgagatatagctgtagtccaggaatagtcagggaagcatataatttagttaaagtgtctcagcctaataagggaactgggcaggtggggataactaaaaaggagtgcttaaaagagtattgtctaagttggcaccagagttggggagttttaagaggtttagaagcctggccgtcaatacctacaacagttatggaggcgagggaaaccggcccttgaaaagaaggtaatgtggagtgggtagcctccgtattgattaagaaggggatgggcttaccttccactgtgagagttactggaagctcggcatccgtgatggtctaaggggcttccgaggtgatcaggcagcgtcagtcttcagccgctaagctgagaagatctgggaaggagtcagtcagagagccttgggccagagttccaggggctctgggagtggctgccaggtgagttgaacagtccgattttcagtggggtcccacacagatgtcacgtgtcttaggaggaatcccgggctgcaggcattccttggcccggtggccagatttccggcaagtgtagcaagctcctgtgggaggaggttctggaggaacgcctggccgctgcagttcaggcgtttggaagttcttgtgtgctggagatgtggctggggtttgtctcacagtggaggcaaggaggaattgcaacttttttctattattgtacaccttgaaggtgaggttaattaaatcctgttgtggggtttgagggccggaatttaatttttggagttttatttaatgtcgggagcagattgggtaataaaaggtattttgagaataagacggccttttgactttttagggtctagggctgtaaagtgtctcagggttgctgccaaacaagtcatgaactgggctgtatttttatatttgatgaaaaagcctaaacactatctgatttgggataaagaaaaaggagcattaaccttgactatgcctttggctccagcaacctttttaagagtaaattgctgggcaggtgggggagggctagtcacggaatgaaactgtaagctggaccaggtgtgaggaggggaggcgataaaaagattatagggtggaggagcggaggctgaggaagaattgggacctagcttggcctggcaaggaggggagaggtcagatggctctgtagaaaaggaagattagaaagactcagcaacacttggggttgggactgaggggacacgcgggagggaaagaaggaagatttgggacgagttgcactgggcacagagactaggaagggactgatgtgtaaaagaatgcctggacgtcaggcacttcagaccgtttgcctattttatcacaagaattatttagatcttgcaggatggaaaaattcaaagtgccattttctggctatttggaactactgtcgagtttgtattggtgtcaagtggcattgcagaagaaaataaggcatttaggttttaggtcaggtgtgagttgaagaggttttaagtttttgagaacacaggccaagggagtagaaggaggaatggagggtggaagattgcctatagtgaaggaagcaagcctagagaaaagagagactagagaaatggagggaaggggttcggggttcttatcttccagaaaagtgggaaaaggggttggggcacagagataagagatcggggtgcggaaataagggatggggcacagaaataaggggtcggggcacagaaataagggattggggcgcagagatacaaggttggggtgcagaaataagggattgggggttcttgccccctagaaaagcgggacttgccactaagggtgaaggagaaggggttgaggggtacttgcccctcccccagaaaagcgggacttgccgctaagggtgaaggagaaggggttgaggggtacttgcccctgccccaggaaagcagagaaggggtagagacaaggagagaagggattggggtacttgccccttccccagaaaagcgggacttgacgctaagggtgaaggaccaaggcaggcatccctgcatggtctgacacctttgaaacgtgggtgaataatcagggaggcgtccctgcaatgattaaacaccaagggaaggctgccttcccagtccgtgaccggcgccggagttttgggtccacagataaaatgtatctcctttgtctctcccagaaaatgaaaggaattgaaattaagagaagggagagattgaagagtagaaagaagaaagtggttgagggacagtgagagaggttggagaagagagtaagaagaggccgcttacctgatttaaaattggtgagatgttccttgggctggtcggtctgaggacctgaggttgtaggtggatctttctcacggagcaaagaacaggacaggggattgatctcccaagggaggtcccccgatccaagtcacgacaccaaatttcatgcgtgtccgtgtgaagagaccactaaacaggctttttgtgagcaacatggctatttatttcacctgggtgcaggtgggctgagtccgaaaagagagtcagtgaagggggataagggtggggccgttttataggatttgggtaggtaaaggaaaattacagtcaaagggggtttgttctctggcgcacaggagtgggggtcgcaaggtgctcagtgggggtgctttttgagccaggatgagccaggaaaaggactttcacaaggtaatgtcatcacttaaggcaaggaccggccatttgcacttcttttgtggtggaatatcatcagttaaggtggggcagggcatattcacttcttttgtgattcttcagttacttcaggccatctgggcgtatacgtgcaagtcacaggggatgcgatggcttggcttgggctcggaggcctgacacttacggcagaccacaagacagaaagttagcgattactcaaaagtcaatgatactgtggaatacctaaaagtaaatgaaccatgttcaggtctttgttcactttggattgtctcttctgcactagaattacaactcaaacagaaaccaaggatatgaaaacagatcccttcttcattgtacccccaaagtttatattcattcttccaatttatgttgtaattaaatttcgggtaatataactctacagataatcataccagcttttcctttttcattaaaacagtgccatctttacaggtaaaggtagggtatttatatacatatatgtaccttgatttttaattcagaagcaacctcatcagtaatgcatactttctgttttctttattgctagtttgccaagcaaaggcatactttggtataggctactgagaaagagtcaagtggggaaacagaacaattagcacatttccatgccccgaataggttctagtaaggtaagtcaaggtggattgcctgctttgtagcactcactataagtactgtccactggtttccttaacttattatactataaataatgacaatgattttaaa

SEQ ID NO: 8594 - DNA, 1041 bp, artificial
  synthetic oligonucleotide
agactgtggtaatattttatggaatccttagaaaactaatatattggcctcatgcattccatgtttgttttgagttgttaatgggtgacttgagcctgtcattctctttttattaaggtattcaagaaaataaacaaaagccagacaactccacaatccttatatttactattgatttcatattgctctagtgttattgctgctacataaacccagtacttcctgagtctggttcgtagatgagacaactcagtatgttggtggaagcaagcaattgattgctggtatgctatcacaccactcaggggtggctttgtagaacagtagtgagggaaatctccccaatgataagatctcctcaaatctcccatgcctattgtcaatggagagaaaactgcctagagttaagaatgtaggggctcatagtcaatggtcagtgacatattggattggttagagatatggaagaagcaaaattggaaggtcagagacaaggagttctgggaaacagacattttaatggaccaatggaaatggcataaactggtgtgaaactgcatgttttgtgttaatgcctaagaaaacgtctaccacagagaggcactgaacaaccagatagatagactaactcattcagtgaaaattagtcgtcatttgtacttgaccatccctgagtggtggcacattgggcacatgaacagaacaaccacgatggcagcgatggaggctctgcccaagttcaactgcatgactccttcacacaaattatgatctagctgctctctctactaaattctgacctgtctgaatgtcagcagttaatgttgagcttttgagttggtaaaatctctcaaggaaatgaaccagacatttgtgacaaattcattatatcagaccccctcaacattggaaggggcagtgattattcttttccagaattaacagtaacatgaaaaatgaattggtttttccaactccatacaataaatcttaaactcctcaattctcctgaagcctcaggaatgactagtgcttgatttt

SEQ ID NO: 8595 - DNA, 287 bp, artificial
  synthetic oligonucleotide
ttgttggcttttagtctggacctgttaatgcaggatttccagacctctcgttaaattccctaagattttttttttggaatttcccaatttaatttcctatatgttgataaataagccttgtcaatggttgattacctttccatgttctctatgttttgcctcctccacctcccagtgatatacattaccacttttttgtgtgttcagagaggagtcatttctactggacagcaccatctccttttgagcactgcagtcttcgtcaagattcattatcgcatctgctt

SEQ ID NO: 8596 - DNA, 3239 bp, artificial
  synthetic oligonucleotide
gggaatgatttaggatacgtttgcaaggctggtgacacacattcttggatacttatgtcaccagccgatattacttcagttaccagtattaagtttaaaccttaattgggaaaaagtgcaaaagccaaagaaaaacatgaatgataaagagaaggaaaccaatatttaatgaatgacaacaaagctatgagataaaaattattatgtccattttataggtgaggaaactgaggctcagaaagtttgagtaatttattcaaagttacattggtagtaagtggcagaataaagattcttacttgcatatctagctgtttggtctgcattctgcctggataaatagagggaaggtgttatgaactccaaaaggaatttttgtcttttcaccaaggaaaaaatatgttaaaactgtttacatggcattagacatataattcccattacttttccccatttttaatcagttactcagcgtacatacacataatcatgttttctttgagcatattgggatttactataatgacattgacacttggtcaaaaaggcagatgaggaaaatgtagtcttaaaatgtatcaagatagaatttagatataatttaaaaaattatttaacttaaaatatattaaagaggatatgaaagaagtcatagactccctctctgtggaggtaacaccagatggcaaagttctccatttataaaacacttggtgtacttgtttagccaatacctgcttactacctttgactcaggtcatgagaagcctatattaccttggatctcattaaaaacaaacaaatttttaaaaccaaaccaaactaaacaaaaagctagacatacctctttccttctgaacactatcttcattggacatgaacccaaactgatgtagccatttcaatatcaacctgagaatgcagccaccaccacccagaggagagccaagataagaatcacagagtagtggagccaaagcttctgtattacatcagccctgaagactgctctgcctctggattttgagttacttgaaccaggaaaatacacccatataaaaggaaacctatacttattgaggaaaatattttcattgtgtagcattttatagatagtaattagctacttgaattcatgctgaacagcaggtaaaatgtagacaatctgctaaaaaaattagagaatcaccattttactagaaaacctgttctgaatttcatatttcttccaaaagcaaatgagtaaaaagaaaatattattttagtgccaaattttgaggagatgataataggatgtccaaatgacagcaaaattatttcctcaaatctttattgagataagccccattaggatggtaaaatttggtagttttagagttgatgcgatgatagcaaaacaatatccatctacattaccagaatcataaatagatagtgctgaagttttctgaaaatattaacacaagtgaaatgagcatttgcaccatttcactgcacaagggttcttaatttgtttaagaacaaagagtaatttctaattatagtgcagaaattacaaaaatacataaattacaccaaagatatagacactattcctattctatatatgttccttgtgtaatcaatttcattcacgtatataaattcaaagaactgttgaagaaatccacactatacaaaatgaaaacataagcaaaatctgtatatttgtgcattatttttcttggtataccattgcttcttctccattgtatattttaaagcaaaaccattattacaaaacctttagttaaagacaacggagaacagagaggtcacgtcatttgtttaaaggcacacagctaccgacagagctgggataccaactcaggtcggtttgattctcaaaccccactgtaccacagttgctctctgaatctcaaagaatccattttgttcttgacaggaaatgaaggaaggaaaaaaaagaagaaagaaaataaacaaaggaaaggaagaggaagggagaaagaaaaatgaaataaaggaacgaaagggataagagagggagaggaaggattagtgtgggattagtattctacaggattagaattagcattaaattagtattctccatgtggaaatataatggagataatagtatttgagaagtctgtgtgcagagttatagttactgttatatctgctgtaaagaatgtaaaggtatatgaggagcaagacacagtttaaatgacaaagggtggcttgagagagtttattgcgttttcatgacttccacaagcacccaccaagccacgacaaatacatatagtttgagtaaaatagtatacatgataagcaaatgtgacttcctagcctagatcttcttcttccccacccatctgactagattgttatccctgcattcctcttataataatggagcagcaactactgagacatagtcttttatcacaaagatcttatggcccaataggggaatataatagtaatatacagatgatgtatttgtttagccaatacctgcttagtgcatagtgcaaagtagaggaaaatattccataatataactaaggcccaaagcaaatggggttcaaagataaatgagtagccaaggattaagaaatacctagaccagagatagctacttggttcaatgtttctcagctaaaggccatagaattaattatgccccagtctaaaggcacatggacaaaagattgtcttgtatctaccatgcacataaacaaaagaataggtagaatgtctgccaggtattggccatacgtgatatagcccaacctagtttatcttatcttttagttttaaatgattattcacatagaatatttttctatgtggccctcaaagattacttcttctgagcttcaggccagtgtacacgaactttgtaatgttgatctaccctttctccatgttgccttcaaaagtttctttctaggattacaattttagcacatgggcaggtatagagggcttcatggaagaagtcattgaccttaaagaatgactggtatttctacatggagagaggaagagaaagacaaaccagagagaaagcacaatatgatcaaaggcaaattactgggtatcataggttattttcaaaatgtcagcattctagtttcattagagcacagctttaatgtggaagaataattacagatgaagtttggtatcatgtgatagaagatcttatatgccagagtcagcagtta

SEQ ID NO: 8597 - DNA, 1193 bp, artificial
  synthetic oligonucleotide
gaagttttgacctgatattaagagaaatgtagtcacagagggaaaataatttacattttttccgggatctagggaataaatatgagtatgtgtcacattggaatgaagactaaagtagcagaatgacataaaggaaggttagaaataaaaagaggggaatataaaagcagtagctgatctaatgtggaaacagaatcgagagcaacagaaaactagaggcagcaagagacctgtgtctcaaaggctgccctcaacatatttggtatttaatcacatggtataaccagtaactataagtgagtttgtttccttaacagaatattcctgtgcagtttagttaattaacttccaaggataataagaaagtttcaattcaagtatccaattccattgagaaataatggttgcacaggttttatgttaagaataattctgaggccacacctgggcgtagaagtggagagtggtagaaaatatgttacgtatttggcatctttcagttatagtccatacggacaacagcatcgtgatggagaaggggaatgaaactaggaaataacatttttgaagttatcattagataagttatcctgagagttatggtgaatatgatttctagaatggttctactgctgaatagagtcagaaagcaatagaagaacataaatgaatgagattcaaaatgtatctatagagccaaaggtaggggcaataatcagagttagaagagacagttggggatgaagtggttctgaacattgcatgcctctcattaacatattcttgacctttaatttatgcttgaatgttgcattctaggcagctttccaaaagtatttttcatgagagaacaatttctggataaaagctttcgtgaaacaatttaacttgcccaacttttttttctcttaaggcaatattaagaggttaataacgttaactgtagtagtggataacttcctgatttttataaggtttccaatactttttaagcagttatttaagttgcaaattcttagacttctgccaaagaagacttaccattttctgctataagaggcagcaacggtattttttaaaaaatgctttcatatacttgtatcattattttgaacctggaataatcttattctaaatgaacttatacttttttacctaaagaaaaacaatgaaaaattgttttaattttaaaa

SEQ ID NO: 8598 - DNA, 2134 bp, artificial
  synthetic oligonucleotide
gtatggggctttttacactactggaaggtcaagtaagagcaaagcttctacaatatccctctcagaagagtcatcagtgtggcctagtggcccaatctctgaagatgaacaagcagaattattgggatgtgcagtagtgttacgtaccaggctggctgatgtacccaagacaagatacagagaaaatagtaccagaagtacagatggaattataatgacctgctaaaattcctagctgtagcattcttctaatccctgtagctcagttaactgatctccatcatagttgaaccttatattctgacttatcacaaagcctataaagagccttgcaatttgtctttgtaaggaaactccttaccctttctaacaaaattaatcccaaacccaagattctacaatgttgaagatttctttacgacatcatttctccaactccattcatatcaaacatgctgggttgcttatattcacagacatttctttccacttcctgcctggcctttctgcattttaactctgcttgaaccatgaataaatatattttattagtacttttcttctattaactaattttgaatgatagttccactatgactctactctttccattttggtcctgtacactaattcagaaagactcctgactatatcctaatttttacagttcccagcattatattaaactctgtagatctacctggatttctggttccagtaggctctcagtccagtcccatttgtgatagaaagagtaataatttagctcacagaattttgcttatagcttctgtctgtatgacatttagaatgaggtgtttagctttcactaaatctaatccattcttttctgggaaggtgatgttttgaaatttctcccaacaagagcaaatggaaataaatattcacagattctttactttttaatcacatttttatctagcattttcagatctttcactttaaattagactgttgattagcaacaacccttcaaaattacctggcctgacaaacacatgaccaaaagatgaaaattattttatgtacataaatttcttgtaagagttttctttactgacttcttgtctccaactacccaactagtaatgtttcttttcttctggtgaaaatgtgttcaagtcctcaaagctacctttatcatttgatattattgttttctttggtattgacagaagaaaagaaaacagcttcaaggtatgctctcggccactatcattattgctaattagtttgttccccttagactgatattacttctagcactttctgctgattacaaagaggttagaatattcactgcataataatatcaaatttgagtatgaagcatatccgttttcccatgtttagatattctgtaaccttcatatattagtaatacatattacaaaacaagtattttaaatttaaattatggaattgattatgatccaagcaatgtgaatgcattcttagaaataataaaaagttgtatatattagaatatcataaataattgaaagaatggaaataaggagcagaatagcaaagatgattctctctctctataaagtcctcattagactctgccaagctctgttcatgtctacttacaccattccttaggaaagacacttatgcttaacttagtatctatctattgtcctcaaatagttcaaaagtatatataataatgatagcttaagggaattgaggttattctgatttgaaaaaaaatgtcttggtggtgacctaattacattttgcagaattatgtcaggatttgaaagttttgactacgagagcagttatctttgttagttttcaagagctaggagagtcttaaatgtcttcaaatcattagccttagatactaacatctggttaatggaaacttcccaacttgtagcccacttgaatctcttgtagacattggaaactaaatctgtgggaaaaatggacttacagaatttgaatatcaaatattcaaagaatttgtcttgctttttgattctctgtgcatatcactgtggcatacattaccatgctgaagataattcattggtacttattcttaaagatcttgaaagtcacagatttcagagcattgtatagacatccttattcccca

SEQ ID NO: 8599 - DNA, 1677 bp, artificial
  synthetic oligonucleotide
atcaataatgcctctcaaaaggctcctgttgaggcacatagagcttcactgatgggacatttatttattaacatattaaattattatattttcaatatattcttgcccaccaccattaaagaaaagtgtgcattcataatggtattagctgtgaggggcttagaatgcacttagttttgtttgcaatttctacagacacttctcacttccataataaagcctgttttgctaaccaggggaaaagaccataaatattcacaaatttggaaaaaaatatattttttctgaataatgaaagaaaaaccagcattaagaaaataaggaagtcacagaactgtgtttcatgtttgtttgttttttcccctctgtgcagggttcttgcattctttcctttacttagtcctaccatccttgtaagagtaagtaaagcagaaataaaagactccctcttggttttcccccactctgagataccttaaggcttacaggatgatactttctccattatagccagtcgctgtaaatcagctgtgtgaataagaacacctgactccttctagacctgcatgtttactaagttttacaagctgaaaagcattggctcttggggtattagggagtgttttaacattaaaacagttctgcctgatgctgtgaatacagctacaaaaacacaaaaatcagttttctccctcctttgccatggagctgcaattttccccaggagcctttgacactttctactttatgcaccaattcctctgatagtgtataatctctttcatattcttttttgaaatgtttctaatgttcaacattcatttatgtttcagtgggaagacaacatagttatgcatgtttttcgggattaagagtattttactctcaatgatacatagttaaaccacttttgttattgcctacattctgtctctgctgcagaggctggggagatatccatagtgttacctctcaatgctttaggtttctatcctgctttgaggaaagatttcagtcagctgtgatgtatatggaatagcagagtggaacttgtctctttttcagagcatggggcttagggaacctgataaatgactgaattttcaatgagtcaaatatcaagaaagaagctgtttctttcattttcctttgcactagttaatttgcaaaggtgctgatttttctcttcagatttataaagccgagggacatatttatgaaaaggcacaaaagaatcagaagacagaaaactagctaactaaaaaggaagagatgcatatatatcctaacaggtaaattctagagggtgtttaggtttggttttgttttgcttctgtggctattaaagtttggatctataaaggtgccctgtgcttttaacgtgcagatcaaagtcttgatggagttgtacctttgctgcttggtgctgtacataaaacatcagcaaagcactgttatattgtgcatgtaatttctttgctgcatttaactcaatttgagcatcaagccattggcttgtatgttttttatttaaaatgtaaacagaaagaagtgatcttcctggaaaataatgtacatgaaagaaatgagaggttacataccatgtgtctgaatactactcaagcatccactgtagttcataaaatgaaatcagggaccaattttcacccggaattc

SEQ ID NO: 8600 - DNA, 1733 bp, artificial
  synthetic oligonucleotide
actatgctttactaactgagtgaacttgggaaagtgcctagcctttctgagcatcttgtccctcattttaaaatgaggattataacaccattgcatatatatgtatgtttggtatatcacagggtttaaaaacatacaacagataataaatggtgaattctttccctttgctaaacccacatgtgcaactatctcaacaaaggttttgtttgcctgtcagtccttttctatccccacattcactgtcccataaaaccttaggcaaaatttaaaattgcctcatatcttttttcttcttcttcaaaacaaacaaacaaacaacaaaaacatgttattggctgtcaacaaaaaataaatgactgcaagacagaaaatccactcctcttcatttttttgtacttattttgcttaattgtacagactttattaaatatctgtaatgtacaaaaaaaaccaccatgccaggctcaggacaaaaagaaacattttcccctgccattgcaggaggtcttgatctactaaggaaagttgacatctgcattgtgactggttcaagatatactggagttaagcattgtcatatgagtgcaaataaagtgttttaagagtatgtatcttcatccatttttaattttcagtggtgtaaatctgtggagagccagaaatcaggctttcttttcaattagagacacagaaattactattaggagttagacaaacataaggttgcttcagcacctttctataattagtgctttacattttagtaaaattacctataaagcataatattcttgtagtgtgatacactcttccattaattttaagacaatgtagtctctcgaccatattcccctgagtgtctgaaaacacactgccttcttctcagcagatgcctctgttgcagtgagtaggcaatgtagcatattcctatctgttcccacagtcaccattagctgaaagggacaattcttaatgtgtaaagctagcgatagccttagggatgagggagacagtaatcaaatctgagcagtaatccagggaacagcagtaggtggcactgagggtgtttaggctgtcagctacttatactacactggcagcttccagaactggcctggattttaagagttccagagagtgcagcttctttttagcattcacaacttttttcatgctacactgaaaaaaacgtagctaaatttaggtgcttttagtattttttcatacctttatgtattactagtccactgctttgagtttaaacggaagggagagtgcttagaaattttgttttattttggtttgggtttctgcctgccctcaccaggaatttacttttataataaaaatgttttgcatgtaacacttcacataaatttgacgctgttggaccattatacaagaaacttaaactttttttttttaaacttaagaaattgctgagaaaaacatgtatctaaataatatgcatagatcttcatctataagtatgtatgcatttccacatgtatttgaaaaaaagtattttcaggccaaagagatttctctcccaatacttgatggtatgttgatagtatttacaagtcttggaggaggtcatatggattcttaccaaacttttcctgatgactggctatatgggccttagtttcctatctgatcatagtaatttttggcttagttgcctcattgggttgttgtaaagatcaaccaggaaatgtttgtaaaaa

SEQ ID NO: 8601 - DNA, 1710 bp, artificial
  synthetic oligonucleotide
aaagatagacttgagtgaagaagaggaaacaaatttttaacttggcttccaaagacgcaatacagcatgaagaaaaatgggtgaaggatttgagctctttgtgaacaattatgacaaagctaaatcttgtggaatgtttcaattcctttcttttgaattgttactgacaaagccagtcccccaaaatatagagtctttccctgtttggtgttgcaaagtcaataaataaaactgaaagtgagtgccaagaaatacagggtttatttaatggccatggaattgagaagtgagaatatggttcacaaatcaacttctccactagtgaggggtgagagagttaaaatataggacttctctaatgaaggggctggacattaaaagcaagtggggaatatttatgtcttttctagaaatggacggtgaacttcccagaacctgagtgttaccttccttttgtcttttcataacttcttctggtcactgtcatggcaattgtcaattgtcatggcactggtgggagtgacatttagcatgcaaattagattataatgaagcctgaggtctttttgtagtcatttggtttgctatcttagttctaacccgtctcagctggtctggttgccatgaggactttttgtcgcaggtgtcatgtttcttaaaaataagcagagttagggcagggtagaaatttagctatgtcatataataggcattacactgggtaacaatatcaatgactggttaaaatttagtgatatattttaactgttaataaacatagtcctgtgtgttatggaggcacacctaaacaatataaaaattagtttctgtccctgcagaagaaaataatgagatttgagagagaaggaggaacatttaaagataaactaatcaataagtacagattcatatttggcactgggaaatgaatgtaaatggagttcttagtgaacagaagggggatcaatcatggaaggcttttgaaataactgttgaatttcttaccttctatccaaacctaccaccaggacactagtccagttggccattgtttcacataggctactgaaagagatgcctaacttgtgttaatttcccttgttctgcatccctattgattccccacatggtagtcaaactagattttctacaatataaattttatacacttgtcactccctttcttaaacccttatagagcttctcatttcttccaggataaaattccagctccttatcatctgcctcccacaaaacctcaaaaaaattcttttatggtatgatcataaaaagcctatttattcttccttatgtcttatttttcccattttttatatctacttaacaaatatttatttaacacctactatgtgtctgttttacatgctgtttacaaagcactgttttacatgctgaagatacaacagatataaaaacatttaaaaaatattctatactcactaacattacattcaagtaaacagtggaagaacatacacaaaaataagtacctaaagcatttaagttcccagatggtgataaattctgtgtagaaaaagcatggaagaggcattgaaagcatcaatataaaagggttacaattaaaagtaaagcatgactaaagaggtgacatttaacaaaagacttaaaagaagtacagctatgtagatgaagtgcattccaggaacaggaaactgcaagttcaaaacc

SEQ ID NO: 8602 - DNA, 367 bp, artificial
  synthetic oligonucleotide
tgaagtcaaatgtattcttatgtacttatttacttgcaacattctctgctgattatagtttttccttcttaattctgagtctttttccccaatgtctgttattgatcactatctgatattaaattgatactctaccagcctaaatagatgaatatttcagtgaactatttggggaaaatccaaagatatgtgatgaaaagttaggttacaatttcatatatagaccagagagagaataaagccaagtacgcctgctggattctagacaacagtttatgtttttgaattaaatgtgacagcttacatataggatgacatcacagataattccaaacccaaatacatgaaaaaaaagttaaaaaagaga

SEQ ID NO: 8603 - DNA, 1117 bp, artificial
  synthetic oligonucleotide
ggttcttcatgaaatatctgagtcctaagtcattctatatacattaaaagcaccttcttagcattacagaacatactgctgtcacttctggaggcattgaaaagttttctcggggaaggcattgctatgttccactatttttcagtaacattccttattgggttcttcttttccatccgtccctccgtcccttccgtccgtccgtccgtccttccttccttccttccttccttccttccgtcagtccttccctttctatcttttgtctcttttctccctaggttaatacctgtttaaaaagccatgaagctaataatgaaggaaatcaaaaataatagcagatacataagtgcatgcttgcaataataaattacatgagtactaaagaattagagcagcaagaaattttacagtttaggattgtggaagagggtaattgtctcatttttctaagagctgaaaccttgaaagagaatacaaaatcaactactactggttctgttactccaggattttcactaataatatggctctctgccctttcttcctacagcatctgatttacgcctcttgttttattttgtagttcaatatttttctttcctcagtggaatgttggtggtggtggtgtttattaagggtgcagtgttatttaaccattttgatcctttccattttataagaatcactgaaaggaacgtctttgaaagccctaggggggtggaagttgatacaaatacctgaagccaatttcttacaagcaaagcagcctacactggaaaataaataaataaataaataaataaaaacctttattccaaaaagttattttttctttaccattaatctctatttaccacaccagatacatcttttaaatatgtgtgtatgtcaggggaggagagagatcaaggtacatagattcaaaataaatacgtaaataatatgtgaaggagaaatctatcaactgagatagtcaaactaggagataggcaggtctccatagttccaaggtacatttattcttcacaaaacctataaacagaggagaacgatgttgactatggatactataatgctatcattgaaaatcacaaaagtcaagaagtacacagag

SEQ ID NO: 8604 - DNA, 1080 bp, artificial
  synthetic oligonucleotide
gataataagcagtgaaaataacacctttagtgccccaaaacgttgtttggactgaagtaacttgcttgcagcagtcacgatcaacttgagcaaactaaacacaaaataacaaaagcttagacccagagtccttggaagcttaccaataagactctgaacttgaatagcagtttttttctcaatatagacaacttttctgctcagttttggctgcggaccaaaaactagcacagtagattccaacttacccatgttattgagttaaatcacagatgttagcacttaccagagtactaggcatgcagtaggggctcaaaaactgacttgtgaatccaatttaaaattttgtatctgaaaattgagtttgggaaatgggtaggtaggaaagggaggaattgcatttgactctaataacagtgccaattagagactggaatgctactgttggagggaccgtattgccagacgtactgagattacctgaaggcaaataatcaagtagctatgatcttgaattgttcatgtcaggaaaatctcatctgaatcgaacccctgtctttctatgattgtgggttctctctatccgatgtatactaggttcttggattctaagtggtaataagtgacaatgccatgaggatgcactagtagcccttgttatgggcctgtaaatgcacaaagctatggcaatttggtcgtgcaatatattattttgcaatgtcgttgagtctacaaggttggaggaattacttctctttgtctctttcccttgctgcttattttgactctttcttcccacttaagtcacaagcagctaagttatattcattcttggaagctgtcttgagaagcctggagtacatggaagcagatattgtggcaaatcctcagccgccccttcctctctccacctgtctttcccttgctccttccctctcttctttctttggttcagctgacacgggatggctagaagtggtgtccccacacaggcttgaaaagatctagggtgcgacataactcactgaggatccacattgtaatatgggaagaatcataatggtaatatagttacttaac

SEQ ID NO: 8605 - DNA, 674 bp, artificial
  synthetic oligonucleotide
aaaagcatcttctttaactgagcacacaacttacagatagatgtacatgtgcatcaatcagaatctgggcataaaaccagtcagatcacatgaactggatattctgaggagagtttgaaagagggagtagttccaaagatatgagcagtgtatggggaataccacaagaaagtataaggcaaaatcttggagctagtaagaggtgaagagagccacttttaggtctaaataggccagagaagtggatgatgacaacaacattgagatgaagtggctatgaggcctcttgacaagatgcagctagtccatgttgaccacacagaaaaggaggatgaagaataactaacctaacctcactgtcttcccttcatctgatagaacttcttccagtcttccccattgtcctaatctaaaatgaagccagaaggcagacaagtcctttaatgtaatcataaagatcagacttccaaggcacaaggcaaggtatagagggatggaatgggaatctggagacaaaatgaaggttctaagtatatcgagggttagaaactggcaaaaaagggaaaggacaaatgtcaccagccaggccaaccgtattaactgtgacaggtaaacttaggctcaatgaagttaagtgacttgtcccactgagtaaatggcagtcctggaattat

SEQ ID NO: 8606 - DNA, 770 bp, artificial
  synthetic oligonucleotide
tgttttggatgatggaattgtgtgaaaatgtgagtaactaatgaagaacaatctctccattaattggagaagtccttccttctaagcctgaatcacatgaggcagaccacatagaagactctttcgtagtcccttctccctttcagaaaaacatatgccaactctgattaatctaagaacaaaatggagtgctaggtttggagactgcctatccaggaataccaccaaaaatcatggtgcacaactgattccatgaagataccactgctgctatcactgagcacagataccacagcttgctactgatatcaacaatttggggatgggcacggtggctcatgcctgtactccccctacactttgggaggccgaggcaggcagatcacttgaggccaggagttcgagaccagcctgggcaacatgacaaaaccccatctctactaaaaatacaaaaattagccagatgtggtggtgcacgcctgtaatcccagctactctgtaggctgaggaaggagaactgcttgaaccttgggggcagaggttgcagtgagccaagttcacagcactgcacttcagcctgggtgacaaagtgagactctgtgaaaaaaaaaaaattggtaactagacactatcaatttaacaattgcctcaggaattagtttagatgatggggagctaaaaacaataattgctgttcccatactggagtcccatctggtcattttgaatgtttaggcctaattcttatgtcagttttgtctcatatcact

SEQ ID NO: 8607 - DNA, 951 bp, artificial
  synthetic oligonucleotide
aagttttggctgccacacattaagcacagccacttcctttagccctcatatcagctgagttcacaatgttaatgtggtaaagtttctgtggtagtaggacagttattctaccggaatatttcatggtgccagtctaagaatggcagctgaaggactcagtaggttagttgggtattttttccccgtcactctcaggccctaagggcttgactgaatgattgcatcattctaagtaatgaagtccctggagaacctgtagaaggcagcatttgaagatttaaggtttcactgctcaagatgtgactggattgctgacacagaaaactgattttaggccactgaccttctggcttggtgagtacaggaataaaaacgtggaaggctaacaagatctacgtgtgttctgggtgcagtcaactcctagtaaccaacattttaattttgacttttaactccactgcatccaaataaatgatgtgtaagtgattacataaagttatagcatattttctcctcactattcacttggcaatgctatagttatatcttcactatggacagcaacatgatatctgtttacttacattcctagaaggatatcggtagcttattatttacacatgataccggcatgttacctgaaatccatgggcagaattacaattttactagaataatttcggatggcataaaaatttttctctgtgttctctaaaactgaaccatggttgtataacctttgttttatttctaggacccaaacagttcctgtggtacttctctttcttccttctcactagtgacagttgtagtatctcataggaccgtttttccaaaagacaaatgttaacacatcatttccccatttctctccctacagcctaggtttctcattgccctctggataaagtcaaattttttaacatggcatgcaaggcccaaaacattaca

SEQ ID NO: 8608 - DNA, 620 bp, artificial
  synthetic oligonucleotide
ccaaacccggggagtgtttttgccttctcctgacagtataataaagtacttcctttcctgccctccttttgttcctctccttctgcatttctagtaccatgaggaagtcacacacacacatacacacacacacacatgcttaacataatagaagaggaggaagaaaatgcaaggtagagaaaacatgtcctctttcctgtacaaactagtgagcctgcaataggcctgagctgggaaaagagaaaagttttgaataaaatcgatagttttgattattatactattttagatatattgattactaaaatgagactcttattacttgaaaagaaccataaaagctattgaactttccttgagtttgcccaggggcaagggaagaagtcatctcacagaataagtttaaaggactcatagaaaatgaaaacgtagctgctttctgattatatcccacaagtcatgtttgatatatgcaccagttacatggcaatcatcttcaaattgactatttttcctcttacttattcttgaatagaaagatatctagcaagatctaaaattctgtaacagatagcatatgtagatttctcttgactttgttctttatccatttgtctgtt

SEQ ID NO: 8609 - DNA, 725 bp, artificial
  synthetic oligonucleotide
tcaaaatttgcaactgtctgaacagcagtgagattgtacttcttttttatatttaactattacatttaatccctcttctttgatgtgtgtgatcatgtttgttgacagtttttactgggctttaatgttttcttaatgatttgcataagctcatataatatatatgaaaataacacttttccagtcatattttttgtaaatgtttccccaatttgtctttttatgttgcttttatatttttggcatatggaagttttaaaaatctatggtcaaatctattggtcttctcattgatttttttccattgcctttatactttaaaagtcctttcccattcaaagatttaaaaaaaaacaaaaactctatttatgtctttttgttatttcatatttttacacctcatttcccttttaaatagagtaattaggctggaagctcatagatgcactttagacacagtttacctggatttccagaagacatttgtgaaaatcttcaatatctgccatctcgctggctattttcctatgcttacaatgatgttcaatttgtccctattctgaatgcaaaaatatttttttaaaaaaaactttcttaaaatgctcttcttacttgaccttcatggcaaaattgtcctctctggattctcctgattcctcttttgaccattccttctgtttttgttttaccccttttttggcaccttaaaggctggtgttccctta

SEQ ID NO: 8610 - DNA, 5732 bp, artificial
  synthetic oligonucleotide
atgcacagttctctctttggtaatgcccaattaaatgtaagtttttggttttgttttgctttttaaataacggatcaggtctttggtgataacaatccatattcccaaattctttctcattcttctcattaagagatagagtctgaggtccctccccttgaacctaagtagaaccttgtgactgcctcaataaatataatgccacagaggtgacttctgaaactaggtttctgcagctttctcatgggacattacaccaggagtctttagctaccatgtaagaagtctagccacccttataccaccatgtggaaagaccacatggaaaagctacacagaaatagagggacatgcctggggtgccctgactgctcctatgaccagctgtttgaatcttcccagaatagcccatggcatagagttatctttgagataccccaactccattcatcatctgactatggccacatatctgataaaaccagagaactgagcaaaaactccccagctgaatccaagcaattcttatatttataaacaaaatgaatgactgttatttttgtaagccactattttgaggatagtttgttacgcagccagaacaatatgttacacctttttctatgcttccagtggtgcttagtaaaatttgagtatttgtaggcagttaattgggtgattatcaaacattaaaaataacttagctattcttatatcagacaaaacaaactttaaaacaacggcagttaaaagagacagagagggatattatataatggtaaaaggccttatccaacaggaaaatatcacaattctaaacatatatgcacctaacactggagctcacaaatttataaaacaattactaatagacctaagaaattagacagacaacaacacaataatagtgggtcacttcgatattccactgacagcacaagacaggttatcaaggcagaaagtcaacaaagaaacaataaatttaaactataccttggaacaaattgacttaacagatatatacagaacatttcatccaacaactgcagaatacacattctattaaatatcccatggaactttctccaagatagacaatataataggccatgaaatgagcctcaataaatttaagaaaattgaaattatatcaagcactctctcagaccacactggaataaaactggaaattaactcgcaaatgaaccttcaaaaccatgcaaatacatggaaattaaataacctgctcctgaatgagcattgggacaaaaacaaaatcaagatggagattaaaaaattgttcaaactgaacaacaataatgacacaaccgaccaaaacctctggtatacagcaaaggcggtgctaatagcaaagttcatagacctaaactgcctacatcaaaaagactgaaagagcacaaactgacattctaaggtcacacctcaaggaactagaggaacaataacaaaccaaacccaaacataacagaaaaaaagaaataaccaagatcagatcagaactaaatgaaattgatacaataaaaaacaatacaaaagataaatgaaacaaaatactggttctttgaaaatataaataaaattgatagaccattagcaagattaaccaagaaaagaagagagaaaatctaaagaacttcattaaaaaacaaaacaggagataatacaacggacaccactgaaatacaaaaagatcatttaaggctactatgaacacctttatgcacataaactagaaaacctagaagagatggataaattcctggaaaaatacaaccctcctagcttaaatcaggaagaattagataccctgaagagaccaataacaataccctgaagagaccaataacaagcagcaagattgaaatggtaatcttttaattaccgacaaaaaaaagtccaggaccagaaggattcacagaagaattctaccagacattcgaagaagagttgataccaatccctttgacactattccacaaaacagagaaagaaggaactctccctaattcattctatgaagccagcatcaccctaataccaaaaccaagaaagggcataaccaaaaaagaaaactacagattgatatccttgatgaacatagacgctaaaatccttaacaaaatgctagctaaccaaatccaacaacttaatatcaaaaagataatccaccatgatcaagtaggtttcataccagggatgcagggatggtttaatgtacacaagtcaataaatgcgatacaccacataaacagaattaaaaacaaaaatcacatgatcatctcaataaatgcaggaaaaaaaaaacatttgacaaaatccaccatcctttagaattaaaagcctcagcaaaatcggcacagaagggacatacctcaaggtaataagagctgtctatgacaaacccacagccaatgttatactgaatggggagaagttaaaagcattccctctgagaactggaacaagacaaggacgtccactctcactactcctcttcaacatagtactggaagtcctagccaaagcaatcagacaagagaaaaaaataaaggacatccaaatcggtaaagaggaagtcaaactgtcactgtttgctgatgatatgatcatttaccttaaaaaccctaaaggctcctccagaaagctcccagaactgataaaagaattcagcaaagtttccagatacaagattaatgtacacaaattggtagctcttctatacaccaacagcaaccaaacagagaatcaaatcaagaactcaacccctttttacaatagccacaaaaaaataaaatacttaggaatataaataaccaaggaagcaaaagacctctacatggaaaactacaaaacactgctgaaagaaatcatagatgacacaaacaaatggaaacacattgtgatggttaatactgagtgtcaacttgattggattaaaggatacaaagtattggtcctggttgtgtctgtgaaggtgtacccaaaagagattaacatttgagtcagtgagctggggaaggcagacccacccttaatctggtaggcacaatctaatcagctaccagcaaatataaagcaagcagaaacccatgaaaaggactggcctagcctcccagcctacatctttctcccatgctggatgcttcctgcccttgaacattgaactccaagttcttcagttttgggatttggactggctctccttgctccttagcttgcagacagcctattgtgggaccttgtgctcatataagttaatacttaataaacttatatatataaaatatattatacatataatatatagaagtctatatatatagaaaaaaggaaggccatatatatatatatatatatatatatatgtatctcctaatagttctgtccctctagagaaccctgactaatacacacatcccatgctcatggataagtagaatcaatattgtgatacacatgtcccatgctcatggataagtagaatcaatattgtgaaattgaccatactgccaaaagcaatctaaaaattgaatgcaatccccaccaaaataccaccatcattcttcacagaattagaaaaaagaattatacaatttatatggaaccaaaaaagagcccgtacacccaaagcaggactaagcaaacagaacaaacctagaggcatcacactacctgatttcaaactatgctataaggccatagtcaccaaaacagcatggtattggtataaaaaaatatgcacatagaccaatggaacagaatagagaagccggaaataaacccaaatactttacagccaacttaccttccacaaaacaaacaaaaacctaaagtggagaaaggacacccttttcaacaaatggtgctgggataattggctagccacatgtaggagaatgaagctggatcctcatctctcagcttatacaaaaatcaactcaagatagattaaggacttaaatctaagacctgaaactataaaagttcgagaagataatgttggaaaaccccttctagaaattggcttagacaaggatttcatgaccaagaacccaaaggcaagtgctatgaaaacaaagataaatagttgcgacttaattaaactaaagagcttttgcacagcaaaaagaaaaatcagcagagtaaacagacaacccagagtgggagaaaacctttacaatctacacatctgacaaaggactaacatccagaatttacaatgaactcaaacaaatcagtaggaaaaaaaaaaaaaaacaatcccatcaaaatgtgggctaaggacataaataggcaattctcaaaagaagatatacaaatggccaacaaacatatgaaaaaatgctcaacatcactaatgatcagggaaatgcaaatcaaaaccacaatgcaataacaccttactcctgcaagaatggccaaaatcaaaaaatcaaaaaacagtagatgttggcatgtatgcagtgaacagggaacacttctacactgctggtgaggatgtaaactagtacaaccactatggaagacagtgtggagattccttagagaacgaaaagtagaactaccatttgatccagcaatcctgctactgggtatctacccagaggaaaagaagtcattatttgaaaaagatacttgcacatgcatgtttatagcagcacagtttgcaattgcaagatcgtggaaccaacccaaatgcccatcaatcaacgagtgggtaaagaaactgtggtatatttatttgatggaatactactcagtcataaaaaggaatgaattaatggcctttgcagctatctggatgagattggagactattatgctaagtgaagtaactccggaatggaaaaccaaacattgtatgttctcactgatatgtgggagctaagctatgagaacgcaaaggcataagaatgatacgatggactttggggacatggggggaagggtagaatgggggtgagggataaaagactataaatagagtgcagtgtatactgctcgggtgatgggtgcaccaaagtctcacaaatcaccactaaagaacttatgcaaccaaataccacctgtaccccagtgacttatggaaaaataaaaaattaaaaaaaattttttaaattacttaatcaagaaacctttaaaagaaaaccatccaagttgaaaataattcttattaccactatttatcactattcagtaaatagattcaaaatcctccaacatcagtggattctcagaagatatacacgtgcatatcagtacacctacccagtaaatcaaagcaaacactgagttgagtgtcctggagtttcactcaactttgccacagttcttaatatataggagtattcatatagcatgctatgaaatgatatatcaagctaatctatcctcaaatgttctctttctgagcttcccaaataagtgagaatatagtgtataattttctcacaaagatgttgtaactgcttctctcaaattggccactccttccctgccaccattctagttcaagtacccgttatcttacagtactcttaaattatctgttttctctttttttcctcctcacactaaactctttgtacaacaaataaactgatgcttttaaaacataaatcatgtcatgcctctgcctaagatacttcaatggcttctctttgtatttaggacaaaattaacatttttatgtttatcagagcctatgtgat

SEQ ID NO: 8611 - DNA, 1148 bp, artificial
  synthetic oligonucleotide
tttgtgaatatgcggctccacatagcaataggattcagtgaacgactctaaagaaacacaaatatttaaagtgatgtgaagaggaagtctcaccaacaattgcagatttaaaaaattgtaccaaagcccttggcaaagattcatatttagacactaatacaattttaacaattttcacaaccttttgacttaagaaatcattctttgtatttaacttctccccctgcttactcttgtaaagtcaactgaataatggaagaataaattaaatcatgcaaccagctgtgtatctcaaatcacattcatctccttatacagacagggacagctctaaacttacataagttgctccagacagatgtattaatatagagtttgtggcagcatctgctgtaaaaaaaaaaaaaaacttatgtttttaaaaatgttcataatatatgaactctcatgtcgaaaaattcctcttcactttatggtctattccaggactgcagagaatcatctaccagacacataaggtccacattctagcctcatctctgtcattaccagttgtgggatcctaggaaattattttttctccctatgccttactttcttcaactgtagaatgaatgtagttggactaaatcaattgttcccaaataatagtccataaataggtaccagtttgtgataaaacatttatcagtcctttctgagcaaaaaatgcactaatacaatgtaataaggttttcattaagctaaatttactcaattttaaaaattctgaatgtgtggctttattggtattggaccaaaaaaagtccattattttatgatatagtggtgcggaaaaatggtaattttttttaaaaatgtctctacttgggaaaattgaaagttgtcaagcctacatcagctcttatgttttgatttttaaaatggttttggtacattacaatcaaacatcaattggatggtatctaagagcccttctagctttaaaattcctaggattatgcatcatgtagccctttcttgcccaggctttgccattcttttagggccacattcaaaagttttatcttcagaaccactgtatggtttttgagcacttacttcaaaaagtaagtgtttttgagcacttacttcaaaaacaactccaa

SEQ ID NO: 8612 - DNA, 1192 bp, artificial
  synthetic oligonucleotide
gaaaaaatgaagatacacacatgcaaatcaaatagtaagaaacaaaatgtgaaagtgttgccaaaatggcccagcagaaagtgtgtatgtgtgtgtatgcatgtgtgtgtgtgtaaaatcatcatcttatatgtaggggaatcttggagtattgccacacatttcctttagaatattctcattattgattatgccaaggacacagatgtaaagtgaggtatacaaggcaaactgggttatgtggtcactctacctatatggagactggtggtctctaccttcaacccaaatgactaagctgaaataaaatttaggtatgcattcacaaaaaagaatactcgtcttattatccaatctacacagtacacatatatagatatatacacacacacatatatatgtaatacatccaatttgtaagaaacactctctcagaaaaaactagctgcagttccctgatactgttttcctagagaaatgtgacaaaaaaataaaacagatgttgttctagccaggcataaagtgagaatcaattatgactatttcctttcctggagtcatttcattttagagagcatctaactaaaaccctttcttgatataaatgaaaaagcatttctttgaaacacacaactagtaaatgatatatatcagtttgcatcctgtgacatactgctaatcctctgagtattaaattgtctctgtttcagttatataactgtttaatttttttcatctttagtcatagtaaggtttcccagaaagtgtattatctctgcagatgtcaccactcaccaattagggaagacagcagtgcacaattcatagtgacctctctatataatagactttgacacttgggtctgctggggagggaatggattaagacaatttaatagaatctacagtgactaatttttttccatgaaaaacattttgttttgtggatagtacattttttcctttggacttatttccaaaaaccaaaacaaaagcatttaatgatgtttacagtgaaatgaaacagctgaagaccagcacataatcaccatattttgttttctcatttttaagtcttttagcagtagggcttccagctgagcttgagtctagcttttctcaagacatagccaagcattctgaagcttcactgagcctaaccaccaagttgaattcatatttcttaattgaa

SEQ ID NO: 8613 - DNA, 3596 bp, artificial
  synthetic oligonucleotide
ttcatgtgaaacatgaagtttgcaagcaaacccctgtctcagctcctatcattagagcacccctgtttaatctggttacagcagactgctggagcaatggctttataaaagcaaatgcagaatacctgccagatgaaagagatggaaaaacagctaatgatcacccagaggttgggagaactagaggggaaaagccttagaagggtgaaatccagagaaaagtcgacactaaagtaactgaatgtcctagtaaagtggatctcgcccccagcactaaagtaccactcttcttgaaccattgtatgatctagaaactacccaaacacatctcccccaccctcttgccatcccactagaaatctccactgttcccaccattccttaggagccttctgaaattacttcaactgggagtgtttggaaaaggaaacacaatttctgtctagcaaacaaaagagcagattcctctcagacctctacctgtcagatactaactgtactaggctcctagatgcagcccttgcttccaaggagctcacagtttgatggagaagaaaacagaacaggcaatagcagatccagctaccacatgggcaccaaacagccagcagtcagaatacagaccccaagtgcctacaataggtaggaagggggacggtgaatgtgtgagagagaggaggagacagtacttaaaaggaaactaaaccccaacattgccctgcacttactcaggtatgttcatgtgcccacccatgcccctcatttgaagatgcactgtgtaatatctactcacactgcttttatctagaagtttatatctcctttttaatgtaaactcaagcaatttttaatgctattggaagcatgggttgggggattaaaaatcaaaagggtcagttcatttctggtttcttcatagagagtgaatgctgaaattgtcacaaacaggaataggaggcaaacttggaagctgtgttaggaatacaatccaagtatttgctggaagaagtttatccaacagtcagtcaaccaacaaacactctttgagttaattcgttgtaccaacataacaggtaaaaatgatgttggttaaatgtgttcatctacgatattcagtacaatatataatttaacaagtgggaagttcactaccccacaaaaattatgctaccctgttgatgtggtttggacctgtgtccccacccaaatctcatgttgaattataatccccaatgttggaggtagggcttggtgggaagtgatttgatcatggtggcggtttctcatgaatggtttagcaccatccctcttggtactgttctctcgatagtgaatgagttcttatcacatctggttatttaaaagtgtgtagtccttcctccccatctctctctctcttgctgctccggccatgtgatgtgcctactcccccttaaccttccaccatgattgtaagtttccttaggcctccccagaagctaagcagatgtcagcatcatgcctcctgtgcagtctgcaggaccacgggccaattaaaccacttttctttatgaaattacccagtcttaggtatttctttagggcaatgtaagaatggactaatacatctgttaaaacccggaattgattaagcactcagcagttcaaatattcatttcactctgcgatcttgggcaaattacttaatccttgcatgcctcagtttccctctctgtaaaatagggataatagaacatgaatccaaaggagaatttcagctgcatttatcagacccatgacaggaatggtgggaatcctgatcccctgctttatacagaacctgcaactaactccaagtaggatcaggaatttgacctcattcaggcaataaaatagtggcacatgcatgttccatctcatctttcaaactaaatcattttttcaagaagattggtaaagagacaaaaatacaaaaaggaaatctagaggatactggctttgcaggaaaaggataagcagcaacccaagctactgtatttaaagaatctgtctttactgcctttaaagaagacagttctcaagtagaaaattttccatatctttgcaaatgaaggcatggaacctgtgtgcactctgcatcaaatatgaagctccgcggagacctgacctccaggcatggtgccagagccacgtgttcaggcaaagaagcaataccatgcacattgtatcactaatgaaaatactacttcttggtcctaagccataatatatctcatcatgaggattcccactcccaggcactgagttgagaagagacaagtctcgagggcttgttagtaattaccttaacaattcttcccccaaatacaggtcagttaaccccaggcagatgtgccaggcatgatctgctactgtaaagagaagaatatcatagaagcttgtaaccttcctatcttttatcctccttttttaactccaaaaggaataaaccacccattcttgtgggtcctgaccttcaaatgaaaatatatcattcccccaaatcagcacaaaccatcatgggcagatgtctcatgctgcatcctaatgcaattagtagcgctagtcaatgtggcaggttcctagaaccgattttcccagaatggatggggctatgctgattcacccattgtcctgtgcctttgtaatccgtctcaggtctctttgtgaggcagttgggttacagttatgggaaaaatctatgcagcagaattattctaattggatagaatacactattctggcctcattagtactacattccaaacaactgagttaactggccatagatgggctattatattatgggtctatgtatactgacatcaagtgttctagctcatactggttcaaggtgtatgcccaaacccaactcctgtgcactgagagagtatattttttcacacttctggtggagcaaaggatgagactcagatcatcagatcatcctgaagaaggaaatattttcttaatgaatagtttgtatgtcttaagccagtggttctcagccctaactacacatgagaatcatctcagaatcttcttcttgtaaaacataaaaataaaaatactgtcaccaaggacccactccaagagattctgaggtaattagcctggaattggacccaggcactgggtgatttttttaaaaagctttccaggaaattttagtgtacctccggggtggcaagtaactgtcttgagcaaaggactggccacaggctctgacctaatgtgctgcattttctaaagcaagcccagctgtttagaagatgtcatttcttttgtcagattacctgccaaggtcatctcaatatgggataaagaaccacagaagaaatacattctttaaaataatacaagagcttttttttttgcatgaatgtattggctcctagttagccttatttaatcaaaatttgcttgacattattccaataccttctctaagtatgctaaatggcaaacaacatgaaacatttgagagaggaaattttctctaaatgtcacattaatttcactaggaaatgtccccatttctaatcagacagccaggttaacacaagaacacagcaaag

SEQ ID NO: 8614 - DNA, 1638 bp, artificial
  synthetic oligonucleotide
cttaaaccaaagcttgggtttttactgaattcctatagcaaatagcttttcttattagctaggtctttttctaaactattttctttttaaatcactgtcatttcaagcttcagactatgctaggagtgctgttcacatcaaattagaaatttggcattaatgaagtgctctggttgaattggcagaaagggataaaaacacatccctttgttgccagtaacttagatttttttctttatctacagcaaatgcagagaagattcatttatgatgagcaataactgggattctacagtaaagcatctggaacagtgcctggcacatgttaagcattcaaggaatgagaagctacatgaagaaggtattaggcaatatttacaccattgtgagacactagattgtgaatttgcaatgaagttgagaatgctgagcaataaaatcacaactggtaatgccttctccactttctgttgcttgtgggaaaccatgacttgctccactttgtattacttttggttccctctctttccaggggtgaataaaattgcacagtattttggtaccaaaagaaatacaacagagatagatcctagtttgcaagtaatgtcaaggcatgttagagcacagtctacatagcaatgtttatttctctatgcctaatttatgtctcttagaattatatgatttctaatactgtcttaagtctgtatgaaggcagggctgttaaaagagtttgttaagagacctaagagttttctaccaactctaccaataactgcattggaacctggtaaaagggttttttttcacacaattgtgtttttaatgttttcttcccattatggaacagaatggtggcaataatggcattatgatgaacatgttgccttctaaggtgctttaaatacgccagatactaaactgtttctaggaaaagagtaaaaccaatacttaaccttcacgcacataattcttcatcttatgcactgccctgccctggatccaccccagtagattgtaaactctttgagggcaaggattattcagcactcatttttgtaaactccgcagtatctagcccagactgatgcataggtgttcaataccacacagctgaagtaaactgaatctgggcagatatggctaaggcattgaagtgtgagttcagagctttggagagctgtgtgtcacagcatgtgcaggagaagtgaatctgcaagtgtgtaattaacaacccagtgactgctgatgagaaagagaattcgatactacgcagcactgaacacaacttaacaagcagcaactcatgtaagggaacctaatactctacacgttgtggagagaaaaatcctgagaggcagtgaggtgtaagggaatctaatcttctgtgaatggaaggcagccaaatagggttcgatgtgattggaaatccaatgtactggtatagaaggaaatccaatacgaaatagtggtgaagagggaataagcgttggtgattaaccagactggtcactggaaatttcctttgttccaaaaacacaaaaccaagctggataaatattcagcccaggatttcaagtccattgagaaagggcagaaatgaccctgactatacaaacactattcttaagttgttca

SEQ ID NO: 8615 - DNA, 2198 bp, artificial
  synthetic oligonucleotide
aatgtaacttgaagagcatttccctctgcaaacaactgatcctctgggattttcacttcaagcctctcaattgttcgaagtaaatgaggctcacatcaaaggccagccagtcacgcatcaagaaatcaagcctcttctccgtgggggaaaatggctgctccagagccatcctcccacctctcacacacaggcctcttgtaaaaacggctttatttacccaaatctgagacactcgattcaaccaagcttggcctcccctaaatcctggaagctgaggtacacatgcagaggggccaacatctgaaactcgaggcagacgcctaagagccacagcactgccacaattgaaagactccagctttgccaggaggtgacttcatcctttttcagtcccctaattcctaacaagcaatcccctaagcccttagcttctgcgctgggcacaataagcccaagccacagcacaagctggggcaaggttagggagagagaggtctgcagctcatcctaccttgtaagtctgactgacaatcagagaaaaaaccaggtggagccacctggacccaaaacaagtggtcctctgataagaggaattccaaagccttagagccctctgtggaaaatgtcctgcctccagccccttggggagaaaaatctcaggatgattagcaagagctctggctgagctcaacttcagtgaaggtgtacggggagagaggtgatctctaaggtaaccagttaattgccgataaggaatgataataataaattagcagatactaatgtaaactaactcagttctgcagttctgtggcagttgcatggagacaacagaggaacagtttattctggaacacatcttgcaagcccatccccactgggaaaccggctgtctcagctagaggtgaaacatgccaataagatacaatgtaggcaatgggtggccctagaatgactgctggtagaaattgagcccttgatttttgaagaaaactgaaatgagaatgctcgaaaagatgtgggctgcattgtttctcattgctttctccttcagggttacttttgacccttagggataggacttaaatgattccaagaccctactgtaataaggagacaaacaaacaagacgcgcactaaagggtttgttggtttcttttaattagaggtgatgctttgtgtcatttccatgctatccaaaccagccttatcatacctattattttttagtgccttctgaatctactacctgataggtttgtggctgtctaatttagcccagaatttcattcaagtcactgcaaatctctaactttaaaactctgttttaggaactaaagtgtactgggctattttttttcaaagcctaactgatgttttattttcattatttccactaagatgaccatgcattcagactttttgtaggataattggaagcattcaatttggctgccacacacattcttgttctgcaagctcttccacggctacgtcactacttatgaagactgttgcatgagtggctatagcagagcatgcacacacaccccttagatgcctcatatcaaagaaactacagtttgctgatgaaaggtagaaaatagaattcaagattgagactgaaaccaaaatttaaatccctacggacctatgactggaattctctaagtttttgcctactatcactcccttacagctgtcagctcagaaacattcaacatcagaaaactaaaatttaaaaatactgcacaaagacactgggtgtttgggccatttcacccctcctggaggcaagaagaagcctcacccaagtctccatttccagtagaagcaatgagttgcattttcttcctccaataatgactgcagccaggtgacaaaaatggtaatgcagcaatgctgctgtacaaaggaataacactttccagcatccagagacaccagtaggcatgtctccattccataagaccggaagaaaaatcatttgccttactaaggagcctctcaaaaaatttggactatttttagaaagatcttagcaaactgacaaacctactatctttcttctccattttccttctttttcaacctcctttcctctctcttcactcttttctacgccctcatacacacacacacacacatacacacacacatacacacgccctctaattcattcacatatacactaagtc

SEQ ID NO: 8616 - DNA, 14108 bp, artificial
  synthetic oligonucleotide
aggcccagtatgttgggttaccttttgctccaagaagcactgatagcaaacccttagtatgaaaatgggcataagcagagaaattctccccacccctgccaggggatgtgccagcacagcagcttatggtatccagcgagcagctaaagaaggagacctgggagaacctcacagagccacttagctgcactcacctcaggcagaggcacaccgttgataatcaggtcaggctgctggggcccctggctgttgaaagagtgatggtagatgtggttagcactggtgttgcgggtattctggttctccacattcaggaaagtgctctcagagcggcggcagcccaggggcagcgtctgctggtggtagtcaaaatagttgagggaggaggtcagggaagagcaactgacaacgttcatcttgtctgtctcctccacatcccggggtaccaggcggatgtcattcttactgatttttttcttcttgcttgatttcttttgatgcccataggagtactcagcaattctatgtgacagaaaaggcagcatgaatcactaacaccctcccaaatcatgcactgattaataaacattaagcaccccagagggttgcaccccatctccgctccagctccttattctggtgcattacatcatcgggtttctccctgtgctttttacaagggaaaacaggctgagggccataaacttttcatattaaacatagtaacctcccaccaaccccccctaaaaaagtttctatactttggatttggaatttttcattgtgagtggcctgtgagcacgggtggggggacagggaaagttgagcctatgggagagaaagcatgaaaatgctcaaatctggagcttccctggaaccaaaaggaactcctaggtgaaatacaaagcaagtcaccaaagaggagatagaggaaaataaaaaatacccgcccccacccccttgccagttcctccaggcatttgccatgtggcacacgccctcaatcagcttcctctatgactcactcgatcagttttggactggggtaggagatcagaccccattctttcgcgtctcctccacaccctcctccctgccctagcccggttcccttttactcaccccccgaccccctcctctcctagaaaaatctaatagccaaacccatttaaatgaggggaaatgcctttttacctctttccccttaggctcactttctcctctgtctttttgtcttgctcctcgctaatgggagaaaccgagatgcaatgcagacacttgctgttttgtccttttataaaacagccgaggagacaagtgatggttaaacaattactgcaaaggaatttaaaggttagtgcattcagcatccttctccattcaggtgtacctacaagcagctgtgctgcaactggaacataaagagctcaatttaattaacactgacacagacccagcaacgtgcaccaaagacaccaggcattaagagacttgtcaaaagaaatacatttaaatgtagccagattctcaaagtcatttattactttgcacataatgattcagtttcttttttggaaattcgatttctgggcaataatcagcaaaacaatagggttaataagtaatacaggttgatctttacaagggaaagactgtgccttattctcactcgacaaagctaattgtctgaatacaaaaagggagcccaattcaagcagcaattgcagatcatctcgcaagtctcataaatgaatgcatttcaggaagaggttctgcggaggcttagaaaaagaaacctctgcctaatcacatggaaagacacgctcctgaactttaggtttctaaaaagtctgagcagatagggagactacacatctacagaggcaaattcttgctctgtccccaggatctacctagagttaagcaattgagttcccctcaccccttcgctctgtgctcaggaagatttgcagtgatggcaaactggtactactggggtttgggagcagataaaatccccaaaaccctagtactaaggttgattttctattctaatctgtttacagaatcaatgggaaattttaatcattttgtttacccaagatgagtaactttggcaatgccccatcaaattattcagctgaagcattcattgtgcagccctttctgtattaaccaattatttaattatactgtacttcattaatcccaaaccatcacaggaaacagaacgcttcacaaaatacacatttgggtgaagttggagagcactgagatttactcttttttttttttttcaatattcagatgctctcctcctgtttaatcatctccttggcaagttctcagaaagggctctcacttctagtcatacatcaccaagaggtggcaaagccttcaatatctttatttcaagctgatttctttttcatcaaggaaaggatcttatgcatttactttatgctgagaagatggcttaaaaagagtcctctccataattatctccatataaataaaattttattgaccccacatttttctcctataaaaatcgccactagcagtcacaggtttgaaagctaagagcaatattaatttacatttctcccatctgaaatgacttggtgctgaaggaaagaaaagtcatggccatttcactagtaacaggattaaagcatttatgaggcattgcagctgctcttttatggcacctgattgatattcatgtgtggttagcatttgtctactaacttgtgtaacgcagagaatagtaaaagggaaacaataattgcatggctgttacatattcagggggctctgattcacagaagtgtgcatttcagacggtgtcaaatacaaactgaacctacaggaacatattttgactgattaacatgcagacacaaatggcacaaaagacacactgatgtgtaggtgtgttgaaagcacacacacaccttggttgtaaatagcagcatcattcattttcagcaaactaaagaaacaacttttttcaactgtttcgatgagacactgctggaaaaaaaatgtcatgtattatcctaaattggattctaggattctagaaatgcttagacttatgtgctctatccaaatgtaagaaagggcttcagtaagaccttctaatgtgcttatcaggaaatctttttaaaaaatactgtgtttcttcttttctcccttttcctcccccttctatccctctctctctccctcccccccccatacacacacagacacacacacatccttcacacacttcaagagaaactgtaacacaatagcccacagtgacatccactggtaggaaccagatcttaatgccacaacacagtctcacattagaggaaagcatcatcaactctagaagattgctatttttactgaaacatctggatgcaaagtcttgttcctcattgggatgtttggtctccacactaccaaccaaccagatatttgaaaacatacagatgcctgatagaatttcactttatatagccagatgtttggggactagataaaaaacaagccaagaataaactaaaaaccactaatcacctgcatctccacacactcctgttctctcctccccctcatctccctttcccatcttacactcccactcccagtctctctccagagttcatcactgcaacaagacagggtagctgccaacactccctctcctttcattcagtacctgtcccaaaaacactgtgccccagacaccaagttgtggtagttggtggttttcctaaaaatatgatctctctctctctccccctccctctctctctctctgtttttcctaccataacttcatggagacagctatgcaaattttaaaatgataattgcgtttctgctcaccatcattatgtgacagaatccattcaaacactaaatgattgtcttccagcaaattgtcagatcaaaagaattgatcaacttggactgtcacaaacttttcaccctacaaaaagaagcactgcaagtatgctgcatgcatttaagtaggaaacaaaagcaccaggattttcacacagagacacagataaacacaccttattcatccaagacaaagaaagaaaacttggctttacctgcagttgtaggtccggatctctttgttgtctcgcttgcacttgattgccacgaagatcatagttacaaagaggatgcccgcaatggagcccagggcaataatgaaaatcaaggacaagttcacagagcccattgactcttgggcatcgagagcaggggacaagtagattaggacgagagcagaggcagagagagatgtcttgccgtggtcgtgagccaccacgataagctcataggaggacttggagctctccccgaaggtgcgggtggttctgacttcgccattgacctggtctatttcaaagaagccgcggtcgccctcggtcatgtcgtaggtgactcggccattttcgccctcatcgtagtcttctgccttgacaacagtcaccaggtagcctatgccagagttgcggggtatgtagacctcggcagtgccgttaatcagaggtggggctgtgatgaccggggtgttgtcgttgacgtcgaggatgatgacccgcaccgtagcgttgctttgcagtgagggaaggccgccgtccttggccagcaccttgaattcgaacgccttggtctgctcgtggttaaaggatcgcagcgcgtagatgtcgcctgagttgggattgatggagacataggtgaagacaggcatgtcccgcacctgcgacggcacgatctggtaggagacactgccgttgagacccaggtcggggtcgcgagcagacacagagagcagataggcgccaggcgtgttgttctcctgcacaatgacctggtagtagggcttggaaaagtgcgggtggttgtcattttcgtcagtgatgagcacggtaaaggacttggcactctgcagcatgggcacgccgccgtcgcgtgcctgaattgtgaggttgtattggtcgtgctgctcgcggtccagccgtccgtccaccagaatagtggagaagctctcatattcctgcagtcgaaagggcacattgcccagcaaacggcactgcacacgtccattgaggcctgagtcgcgatcagacacccgcaccaaggcgatcacgtagcccgggggggcgctctcgctgacctccacaagctcactgttgactgacagcaggttgatgaccggcggattgtcattggtgtccagcacgctgacggtgaccttgcagtgtgccgggatggaattgggccccaagtccttagcctgcacgtccagttcgtacacgtgcccctcttcgtagtctaaagcgccagtgacagtgaccaggccactgtgcgggtcgatctgaaagagctcgcgcgtgcggtcgttgacgtagccatagaaggagtagaccacctggccgttggtgccctcgtctggatcgctggcgttgaggcggatgacgggtgtgttgggaggcgagttttctggcacgctcaccgcgtaggtggactcgctaaacaccgggttgttgtcattggagtcggtcaccttgatactaaggccaacggtgcccaggcgcggcgggtcgccaccgtctagcgcagtgattcggaagctgtagtgcgactgcgtctcgcggtccaggctcttttccaccacgagttcggcaaagcgggagccgtcgccgcgcgtcttgatctccaggccgaacagctcgttgggcgtgagctcgtaagtctgcacgccaaagcttcctgagtctggatcgtaagcgctgtccagcgggatgcgcgtgccagggctggctgcctccgagatctccagctcgatctgtgctgccgggaaactgggcgcattgtcgttcaggtccttgatctccacctttatcacgcagatttccattgagctggacatgacctcgagcgagatgatgcacttggggctctggcggcacagcagatcacggtcaatcttctgcttggtgaccagcaggccagagctgggattgatgtccactaggtgtggagccgagttggacaccacgcgaaaggctgaagcctgccgggggtccagcgcgaagcccgcctctcgcgcgtctttggccacgttggcaatcaccgtcccggcgcgctgctcctcttctaccgagtacttgagattaatgagggcggcagcctgcgtccacagtatggccagcagcagcagcaccggcagcaggagcgactccatggctgcacggggctctgcctggcctcgcctctccacacccctccgagaccgacgccgtcggcgctccagcttcccgccggctcgggccgcctgttgcgcgcgccccgtggccccggaggccgcgggagaagtcccgcccagggcggcccggcggcgcgcgggggacacccgcggcggctccaatgctgaggttgcggcggacgcggcgggggctcgcgggggccccgggggctccgaggggccaagggagcgccgcgcggccccgagccccctccctccagcccggctactcagttttaccccttcaaagttagccgggcgcgactgtcggcagccgcccagggctgcgggtcgggcggcgtctgcgcggcctggaggacgcaccgctgagtccggacagtacttgaggcgaaggtaaagagggcggaggaggcgcagcctttcaggcactgcccggcccgccgcggtgcaccggcactgaggctggcgaactcgctgtctgtgcacctggcatgcgcaaagacctccccccagcgctcccagttcactgcggagagagtacccgcttggaatgcgccctccggggtctgggggggccacactggcctcttcgaggcctgttcgggagaaagggggtgtcgcagacgggagtcagttactggcaagcgccgcgggcacccggttatagggttgagtcggatggcggtcccggggccagcagaggaagggggaggggagagaggctgccagagcttgagcgcgctccctcgcgctaaggctggcttcgaagggcttgggggcgcgtctgtccaggatccgaggtgggagcggagttccccccacagagcagttgagggtctgcgggcgttttcgtctaggaaatcaaagttaacaacgcagtccgaccctccacgtcaagtttgtggaaacggggagatggcaatttgtccaagaaaatcaaagccccggtctttctaatggccgggggtggcggggaatggggaagagggaaggggaggcaacaacagtaccggccaggagaggcggggccgccgccgtgggtaccgggtgcttctcttctctccgtttgggctggggtgtcgctccaaggtccgccgccgccgccgccgccgccgccgccgcgggaggaagccctcctagctcagttgcacgtcgctggggtccgcctcagcagctgccacagtcgacgattttgtcgccgccgaagtttacttgcaggagcgtcttgatttcatcttcccggagaggcgctggccgcgctgcgttgggctcccttcctcccgggcgctcgcgcactcgggaggtctgtctcgctttctctgtctgtctcgggctgtgtgtgaatgtgtgagagagagaggaagagtgagtgtgtggtgtggggagtgtgagtgtggagtatgagcaagcaggaggcaatgggtttggggtaggaggtttaggatttcggatgaaatcgctcagccggaatgctgcggagcgcaacgcgccaagggccagcgccgggctagggacgcgggtgccagtgcctcccgggcaagccaggcatggtgcacgggagctgtgctgccgtctgtgcccgctcgtccgtctccgcgctgcgccagccgccgccgctactgctgctgctgctcctccggatgccgcaaactactggccgcggagtctggagaaagccggagaaagctcaagctgccgagcccggctacgccaggccctggccaatcagcgcgccgccagcgggctccagtcttggggcggggccaagcggaggcggggggtagcgggggggcggggccaagcggaaacttcacaccggcgggaccaagtggtaccccggcccatggagccctggcgggattcatgggaggacggacagacaggccaggcaggccaggcaggagcaatagggcaggaatgagcagggaggcggtgtgctggcgctgcggctgagcctcgccgggaactgtgcgcttctcatgtttgcagagatttcaggaaagatgaggatgatatgattgtcttatcgtgtttacctcccttacatatcttcatatcttgaatataatatatacatatatatacacatatatatatatatacacacatatatatatccctctatttctccttgtctcttcaccctaaaaaatcgtctgtttttgttttcctctcttctcattctctggtagtggaaggaagaaagggaaggagaaagcgcccctgaggtggtcattcatccagctcttagccggtgtgtcttcacatcaggccagagccacggccgccacccccccggaccgtcacccccatccttccaccccgggcagacgccgcactactctctgcgtgccgcactcccagcagggcccctggatcggttcgctcttgtctgttgcttgttaatcaaatgggatatgtggcacagagaatgagctacggagggggccggacacatttcattgcccctcaccccaccctgttggagaatttagctccctataaataaactgtacgtttgagaagagccggtggagcggacgccgccgcgccgcgccaagccagcagagctcaaagccgggcaggagctctggggcgggcacgccatacatgtccgcttaggtcgccgacagctgggagccggcgccgatgtgcagggcgccccagccttcccgcggggtctcggtcccagggggctgccagctccacttgggcggcggtggtggctgcggcatgtgccagtactgggaagcgggaggccggcgtggccagggctgacatcaagctcatcctgccttctgcactgaaggctccctgggggcagcggggcattcctccccacccgggctctgaggcttttaattaaggtcgccagcggcaaaaaaatcaaaaacgtgcccgttaaacaagtttttttttctcttagaatgtggggaagctgcttctgaattcacaattcttggaagagtaaaaatgtcttctgagtgagtcgtctcggatatttgggagtgggataagcagactcataattagcccagcgacattggctcgagcctgtgggcttcacatgagcgtcatttttgccctctaaaaagcgttaaacaagaaaaggaaaccggcatttggacacataatgggttttctcaaaactgccatcttcttgtggagagcaacccagctgctttttaaaatatttttccttccaagaagagctactttagcagcctttaccttggcggtgggagaggggaaaggcggcttcctcttacagaaagaaattatttcgcgagtgagattgcgatcccctgaatatgtagccgaggccaaagggagagcgtagggagcctgatccgctttccgcgtgggggtcgtttcactgtttcacgttaggatgtgattcggcccagaacaacagggagaaaaccgatgcttctgcaatgagtatcatttaattttggtcatttagagctgcgggtggacaccagagtggtggctcaagggagcccggtggcccgaccggttttctccagacaccgttggagaaatgggcaagtagtagagaatgacaacatggcaggcagcggtgggcgcacctcgcgggctccgcgaaaggaagggttccatttgatttatcacagttatttacctttgatgtcagagcatgggaatgaagtgcatcttggtctaattaaaaaggcctaaaaaggcatttgaaatgggtttgctatctgatcacgggatgtgaattcggcgtttggcagctttctaaaatattgcttggactatttaaacagaacaattagcagcatgctaaaatgtttgcatgctatgcttagaagcttttagctgtaaactttaaggcgatctgttccccctttaagttaaaaaaggatgatgctgcttccttgtggcgaaggctgtcaggaacccactgatcaataaaagtaaactggcgcctccacggcttgattgagcgggagcaaagagtctgagaagtagtctcggccattaacaatcccccaggtaacgagaaatggaagaattactcaggtaaaatgattaacattgtcgtagcatctgaaaagatgcacacaacaagataagaagactgcagacctcttaccttagggagtgctaatagaatgtctatattctgctgtcttttaaagataaataggagaattcaattcatgtacaatgtcattaccttcataattgcaatcacaatgtaaagacatgttctgcatttgcaaagacaaaccctctttgctaaggcgatgccaccgtgttccctgcttcctgctcgctgttcacactccaggcacccctcttttccaaggagagcatccaagtacttccagctaccaaaccacttttacacaagccaggtgctaagggaggcaggggcgtgtgcctatgctttccttctttcctattatctcctccccacccctaatctcaaagtgacagttacacagccttccccatccccacacacaaaatagctcttccatcccccagtctatttctacagataatcctaacaacagcctttgccctcagaatttctttttttctaataggcacactcgatcattatactccaagaatgccattgactaaatgagtagcccaaaacactttcatgatcaggaatttattaactaactgaataaaatcgttctgcatgtagataataaaaacaagaaagttctctccgttttagcttccctttacttcaatcctgaagggagccccgcctcctcagcctctttagagacacaagagggacatctagtgaccatcctcagtattttttaatccaacagctactaagaaatactaatactaatggtgctatgccgcctacggctgctctccaggtcaaagcagctccactgaggccagaatcaaaattggcaaagagaattttttttgtctttaaaatgtcatccatgccactaaaatcatgctgaatggcaataaaagaggaccaaaatgggagaaatcttacttttagatcaaaccagtatgtgaagctaattcttgttctcctaagattgataagggtatggtgaaaggttttgtccagaaaggtgaaaagtaatggtaggaaccaagataccagtatatgagggactgtaactctgacaagtttaaggaagctttctgagatgtgtttgttttgttctgttgttttagagacaaggtgtcattctgtcgcccaggctagagtgcaatgctgcagacatggctcactgtaacctcaaactccagggctcaagcaatcctaccacctcagcctcctgagtagctaggattatacaggtgtgcactgtcacacctggctcattcttttcattttattttttgtagaaatggggtatctctctgttgtccaggctggtctcaaactggcctcaagcaatccttctcccctggcctcccaaagtgctaagattacaggcataagctactgtgccctagcctgagatatgtttttttttttttaatgtttgctttaagctcaaaagagattagccttcaaataactccagtctctctctttctctcctcctcctcctccttccttttgcccccttctctttgccctggctgcagaaaagtgggtcatcttctagcttggctttcactgcatatcatggggatcccattccacccaactagtttgaccagctgcctgatgaggttctcttagaaagaaaaaattgattttaaaattagcaaattcaatcaaacttcttctgactgcatatctgatctccttacttaggttacaatgcctagagaagagaacatcaaagaatgaaaatggaggaaatgggaaaaaaactataaagtgtcattattaaagtcatcatcttatttaatttttacaatatccctgggagataaagacactttgcagatgtggaaacagttgcagagcagttcaacgattttccaagacgacctcattacacaaaactcaaccacttccctcgtgagatcaacaagtgttggctttttgtccagcattgtgttaaggattgagaattttttttagtggaccttgcccttatgtagtttaacatgcagttgattaatttaataacagcatgtatgtctatgtactataaattttcctagaggagaaactaggatgagatatattatgtcgacagcttcctaaaattctgttctcttctgcccacaatgattgcccgatttctagatagtccttccctcccttcctgcctcccccgccactgtcccagacagtataaggaaaggcatcaacagcagcaatcagggatgtggacctgctgggcaggggtggggttatcctggatgctgtttctaacccttctggaacaccaagaagactaggacagaggccaagaaaaacctttgaggtccctcacacttttccctctcttcctctcaaactccaccccttttcctaccctgtgacagaggataacattaacagcagggagctgtagcagataaacaaagtagagaaagtgtttcttaagtgctaaaattgttcaccatggccccgatgcctgccttttccaagaaacacaagagatgtgcgggacagtggagaaaaagagactgagaaagttattaatcacttcatgtcttcccattttgacaaggccagcatccttgaacaagctatgtccaaacttcctccatgccttatcccctccctttaggaatggcacttcccacaggaccaaacccctgctgctgccaaactcgtaactgtccctaaataagcacacgtcatggggactatttaattagcaaaggctaaatcagcagatacatttcaataaatgacactgctctctaacaccttttgtactgccctgcagtgatcacctgtgatgttttgacagcaccatttgggctctcagcattattgcctcaatcttttcatgtgaattttctccaagtggaccccaaatgctggtttcctaggtgcaacctcatgtcagctgttactccccacatcaccacttttgaaaacagaaagctctcccttcaaaggcactctgattaaatcatggccagccttcccactgctgactccctcatcccaaggaggagggtaagggtgacattccacagctccccagaggaaatgcttttttgacagcttgaaaaaaaaaaaaactatcaccaaattggagacctcaaaaaccaccgaaatatgaaccacaacgatacaaagaatacgtaattgaaagtgagcagactttcacttgggatgcactgttttaggccaaggccaagcctttttgtgtgtgtgtgtgtgtgtgtgtgtgttgctgtccccagcctctaacactgcaacctagtaggtagatcccaggcaccttataccttgtgtaatttcctcagactggagctcctgattagggcttggcttttgattcccaccctaggcttctatcacagtctcttctgctatttctgaagcagtacaagtggggcaagaaaggaagcagaactatcactgaaaggaatggttgaggctgaaagagccctggccgaaatatcagccttataggatatgccctgaagatcagctttccaaattaaaaaataaaaataaatatctgtctggttgcttgatcttacaggaggctgagttctttctggagatacccacaagattggagaaaacaaaccagatctttcaagaccttgagatatacggtactggagctgaggtgagtttgtgaactccacactacagtaccctgttgcattaagttcaaatgaacaataatagccagaagaa

SEQ ID NO: 8617 - DNA, 971 bp, artificial
  synthetic oligonucleotide
ccactcctttctcccaggatttcttggagaaaatgacaattattgatttctgtgcacaaagggcaggccactccctgatgacagtaaggaagttttgagaatgtaatggagaatgttcaaacagtagctgggatatttctagcagcagcagaaacagggaaggcggggtgctatgcagatgaatgctagctagcagaagccaagaggcccaatacagggtttgtctgctaatcacattcaaaccaacaccttgccagaaagccacgtcccaagctctccaaataatgcttgcttcaggggtcaatttttccaagagctttccatgaaaagatttttaatggaaatataagcttcatctgagcaataagggaaaaaaatgtaaatctcttctccaccttgcactcgcttttcctgctgtattataggtaaaagaaaaactcatcagaaatgactccacagccagactctgacctcctcagatcctgctccctctaatcaggccacagttgactgacagtcaggaaataaacccttctttcaaggtacagccagaacaggtttacagcaaatgactaatatgatctaatcttccagcaatttcgacagttttcaattctggaagattcatatacgtctgtttaactttctgattctatccttcgactgctcattgaattatccttcaagattcaatcttctcaaatattgcaacctttttgttatcaaactccagtgtaatatcagggtccacaatgtgcccaagtactacaatatccacctgggggacattgaaaagccaaaagtctaacagccaaagccttgttggtaggaggagtagaaaaccacttatccaattagcaaatcctcattaaactgccactaggtgtgctagccactgtgctaagtgttgtgggtggtacaatcatcaatttctgagatgccattaacgtccacttggccaaaaatctacc

SEQ ID NO: 8618 - DNA, 782 bp, artificial
  synthetic oligonucleotide
cacctttggatcttgttcccccaactgtaaagttgtactcaattatctaattctatatggtctttctaaggtcaataaatctatgaataaattaatcagtaaatgatttgtttcttttaattttcatatgatttttctcactgagagttgtaacaagtttgtgacaataacctgctactttcactataatttaaacacagccagaggtttgaggatgtttttggcctttgaagtttgtgaactggaaaccgttacagagtgttttgaattctctacaacctgcaatcctactcaacagtataggccacttatagtttcacttctttttaaaatttatttttattgtatacatttaaggtgtacaacatgatgttttgatatatacatacacgtaatgaaatgattactacaagtaattgagttaacatatccatcaccttccttagttacctctttttttgtgtttgtggtaagagcacctaaaatctactctcttagcaaatttttaataaataatacaatattattaactatagtcctccggctgtacattagatctctagatttatatatcctacataacttcaagtttgtaccctttgaactacatcttcccatttcctcacccttccagcccctggtaaccacagtcctagtctctgtttcaatgtatttgactttttaaaaatattttacatacaagtgagatcatgtagtatttttatttgtgtgtctggcttattttacttagtttaatgtctttcagtttcatccatattgtt

SEQ ID NO: 8619 - DNA, 4179 bp, artificial
  synthetic oligonucleotide
atacaattcctttcaatgcatctcaaggtcgttacagactcaaggacaaaggtgctaagactttagaattgtaaatgattccgggagaaattagtaagaactaggtatacaacacaattacctcaatactagaaactgaagagaaagtggcatccttcacaatataaaaaaagctgcttaaaggaaaaacactctgtgagataaactctaagcatttacaatgaaaggaatgcaatagtaggaaggccagtgaagtcataaactggagacttgcctttaaaacataaaaggaaatcttttgtactataactagctaccatcaacaggcaaatcttgtaaaaccaaaatattagattacattgttattgaattgatctcaccagtttggattataggagttttgtcagcttcgggtcaaatcctgcttgccacccaagatgcaaacctaaaataaggcaggctaataaaatgtatttataaaaaagaaaacaaatgtaaatcacttagggttccagaagctcaagttaaaacatacacagacccagggcaccctgaaaataacgaagcccctttctgactttgagtgaaatggtaacagagaaggctcctactttagtaagcagtcttgctgttagacccaggaaggaggaaggatcagttgttaactcccccaagggcacccactgaatgcaaggcacagagctagttcaccagcagccctaggattaaaattgttacactcaaaatatattgctttccagcatcccataatgtctcacttgttctactaatttctctgccaatccctaccctaagctactttcttctttcagaatgaagaaattaccacaactttctttgaacagtcagtgatttgggtcccagcagaaaagcctattgaaaaccgagattttcttaaaaattccaaaattctggagatttgtgataacgtgaccatgtattggatcaatcccactctaatatcaggtatgacattcttatcctcatcctcctcctattttctaagacagtaacaggttaatgttcccagcatttagaggctacatttctaggaaaacaaatgatcggtttatatcttcttggatgagtctatatatgctgactgccagtgaggagggaatttttcacagccaagttataaatcagataaattaatgttgacaggcttttaaatatcccagcaaaggtaacaccaccctaatgtgactagtgatagcaaaaaactaatctgtctctctttgcacatctatattcattgcagtcggtatgccagactattgctcaaaccactgtgggtccaacccaagaatagaggagagaagggcaaaaacaatgctctgctatcaagaaggattccctatgtcaaatggtggcattttccttagaagataggacaatcactgcaatacaaatttctttgttgctgttttaggaattactataaaaatagttgagggcttgatgtccagagtagaagagtccagccctcaacttccagtcagcccatagagaaggtaaaggcccctggatgtcttagtctgtttagctaacatggaatttggcctccctcattctgcacagcatagattactctattacccaagagaggttattctcaccaatgtaagcatctgtgggtactctttagagatattaaaaaggtgactaaatgcagtgtggtatcctggactggatgctggaacagaaaaaaacattagtagaaatactaatgaaatctgaataaagtctgtagtttagttaataacattgtaccaattctaacttctgatttttgatcattgtaccatggttatgtgaggtaacattaggggaaaccgggtgaagaatatgtgaactctgtactatttctgcaactcttccataaatctaagattatttctaaacagaaagtttaaaaaaaatttaagacaagaaacataagggaagtgggaggacagaggatgtcaaatcaattcaggcaaccaagaaatatttattgagcatctacatgggtaaaatcatcattgtaggagatacagaagtcccttgtcctcagtttttaatttagtgtgctattaagtcaaagcagtaaatgtttgatgccaaagaagcaaagaagtttgtgtatgtagaaatgatcaggcttgttttggaaactactctaaaatatcagctgaaggagcttggaaaagtggtccatgcctaaatgatgccagttagaagacacaatgaaaatctctatccccagctgctattctcccaagcacttctttcaggaacatttgcaaagcagttgcatcacaactttgcatttattatcttagtttctgagttacaagactttgaggaggagggagaagatcttcactttcctgccaacgaaaaaaaagggattgaacaaaatgaacagtgggtggtccctcaagtgaaagtagagaagacccgtcacgccagacaagcaagtgaggaagaacttccaataaatgactatgtgagttatgtttatgtaaactcttgatagaggaggaaaaaagagccctcacaaaacttactacccctcagatcacaatcattggaaggagaacgatcatggctttaacaaaaaaaaaaaaatgtttaagaaacttggaatctccaggaggctcattcaaaatcaatctcgatctctgtagatatatctccatgatcaggctaaggagcttaatttctcacaagcccccaactcatacagtcttctagttctcccctgcttggtgagaactcttgctagtgaaccttcctctcccacccccaacactggcttcttcttctttcagactgaaaatggaatagaatttgatcccatgctggatgagagaggttattgttgtatttactgccgtcgaggcaaccgctattgccgccgcgtctgtgaacctttactaggctactacccatatccatactgctaccaaggaggacgagtcatctgtcgtgtcatcatgccttgtaactggtgggtggcccgcatgctggggagggtctaataggaggtttgagctcaaatgcttaaactgctggcaacatataataaatgcatgctattcaatgaatttctgcctatgaggcatctggcccctggtagccagctctccagaattacttgtaggtaattcctctcttcatgttctaataaacttctacattatcaccaacagcctgattgctgctgaacacactgggtaagtgtttgctgagaatattcacagcaactgaaatggagcagacccgtcaaacatagatgactatgctgaggctcagaaaacaatgccccaaaatgaaagcctcagaagcaaaagtttttctctgaccttctcctacctgccagtctctcagtcccattctcccccgaggctagccataaaagctagaatccctcttcctcaaggcgtgtcatataaatcaaaaccccttttttccaaagccagccttaaacctaaaaatatcactctgatttttcctctgcttttctgtgtaaaagctggccataaggaaattatctgacctaccttgtttgactgtaggtcataagactccctttccagagaggatccaacacaacaggtttggaagtagaaaagggcaaagcataatgatacctaaatatcatattttactctgctgtattaagacagtggaaataaggagctgatgataaaatgtctccataactgatgcattaaaaacatatccttttgtgcatagccccagtgtttaattatatgaaagatatattgtgaacttccttaagtatcaattaagctgctggacaggcagtgagtcatagcaggccaacactaaaatattccaaatgtgcagactcagcaaaggagaaagctaaactagcaaaaagggtctcaggctctcctcctataaacaggaactcaacttaggacaaattcaacattccatagccttcacatctggctcctctttatatcagtgtttgattagatacctttccaaggcaattgtctaaaaaacaagaacccataaataccattcacagaaacaggcatcataggaaattattgagatgaggaatcaaatgggattttccctcccaaatcacagggagctagcagtataccagtttctgaaagaaaaggtaagggcata

SEQ ID NO: 8620 - DNA, 1551 bp, artificial
  synthetic oligonucleotide
agctgccactcttccctacacccttccctaagcccagcctcctcaaagagcaacatcaaagtaactctgacgtcccaagccagagaccttgcagtaattataatgtatccctgtcacccactccagctcttttgttgccaaatcttttctcttctaaaccttccccaccggattatttcttagatcatttgttacaacttcctccctgctgaagttcccaggttggagatggaaactaacataaaatgcttatagacaaagtttgtttttcactcacagatttcattaatgccatttcctttcctgagagtctacaatagctacttacttactacattaaggatcaggcctaagtcgcattcaaaacatcctgattcaaaccaccttaaactaccaccttgtatctcttttctcctcccactaccctacctaccactcttgcttttctcaggcattttagtttcatgctctgtttgtccagtcatcccatctcctttacagacttgtctctcactgatttgaagacatttttcaaatcccattttcctcttgcccaaacatggaatctaaattctctctacttcattctatgcctgtataaattaatactgtcgttccttggtatttgtgggggattggctccaagacctccatggataccaaagtcctcgaatgctcaagtccctgatataatatgaagtagtatttgtatataacctacacacatccttatttatactttaagtcatctctagattactatttataatacctaacacaatgtaaatgctatgcaaatagttgttatattgtatttttttatttgtattatttcttattgttgtattattttttgcagtggtttttccatatgctttttatccacggatatggagagctgactgtatatcactcaatgcacacactcattacacatgattttaacgtgttaagttctaaaagaaaatggcccatatcctctcccattttgctctgtctagaacctggcaccgtatctaaagcatatatgtggcctttagatgttgtgtgtgtgtgtgtgttttaactgaggccaatgagaaagaagacggggaagaagacagaagaaaaagaagaggctgtaaaagagcacagttacaaagcccagtcagaatattattacaaaaagttggccttgagttctgttcaaatttaggatacaagttctcattttacttaaattcatttttttattcctcatcttttgacacagttgaattccataagtgtaaggaattcctctaatcccagaatgatcaaaagcatagatgattgtccacagctcgattatttccattatatgaatgcagacatttggcattttcatctcaattttcaatgattctatgcataaaaaagaaaaaatgccaaaaagcacatctgccatgaaatcacaagaaataccatattacctttcagattctttggggatctaaattccaatcaagaaaagtcaggtaaggcaaagccatccattgctcccactcagcataaggatactatgcattagtg

SEQ ID NO: 8621 - DNA, 1796 bp, artificial
  synthetic oligonucleotide
ttgtggttgaccttttcatatttcctgttcctccaaactacttctctttttgagagtttcttcttaccagggcatgtcaatctagggtaactgttaaactaacatgatcaacaagatatgaagaacccagaaacctgctagaaactatggcatgacagatggaaaataggttatcctctttgttgtctaggcatttacaaaatacttggcatgataaaaactgtgctttgtaaacaattaagaaagtgtaagacagaattcttttcaggattcaggagaacaagaattcttcatatgctctcagagaccaagaacttctgtccctcaaaaaccaacagtgatggttttctcagaatcagcctatcagttatatcaactcaaaaatctgcaaagccctgatttcccaaagatattagtcttactgttaaaatcaagttcagctgcatatgaaaggaaatcctaaaatgatgtaacttaaacaaagtagaagtagataatctaggttgtccagtcaactgacccatgtacctatctttctgttcttctatcctcagtatgtagttttcatcctcaaggtcacctcatggtcaaggataactctagttctagccatcgtgtctacattctagattggcttcagaaagaagctggacaccacaaaagcacaccccctaacttttagggagacttccacttacacgtcataagcctgaacttagtcatatggccaaacatagcttcaaaggagactggtagcattctttgttctgggtgcattatcacttcaaatgaaatcaagattctgtcactgaggaagaaggcgagaagacatgctggaggaggtaattggcaatcttggcaacatctagtaacttgtcacaggatctaggatccctactattaaaaagttaatgccttttgtattaagttgctgtccctcaaattctcgttaaatgtaaatatattactcggaaagtgataaaacattaacaaattaaggcccattctcatacgatcacaaaccaatcgatgagatgaacattttctctgaagaatgagagcataaataaagagaactaaaaaccctacttgaaaaataaataaaggataggttaaaggaaagcatctagaggactctgtaaaatcaagacactacaggtcaaaaggctaagggtggggagggagccaaaaccaattttgcttacatcacaattttgctgcagacagaccccacacttctgggttgatataatggtacggagttgctacagtctgcagataatacccaaagatattatatcacaaggcaaacaattccatttattatcttttgcaagatttttgtttttcatttttaccaaccaagagggaaaagtggtactaggagatgtagggctggttggaaaaaggaaagaaaaaaatctttctaataactatagctcttgctctcgaatcaaaatagagcaccattttgaaaaaaagtatgacaggtttttcttttcaaaaatcctcgttagtttttggagtaagacctttgtaaaatgaatattattcatcaaagggattttgatttgacagacttaaattgactagagaaagttcaagttctacattatggggaatcaaaatgtctctagcagaacagagtaagtttcatgacacatcatacactaagcagatgtgagaatcttaggccagtaaaaacaagttctattttactgtcacccagggaaatttcccttttcttttgagtagacaataatccacacttatttttctaaatcttgattttttgc

SEQ ID NO: 8622 - DNA, 4826 bp, artificial
  synthetic oligonucleotide
gacttgccaaagagctcacaaccagtaattggtaaagaaggaactccaacctagccagtctggctctagagtctgtgatcttaaccatggcttccatttgtgggaagaaaaatttgtacagatacacatgtatatggcaatgtgtggaaggaatcataaggcactttaatcagtgatcctctctgggcagtgggagtgagggtgggcagcaaagcaagactttcacttattactttatacttctttgaattctgaattttttatacattttctaataactcatgtattcattttgtagataagaaacttctacttttaaatcaaaacattggttatctttgatttgttacattatacacctttaatttccctgaacatttttacattttccatgttctttgggatatgtgtgtcttcgggccaagttctcaaataattaccatgacatgttttctgctacattttgtcttgccagtgtcagagtcccaagatggggctgaggccaagaagggttgggtaggaggctacggaaaacttcatgaaagaagggcctgtattgctcgctctgcttgggcaagactgtgattgggctggattcaaggctgtcctgagctgcagtgtgcagctctgaactccctggatcccctggggcactctaaggggggctggctgcttcagaaattgcttctattctgtaggggaatagattatctgcatgcatgtgcacatgtgcgaacaaacccatttaatgaaagcaggagtttggacttgtgcctgaagagtaggagtgattctgccctgatgtgtgagtgtgtagcatgggtgtttttgttcttgtttgtttcacttaatatttaaagatactcaaatgggactatgttatgaaagcaactaagtgttgtggagtgtctttactaacataggaaataatagtttgtaaactttaggaagcattagactgttgagatgcttaaaagaaaatggaaagagttgatgtttagactgcgattaactctctttgtaatcattcccttggttcgatgatgttgtggagctgaggaataataacaaggttggttggtttgtttttaatatgtacttactgtatactaacaccctacaaagggcatattgtgagagaataggatattctttttttattattatactttaagttctagggtacatgtgcacaatgtgcaggtttgttacatatgtatacatgtgccatgttggtgtgctgcacccgttaactcgtcgtttacattaggtatatctcctaatgctctccctcccccttccccacaccccacaacaggccccggtgtgtgatgttccccaccctgtgtccaagtgttctcattgttcaattcccacctatgagtgagaacatgagggtttggttttctgtccttgtgatagtttgctgggaatgatggtttccagcttcatccatgtccctaaaaggacatgaacgcatccttttttatggctgcatattattccatggtgtatttgtgccacattttctgaatccagtccatcattgttggacatttgagttggttccaagtctttgctattgtttatagtgccgcaataaacatacatgtgcatgtgtctttatagcagcatgatttataatcctttgggtatacacccagtaatgggatggctgggtcaaacggtatttccagttctagatccttgaggaatcgccatactgtcttccacaatggttgaactagtttacagtcccaccaacagtgtaaaagcgttcctgagaataggatattatttcatgaaggttttctctttgaagatttcatattcaataaggactgattaaaagatatttggacaggtcgggcgcagtggttcacacctgtaatcccagcactttgggaggctgaggtggtcaggagtaagagaccagcctgaccaacatggtgaaacccccgtcgctactaaaaatacaataaattagctgggcgtggtggcatgcgcctgtaatcccagctactcaggaggctgaggcaggcagaattgcttgaacccgggaggcggaggttgcagtgagccaacatcgcactactgcactccagcctgggcgacagagagagactctgtcacacacacatgcgcgcacacacacacacacacacacacaaagaaaaaaaaagaaactgaaggggggaaatagtcttttcaaatggcctatcttctcttatatgccactttttttttttcagacggtgttttgctcttgttgcccagcctagaggtgcaatggcgtgatctcggctcaccacaacctctgactcccgggttcaagcaattctcctgcctcagcctcccaagtagctgggattacaggcacgcaccaccacgctccgcttattttgtatttttagtagagacggggtttctccatgttggtcaggctactctcgaactcccgacctcagatgatctgcctgccttggcctctcaaagtgctgggattacaggcgtgagccaccgcacctgcccttatctgccactttcctgctgaggaagtacatggcctttctggacaggaaaatgtgtccagaatctcttacgctgtaccctaggttgccctgtgtacataatgtagctactttacctttctagttatgattctgagtaattgtctaccctgctatatatgctgtatatagccattggtgaattgtctatatccaggcaagtgccacgtcagtttgatttgctttgtggacattgctaataggtttgtgttttcccagaaaaaaagtggtgagaaactggctggaagaaacaagagccttaccaactcaccacttcattttttttaatgaaaattttgaggatatggtaatgagaacaccatcagatgaagcatgacaatcccaaagaactgatgtgcacttgataaatgcttgtggttagaacagctgacccattttccccagtttccataagccatgtcatccctgattaaagagccaggtaggtcaatgtcaaataagtacttactcttccatttgctagatgttataggaggaatatttaaaaatttttaagtgttcagaatgctactaaacttttaggtattggagaggggtaggaatataagcaagctgctatgaccaacacacaactaaagtgcatgtcccaagaataaaaggttaggcctgatgatcatgtactttaattcctcaaggtaaggtcggcataatctaagagcaaaaaaccaaatacaagcccttggggtcagccacacttgaaaaggaggaggaaattcaaacaacaaagtaaactagaaagagcagtaaaagggaagaaaatcaggatgttacacagtcaaaacaaaaaaagaaaaatatttttagtggtaccaaatgcaacaaagacttcaagaaagagaagcagcaaaaagcgatttgaccaggaggaagttagctgtggtttccgaggttaagtggtttctgactgggcaggtggtttctattatataaatggtggcttacatagaatgagatgttgagatcatcttatttcacacagaacattaaaggaccattataattagactcactcattcattcatttattccattagcatttactgtgttcttacaagtgcctgatgctactaagctccatggggtcagggtacctaatagaaaaaccataattaaatcataatggcttctctctcacaagcaatccgggtgaagttttaaagcgatgacttaaaaatgaaagtcttatttccctatagctgtttcagtttatatattcatttctgacacattagccttttgttttcctttttaaattagtaaggtttggtttgccgcatcacaaagtttcaacctagaaaagtagcaaacttaaaaaaaaatcaaatctcaaattatcttatatatgctgtgaggaaaagtagaaatggcattaatatcttaggttaatttttttccctgcaaacacaaacaaaaaccctcacagaatagtccaaaggaaccaaagtttactgtttcatgagaaaatgcatatattgctttgtgtctcttttttattttattttattttatttttttgagacggagtcttgctctgtcacccaggcgggagtgcagtggcgcgatctcggctcactgcaaactccgcctcccgggttcacgccattctcctgcctcagcctcctgagtagctgggactacaggcgcccgccaccatacctggctaatttttttgtatttttagtagagacggggtttcaccgtattagccaggatggtctcgatctcctgacctcgtgatccacctgcctcagcctcccaaagtgctgggattacaggtgtgagccaccgcgcccggctctgtgtctcatattttaacaggtttgtttgggtgcatcaccaacttggattctgacaggaggttgaaaacatcaagtctcaaagattcttttgtgagctctgaggaaaaccagaaatggtatttataccttgtattaggtatttatttccacaaaagtttgatgcttacaacataaacccaacaacccacctggaataggccatggaaatctaacaagcttttcacacttaagatatacctagagatttctgcttctcaaaatgtcaccttgcagtgagcaacctggtgcctggaaataaggcaacccacatcaattttgggacatcaaaaatgaattattttaaacatagatatatagtgaagtaaaatgtaaaattctccagatttctataaaacaaaacttaaaagctcaaaacccccagcctgtgccactaagg

SEQ ID NO: 8623 - DNA, 1214 bp, artificial
  synthetic oligonucleotide
gggagggagtggccaggaaaagtacaacctgaggccccagcctcccaggtaaagtctttgtgaccttataatcaataggtctgcaactgtagtgctaaatgacttcccgtaatttgaagatggtgtctccagatggcagtagtgtgtctcagtcacatgctcaaaacgaatgctgggaaccacagcatgttgctgctttaggaaagatgggacactggctcagacccagacactgacttagggaaaatcattcacagggttgaatattttacacatgaaatttcatttggttctcacaacagccctatggaacggtttattatcccccattttaccaaccaggaaactaagctcagggaagttttagattcagagagtcacagagaatttaaactcagatctgtctgactctaaagccatgcttaattcatctctttcatcaaaaattaactcattgttctaaaaaagaagaccagaaaaaaaagaacaaccaaatcattattttagagcaaattggcatgtcatttgctatcattttcactcatcttgcactttctatcattcccttatcccaactcctagcttggagtcagctggggctgctgctttccttgcagcttgcctcatccctgagcaagctagtcacactgcctgggttatctgaagataatagaagacaacagagaaggccctttcaaaactctcgtcagcactttattttctgcatacaccttaaaaagagatagacagatgaatagctacagaaagcggagacaatgggcctgagttcaaacctccgcttctcccccttccagctcttggactctggacaaacacctattatgtgccagtcactgtgctatgtattttataaatgttatttcatttaaataaattgcacacttgctatgtagtgatatggaaagatctctaaatacactgttaagtttaccaaacaagcaatggagggaagagtgggcataatatgctactctatgtattaaaaaggaaggaaaaataagaagctataccaacatttgctttataggcacaaagaaactattaaaagtagttatttgggaggggactaagtcggggtgggcatgggagcaggggttgggggaagacattttactttgtaactttttatacttttgaggttttgagtcatgcggatatattatctattcaacaaggtcagtgtttacttcaaa

SEQ ID NO: 8624 - DNA, 5331 bp, artificial
  synthetic oligonucleotide
ctcgctgtagaacactgagaatcaaatccttttcctcctcagacagaaaagaaaggtccagtaactccgacatgatttactcaactttttcttctactcttctttcttcaaaacaaccagacaaggagagctaccagagttgcctgaaatgacaaaagaactaatttcacacagatgatttactcaagaataggcccacagccctaaaccctttcaataggttcctttccccttgagccaagctaaagagacaaagtagaagtatctgacctatttagtcttcctactcccatccgaaacatgccctgaaaatgaagagtccttgatttttcagaaagaaaaagttattcgtgactctgggaaaaggattggttattcagtatatgcatcttagtctggaaagaacatagaacagctgagtcaatctccccctccaccaagtgagtcctcaatcatccaatttttaatactttaaatgttctcaaatctcaagcctattaacccaaataaccaggcagctggtctctgcagtgaaggagaaaagcacatgaaggctcctgccagtttaagcccagttgtctattcctaaccagcttccattctcccaggagtcagtcagctttctgctatacttcaaaacttccaccccctactctatctctcaaagttcttatcatactagcactctagcactacctccaggatatctttcccaaattcatgaacacttgttgagcactacgctgacaggcattgtgtaaagtgctggggatacaaagatgagtaaggcacagttcctacccttatgaaaatcacagagtagcaggggagacagacacacataaatacagtacaacgcattaagtgctatcagagggattataagggactataaattaagtgctatgagaacttagggaagaaagcaactcattctatcttgcatagagagaggaaagagagcagtatacatgggaaatttcacagaagaggtggattttgccttatcagaggacaaatttcctggtagggaagaatggtaggaaagatagtttgggaccagattacataactcttaaaaacttttttaaaattttaagaattttggctcagcatggaggctctcacctgtaatcccagcactttgggaggctgaggcaggaggatctcttgagcctaggagttcaagaccagcctgggcaacacagggcgactcagtctctacaaaaagaaaaatcaaaacttagctagccatgatggtacacggctgcattcccagctactcgggaggctgaagtgggaggattgtttgagcctgtgaggttgaggctacagtgagctgagatcacgccatcacatgtggcccactctagcctgggcaacaaagcaagatcctgtctggaaaaaattttttttaattttaaaatttactgcatagacaatagaaatccaccaaacatctctgatgttgctttttgatgctgggaaatcacatgatgaaattcactttacaaagacatattatagctatatcgctctagttataatatgaaagactgatttagaggacaaatcagaggacaatttggtagtacatacatttaaaataggcatatacttaaccaagcaatatgacttctaagaatttacctaatagaaatattcatacaaatgcacaagcaagagtatatgcacaagactattactgcaacattatttgtaagaacagaaacagttatttaacataggaatcattaaacaaaataatatgtccccataatggaacattatgtcgccattaaaaatgtggtagatacacacgtactgacataaaaatatggccatgagtgaaaaagtagttgtaggacaataaaaaatgatcttttataaagaatttatctaaatatttgtatatgcaaagagaaaggtctagaacaaaagccactatcattggtttcccttggggagtagaattgggaaggggcaactttcactttttacttcacatagttctaatttgtttttacatatatcttccatttatatctcaaaaaagaaaacaatacaaatgaggcagagatattattacaatactgcagcaaaagacaatctagatttactaactgtgcctctaaacaattagaccagtcattttatttttcatttcattttatttttcatttttagagacagagtttcactatgttgcccagcctggactcaaattcctgggctcaagtgatcttcctgcctcagcctcccaagtagctggaactatagacagagccaccgtgcccagcagaagtcattttatttctgactctttggtttctcatctacaaaacgacccacctcaaacgttgtttaaaaaattaaataatgtgtgttaaagggccaatcacaatgtttggagtacaaatacttgctgaatcttctaaaatgataaaggcctgagccaggcagcaagaaaaaacagaataggtttgagaagtagaattgacagaatagggagactgactgagcagagaggatgaagaaggtgaagtcaaagatgcctagttcacagtcaagattaaacaactgactggctagtgacagccctcatagcaatagaagatgtaaggaaagaaacaggtttggaagtaaggcaaaaagttttgttttaaccctattaagttagtgttgcatacttgatatccaggtaactgggcccaggaaatagttggagacacagggctggacctcaggaagaaaaaatgtatctgataatatacacttggtagtcatgggagtcaaagagcccaaggtagacagagagtgaaaaaggaaatgagaatcacacttaccttctctcctctcctttgaaactagacaacacgcctctttcactttattttttctttttctttttttactagttccctacaaaacagtggagaacataaacaacacggcaaagctatacaggttcctgaaacctcaatatttcctcaacttgtatatttcctggtctttattgaactataagatgttaagcctcttgcacacaccctttcttagacagtcttgaggaagtgttcttagttcttatccccaaggagaatatataccctccatgaaaacaaggactttttcaatcttctcctctgtatctgccctagcacttaatgcaatatctggtatgcaattttgcatatgctgccaatattgcaatcactgtcattgtcaccccaacagtatcttttattgagaattgactatacgccaaacaagtacctaacatatattaactaatttaatccttgccacaataccaagaatgagtgactattattacccccattgtatagattaggattcaggagaggttaggctaacttgcccaagaataaagagcaagtaagtgaaattgcagggattcaagcccaggcaatctgacaccagagttggtgctctacaggctcagtctaggcagaattataaccaaagcaactataaagtactaaacagacaaatcaaaagcattgtggaaatgaattcccatatgtgtgattacggctgaaacactgcgcaaaaaaatcagtggctcctggataaaagaggtattatcagttacctgtcagctaaaaagcaaggatagcacaggcacactagaaatgagaaccataccagatttaaaaactggtgcttgtggagaggcagcagaatattgtgatgagaaaggcacgttggcataataatgagaccaagtaatatcaaaatccagggaagtaagaagatccttgaggaaataaagatagtatcttaagaaaatggaactaccaatattgtacatctgccctttctttttcatttatggacctgaccaaccagaactgccccctctgaaatcttaaattcaagaattcccactttccaaccacagctcactcctgctctatctgttcttcaactttatcaagaccacagtctcttgagccccacattgtctcttggtccacttgccttctgctgatctatcttccccccatacccatcctggactccagatggctcaacatttgaaccactctcaccagtaccttccatatccatataccttcatccctctgccacaactgcccatgaaaatcccaaacctgtgctaatgctctagcctgccttgtctgctcctatacccaggttctacataattcctggtctacaacctcagctgaaccctcattgtcacccataaattctgttacttatgcttgttcaattcctttacctagtccctttgggttctattcaagccttcattcatctcacactcccacttcccttccctccagtcccatcagacatgcttgtctcatacttgtaaaaaggtttttgtaagaccatcagacatggactctatcagctccctgcctcctcttccccatcacttgccaatctgactcctttcagaaaagccatatcccaccccaagccccaccttccaccataggttgctgttgtttccaacactaaccctgttaacagccagcttgtttgcaatgggatcttgcagaatcagtaatgaggagcagaaaacaaattaagaacaaaaattaaaaggcaagaagacaaaggtaagtgcagaaaaaactgagacaaagagaaaacaaaaggtaaaatggtaaaaacaagttcaagtatatcaatgaatatgaaactcatatatgagcaaaattcaccctttgaaatacaggaattaacagactggataaaaggaaaaaatccagttatgtgccatttatgagagacacatctaaaacataaattgaagggaaaattgaaagtaaaaagataggaaaagatataccaggtaaatgctagccaaaagaaagctgaggtagctatattaatatctaaaagtaaaaaagacaataaaagctttataaaggttagataagatcactacatagagataataaatatgcacccactaataaaacatcactaaatatacaaaggaacaaaagagagaaattgaaaaatcaaccatcaaaatgagaggttaacatatacttctttgttgttgcaattatgaatggtacaagcagatacaaactagtaaatatatagacaagttgaacaacaaaatgagcttgatttaataggaatacaaaaaaaatctatatccaactggagaattacattattttcaagcacatatagaatatttactcccaaaactgaccatgtactaggctgtaatgcaagtctgcataatttttttaaaaaatccttcccatacagaccagtctctgacttcgaggaaattaaattaaataagaaatcaat

SEQ ID NO: 8625 - DNA, 1289 bp, artificial
  synthetic oligonucleotide
aagagatattctcatattttgttggcaaatgtaaattagtaaggcctgttaaaaagcaatgtgacaatctgatttctaagaaaactgaacttcacagaacttatcacaattgtaattaaaaaattatgtgatacaatatttaatatacacttcccctgccgaaataagttccaggagaaaaatggccattgtctaccttcttctcagccatacctcaagcatctagctgggttgatggatggatagatggataaatctacattgtaggatcctgactgtaggctctcagttggtgcaacgtaaatcctcagtaaatcaacacagagcatggcacaacataggccctcagtaaatcaaatcacgctttctgatgagtttaaagacactgatactaatggtattctgatgcctgaatcgatagagctacaaacaagaagcagtgtagatgccatggaaattttctacttcttaaaaattactcaaggtcaagttaggtttagatagtcacagatatgaatatgaaagccacagtggtccatcatttcaactattcttctgccagggccatccaatctccagccctctccctatttctgtcacggccacccggaaaaaattccccatactagattgtccacactctgttcctggtctgatgagtgctgccagacagaatggatacagggttctgcgacttgaggcagagacaaattcaagttacccaagccattttaaaacttttttccagttttatggaggtatacttgacaaaaattgtgtctatttatggtgtacagcatgatattttgaaatacacatacataacctggatgatatgcccctaaagaactcctcttttcgtctctctcaaatgctattccaacccttcaccattcttgccttctttactctctggtgaacctttcactctcttgttgggggcggaggggctctctcaaaatcctgtccctccacaggtacttccttctccatagtttttaccaagaggattggtgaatcctcttgtttcaatggaagagccaccactttttctctaaggctagtcttttctcctctttcactctggcactcccaccctctgactttctcggggaccttgcatcatcaagctgtatgccatctgcacataaatgggctcatctatctcttatatttaaagtaaaacaaaattaaataaaacagcctttttatcccctgtgccttactgtctataaggaacactctctccttcccatcatagccaagcttcttcaatgtatatactacat

SEQ ID NO: 8626 - DNA, 2250 bp, artificial
  synthetic oligonucleotide
gcaaggagaaaaacatatacttgggcttggaagacaattttttaatcacttagtcctcatccatgagctattcagtgttcccaacatctaagacaacagaggtggtgtgacaggataggaacacaagctctgcctccgagattttgagggcaaggcacttaacttctcagtctctttttcatcataatatggttataactgtagcacctactgtatagagttattgtgaggattgcatttttatgtaaagaacttatcacagtgtccagctcaatggagcctaacaaccagagcctaacaagctcagagagccagaatgctacatatactcacagatcaattaccccagaacaggcctccagctccatttcactgctctgaccaagagtgagacacctgaaattgtgttaccagaaatgttcatcctctgcccaaaaagggcctcacaagccaagttggtggtgcttttctactagggtgctaaaaaccaaacaaccaaaaacgcagaaaacttcatcaaggccacgtctctgcattaaacattgttcccacagcgacaaaagtcttaagtcattaatacctcaatattaatagatttatgagaggtgggggtggggagcttaaagagcagaaaataagccagttaaatataggaggtccaggatgtacagaagactcatttttgccacaaatatacaaggtctagggtcaaccctgccaagcacagtactctggaattttacgtcctctaatcctgaagaagcagggtactgggggaagaaaagcttgattagaaagtcaccacttttcaagccaccagaattctaaccaaatgatttcaccaccccaaatcccacctcattcaatgttaagggttggaggaacacctttttctgccccattacaaaccaacacaggagacagaagcattctgtgccccttctgagatctcggggaccctcctccagtaccagatctctcacagcctgcttgaagagcggcaatataaagcagctccacagcacacagccaggtccccagccccaagcgcagagggagcccactgaggcaggactccagccaaccagcctccagcctttacctgtggctgactggccaacgccagagaagccgcgatgtcgtaggtccgaagagagtgcgggttagcgaccccgctcgacggccgagcgctgtgagaggaacccacgaaaaggtgactggacgccttggagggcgcagttcccgctaggagctcggccccgcccccgcccccagggccagctctcgggaggggcaccagctcgggctggcgggaaaagcccgggcactccccgcgaggggagccgaagaggagaggggaggcggctcccagaggggcacagaccgcattagtgctgggtgggtcagggaaggggccagaagaagccctggagaaagaaaagtggccgggagggaccgcccaagcagacgggagtccaagcctggggatgcggtcgggagaggcggacggggagaggggagacgcggtcagctagggagaaggaaaaattgggggaccagagagcgggtagggaagacgcacgaccccgagatgggggtgggggcgcttcagcagcgaaaaggagctgggggtccagaaggagcaccggaccgagggcgaggggccggccgctggctgttgacctacctgtcacttgcaacaggtgcctccagagatcgagaagtcccagtgccggtttcaagggagggtctccggctccgggaagatcgcaacccagctccggcagccggcccttctcaccctcccgggaggcggaaaaagctgcaactttccctggagcggggaggagctggactcttaaaggggccgcacagcgccccgggctccttagcagggggccactcagcccaaaagggagctctgggacccaaagccttgagacacaagaggaatgtccttccaggttaggaatgggagcctggggactgaggataggggtctaacactagacgtgcctcctcacccacttacttccatctgttggtcactctcttagacggtgaaatcacctgtctctttcgttcagctgagtcaaaagttgtcaaattgtctcacacttctaagaagataaaagagtatgaactatctaatttgagtaaataaaatataataccattctgatcctttgacttgtggccttttatggcaaataaatgtctgtctaaaatagaaacgttttgggcaaaagc

SEQ ID NO: 8627 - DNA, 210 bp, artificial
  synthetic oligonucleotide
gttgaactttactggcttctactcaggagccccacctggtgtctatctgtagtactgcagcctcgctggtggtttaataagacatagcactggagcgccgcctagtgtctatctgtgataatgcactctggtgcacatttaactctctttttctcagcagcccccaacctggcaccccattcttatcagtacttagctttagcaagacag

SEQ ID NO: 8628 - DNA, 889 bp, artificial
  synthetic oligonucleotide
gactcaggccagaagaaaagtgatatacgggattataccttttttgttttgaggttgtggtctgcacactggaatttgtaccagatggatttcaagatagaagcaaagggggtgaccccaattcctgctccaaccagcacagccacttcatactggaaaacatcctcactggctgtgccaaagggaccatccacttcaatcctggcagaagacagaagataacgggcaactgaagactcccctccacctccaacctcaaacatcctcccagaaatatagttgttctcatggctgacttctgcatatttattataatcctattctattgtaccaaacttaagattcaacgaagaattgctttctcttttctgccagtctgcatcctggtctgggactctcctggtctcaaggacctacctgggaattggtgaatattgttgttcgaaagcccttatgagattttctgtccagtcccctgctgctcggatatgaatggagaagaaatcttcctctggagcagaggtcaaagtaaaaggatgccattccaggagagagattgaggggcaattaacaaagatatactgccccacttccatgctgaagccacgcttgttcatctgcaattccaaaactttggatgggtgcataacaacctgtgaatgaagcacatagaccaaagaaagcaaactctaatgacgacagggacaggcagataaagcaaatgagtgaagctggagggctggtgacagtggtgaactacaaacacaagtcctctctaaagagggcagcagctacttagctccagacagtggttgcgatatggaaccatgacagtgttatcaggtttcctgattcttcaagagaagcaagaaatagcttttaaaaaatc

SEQ ID NO: 8629 - DNA, 2825 bp, artificial
  synthetic oligonucleotide
tctagtacaatgctgcacaaaggtagaagtagtgatccccttgcctaattcccaatctcaaaggggattcttccatttcacccttaagtagaatgttttgtataggttttgtagatatactgctacatatttttattttactttactttaggcacaaaagcaaatatttatttaaaacagaaaagaaagcacagcacaattaacagatttattgaggtataatttatatgccatgaaatgttcccattataaggagtatagcgcaatgcacagcacattttatatttattgtaaaaagctgaaaaatctcttcaacatcacaaaacccataaaaacaacattttcattagctgctgaacacacctgcaatttagtatcataatgccaggtgaaattggcacagtgggtggtaggagttttcctggaagccatttctacactaaggcagctatcaatcagttaactagatatagaagtgtcagtgaaccacataatatatattctcctaaatccaaactaaatataccaccaacacaacaacctcttatctgtattccagaaatgctcatggccactccagcatcacttgacctgaggggaagtgtgacagagggaagttggagtggtaagagacagtcaatcactagcaatgaaaatattttacatttgtaaattttacaaaaacacttgcccgtgcccaagaccacacattaaaagagaaactaaagcctgtccatggaagggtgaccaagatgatgtaatgagttgaaagcatcctatattaggaggatttaaagagtgtagggaatttggcctggaaagaggtttatcggggacatgagtttatctacattttttttaagaagatttagattgttttgtatgtgacccaaggagtcaaccaaggaatagaggctctaaagtaacacactttaggttgggcatggtggctcacgcctataatcccagcactttgggaggctgaggcgggcagatcacctggggtcaggagtttgagacaagcctggctggccaacatggcaaacccccatctctaccaaaaatacaaaaattagcctggcatggtggtgcatgcctgtagtcccagctactcgggaggctgaggcacttgaatcgcttgaatccaggaggcgagggttgtggtgagccaaggtcacgccactgcactccagactgggcgaaagaataagattctgtgtcaaaaaataaaaataaaaataaataaagtaacacaattttttttcaatataaagcagaattttccaacacgggtattcagagaagtaaagaggtaatgagtttcctattacttgagactctcaaggaaaaatggacaaccccttgtcagctttttataaggggaatatcagcaccaggtagatggttaactaaatgtcccttaaatatactccaacattgagatcctgtgattcataaaagaatgatctataatctggatgacaatttatgtattatctaaagaattatatatgccatgctgattggacccttatgtctgtgaggtaggacccccattcccaatatcagagtactaggaagtcttttgataagctggtgatcacagaatctgagctaagatagtcagatgatcttaacggaatattactattaagctgcagcagcaaactcacttggcccttttcaaggtaagattacaccagcaaattcaactaaaatatccatgccccaaatctgaaacctccctctcttgggcaatgccggacacactaaaaacttctcaccatcaagacatttatgtggccaacaaacatacgaaaaaaagctcatcatcactggtcattagagaaatgcaaatcaaaaccacaatgagatgccatctcacgccagttacaatggtgatcattaaaaagtctggaaacaacagatgctggcgaggatgtggagaaataggaatgcttttacactgttggtgggagtgtaaattagttcaaccattgtgaaagacagtgcggtgattcctcaaggatctagaaccagaaataccatttgacccagcaatcccattactgggtatatacccaaaggattagaaatcattctactataaagacacatgcacgtgtgtgtttactgcagcactatttacaatagcaaagacttggaaccaacccaaatgcccattaataatagactggataaagaaaatgtggcacatatataccatggaatagtatgcagtcataaaaaagaatgagttcatgtcctttgcagggacatggatgaagctggaaaccatcatcctcagcaaactaacacaggaacagaaaaccaaacactgcatgttctcactcataagtgggagttgaacaatgagaacacatgggcacagggaggggaacatcacacactggggcctgttggggggtggcaggcaaggggagggagagcatgaggacaaatacctaatgcatgcagggcttaaaaactagattatgggttgataggtgcagcaaaccaccatggcacatgtatacctatgtaacaaacctgcacgttcagcacatgtatcccagaacttaaagtaaaataaaaataagttaaaataaataaacaaaacttctcaccatcaacctcccttttttgtaaattctcccagaattgctttccttctgttggctctagacattataatagtcccctccaccctgtattgcttcacctgtcttaatgtttgcatttcccaggtttatggattatgcggcattgactaaatttgaggttgcttcctggagatctctagggagtacttaaatgtcatcagt

SEQ ID NO: 8630 - DNA, 464 bp, artificial
  synthetic oligonucleotide
ccttgcatggcaaaggggaatgaaggtggaattaaggttgctaatcagctgaccccaaagcagggagattattatggattctatgggtggcctaatgtaatcacaaggatccttaaaaatggaagagggacacagaagtcagagtgatgagatatgagaacatgacccactcttactgactttgaagatagagaaaggaagccaggagccaaggaatgtgggctggaacttctcccccagagcctccagaaaggaatgcagccctgtcagcaccttgattttaacccagtgagacccaatgcagaattatgacaaccagaaccataagataataagtgtgtgttgctttaagccaccaagtttatagtaatttgttatagcagcaataggaaagtaatacagatggtaaagaaaagactttcctgcaaccatatttactggctctgaactgactactctgcctg

SEQ ID NO: 8631 - DNA, 1100 bp, artificial
  synthetic oligonucleotide
ttcagcaactctaagatgagcctaatgagaagaagcctgttctagaagaggagtgggaatcaggctgaggataactgttctactttaatattaaaatgagttcacttttctctcacatgtatgagagttaattttttttttttttttgagatgaagttttgctcttgttgcccagcctggagtgcaatagcgcaatctccactcactgcaacctccacctcctgggttcaagtgattctcctgcctgagcctcctgagtagctaggactacaggcgcccaccaccgtgcccagctaattttttgtatttttagtagagatggggtttcaccatgttggccaggctggtctggaacttctgacctcaggtgatccacctgccttggcctcccaaagtgctgggattataggcgcgagccaccgcacccggcctgagagctaattttattaacttaggctaggaattataatctttcgctagaattactagtagctgatgataccttagccctactttctaccacaccccccaaaataatggcagaaggaatgagaaaggaagtgctttaaagaaataaaaacctttgcaaaggactgcaaaccagtgctcagaacacctgggtaagtctagaagagtagcaagcagaaagacaagctatctggcctatgtattacccaactactgtagttacgttttatctgcaacctggtgtgcacttttactcatcacaccaaacaccaggcttagagaccaaaaatccaacgtgattctcatccttggctacacaacagtcatctggagagcttttaaaataatgatgatagggctacacccaaaatgaattaaatcagaatgtgaagtgatgacactcaggaacttgtttttgacggtctccaggtgatgtgcaaccaaggctgagaatagttgctctgaaccagtggttcctaaatttgaatgcacaccagaatcacctgaaagacatgttaaattagattgccctagccccagtgtttctgattcagttgagggagagcccaaatgtgtgcatttctaacaagtttccaggtgatgccaaagctgctggtccagggatcacactt

SEQ ID NO: 8632 - DNA, 1623 bp, artificial
  synthetic oligonucleotide
gggatgagaggtcaaatgaaaccaaggaagataacaataaagggaaagcaggaatgttctctggatgaggacaaataaggtttgcttggagggtatggcatatgtgaaagtctgtggctaagaagatcaagacagtccatagaaggggagttccaatcttgccataaagcaggagtcaacaaactacttatgtcaagagccaaagagtaaataatttagggctttgcaggccatatggtccctgttgcaactactcaactctgccatcatagtgcaaaagcagccatagacaatacataaacaagtgagcttggctgtgttccaataaaactttatttacaaaatcaggcagcaagacagaattggcctaaaagctgtagtctgctaacccctgccataaattaaattccactcttctgaggccacattagaaaggtttccaatgttacatgggcaaattgtgtggggatggcagggagaaaggtttccaaagtttggaacctttctaaggaggtaatagtggagtggttgatacaatggagtctctatcagatagacctgagcgtgaatctcagctctggccctttctagatgtgtgtcctgggcaaattactaaatctctctgggcctcaaggtcttcatctataaaatgatagtatctacccctccaggttattataaacagtaaaatgtgacaatgatgcatgataataatttagcatagggcctggtccctagcaagtacccagtaaatatcagctgatgttattagcattaaggggccttaatagataaggaatagggaggtgggggcttacagagggtataataggatggagaagacaagagagcctctcagatttgggtacagccgttgtcacactgactccattgagcatttggatgtaagactctagtctttgtaaaattttcttctgagctgcaaatttcacctgcaaaagaatataagctatgaaacgaaatactggctgggcacggtggctcacgcctgtaatcccagcactttgggaggccgaggtgcgtggatcacctgaggttaggagttcgagaccagcctgaccaacatgaagaaatcctgtctctattgaaaatacaaaaattagaggggcgtggttgtgcatgcctgtaatcccagctactcgggaggctgaggcaggagattcgcttgaacccaggaggtggaggttgtggtgagccgagatcacaccattgcactactccagcctggccaacaagagcgaaactccgtctcaaaaaaaaaaaaaaaaaaaaaaagaaatgaaatacttttgtagcttcaccgcaaagaatggtaaacaaacaggacaaaagaagagtgtcccacagattcttggctcatggtctcaacagatgaggaacccagaatgaaggaacaaaaacagacctaaaaaggtaatgaggaaaggtcaagaatgagctcttgtgcaagctcatcattttatctgacctttcagactgaacactcaaggtatatgtcagttctgcccagcagagctttccacaatggaaatgttctgtttgccctgtgttctacgtatacagtggccactagctatatgtggttactgagcacttgaaatg

SEQ ID NO: 8633 - DNA, 1150 bp, artificial
  synthetic oligonucleotide
ggagccatgttctaatcccagctctacttctcactagctatgcggttttaggtaagatattaatacttaagtgctatgaatctcagtgtcaccatctatacaaataggactgagaacacctatctttcacagttttggtgagaattaaaagcattcaaatatatgacatgttcaggactgtgcttaagacagccagtgctcaacatgtgtcactgctctttcttaggctctgattcaaagcatatcacttggtttcttcatgcctcaacatctccaacctgcaaaactgacaagatgtaacaatgcatgcaagtgctgtgaggatgagtacagtttgtgggaaatttaaaaaacaacatacacacacatagacacataaattttctgaccctctacatgagtgcctgctggagtgtagtgaggttatggcctgtgctggactacctgttaatactctcaaaagtgtgtggcagccgggtgcagtggcttacaactgtaactcccagcactttgggagaccaaggcaggaggattgcttaaggccaagagtttgagaccagtctgggcaacatagcgagatccggtctctacaaaaagttttaaaaattagccaggtgtggtggcacacacctgtagtcctagctacttaggaggctgagacagaaggatcacaagtccagcagttgaaggctgcagtgagctatgattgtgccattgcattccagcccgggagggagaccctgtctccaaaaaaaaaaaaaaaaaaaaaaaaagccaggcggggtggctcaggcctgtaatctcagcactttgggaggccaaggagggtggatcacttgaggttaggagttcgagaccagcctggccaacacggtgaaaccctgtctaccaaaaatatacaaaattagctgggtgtggtggcgcacgcctataatcccagctactcagcaggctgaggcaggagaattgcttgaacccgggcagaggttaaagtgaaccgagatcataccactgcactccagcctgggcaagagactccttctcaaaaaaaaaaaaaaaagtgtgtggcctgtgagaatgtacgtattcgatatggaggatggcaaaagccagagaaaggaaatgaatgaagaggcaagagacataaaga

SEQ ID NO: 8634 - DNA, 1725 bp, artificial
  synthetic oligonucleotide
tattggttattgttatagaaaattggaggagggagaaatcatatctaactgacaatggatcaggaaaggctttatagaggaggtgacattaaagaaaaggtttaatgctaatgaagagtgatggtggggggcggggtcaaaagatagggagttaaaggtagaggaggtggtaaggcgtaggttgtgtgaggccgtgagtagatagatgagtggtggcgtgtggcagtgggagccattgaaaactaaatctccaaagagagacaggggtcaaaatgtggagggccttgaattccaaatttaaaactggagttaaccactggctatgagagtcattaaagatttctgagcaagagaaagaggaagccttctttggcagcattgaaggctgacaaatttgcagttttatccttgagtgttacgaacttcagaaacaactctctgagggctaatattttgatttaggaaaaggaaagggggacacaaaggaagagatggaaaaagggagtgaataactgaaggatgataagtgggagggggagatgaaaagtgagcccggtgggaaggtggcagcaaagcctgtcttccctaattcctcattcctggggtcacttggtgactgaactcatacataacctcccttctccccatttaagatttgaagtttccgtctttcctttagggcttcatttaacttcgagactgtccttttggcctgtgagcacacgtagggcattaggacccagcgtttgttgtagtgagagtggttgaatctcgatctctcaatttttctctcgagctccctcctctccctttgtcattctagctgcctgctgcctccgcagcgtccccccagctctccctgtgctaactgcctgcaccttggacagagcgggtgcgcaaatcagaaggattagttgggacctgccttggcgaccccatggcatcccccagaaccgtaactattgtggccctctcagtggccctgggactcttctttgttttcatggggactatcaagctgacccccaggctcagcaaggatgcctacagtgagatggtaagtgaagcaaacgggtgatgaggagcgcactcccatgggattgcgaggacctctccccttttttccttctcagtttctggtcccacccccttagcccctatccccacctggaccctccgttctcaacaactttgcagctcggaaggagcagctgggcaagagcgatttcttttgtgggctatgctgttctggagccactgaatgccagttgggggaggggttgcgcagcgaataccccccatcccaagtaaaccagaaggctgagacctgcgtagcacctgtcattggcaggagcccttccctccttccagcacacacccaaagtccgggcaaccagtatacaagtctgattccctccctgtgagctaagagtttagcaagcggagagtttatttattttagagcagaacaaaagggaaagaggaaaagagctgggaaaaatgggctactaaaacaagcaatttttaggggctgactggtattcctcatcccaggcagacagctgatagtattcctccagccacctgggtatgtatctggatccttgagacaaagcattcttggcccaaataaaggtcactaagctcttgtttcttccccttctctcaagggagagctagatgttttgttttattttgttttgtgtgtggggtaatctacaaaat

SEQ ID NO: 8635 - DNA, 1305 bp, artificial
  synthetic oligonucleotide
taatgtgagatttttagatccaagagtgaataatagtaaaagaacaatcgagacactaaaatgtagtttaatttagcttgtctcctttccaggaaatgctgtaaacacacggatattgaagtgcatgatcccagcaacagtaatatcagaagattctgtggttaaggcagtctcctggctttgtgttggcaagtgttctggtagcaccaaggtaatctttttaaacactttgatgataagtccttcagaaccacttaagggctggcaaggaagagccacttatgaagtaatggcattggccttttgtgcaaagcctgtagttttggaacaatatatcttgatgcaaggactatgttcaaacagaaatttttactgagaaataaaatctattattctactttgtgcctgaagcttctaaaatagccctggtggcgggggacggggggcggaattaaactcttctgtaccagttatatttctttaaagataagtattttgtctcttcaataggtacttttttatcgttggctggttgcaatgtttgacttcattgatcgtaaggagcaaattaacttgctctatggcttcttttttgcttcattgcaagatgatgcactggtaagtaaaaattggacagcattaggcatcaatcaaatagtacatgtgtgtatattgatgcaccatatatgcttcagtgtgctacacaatatgtttttccttattttaaaaatatatcaaacatatagaaatgtaccaagataacgtagacatatcaaatatacagaaaagggcaaataataacattctattttgcacctgtctctcagattaacaaatagaaaatttttatcgtatttactttatgtcttcttttaaggaaataaaaatgttacagataaagttgattccacgttggagtcttgtttgctgatctggagcactcattgccatcttttcccttttaaaccacttcaacagagtcctttgagtcatttactctacattttcttgattaacactgcaaaagcctcatcagaattaatgagaaggagaggattacttttcatgagtgccaatggagtgattttgattaaatagcataattatttctcttaaaaacattaataactttaagaaatcaatctactgtccacctggaagactttcaaggaccatcagtagttcacagaccatgtgaatcactcatctaactgtattgctcttgcctttgggaagggaattcatttattgattttattttttaaaaatgatgtttccagtgtgttcattgcattgtcctagcca

SEQ ID NO: 8636 - DNA, 2104 bp, artificial
  synthetic oligonucleotide
tgctacaaaaaaaatgataagttggtgggatgatgaatatgttaattggctgggctgaatttttctgcatagtatacatagatcaaaacatcacgctggagcccataaatatatacaattattatttgtcaattaaaaataaataataaaaatacttcataaaaaaatcacataataattttaaaatggaactgaaaaaaaacagtaattctgggtcctttagacactttgtaaacactagtcctagatcctatgtaaatactagtcctagatcctatgtaaatactagtcctaggaagtattttctttctttctttctttctttttttcttttttttgagacagagtcttgctctgttacccaggttgggtgcagtggtgcgatcttggctcactgcaacctccacctcccaggttcaagtgattctcctgcctcagcctcctgagtagatgggattacaggcgcacaccaccacgcccagctaatttttgtatttttttggtagagacgggggttttaccatgttggtcaggcttgtctcgaactcctgaccttgtgatccgcctgcctcggcctcccaaagtgtgggattatataggcgtgagccaccacgcccgaccctaggaagtattttctaagttccagtgccatcagagcttataaaatttttagaggcaaatcagtgaacttaagcaacccactcccaaccagtctttgtctctctccatatacaccctgttcccagagatggagggaggaaagaagaaagctgcttttatcctttgctgtggcctgggactgctggggctttaaatctttgtatgtttgtgtaggagggtgaggatggggactttctgactgctattcatccacctattcattcaatttactcattcaacatatatttattaagtaacctactgtgtgctgggcacttggtaaagggatataatcttatctatcctgccagtggcttctcccaggtctctgagggtgtttggagctcataccctcttctctttaacaagcgtgacagttaaaagagtaagggctggtatggacaaaagcaggaaggtgcctggggtagtagtcattgaggtgagtcatggaggagctgtattttcctgaattattcaagatccattttgtttccccaatttgttgaggctttttctacacgtgagatctaagagggtgtgaggatgagacttaggggtgactggcagactgtcctgagcccaaaactgtaccttgagtaccagtgatgattccagaccacagtgtttcaaccctcaacacagaagcagaatcctggactggctaccgaggggcccctgccagctgctggctccaaagttggttttgtctgtgggctagatcggtgtaagttggggtccaggctgctcgctcagcagcctgattgatctccagggctcttttgtctcctcctccccagtggaagcctctccccctcttcccctctccccctctccccctctctccctcttccccctctccttgtctccttctctccccctctgcttctcaggctcttccgctttcctcctctgcttctaatgaattgacatctccaagagccgccacatctctggtagttttacaaaactgtccttgctcttcctgcgtttgcccagtcaagggtatttttgcctgaggtcggaatgatgctgttagtcctggtgatatgattgcatagcaacacagagcagctctgagaggggaggaggaggagaagaaggaagacagggaagtgggagagacagagggagagtgtgcatacagcagctgtcggcatccctgtctcagggacttctttgctgattcacagaggcagcccagccccggcctcccagcttacagctgccgcctgcttctcagacctgacggaatcagaaggtaggccacagaaaaattatttccaagccttggccttgttcagctggctgaggggaaatgactgagggaggggaagctccagaggtactgtgtggcgggcgaggggtggggggagagagggaaaatgagtgtgtgtgtgcgtgtgtgtgtgtgtgtgtgtgtgtgtgtacgcgtgcctgcctgcgg

SEQ ID NO: 8637 - DNA, 2209 bp, artificial
  synthetic oligonucleotide
tgctttatgtacttttataggtatatttctcattttgaaaagggcagaaatagtagaaatcccaaagacatggggagaatttttactgctcagttcccttctccaatggtaacaggctcttttgtatacttccaaagatatttttttgcatctataagcacatatttttagtatacaaatgtagactaaccaccaccttgatttttctcttgttttctttttacttaaggtatatcataagagatcattttgtattggcatataaagagttcttaattattttttaagtagctgtatagaattccattgtatggatacaccattatttaattagtcccctagtgatagacgtttaagtttttgcaattttttttgccatttcaagccttgtttcaaatgctgacattgtacttattattgtacttgtttcaaatgctaacattgtacattattccacacaaatttaagtagcatatgttcctatacatctccagtttatgggtgcctagcactgtgttaaaaatatgtgggatataaataaatatcaggtgtgggttttgtcccccatgagccaacaatcttgctttcatgctgaaatcctaatatctcccctgtgtttttaaagctttttatctctgctcaagagaaacaatgccttcccactgaatcctcctcaaacagcctgtgtatggcttttagaaccaggaagagtatttgtagtagcaaaaagccacagtttggtatccagcagggtccctaggggagggcagggaaggcttattgccacccaaaaagcatcctccacacctgcatatgtcaaaatcttctctttcaccttagctcgaaagcttcttttccataaatacatcccaaatccctccaactagaagtgaacacttcctcctctgtgacctcttataccataatttctgtgtcttgctgtctcagtccattttctgttgcttataacagaatacctgaaactgagtaatttataagaaaaggaatttatttcttacagttatggaagctgagaagtccaagtttgaggggctgcatctggtgagagtcttcttgctgtcataaactctctgaagcatcccaagatggcacggagtatcacatggctagagggcttagtgtgctagttcagatatctcttcctctttttataaagccatgaattctcctcccgtgataacttattaattcattaatccatgagtggattaatccattcatgagggcaaagccctcatcacctcttaaaggctccagctctcaatactgtcacattggggacagatattcaaaccacagcacccacgtatggtatgaataattttccccgctaaaattatccttttttttgtttgtttatatgtcttgtttcctacatttgaccagttggggaccaagtctgattcatcttcaatctctcatagcctttgcaaattaaaaagaggaataggaaaaaaatcagtatgtgcagatggtgatttgagataggatggagctagatagaggcagaagaatctttgtgtataacaaagagtactcgcccaggaatcaggaggccctggttcacttgtgtctcagcatcttcatctgtaaagtgggatcttaattctgactgggacaactttactaggttgtactgaggatcatgaaagacagcacagccgactacaaaggcatgctatatgaatacagagaatgatagtgtttggtgcttagcaacccttaaacattaacacttgatacattagcaaactaaggcctagagaggcaatatgacttgaggtcacagtcaggggcaaagtctaaaaagagcagaggatagtcattttaggaccagaagaaatctattccttttctgcctgtgttaggattagaaggtctgaattctctgactccttggtttatcttagttttgttttgtgaagccttaacctagcatcaggtcagtagaggaataagaaagaatcttataatctggagagaaatgaatctcaaaagagaagaaaagagatagttgatgaaagaagagatacaaacgaccactaaaagtgtggaggaaaagctaaatatctttagcaattaaggaaacgcaaagtaatcctcaaaatgccattttcacttacaaagttggcaaataaagtaagaatacatactgtggacaagtgtgctgggaaactggcactctcat

SEQ ID NO: 8638 - DNA, 1276 bp, artificial
  synthetic oligonucleotide
tataaggacaaaaaatgagtggaggaataatacctgttctaactacctcacagtgtggtcataggaattcaaatcagatgtggaaatgctttctaaacttaaaaatgccgaggtataaatgaaggggatgattgctcccttctcctcttcctctcatagctgtcctatatcttggtaggtctcatctgttcacttccccatccttttacgttctatccataagttttcagcccacctatttctccccaaactaagggtagctctgtaagagcctgaagtcaatttttttctcagttgatcggctttccctagctgtctgtgcatgcctgccactttttttctccaccctctatcatcaaagtccaagcttctggcttctgatgggctttgttaggggtgaggcattgtggataagttgaaagaatgcaggctttggagtcaggtaaacctgagttcaaatcatcgctctatcaatgacttaactgtgtgacctttgggaacctacttaccctttctgggcaataggaatgcctacttaataaggtttttgtaagaattagttgaagcaataatttaggtaaagatcttggcctaggtggtggtgaggggggggcaatgaataaagatagttattattgtcagccaaggggaatggcttgatggctgcacatatccttggccagcctccagcttcctaccatggttcatttggagggcagcggggtaggagggcagacagagataattatacagtacagatttttctgtttccatatctcagacctctagccaatgttcctttgggtcccaaggactgttatattcgtatgcatccttgcacatgtgcatgcctatactcaaccacccaacttgccctttccacttactgaatcctctcctgctcagagggcagttcggaacagcctctatggttgagcagtttggcatgacttgaattctaccagggcaagaggggaaccagacagctgtcacctctaatgcccttgttcagtttcctacccttcccagcctgatgtttggcatgcaactgaagtaactgagatccacaaagtgacattttaagccattgaagtttgggatgcctccacacccatggttctacctactggttttagtactgtgctctatgtggaggtgccttgggaccctctttgggtgggtaagagggaggactccaggcctcctcccacttgaaccagaaaagctcctcctgaatttgttttctatattaaagttccatataacttagtttgga

SEQ ID NO: 8639 - DNA, 2463 bp, artificial
  synthetic oligonucleotide
gggctgctgagggcctgtggcaactgcagtgggccaggcatggtagaaaagatgtagatcttgttatgtaggatttgcgttgtaggtggactgaagcagcaggtcaagagttgaattctcactaaggggtcactgacattttgtggtcctgtgtttaccttaatgcctaaggtgagtgtattgttcaagggtccagggacagtcactgcagtatgtgtggggaattttcccacagtaaggtaaatggatccttgggtactatgaatccaacttggggttggatttaccaaaatgtgttgtatgttgttagacatcttgttgtgtattagtcttctaaggatattgtgcatggcactgtgtagtttatagccctacactggaaggatggtgaagggagttgctagattgatagcctaaagaaaaccttctgactgtgggattagcatcaatgataaggaatgtgagcatttgctggggttgttgtcaaatagtatcagagaacagttaggactgagaggtgatttcttcttgacagaatttgatagaggccaaaaagccattacgaggatacctctgcttccagtgacagcagagtggattcacattgattgggcattgtcacggaaggctgactagctggaggacatcaggctgtgctatgcttccctagggaggacatgtgcccttccctccagattagaaaggctagaatcaagagtttcaagtgctcattttcttcaaggtccaaggttgggaactatttccctacagagaaatctgtttgagtttctggtgctccaggaaatgggttggcaggacacagaaatgagaaaccctgaggccaggaagaggccaatcctaggagatgttttccctccagattcattttaaggaatatctgtgcttcctgatgtgtgtgcttgagatttgggctctatatccagcatttgaactcacattctcagtggcagagtcatggtctgtggcaccatttcaaggccaaaaatcccatccaatttcccttcacatagatgacagaaaagcaagaaagtagctgccttaactcgaacagttctgggaaaaaaactgggggccttgtcctgaggctgtggagacttaattcttcagctgggtggttcccgtaggaacaaggaacactttagctacttcttactcttttaacaccaatggctgtgggagaaggaaaggctcaaggccagggctcagctcgcagagtccatcttctcccacagttgccacatttgagagggggcctgctgaatgcccttgctgtcccctatggcagtattgaggcctgaccgaagtctggtatgctgcttgctggctacaagaactggtcacaggatgaaaattggggaaaggatttgggggaggtgacaagggtggcatggaagtctaggggacaaagggacagggttgggaacaaattggttaactttgattgccactcactgtggtgctttccccctttcccttgaattctgctttgaaaagaataaatttgtacttgtttactttggttcctctggttatactctctgagtctgatatttcatatctttcccttatttgggggtgggaagagagggtagaccaagaagccacagaagtactgtaaaacataaggctaccagatgagtccaacacctgtgggacacaaaaagacctccccattgggctcatctgccactgttacccggattaatcacctctcaacatcctcccagccctccccaaattagctagttagcgccttatgagatgagctgtatgtagcaatcgtttctaaatttcatcctcctcaatctgagggtttttcaccagcctgaagcattgtaagaaaagtcaggacaatgcattgagttttcataaaattatattaagtttaaaggtctaccttttattctgagattacggatacacacacacacagacacacacacacacactatatatatatatatatatatagtgtgtgtgtgtatatatccgtaatatatatatagtatgtgtatgtatatatatatatccatctatatatatatatcctgtgtgtgtatatatatcctgtcaataagtaaaaccctgtcagtccctctttttctttttcttttcttttcttttctttttatattaaggatatatatatatatccgtaatatatatatagcatgtgtatgtctgtatatatataatccatctatatatatatatccatctatatatatatatatatatctcctgtgtgtatatatatatcctgtcaataagtaaaaccctgtcagtccgtcttttcttttctttttttttttttttgagacggagtctcactctgtcacccaggctacagtgcagttgtgcaatctcagcttactgcaacctctgcctcctggattcaagcaattctcctgcctcagcctctcaccaaactatagcaacact

SEQ ID NO: 8640 - DNA, 2882 bp, artificial
  synthetic oligonucleotide
accctttcattcattactaccctttattgtgtgcattctgtatgcccagtactacattgagtgcattaggtctatcatttcatataatcctcacaatcaccacttacttcgaatgcccccaaaagctatttaaaagaactcctaagatggatctttttatttaaaatatatatatatacctttggtgaagtgaatactttcttccaagttaatctttttttgacaaattataatcatatataattatggggtacacaatgatgttatgatatagtgtgaaatgactgaatcaatctaatgagcacatccatcaccttaaatacttatcagttattccccctaactgcaactttcattttttttaattttaaaagccaaatttggaagtgggagattgtataccaactttagtggcattaatgttaataagttgtgataatatcccactactattggaccagcctaactgaaattttctgttctttgatcaacatctcctcaatgcccctcccgctactccagcctgtaataaccaacactactctctgcttctatgagttcaattattttagattccacatataagtgagaatatgtgatttttgtctttttctgcctggcttatttcacttaatataatatcctccagattcatccacgttgttgcaaatgacagaatttccttctttttaaaggctgaatagtattcagctgggtacacataccacatatttatccattcacttgttggatacctagattgatttcataacttagctattgtaatgctgcagtgaacatgtgtgtgcggatatttctttgacacactgatctcaagtttttaggatatacatctagacgtgggattgctggatcccaagtttttattttattattttttattgttttcattatttgtttttcaattttatgttcttacaatgaaccaagactttatttctaatcttattttccatgtatttgggatgtatttgtagagccctgcattttgggtattagggcccacacttttgttttgttttgttttgagacagagttttgctcttgttgaccccaggctggagtgcaatggcacgcatctcagctcactgcaacctctgctgcccgggttcaagtgattctcccatctcagcctcctgagtagctggcattacaggtacctgccaccacacccggctaaattttttttttgtatatttagtagagacagggtttcaccatgttggccaggctggtctcgagctcctgacctcaggtgatccacccgccttggcctcccaaagtgttgggattgtgggcatgagccactgtgcccagccaggcccacacttctgaggaagatttttctcaaaggtggaaagacagctgggcgctgtggctcacacctgtaatctcagcactttgggaggctgaggcaggtggatcacctgaggtcaggagttccagaccagcctggccaacatagtgaaaccccatctctactaaagatacaaaaattagctgtatctttacagctagttgggaggctgaggcaggagaattgcttgaacccaggagatggaggctgcaatgagccgagatggcgccactgcactccagcttgggtgacagagtgagactccttctcaaaaacaaaacaaaacaaaacaaaacaaaaaaagtcagcagtagaaaagcagacacccaggatgggagagggaaagatgcattatttgtgattgtaatttcttctcttcttgtttcatacagatatatatgtatatatatgcatatataaatacaaaagagaaatgtaaatgcaagaagagagttgatcgaaataaataaaaaatctgggggctgagcacattccctaacagaacatagtaacaattaaggctgggagcaggaacagattatttgaagaactagctgctaagcaagattttatcagatcagtagtaacttttagatttctcagcagaactaaaactggggcattttgttcatttccaagcctttttggtaattcctcttttatggaagaaagaatgtaagaactgaaactatttcaatgtatttgtttgataaacagacctaataaaaagtctggtgggagaaaagttagacaatcctggttgaactgggttttaattattttttaaatttacttgcatttacctaaaagactagttgtacggtattcactttaagaaaaagcatccacttttttccagcaagcactctttgatgcctgattaaattaacaggaccccttactaccattcacctctagttccatctcgctttagcagaattacaattggaattataattggctggagggcgcctggcagcatgctccaggccatgcaagtcagtacacgcctaaatgggtgttttttcaagttcgcagtctccggctgcagtttaagagactgacctccatccttatccccggggcactaagctttcaaagagaaagtttgacccctaggctttgatccactttcccttgaaaacttctcgcgaggcccaacaggtcgcaacgggtcccagccttcgcgcctcgctgtgcaggctggctggggagggctgcggggtgcaccgcggcggggtgcacactggcggggcgctgacccggtcccggccgcccggtcggccgcccgactcacccgctcctccgggaactggcgccgacaccgaaaaggctgggacctgcgtctctggtctgtgggttccggacgaaccgcgcgtgggctcccgcgcggaacgtagaggcgaacgctgggctgccggcgcctggacagtaaaagcggcgcgcgccggcccctccccgcctcgccacgcctccgcggccgcgctgcccagcggactggagc

SEQ ID NO: 8641 - DNA, 2100 bp, artificial
  synthetic oligonucleotide
tctacaccaacaaagccgaggtccggaatgacagtccccagagaagcggagtcacccttctcccatccggctaggccacaggaacctgagaaaatcaagggttgctgccaggtgcccgccccccaccccgaatccccgacgttgtcgcgagtcccgcggtacaaggacagagggaaagtaggtacagtgttcaggtcccagccccaggctcctcacccaacaaagttcagtcatctggtgcaccagctgctggaagcgctgcttttgagtctctacctcgatgaaatgctgcaactgcgggtccactgcacccaaacccgccgcggaggaagaggaggaggaatccatcccagggcgaccaagcttgcagagacgaactccgcaccgaccttcacgtgtctccgcgacggaaccggaaccacagctagctgcctctgggaccgcccccgtgagtgcactgcgtcggcgcgaggcaggcgtccaactccaccccgccgcctcccacaccttggcgccggtgcttcgttcccggagtcggcgggttccactccccggaccccgcaatcccgtaaccccgcaaccctgccgttgcgcccagccttgcgccttgagatcgcagggcttacagcccagagccgaggtgccgttgagatgttactccaaaaagaaaagaaaggagaaaaggaagttacttcagaccacgtgatccattccgtgctggccccacagctccgcccctgtccacttccaaattagcccgcgttttctgagctaccagagttgtgcactgggtcagttagttgactgggtcgattagttggctatcctgggcccctggctttcgttttttgatggagttttcctctcccgacgtagggaaatgaggctatggcagtttgtgcccaactttcagattcattcaaataacattgcatgcgtgctgtgacaggcactgtttttgcttaatgcatctttgattcagaggcaggagttaacaagagggcttaaacctggaggatcctgtcgagttctcagtgtaggaatatgccaaactaatgctacacagcagctttctggaatactgagatagggcgcttcagggaggctgcatgattaatagagataccaaagactttcaagctttctagtaattttattttatcaaaacaccctcccctcccatctttatgacaccatttcattcttgccaaattcggtccacccccacacacacacccccaagctctaccaaatgcctactcaaagagctgttggacccctttgtgcggctatttacatcctccctcctaaaaaatattttcatcgcaaattcagtctgtcttaattctctcgggaaatttcaggcacaataatttcttggcctttgctcagaagccactatcccagggaatcaaagaagaggtgcattcccagatgtagagaggggcctttttgtattgagtgggagcacaaaggctccagggctcctaagcttgggatttcctctgagaaagtgaaattggggcttgtggagaagagaagtagaaccaagaagcttattggcgagctcaggattcttcatccatgacatctagaatattgctcagaagaattttgaaagtgggacgctcatctgctttctaaaaccaaagaaaaagtaaagtgttagagtggctagaatccagaattcaagggaaatgcaatgagtaagcagcaaatgtttattaaatatatgctctatgcccagtagcatgccctgtcgattacaaaaggaaaaaaaaaaaaaaaagaaatagcagctctccataaagtctttgtgcacttttcatctttagtaactcaggttattagtgtgataagaacaatttgcaaattaaactgacaatcacactgatcaaaattgagggcaagttcattatgtaactgtatacaacacattcttattttggatcctcaagtgaaaaatggctaccaaacaagttcaagtggttggcagaacagaaatcccatgtgataatttttagtgattaatatttcaaaaccacaggctgtattactgagcagggattctgagtacctgggaccttttttttttttttt

SEQ ID NO: 8642 - DNA, 1406 bp, artificial
  synthetic oligonucleotide
cattaagaaacctccctacattctcaaataatgtctgcctcttaagaggtcccttgaagatgacaccccttcttttgttggctaatccaaagctggtatttccagctacttaggacaggattgcaaaagcagggtgtacaagtgggagggctgggggagactgcttgcttcaccaatgcacattcccctattgggaagcactaatggttagtacatattctccaagcacttgatgggctggtcttttctatccatatttatgaggttaatgtctaaaattctgtttcaggcatacatgaatcattcctttccatactgtttgtaggagatttgccaatgctattctcttattcattttggtgaggtcaggtcatttgcctacttttgaatttgcaattaggataggttctattgagcttgaccaaagattcaagaataagtataggcaaatatttgtggtgctggaacatagaagggcccactgccatatttaaggaaatggaaagagagagtctgtggctaagcccacaggaatacaacctttgcatggcaagcaccattgagaaaatgtggcagctggatatgaggtatctgaggctatgcttttaaaattgaggtataggcctggtgcagtggctcacgccttgggaggctgaggtgggcagatcacttgaggtcaggcatttgagaccagcctggctaacatggtgaaatcccgtctctaccaaaaatacaaaaattagctgggcgtggtggtgagcgcctgtaatcccagctacttgggaggctgaggcaggagaatcgcttgaacgcaggaggcagagtttgcagtgagccgagattgtgccactgcactccagcctgcacgatagagcaagactctctctctcaaaataaaaaaaaataaataaataaaattgaggtataatttacatataataaagtgcacagatttaatgtgtacagcaaaccatatttttccacacccatttaacctccttgagatccagcacctcatgcctcttcagtcaatatccctgcaaaggtaaccagtattctcatgaggtccccttttcatgtcaatgatttcttattggtgcattttacccaagagtaggataataaaaacataaaaacaaacaagaaaaaaacaaaaagagtggaataatatcattattttgtggctcctaggctaactcactattgacattggcagcacctgggactgtcctgggattgttaggacttgcacctaaatctcccagcaatcatggtatttgtcagaaggtgcctactttttggctcttgttgttagcccaggacggttcaacaagactatacccaggtggaactactgggaaaaaaaatgcctttggtgaaacataagggaagagaaggcaaagatg

SEQ ID NO: 8643 - DNA, 1965 bp, artificial
  synthetic oligonucleotide
tagctattataattaccaggccacaacagcaatattttataatgttaaaggaacgcgggctctagagtcagtctacttgggtttgtatcctagattcactaaataccgttgacattgggcaaatcgtttaacatcctacagcctcaatttcttaatctgtaaaatgagaataatagtaccacctgtctcctagaattattgtgagaattgtatgacacaatctatttaaaatgtttagcaccctgaagtctttctatgctggactctcttgagacctagtatatgccttctgccaggtttgcaaggaagggaagagccgctaggtactttctacttctaggcttgatgattgctattacaggagccaaacaatttcattgtcacttttcagaacctagagctgctgacttactccctcaacagaagggtgctgctttaatgccaatcattgttccttttcttcaaagtacttagttcataattgcacatttataagcctattagattactgtacctctcccccggaacagtgcctgccacataatgggcatccaataaccatttgttgaatggaccaactggccatgtgatagatgaactggaacaattggctccctccaggtcttcattgaattagcagtttgctgcgaaaggtgttcccagtgaccttgaggtggaacaggaatggaacgtggaggtggaggaccccttcattcgaccctagtcctggcttccctcggggacggggaggccagaggatctgggaaaaacactgctcccttcactgaacgccactacgtagcagagtccaccaaaagagataaagtgacgaaacgttgaaagctgcggggcgggaggaagtcggggtgagtggaccaccctttaggcggagtccttccttaagctcccgcccgcggctccgaactgagtcctctcagccgcccgagggcgctgcgctgagccttacactctatgattgctcctaccgactcccatgaggaagtgcgatcgggaacctcctatatacttccgtttgcctcgcggtttctttctttccgcgccgatagcgctcacgcaagcatggtaggacttgctggtgggggccgagtaacatccagcttaatctttcccccccttcgtcgcccgtgctatgccgggatgggtccaggctcctgtgtggactcgatatatcagagcaacccaatcttgccgggatcaaccctaaagggaccgggctacggggccaggaattgaagtgatgggttcaaagaggtagagttagccgggggtggagttaatgaggtctcttccctctttggggctcgacggagggaggaagctctgcttgaagcacatggggctggcccaccctgtagtcagaggtagcaagtaatgaggagtcctcctggagtgcctcagctttagctgggtaaggtagggcgttgtgccattgtggtcaaataacattgcacgttctgaactgtttctttactaggttaacgtccctaaaacccgccggactttctgtaagaagtgtggcaagcaccaaccccataaagtgacacagtacaagaagggcaaggattctctgtacgcccagggtaagatggattccgcataatttggtgttaatgtgacatttgtgttgtagaataacatacgagtccgggtctctctccctccacgcctggcttgagcgttaatatttctgctgcgaaattaagataaaacctgtaagacttacttgctgatcttcagtattttataacaaataccaattcgttttcccaggaaagcggcgttatgacaggaagcagagtggctatggtgggcaaactaagccgattttccggaaaaaggtgagtggtagttactatttgacgtttcccagttaattgccgtaaggatatgcacttgtctctagtccacacacttcatgatataggtatagcgttagtttagcga

SEQ ID NO: 8644 - DNA, 384 bp, artificial
  synthetic oligonucleotide
tttcatttcttgcttatatttccagatgctatctataatagctatgtagctataatagctataatagctctatgcagtttatatcaaagtcttctctttatgtgagaaagaaagcagggtaggccaggactaacatttggtgaagtccttttatgtgtcagacattctttgttgattttctcattatgttctctcttagagtcacgtaaaaggtaaaataaggagggcaagaaaacacaattttttaaaaaaggaaatggcatagggattttctatttttttctcagccccagaaggtaattactcttacaatgcagaagtatcaccagatactatctgcacaggttttcccattttttcctcacaccactgtggtaaagcagg

SEQ ID NO: 8645 - DNA, 3481 bp, artificial
  synthetic oligonucleotide
aagagagaaataagtgattactcaaagaagaaacataaaaggccacagccaagggccgggagtgggtagggggatgcagaccctcccctgtaactgaagatgggtaaactccaaccacaaggcgatgatgccacttgtgggccctcagattggagaggacggagatgagtgacaacgcgtgcgcactggggcaccgagcacagaccagagaacggggatgtctgtgcgtgcggagtggaggaggggggagttcctggtgactggccgccggcccttggtgggtggtagggggtgctggggaggagggcgagctcggcggtgacgcgcggtcctcacgtgacccggagctgcagagctacgcagccttcgttgcagtcgtcactcgcatctggctaccagctccccgctgccctgcgctcggcgggctggcatcgggcccggggaaagcggagcaggtaagggccctggggcccgcgcgccctggccaggccggcagaagctcactgaccccggcagcggttacggggcttgagggggcggtggtctatgctgcctcaagttcgaggagcctttgcctctgattctccctagcccccttgcccccgcctacatctgtgcaggcgaaccgtgggctttgatttgtggggagattgtctctgccagagggaaatacagagattgagatgcccatcgctctaatcactggccacacatgtccgctcgcttcctgctcaatttagtggaagggatgcgccacggtggcgtttgcagagaaaatggtgggccttagagactggacggtggggttggtaagggtggtgtctcagactgtggggagggacgtttgataaccaggttcctgaacccggaaaggcgagtattgggatctatgtcctgggctctagaccaacactaagtggttttactctctcctgtctgtcggacagtagttcggtgtagcactgtttgcggcgaggagaaaggaaggagaggagaaaactgcactggatcaaggaggttagtgtgagtacagacactatctaaaccattggagttccatatgaattctatgacaggaacttaggtgcggctgtctgaatgggatgtggggtggggctagcttggggactttccctaaactgcattttacttaccaagcttaggacttttaaattgtatgttgaagaccaatgaagacagcaaacttttctacagatgcttttatttgcatttcagataatattgagaaaaagataaattatattaaagaatattattattattattattttttagatagcctttggtggggaaggatagtgattttgtagaagcaaaaggcttcccctatagcttttctcttctgctggagactcctagagataggttgaaagggacgtggacagcagtaggttgtggttctagagtatgggatctggggtctcccatctctcctgccatccttcagttttccagatccctctacctacctgaccatcttggtgaaggaaatggtgggcttttggggaaatccctagaaccctacaggtggttttaaaataatttgccttgttgggcctagtagctcttgcctgtaatcccagcactttgagagacccaagcaagaggattgcttgagctcaggtgttcaagaccagcctgggcaacatagcgagacttcatctctacatataatttaaaaattagctgggtatggtggcacagtctgtagttcctgctacttgggaggctgaggtgggaggatcttttgagcctgggaggtcgagactgtggtgagccatgatcttgccactgcaatccagcctgggtgacagagtggggctctgtctcaaaataaataaaaaataaaataaataaaataaaataaaataaaataaaataacgtgcctctgtctgttgccttttacttttcctgcctcccttttccatccttcccatttcagtgctggggaagccccaggcttttttttttttttttttctgccagcaaatgggtctctaaatccaggcaggcaggtacagggacctatgtcttagatggtaagtgtcacaagtacttaacatccactctcttctttttctccatctgttccaaggtcttcccataggcctgcagtagggctgtttaccattggaagcaagggaaagaggaggagatcaatctagaagcatggaggttggtgtgaagtgggggtagtctctggggatgacaagagagggtgggcataggaggtgggtgagatttaagagggtctcagtggagtgctggattgccacagtgctgccatgcctcctgtggatttcagtgcaggaaatgataggaatatgggggtaagggtgggctggagtatgactgggggaagacttgatggggggaccatgagatggtacacattagtatatagaacctgggctctggcgaggcagacattggggtcagggatcaggttgcttgtctgttctaccagggactcggtttccattacctactgtttgtttacttgtccatagatctgcctgcatgtctgctgcagggcttaagatcactggaagcaaagaaacaaagaggagattgctcctgatcagtatagactggtaagagtgtggggactgcctgggtagacctctagagtgggttggtggagaccagtgtgcatccagtaaggaccagtgaccagtctggaggatgaggatcctcagtctctccttttccagccacctttcccaccatccctgtcatttactccataccctcaccttaattctggtacagggaaaagagtgtgacagtgtcttagggagtggggtggactgagaaacgtagaaaggtagtttgctaataatatgtctgtcccatcaagaacaaactctctactcccatctgtccctccatctgtctgtctgtctctaggtccagagatctcatgaatttatgtatctactttagggtgtactgccaagagaagcaagaggagaggagggaactgcctcggatcattacaggttggtatgagggtggggccctgtagacaggtgaccagagtaggtccagtagaaatcaaagtctgggacttcttggttgctcccatttatcgtcagacctcctaccatcctttccactgttcatttggtgtatagaaatgtgtatagaagtatcttggaagaaaattattgggcattggggaaggtggagagaagatgaaataagaggaatggagaggctgctaatcatcctctcttccaccaagcacatggttctaccattttctgttcctctgtgtatctatctgtatgatgcaacaaaatcagaagagaaattttagtccatttccttcctccacttctaggtccacctccagaggcagctgtagtggcctttgagtggctgaagaccagcaccctcacaggcctacacccacaactaccactctctttaccccagcccgagtgcgctctacca

SEQ ID NO: 8646 - DNA, 1778 bp, artificial
  synthetic oligonucleotide
gtcttgggctctcgctgggaatcaggccattggagagctttgggctgcgggtcaggccagtgatgggtcctggcctgggggacaggccagtggggtgtcctgggttggggaagaggccattggagggtcctggactggggctgagaaccaagccagtgaagggtcttgggctggagctggggctgggaatatgagtagtgtttcatactgggctggggttgtggatcaggccggtggagggtcctgggctgggactagtgatcaatctggtggtgggtccaagcctagatttgaggatcaagccagtggagaagggtcctgggctggggctggtggccaggctagtggagggtcaatgttggggcctgaggaccagtccagtggaaggtcttgggctgacactgcagaccaagccagtggagggtctaggctgggccacgtagatcagtccagtggtggggcctgggctgggacacttgatcagtctggtggtgggtccaagcctagatttgaaaatcagaccacagaagaagggtcttgggctggggctggtggccaggctggtggagggtccaaggtggggcctgaagaccagtccagtggaaggtcatgggctaactctggggaccaaatcagtggaggattcttagttgggattgtggaccaggccaatggagggtcctggactggggctgggcatccagctagtgttgggccaaagcctatatttgaggatcaggtcagtggcagagggtcctgggctgatgccagggagcaggttgttggagattctaggctggggcttagggaccagtctagtggagattcctgggctgacactggggaccaggccagtggatggttctgtgtttgccctgggagtcagacgaatggagggtcttggggtggggctagtggccaggatgttggagggtctaggccagggcccacgaaccagtccagtgctgggtcctgggatagccctgggagtcaggtcagtggaagctgctggactggggctggggctgtggatcaggctggtggttgttccaaacctggatttgaggatcaggccattggaggggggttctggcctggtgctggggaccagactggtggaggctccaggccagggtctgaggatcagtccagtggaataggttcctggggtgtggctggtggccaggtccttgggggagctaggccggggcctgcagaccagtccagtggtgggtcctgggctggcactgggaatcagtccagtggaaggtcctggattgggcctggggatcaggctgttgactgttccaagcctgaatttgaggatcaggcttgtggaggaggctcctgggctggtgctgggagccaagccagtggagaatcctgggctggatctaggcctgggaatgaggccattggaggatctaggatgggatctgaggaccaggccactggaggatcctgggctagatctgaggaccaggccagtggaaggttccaggtcagttttgaggtggaggccaatgaaggattctggtttgggcctggagctgaggccgttatagggtcttggtgctggacagaggaaaaagctgatattgtgtccaggcctgatgataaagatgaggccactactgcatccagatcaggggctggggaagaggccatgatttgttctaggattgaggctgagaacaaggctagtagtggctcctggattagatctgaggaggtggcttatatgggctcctgtgtaggggctgaggctggggctgggg

SEQ ID NO: 8647 - DNA, 1405 bp, artificial
  synthetic oligonucleotide
ggcggggataggagtggtgactggagattggaaaaacaggaagctaccacaagttactccaggcatgagataataaaggtttgaaattttactggaggccatgggaatggtaaggagaggatggacgtgagaggccctttgaaccaataagtgctgagatgtattctggagacatacagagaggaccaattttattttagggtccttggggcatttgacagaaaagtgtcctctttgccaattctggtatccatgtaagtaaacagttacaactttgaaataataagaaagtatactagaagaaagaagttttagtgcttgtatcagatttcctttataaggttggttaaggtggggcctttatggaaccatagagagtgttgttgggatacacatagaagatctacctctctcccaccccatagtgagggtgagggtgtcgggggaggagcactcttaaactgctggtgggagtatacactggtacaaggtccattggaatatatgcatatcctttgaccctgtaattccacttgtagaaatgtatctttaggaaataacacgtaattggcttgtaggaagctgtgcatcttcaaactgttttgaagggtgaaaagttgtaaacgacccaagtatctcaagataggcagttggctaagcaaattgatgtatgtctacacatttaaatattatgccgctattgaaaatgttgatggacatctacatgtgcttacattagaaattcagcatataatcttaagtgggaaaaataggctgtaaaagcacatgccatacatttaatgaagaaaaagtatatatctaaattatcttgctacatactctgagaatattaatagttttctgtgggtgttagactgatgggtgatttcatttgttgttttttctctttctttttttttttgttttaagacggagtctccctctgtcgcccaggctggagtacaatggcacggtctgggctcactgcaacctctgcctcctgggttcaagcgattctcctgcctcagcctcccgagtagctgggattacaggcgcctgccaccacacctggcttttttttttgtatttttagtagagacggggtttcaccatgttggccagactggtcttgaactcctgacctcaggtgatctgcccgcctcggcctcccaaagtgctgggattacaggcgtgagccaccacgcccggcctcatttgtttttactcatctctatttatgatatttatataagaagtggaattttatgcataatttaccaacaaggaagaagatggattcatattaggcaggcctggtcagtagtatttgagggacctggagcaaaagtataaatggaggctcacatatttatgcctacatatttggaaagtataacttaaaatt

SEQ ID NO: 8648 - DNA, 1224 bp, artificial
  synthetic oligonucleotide
agccagaggcaagaagcccagcggctgcacctctcaggtcaggtggtggcagcacacagtattaggagcaatgctcactcaggcaccatgaataagggcagaggggtaggtaggaacagaaagcccttcgatgcattgctgttacctctgtgggaatttggggaaggaagggaaggagccaaaggtatttactctgattggtcacctgagtaaacgtggcatttaccaccttggtcactcatctatatatatttttggagtgaacaatagatgggtgcctgaatacaggggatgagaggctatggaatgtggaagggtgggagggcagcaccttcttccgctcttgacagggcaggaaggattagaacatcgctgcatccctcacaccctcaggtgcctcagccttggtagactggaattcaattcagaggcaggtgatcagagtagccatcaaatcacaagaggttcatataacagtcggtcaagactttgggacgttaaatacatgcttttctttaatttaataagacagggttgtgttgctttaacttatcaaattgcaagttgattcaaaaatagaaaaagtaaggaattatttgtgtaaaatggccaagattagacaactggtcgtctctttgtggagtaattcatagatcatgtaaaaaaaatccattttttttaagagatagaggcttgctctctgtcacccaggctggagtgcagtggtgacatcatagctcactgcagccttaaactcctgggctccagcaatccacccacctcagcccacttttcaattttaaaatgagttattttgttttaaaagctactaattggctgtaaccagtagaaatattttcctactgttacaaataaaataacgaaattaatgaggccttttgggttttctctcccgtttaaactctccactcaaaggaaaatagcatcattttattttctcaatataaaagtaatgcgttactgatttaaaaacaaatgagcagaaaagtttaaataagacactcccacgatctatctccttttctaacatcttgctccacattttacaggggtgcagaagaaataggacattcatgacttgtgatggggggaggtatagagagagacagttggactgggactagagaagataaaaaattattcctcgaagagaagaaaaggccaacggacacgggagcagatacagcctctccctgtaaacca

SEQ ID NO: 8649 - DNA, 1704 bp, artificial
  synthetic oligonucleotide
tcccgggtgagatctatatgtacccagagctctcagtacccctctccccgcgcccttggtctgcaggtttgcacgaagcagtgcacttggaagcaagaaagagaaggaaaaaaaactgcctggacctctgtgggtgcatgtgagggcgccactgttcacaggacatctggaagggcaggggtggcagggaactttaacgttctagggtggggtggtggaacgtgaggttggagagtctttaagcggggaaaatttccaaacttagcttccgggtggaagaaaggaatcagtgatctagatatcaagccccgagtctctgccagtatctctgtatttttgtacgtttgtttgttttgttgttgtttcagtctgtttgcgttcaaagacacaaaaaggagcctgaaatctgaaatgcatcctttattcctaggtcgagctgcctcagagccggcccgcagtagctgcagactccgcccgcgacgtgtgcgcgcttctctgggccagagcgagcctgttttgtgctcgggttaagagatttgtcccagctataccatgggccgcactcgggaagctggctgcgtggccgctggtgtggttatcggggctggtgcctgctactgtgtatacagactggcttggggaagagacgagaacgagaaaatctgggacgaagacgaggagtctacggacacctcagagattggggttgagactgtgaaaggagctaaaactaacgctggggcagggtctggggccaaacttcagggtgattcagaggtcaagcctgaggtgagtttgggactcgaggattgtccgggtgtaaaagagaaggcccattcaggatcccacagcggaggtggcctagaggccaaggccaaggcccttttcaacacgctgaaggaacaggcaagtgcaaaggcaggcaaaggggctagggtgggtaccatctctgggaacaggacccttgcaccgagtttaccctgcccaggaggcaggggtggaggctgccaccccaccaggagtggatctagggccgggggcagggcaagtggaaaatccaagggaaaggcccgaagtaagagcaccagggctccagctacaacatggcctgtccggagaggcaagttcaactttccttataaaattgatgatattctgagtgctcccgacctccaaaaggtcctcaacatcctggagcgaacaaatgatccttttattcaagaagtagccttggtcactctgggtaacaatgcagcatattcatttaaccagaatgccatacgtgaattgggtggtgtcccaattattgcaaaactgataaaaacaaaagaccccataattagggaaaagacttacaatgcccttaataacttgagtgtgaacgcagaaaatcagggcaagattaagacgtacatcagtcaagtgtgtgatgacaccatggtctgtcgcttggactcagctgtgcagatggctgggctaagactgttaaccaacatgactgtgactaatcattaccaacatttgctttcctattcttttccagacttttttgctttgttattcctgggaaatcacttcaccaagatacagattatgaaactaattataaactttactgaaaatccagccatgacaagagagctggtcagttgtaaagtaccatcagaattgatttccctctttaataaagaatgggatagagag

SEQ ID NO: 8650 - DNA, 876 bp, artificial
  synthetic oligonucleotide
gattggtagttcgtattgggcttatctggttagttcttctgctagtcttgcctgaggtttttcatgtggctaaagtcagctggcagattagctgaggactggttttcctgtagctaggattgctatatccagcaaattaaaatacagtatgcccagattaatttgaattcaagatgaacaattaatatttttaaagtataagtatgtctcatataatatttggaaaacacatacactaaaatttatttgatattcagctgaaattcacatttaactgggattcctatattttatctgacaattctttctaggattcctcagttgaaacagttcatctctgttctatgtggtctcaccctccacaggttagcctgggcagctccacacatggtggtttcagagcagaaagagtgcaagtctcactgaaaatgctctgtccaggcctcctcttttgtcatgtttcctaacatttaaactggccaaagcaaatcacgtggccaggcccagagtcaatgcgggaggggactatacaatggcatggatacagggaggcatggtttattgagggtcattactgtaatattttcttagatgatcttctaattgtttttcttcccttatttgcttttattgcaccctctagtttttctaacctctcaattcattttaccaagtctccttttattcatgagttcatctactaccctaaatcttctatcatattgctccactttggtctagttaatcaggacctattatttgaccatcaccttaaaagtaacctttattacttttccaagttgggatcactatttcctggattccatatttacttttcaattgattactacctcattttgtgggagtacatgttca

SEQ ID NO: 8651 - DNA, 2615 bp, artificial
  synthetic oligonucleotide
tcgagagggccgtttatggggcaggggtttccaggagaatctctctgtttccatttctgataaagagggacatgaatgagaagagcatctgggcaccgactaactcccccgccaagactggcttttcagacaaacccatcagcggtttcaaaacctgaaccttagcacatccacttccctctgatatcaaaggaaacttcaagtctgaagcggacttggcaagcatgttattaataactgtcatgcttattaacaaatttaatccggcctgctgcagaaatgagttgcagcaacgtgacacagtctcccgacacacttcattgatgtacatcttaatctggccctgactttcaatactcgcatttaagttatccggggcacacaaagcctctctaacagtggggtctggagtggggctcgtgtttctagccattgagaggctggccaaatggctattgatatcctggctaaatggaaagcccgcatccttgggctcggcaaacaacagttttccctgaatgaaaagacacttggagaggtccagaacacaactgccatttttacaattttgagcactccaagtatttttatgttcataggggaatggccgctgttttattgggtgtgctcggttggccttgcctccccctgagggcctgtcctcagtgccacctggggccccaggttcagtccaatccccatcctcagtccagggccgagccatagtttcaaaatcaaaccaaatatcaggctcctcctcatccagctcctggtcatcgtcccactcctcttccccctcctcctccagcttctcactgtcatctcttcctatggtcagtttgtaaacgcagtagcaggcaccagccccaatcatcagtcctgccgccatccaacccacttcccgagcccggcccatgctcaagtctgtgccagccttggggcaggacaggagagggccttgctccacctgattgaagaggtctctcaggtccagggtgagtaaggatggagggtagcagtcttcagcttcttccaggctcttgtagctctcttgtgatgaatctgtgggtgaaacagagtattagggctcgggactatgtttggctttgtgcctcacagacagggtggatttcgagttggtgataaaggcagattaacaggatacaatttctttgttcttttcttttctgtcttcctctatcgacctcaggagcccccatttctcttcctgggtccacagggaagggcaggagatgggtctctgctatgatagctaggagggtgacagtgtgagtacctctcaggtagtctcctacaccagacctccacccccaaagattaagggcagtttctctcattaacctctaccaaagtcagataaattccttcgttttcccttgtcttctgttgtcagtggtccctccacggtgatagaggatagagtctggcagaaggacaaatgcaaagacaggtaggcggcaatggagaaatgaaagtgtagtggatgaactgaggacacaggtcccaatttctgtttttgtgaattttagacacttgagtttaaaatatttctcatactctactgactttccggacgcaggcctcctccgccccacttgtcgtccgccatttccccagcaaaggccgccacacccctttccctgcactgaaatgggagtgggtgtggagaaagaaggggccaggagagggcgactcggacctggccctctcatatcccagcccccctcctccgccacccccacccatggtcctgggctaatcccaccttcacactgacctgcaaggttccaaccaaggcagttttctccttctctcgctgaaacttgtgccgaaacctacaggccaacagacctacaaacctgcaaacagacaagggaccgaggggacggagtgcttggtggacggaccagcacccgggacactagaacctttcttttctcggagtctctggaaacgccattcactcccctcacccccacccgaaacccgccacttctctctactaaaatgagcacggggtggggtgggggtgggtagcagtatttagaaagtaggcgagaaagggacccagctgtgatcggcctgaactcggatctgtggcgttcttggccctcttccacccatacctcctctcaagcagcgcccaccctcgcaccgacctgcacggtccgagctagtttccttctttcttcacacgcctgcagagtaatagggggctggtacccagacggaggcgactagcaggacttgtgctctaggcggctcttggtcacgtgacggccacgtcaccagtgcgctctggcccccaatttccactcccacaagcagtgcggcaggcgccagcctgccttgtatctccccctcaacccccacagtgggccctgtcacttttttcctctgtaacaataccagaaaccagaagtggccctgtctttctggtgtttgaatttatgtttctctaattccaggaaggggcagcatctttaggaaggggcagcatcttttcctgagtctacccttcatttacacttcttggggaattgtctcatcctttccttggctctgaaacttctgcagcccctttcttaaatttc

SEQ ID NO: 8652 - DNA, 4603 bp, artificial
  synthetic oligonucleotide
acactctcattccagattttcttttctgatcgcttgttcctttcagatctgggactagatttcagaggaaatggtagactttcatagctcgggggaggggaggtggagggagaggctgctgtcccaggagcctagggaaggaagaggcaatttttcataaaagtacaagtggcccatagccccaggggaagatgccgtccctttctggtaatcggtggaagggaaacacaactacaaggtgatgagattatcgaagaagaaagagtaataaggcctggtgtgggggagggaaaggaggggggcgggccctcttctgccgcactgctggtgggaggggaaattggggacccgagttggtggatgacgtagccctcacgtgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcaggtcagtacctggaagattccataaagtcggggtgcttgagggcgtagggccgagaccgtcgcgggtactgaggcgcctccgtcgtctctcccactcgccgcccgctttccaagacatatgtcccgcttgcagcccatttcgatgctgcgaaacggtgagctgcggggtgtttggggaagagctcagagactgggaaatgggaatctgctgggagcctagggccgcaatccggaaagggagctgtggcctgggtgttggcccctagtccaccaggacagtgccggaggggaatggctggatatgggggcgggggtggtgagatgcaacgcgatatgtcagcagaaccccaagagaggtaataggggtgggaaacctctgacaaccaggcctccgaattagaaaagagttttgtgttctggggactagtccgtccaccaagcgctcagtggcggcagtttcccgtctttctgcctgtggctgtgtcttactgaccatggctctgtgtctagtgggtccaagcctctcccgggtggccagtctttctgtaggttgcggcacaacgccaggcaaaagaagaggaaggaatttaatcctaatcggtggaggtcgatttgagggtaagaccatctggggaccctaggagggacgggggtggcggcgggggtggggagaaggcagagaaggtaataatctaggtacatgtctgagtccgaatgtgtttcttgcactccccggactgtggcgaaatggcgtgctttgtgtgtctgtggttggggggaagtgggggaaatgacagcagggaaacctatcggatagtttgttcgtaatcctcctctctcaacagcacttactctccatgttttcgatctgtcatcctgcaggtctgctgtagcaggtggctccgcttgaagcgagggaggaagtttcctccgatcagtagaggtcggtgtgggcgtgggggctgcctggaatgggggaggggttagaaatcgccggcactttggacaggctcttccaatcctgctttattttccttacctccctcccatttcaggctagggagggggcagacctgtgcatgtctgggatagcataaagaggttaaaaacaaacctgataaccggaatggtgaatcaggaaagcaacgaatcaacagtcaacccatcaagtgctccattctcactggctctggtctctctgcagattggaaagattgttgggagtggcacaccactagggaaaagaagaaggggcgaactgcttgtcttgaggaggttagtgcaagggttctagtcaggtccctagggacatctgaggttgtggtgactgagaccccagcagagtctgtggattccattgacattatctaggctttgggcggggtgacctgggatggggagggaaaggctgaaatgagaggcatagagatttcgtcaacaatctacatttcctacctagcattcaattattattatcttgtccctctgtgcagctccctgcatggggcaacacaagcagaagagaaactcaaacccaattttcttcttccactcctaggtcaacccccagaatcagctcttgtggccttgaagtggctgaagacgatcaccctccacaggcttgagcccagtcccacagccttcctcccccagcctgagtgactactctattccttggtccctgctattgtcggggacgattgcatgggctacgccaggaaagtaggctgggtgaccgcaggcctggtgattggggctggcgcctgctattgcatttatagactgactaggggaagaaaacagaacaaggaaaaaatggctgagggtggatctggggatgtggatgatgctggggactgttctggggccaggtataatgactggtctgatgatgatgatgacagcaatgagagcaagagtatagtatggtacccaccttgggctcggattgggactgaagctggaaccagagctagggccagggcaagggccagggctacccgggcacgtcgggctgtccagaaacgggcttcccccaattcagatgataccgttttgtcccctcaagagctacaaaaggttctttgcttggttgagatgtctgaaaagccttatattcttgaagcagctttaattgctctgggtaacaatgctgcttatgcatttaacagagatattattcgtgatctgggtggtctcccaattgtcgcaaagattctcaatactcgggatcccatagttaaggaaaaggctttaattgtcctgaataacttgagtgtgaatgctgaaaatcagcgcaggcttaaagtatacatgaatcaagtgtgtgatgacacaatcacttctcgcttgaactcatctgtgcagcttgctggactgagattgcttacaaatatgactgttactaatgagtatcagcacatgcttgctaattccatttctgacttttttcgtttattttcagcgggaaatgaagaaaccaaacttcaggttctgaaactccttttgaatttggctgaaaatccagccatgactagggaactgctcagggcccaagtaccatcttcactgggctccctctttaataagaaggagaacaaagaagttattcttaaacttctggtcatatttgagaacataaatgataatttcaaatgggaagaaaatgaacctactcagaatcaattcggtgaaggttcactttttttctttttaaaagaatttcaagtgtgtgctgataaggttctgggaatagaaagtcaccatgattttttggtgaaagtaaaagttggaaaattcatggccaaacttgctgaacatatgttcccaaagagccaggaataacaccttgattttgtaatttagaagcaacacacattgtaaactattcattttctccaccttgtttatatggtaaaggaatcctttcagctgccagttttgaataatgaatatcatattgtatcatcaatgctgatatttaactgagttggtctttaggtttaagatggataaatgaatatcactacttgttctgaaaacatgtttgttgctttttatctcgctgcctagattgaaatattttgctatttcttctgcataagtgacagtgaaccaattcatcatgagtaagctcccttctgtcattttcattgatttaatttgtgtatcatcaataaaattgtatgttaatgctggaaagaaaaaaagaagaaagaaagaaaccatccctgtccttcagtttataatctagttggagagataagaaacgtacaaaccaaaagataacagaatatctgaagcatgtactcattgtcagatgttccctctgagagcacagaggaggcaaaagcttctgtgggatgtgctagtcggctaaagcttcacagaggaggtggcaattgaaaatgagtcctgaatggggtagggtggttagggaattccatgagacaagacaaggggggcatggtgtgagaaaggcatggaagtaggaaccctcttcctatgacaggagatcattctgcttagagtggagagtgtggagagtgggagtagataattttggaaagctgggtgaagccagttgtggagaattgtttgaatattatcccattgaatacccagagccactaaatctttttttactagaaaataattggggtccatatgaaagtctctattactgagtagtgtcaatgagggtgtggcaaaatggagcctttcacatcctagtggtggccatttggtaatacagatataagccttaaactatgtaaacccttgtcctaaggaagtaattgaataattgcccaaagattgtatgtatgaggctgttcatcccagcactgtctaagctagtaaaaattggaaacaatttaagtatctagcacattggattggttataaagcaaggaatgttcacacagtaggatattataagtatgctgatggaaatctatattgccaggaaaagctattcattatgcgttgtgaagtcagaaagtaaaaaagggtagatagaagtattcgaagtatagttccattttttgagactaataaaacatatgtttaaaaggacac

SEQ ID NO: 8653 - DNA, 1656 bp, artificial
  synthetic oligonucleotide
agaaatgtaagggactatgggcagctggggagagaagcacagaattgaaacaatgtatacccttccagacacttttactattcatatacttatatattctttacataaaattggatcatactattgaaaaattttcagtgcctgatttaaaacttttttcctcaaaaaaagaataatattcattggagatataatacttgaaaaaatagagttgatgagtacaaacttgtgccttgacccagatatgtagcttgaacatctaacaaaaatccagatcaagccatgttgaacttgagatgcggagcgacttttacacctggggtgaaaatgaggctaactcgagtagtaaaaatccccagtgaggcaggtataggcctgactagcacccatctgctcctttccccattcctttgttccttctcattcttctttccacttccttcctcctacttttctttattttatccttctgggagatcattggtggtagcctctctgggcttctctgatccttcaattcccatgacgccatgccatgtatcagtgggcatttaatacagaataataactgtcattgctctggtcataagttgaccctgggtgtgactggatgccaagaatttttggaacctttgttggacaaaaagagactgagaaggaactagtcttaacttgtcacggccacatgtgcactgcatgaatttttgatgtcctgtacccggtcttatttagactgaataacccggagtctgggaaaggtgtatgagatagatgtgtgactgcttggtccaggcagccaggtcacaggttgatgtcccaatgttttcacataggaggttgtcactctcaatccttttggaaggggcagagttctaggattgtagctgattatggcagcccattggcacatggaggaggcagtgtcttctctttagagaggatggcagcttctgggaaaccaaggaaaccagaaactcagaggatgtcctgctattttggttttgttctcatctaacagttttaggaatataagtggatctatcccagtgcaaacatgttcaaaggcgattttacaaaagtggagtgttgttctgttgtaaattgtcagccaatatacataatatttcaaggctcaggaaatggattttcttttttgaaaaattcacattttacctgtcttttttcaaaagagattccaagtgtaggcttagcaaattgatgtggttcaggcaaattttatgtttatggctctctttcattaatttctttgctaagttcccttgagaatggccttttagataatgattcatactattttcaatgctagctttttacatttattttgcatcgcatcccaggctgaagatttttttccggtttttctgtttaaaccatggctctttcttgcttttaagccagagccgtgtcaccatcatcctggggtcccttatctgccctgccccgagggtatggtattagcaggataagtaatatttacttatctgagtggcatagctcagtgcttgaccctctccactggggccctctcaggtattgtgctaagggcttgggcaatgtatgctttaggggatagatgggagaggagggagaggggagaagggagtgaaggaagccttatcagagaggtaactttat

SEQ ID NO: 8654 - DNA, 948 bp, artificial
  synthetic oligonucleotide
acacttgaataagaatggaaattgtgagtaacagtgactcgtttctggttttagtgggaattactttggcatttcatggtctgaatgaggattgctgttgattgttggtaaaaagtgcttttaatatttaagtcatccccttctatttctattagtgtctgttaggattagctgctgattttttccctagtggcttttcaacatctattaacagaatcatgcactttttctcctttaatttttttttttttttgagacagagcttcgcttttgtcacccaggatggagtacaatggtgcgatcccagctcacggcaacctccacctctcgggttcaagcaattctcttgcctcagcctcccaagtagctgggattacaggcatgcaccaccacgcccagctaattttgtatttttagtagagatggggtttctccatgttggtcaggctggccttgaactcctgacctcaggtgatccactcacctcggccttcccaaatattttatgtaattaattatattgatagaattcctgggggaaaaaagacactatctgtctcaaaacgcacatagaaaaaaaacttttttagaaaagagaattcagcctgtagtcccagctatctgggaagccgaggtgggaggatcacctgagcctgagaggtcgaggctacagtgagccgtgattgtgccattgaactctagcttgggtgacagagtgagacctgtctcaaaaacaaaaacaaaacaaaacaaaaaacaaaaaagaatttggtgtttgactatttatttttgcctttgtggatctatccctatcaggtaatagtacagtttttttcttgctatacttctgagatctgtttgtctacatattttagagtttgttaatattttattttttttatgtttatcattgataactgcttatagttacctttttatgtactatct

SEQ ID NO: 8655 - DNA, 3910 bp, artificial
  synthetic oligonucleotide
tctcatattttgtactgttttatctttgtgtgctgcattctgggtgatttattgagatctatatttgaatgtcctaattttctccttgcctttgtctctgctaaggctataaaagtttcaccagttccagattaatttttatattagtgtatgtcccttgaattctctcacatgtacagattatgaattcggcctatgaatggagctggcctggattttgattgctcccagggggctctgtatccacccatgacctcacataaaagatgagctttcttctcatgtatctttgctgtgggataaagttttctagttatcatttcatgtactggttgtgtttctgtggggcctagatttagattggagctcagtaccagcttcccatcttccactgcctagaggcattgttttctgtccctatgtgggattaaatcctggtctctagatcttaaagccgatagccgtctgtctttatctcccgctccttgctagctccttctttgtttcttggagatttccatttcatgatgatgaacttgactatttactgtttttagcattctatcacatctgtgagtttcgagtgggaagggggaagctttccaactcacttcagtctgctgttgactggaagttcgctggacagttttgttggattaaattgtgtaggtgacatgtcatacctgttaagagatacctgaagcattgctgctttacattgcttccagacatatagtatagagtctaacgaagttttctgtatctcagcatagcaaaggcagggaagcaacacagaaagtcttgatcattcaaggtcgacacaagcaaaatagagagctacaatatttgaagaggtcctgaggaaggaatgaaaatggtgaattatgtagagcagtattactagaatcatgtggacctcctccaacaactctaaggtgctttgtaagcatctttgatcttagacacaccacggaaaatgcagcagatcctaaattgattccatttcagcacaacaatgggatgagaagacaaaatataaattatgagtattgctatagaaaataaaagctggatgttttatacacttgggtttgtggactgtgatttattccaattacacatatgtgttagctatggcattctgcaggatgtatgattaccagacatttatattatcctctttgcctagtaattatacttttccttatttcctctcaaattttacttccttagggaagttttctttgttccctttttagcccctcagagtatgtcttgatctgcagcaatatactcatatacatacctgtgttccattccttctttgtatttatgtggaattataattatccatacactcatgtgattatttgattaatgtatataccccactaatctgtgagcttcatgaatacaaagacctagtctgtttttcctaccattgtattctcaatgccttgcataggtgctcaatagagacttattaagtgaatgaatgaatacaatacatttctgcgttgtttgacatttttacaatgactatattagttttactattaaaaaatgaaaatcatcctatttagaacaaatataaacatagaccttctgggccagtggtttttaatatatttagggttatacttcccattaaaaacatgttaataattatagcttatagccgctcacctggaaaacttatatgcaccttcccctcactcccaatacacaaccttgtatacaatttccaggagtttatagacttatccagttgagaacacctggtctaggttaatcagtatggtcagtaggtgagagtttcttggacactgtccttagcctggctgaagggccactagggaggaaggtgactgaaaggcagcaaagctaggttccctagattccctggagatgcagattttgggcatgaaaggcccaccagactgcactgctcatgataggtgggaggcagcagatagggtccagggaggcttccactcagacactgtgaataagggcagagagcagggagatggctagggacactcccccagcaatcacttctccaggcctcatggacaccctcagctgcaagggtctagaaggcatgagttctggtttccagtggcaggaacagtgctcccttctctgctggggctgggttacccctgtggaaatttaggagagggaggagggaaggatccaaaagcatttactcaggtcaccaccttggtcatctgtccaggtatatttttggagtgagcaagagtcaggtgcccatatgcaggaaatgagacgttctgaaatatgagaggggatgggggcagcaccttccccctatcttgactgggcagaaaggataggaccatctctgcattcctcataccttgcagcatcaatctcacagctcttccctttgctcagagttaaatttcattgtttagaaggattcagtctaatccttctaaataccttatcaaaaaccttaccaatcaccttatcaaataccttagcatgtttataaactcttcttgtgcagaaaagcaatacattcataaaacgtaattgtgctaaggcacttcctccctcttaagttggactttttttttttttttttttttttttttttttttttttagactgagtctccctcactcttacccaggctagagtacagtggtgccattttggctcactgcaaactccacctcctaggttcaagcgattctcctgcctcaacctaatgagtagctgggattacaggtgtgcactgctatccccggataatttttgtatatttactagagacagggtttcgccatgtgggccaggctgctctcgaactcctggcctcaagtgatccacctgccttggccttccaaagtgctgggattacaggtgtgagttaccgcacctggccagaaatattttttatgatagatttttcccagattaattcctcattaatttttcagtgaccataacttcattttttttctgattgtaaaaatgattgcatactgacgctttttttttttgatggagtctctcgctctgtcacctaggctggagtgaattggcacgatctaggcttacggcaacctccgcctccagggttcaagcgattctcctgcctcagcctcctgagtagctgggactacaggcgtgtgccaccccgcccagctaatttttatatttttagtagaggtggagtttcaccatgctagccaggctggtcttgaactcctgacttcaggtgatctgcccgccttggcctcccaaagtgttgagactacaggcatgagccaccgcgcctggccactgatgcttattttttaaggcggtaatagtacatgaggaagtgaaaatatgaggaagtacaaatctcatgttcattccctgcctctgttactgacatgctgtccattttctaattctaatccctgcctgcctctccgccctcacgttttgggggatggacacagttgcaggggaaatggaagacattactgatcgtggacatcgagggtggagagagaaacttgggcatcaaactagccctgagaactgtaccaatgaggttgaaaacatttgtaaaccattgcctagtaaaagcagtcactgagatcagcgttttggatgattaatatctcttaaaaacattttataattccctcaacaaagctcttgcaaactgtggtagaggctgttagtgctctccaatatccatgttttctgcccactccttggaatccagctagattggtcaatagtggcctagctatagtggtcaacgtcccctatgattgggtgcaaccatgagactgagttctggccaatggattgtggcaggagtgatgtgttccagattttgcctcatgaaacttcctcatgcttgacttgtgctctctct

SEQ ID NO: 8656 - DNA, 707 bp, artificial
  synthetic oligonucleotide
gttgtttttcttgaagtctcacttcattcattttcaagaaaatctctgctaaataccgaagtctgaaaaaccatagtttgtctgccagtcattcttcaagtaaaactaatgttccatgaaaaaagcagctaattcagtgcacaactaaaatgattatgcaaatatttaccttagagacaaccattgtcctaagctatgtggcagaaatgctttgtgcgtacttcctatttcatcacacggaatattaaaaagacttgcactcaatcattgagattttatcatatataatttttataaataaggactatattaaatacatttttaaataaatttggatttaaaaaaattagagcgtgtggttctaaagaatgcaatcactactagtatagtatggggacactgccttaatccatgctaaggcaccagcagttttacccaccaatgcttttgcaccatcagtgcaaatgtcaactcggtgaaaacagcaaataacatgttactattgttttgaaaatagttttgaccttactgtttcagggacctgcagtagtccatggactacacattgagaaccattatcatacaatatgattccaattttatgaaaaaaatacgcagggatgtatataataaacatatgaaggaattttcacccagttttaattgtgtggactttttgactgatgcgacaggcccttacacgtagt

SEQ ID NO: 8657 - DNA, 1463 bp, artificial
  synthetic oligonucleotide
cagtaactgccttttcgtgtttgcacatcagaatgtcaaatgattctacctctcaattccttcaactcttctcaccccacccctcccacctcaatcctcctcctgcgcaggctccccaggcactcaatccctccttccgctttgccccgcccccgtccgccatttctccaggacacaccgccacaccccttctcctgcaacgaagcgggaggggagcggggcgagggtgcagcaaaagctggatgggacgcggtatgggggactcctgccaaacaattcagtgttcccctcccaggatcacccatctttcgctccccagcccctaggcctagcgttagcctgcagaagaggggcctcaacgtctgccttttcgggttcagggtcgagattttccacgatttctctgctatgggctctacctcccacttcccacaaatccccccaacaaccgccatttctcccgcctgcatacccgaattccttttccaggactgaaaagacggggggtgaacggctgtgtgggccggaggtgtctggaaagcagtctgcgagttaacaaggcggtttaataccagattctctcagggtccgccccttcccccccacctcccgtgaagcccagacagcgccaaacccgccacctctccaacagcagctggtacacccatttcccagcactcccaaatcacagagggtcggctgggggatgggagggtgccggggcggtggtggggaaagtcagggtgggagtgtgccgcccagattgttaccaaattgcatgccccacccccgcctcctggttaccctttcccaacctccctgctggccttctatgcgctgccacgtttatttctcttccctcctcctctcaaaacaggacggaatgtggggtgcgggcctgaatattataaacaaaaccaaaaaacactggctggaaaggaagtaagcggattcttcgtaaagtctatcaaaagtcttttcgtttccccctccccctttccccaccgcccaccaaaatgagccgcgtttgagcacctcaggtctggaaagccggccaggagtgggggagaccgaggcacccgcggcctccgactcccgcatccctagattaccctattcaggggtcccagactgtgcccaccctcacacccacctgcccgaatctgggggaattttctcctcctcctcctcgcctgggttaaacgcacggcagcgagctgcgcaatagagttggtacccagaggaggacggagaacgacggtcagggctttaagtacctttgcccacgtcagctcctggtcacgtgagggctgcatcgccagtaagcttgggtccccaatttccactcccaccaagagtacgagccccctcctttacttccattcccatctcaccccaccacatcaggtcctgtcactcatttttttgtctttgtagtcctggaggcctaaagtagccccttc

SEQ ID NO: 8658 - DNA, 3141 bp, artificial
  synthetic oligonucleotide
tccctcacagacttcagatctttactcaaaggtcacctttttagtgagtccttccttggtcaccctttctaaaagttcatcccatcttgacttttcatatcttctttcctgccatttattttttctttagtacttattaataacaatatactatatgttttatcttgttggttggttgtctctttcactagaaagtaagaactatgaggttagaaatttaggtcatctctattcaccgctgtaaccacagcatcaagaacaatgcatggcatgtagtacctgctcagtacacatgttgaataaatgaataaatgaatgaatggctttccaacactcaaccacctttacactccagaaaaaagcctagttggttctggcatatcatcagatttgtaaactctcaaatgagtgattacctaatcaggatgttgtcatgggacaagatgtagaaaacttaagattgctttgagtgacatgtgcagaactcattatgcagtgagaattattgtttatgatatatgccatttaataaaagtgaatcatttttcttgaatggaaatagttctttaacatttttcaataataaaaatgcatgtttgtataacaaagaacagaatggtgttaacaagaaagtaacagaatccattcctactgtttcctttcctgacactccctccctcatcttcatttccaggtattttcaggactgcagagatgaacattagtgagcccaaatggaagtggtgaagggagcagagaagaggatgggcccgtttcccagagaagcagaaatgaccagtagctcaggagaagatgctgtttcttctggtaatcagagaaagatgacacttttgttgtgtgcacgaagactaaaaagaaaacgagtgacagtgccctgcatggtggaggtggtgggagggaaggcgggggagtgaggggccttgcaaataatgggaggggaaatttgggacccagactcaccagtgacgtggcttcacgtgaccaggagctgacatgctggtgtgttggtccaaatagcggttcctcctcagctaccagctccctgtttccttaaaggtggtgtgactgtggccaaagaaggtggaggaggacagggaggaaacccatccagatccttgtaggttgctgtgaaggtgggtgttgattggagactcctgaagtccaggtggaagggagcagcacaattttcaagttaggaggcacttctctgtttccccaaggggacaacccgaacccaggcttgttctcattttgtgacttgtcaaaggcagggcagtgtcagcagcagaaatggttgacattggtgactagaggaggtggaggggagaaagtggttatcatgtagcagagtgacggaggactgtgaaataagagacaggcttgacaacctggattctgaacagggaaaggtctgggtctggacctacattcagatgttggtgcatccactgagcactaagtccgaattgtcttttctttgttcctgtctggttttcgcttccgtctgtctgtgtctgctgctctgtctgtcagtggtggggtttccacgcaaaaggaggagaagctaaaagcttcatttccttcctccttcccctccccctaaacactcagtccctacatccaacttgattgaagcttcaaactcctgccctcaatgtgttctcactagcctaagggagcacccctgagacattcacagtgctgtagaatggtccgagcttagaactcagacttgatggcagtgggactggtgatttgggctggtgcctcgtactacatatactgactggcctgtggtagacagcaaaaaaagaagagaccagctgatttgaaaaacaataatcacatctacaaaagtttagaaaatacagaaaactataagaaataaaataaaaataagccaccaataattaccactccttgtctttcctctctaagaatgtggttgtgtgtatttaacattattgcagtcatactatatgttgccctgaaattattattttttcagaagcattgcagggtattacttttattagttaatgaaaatgcttcataaacatcctattaattaatgtttcataataacaaagcataataatcataaccttacccttttgctgcctttcatgaagcaggtatgaaacttaactcatgtgtgaaagaattattaaacatctttatttttgtaaaaaaacccagtcctctgtagattccaggatggcaaaacatcctatcacatggatttggaggtggtgccaggtccctggggttacccattaccaaggtattggggagtgtctttctatacttgttatagctgtgaaacggatcatccatgtttccatgagtttccatgagcctttcaatgggccagttaagcagcttgtgcgacatgcttggcatagaggggacaggaatttggtgagactgggcatcctggataggactcagcctccaaggtatatcacatggccatcagcattgaatttctactctgttctctaggttgctggggagcaggccagaggtcccatctgctgaaggaattcaaaggcccctttcttttccccttcagtagtggtggtgaggcattttctttttagtgtgagggaaatctttcactcctcgaactctgttcttcacaatggacttggatttctgggaaatgaactctgggaagtcctgacgtaaactttctctgaggcaaggaagtgcagagttagcttgactgagaaagggaaagtggaaaatgtaaacagacacagagatgaaatataaattagtaccctggtgtcttaagtggggttccctagaagcagaaccaagaatggggattcttgtgaaagtggtttatcgagggagtatccttagatgaaacctatatggaagtaaagggagcagcataggacaggggaagaaactaagcatagatataatccagctgaaatctagcctcagcctgagcccagggggactgtggaacgtgaagggcaccagggaaagaacacaccttgagacaagggagccaggcttttatacccactgattgcaagacaggatgcgtgagtgggtggcgggcggtggggcgggggcgggggggaacagggcgcggtgtggggt

SEQ ID NO: 8659 - DNA, 8251 bp, artificial
  synthetic oligonucleotide
ttataccatggtttagctatttgacagaaaaaaatggctgtttataaatgggaagtgttcaggataatagtgaagggtactgactttagcaaagtgcctactatgtgtcagacactgaattgggtatttttcattggttttcttttcaactcctaccaattaaatgagcagtgtttatatttctaatcctcttctatctatatctgtttaaagaaaatttgaatatctctgtacatattggttcattgcctgcttagaaaataactttcattgcttcattttttttcttgtactaatgaacatatgcactgggaagcaattagaaaatacagatgagtgacacttaggagtccagagtcagaaatgcaacctgaacatcacagagcaggaatgttagaagggaaggtaagaaggagggaataaagaagtgggaaggggctgctgctgtaaccgccagactgagctttccagaagtttgcctggcatagtaagcacatcagtggcaggcagcctctgctaagattcttctttttttttttttttaatctgttgagatttcctccagacaagtcagctaggcctctagtctatgctcttcttcccccttctcccactatatccctccctctcccttatctccctcctactacttccagcctacttgtcctacaacatgcacaaatcaggctgggaactgccaaagtctgtccagagtaggcagggagctgtctcagtcctagggaatcttccaccctcagataaagagaagctctgggtgtgcatgcacacatgtgtgtgcacacgtatgcatgggtttaaaattaagataggattatgtcgtttgcagttttttctgattataaaagttgtgcttgtttactgagaaaaaacagtgaaattcagaaaagtgtaaagaaaatagaaattacctagaatcttataattcagatgttcagttatgttttggtacttttgtttgtagagcttagaatttttctgtgcacaaacgtatatgtacatgcaatttgtaaccaccattttaaatttagccatgtgttgtggatctttcaatgtcaataacaatttatatcttactttctgaattactttaaaacaatattttttatgtttcaaactttaatctctatttttctgattttaaagctaataaaatccttgtaaaaatcaaataatatgcaaacatataacatagataatgaaattttcctgtatttctttcacctgccaaacctgtagaaatatcctctgttaataatgtcagatgcatttgaaacagagcaactccatcttaaatagggctgggtaaaataaggctgagacctactgggctgcattcccagaagattaggcattctaagtcacaggctgagataggaggtcagcacaagatacaggttataaagaccttgctgataaaacagcttgcagtaaaaaagccagacaagacccaccaaaaccaagatggcaatgagtgacctctggttgtcctcactgctacactcccaccagggccatgacagtttataaatgccgtggcaacatcaggaagttatcctgtatgatctaaaaaggagaagcatgaataattcacctcttgtttagcacataatcaagaaataaccataaaactgggcaaccagcaaccctcgagggtgctctgcctatggagtagccattctttattactttacttttctaataaacttggtttcactttactatatggattctccttgaattctttcttgtgctagatccaagaaccctctctttgggtctggattggaacccctttccggtaacaataatacattattttagaaacgtttttcttgggatatatacatatattctttcataaaagtggggccatactaaaagcatattactctgcatatatctttccaattcattcttacgtttacaatgtttgcaagctgcttttgttcacctagcaataaatcatgaacatatttcaggtcaataaatatattcctatttaattttatgaatcactcactattcagtaagatttcctccaatttttgaaattttaactaagctatttttctgatcataaagtatatatgcttgttgcaaaattttatttatttatttatttattattattatacttttaagttttagggtacatgtgcacaatgtgcaggttagttacatatgtatacatgtgccatgctggtgtgctgcacccattaactcgtcatctagcattaggtatatctcccaatgctatccctcccccctcccctcaccccacaacagtccccagagtgtgatgttccccttcctgtgtccctgtgatctcattgttcaattcccacctatgagtgagaatatgcggtgtttggttttttgttcttgcaatagtttagtgagaatgatgatttccaatttcatccatgtccctacaaaggacatgaactcatcattttttatggctgcctagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaataggatggctgggtcaaatggtatttctagttctagatccctgaggaatcgccacactgacttcgacaatggttgaactagtttacagtcccaccaacagtgtaaaagtgttcctatttctccacattctctccagcacctattgtttcctgactttttaatgattgccattctaactggtgtgaaatggtatctcattgtggttttgatttgcatttctctgatggccagtgatggtgagcattttttcatgtgttttttggctgcataaatgtcttcttttgagaagtgcccgttcatgtcctttgcccactttttgatggggctgtttgtttttttcttgtaaatttatttgtgttcattgtagattctggatattagccctccgtcagatgagtaggttgcaaaaattttctcccatcttgtaggttgcctgttcactctgatggtagtttcttttgctgtgcagaagctctttagttgaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggtgttatttctgaaggctctgttctgttccattgatctatatctctgttttggtaccagtaccatgctgttttggttactgtagccttgtagtatagtttgaagtcaggtagtgtgatgcctccagctttgttcttttggctcagtactgacttggcaatgcgggctcttttttggttccatatgaactttaaagtagttttttccaattctgtgaaagaaagtccttggtagcttgatggggatggcattgaatctgtaaattaacttgggcagtatggccattttcacgatatcgattcttcctacacatgagcatggaatgttcttccatttgtttgtatcctcttttatttcattgagcagtggtttgtagttctccttgaagaggtccttcacatcccttgtaagttggattcccaggtattttattctctttgaagcaattgtgaatgggagttcactcatgatttgggtctctgtttgtctgttattggtgtataagaatgcttgtgatttttgtacattgattttgtatcctgagactttgctgaagttgcttatcagcttaaggagattttgggctgagacaatggggttttctagatatacaatcatgtcgtctgcgaacagggacaatttgacttcctcttttcctaattgaataccctttatttccttctcctgcctaattgccctggccagaacttccaacactatgttgaataggagtggtgagagagggcatccctgtcttgtgccagttttcaaagggaatgcttccagtttttgtccattcagtatgatattggctgtgggtttgtcgtaaatagctcttattattttgagatacgtcccatcaatacctaatttattgagagtttttagcttgaagggttgttgaattttgtcaaaggccttttctgcatctattgagataatcatgtggtttttgtctttggctctgtttatatgctggattacatttattgatttgtgtataccgaaccagccttgcatcccaggggtgaagcccacttgatcatggtggataagctttttgatgtgctgctggattcgttttgccagtactttactgaggatttttgcatggatgttcatcaaggatattggtctaaaattctcttttttggttgtgtctctgccaggctttggtatcaggatgatgctggcatcataaaatgagttagggaggtttccctctttttctattgattggaatagtttcagaaggaatggtaccagttcctcctcgtacctctggtagaattcggctgtgaatccatctggtcctggactctttttcgttggtaagccattgattattgccacaatttcagctcctgttattggtctattcagagattcaacttcttcctggtttagtcttgggagggtgtatgtgtcgaggaatttatccatttcttctagattttctagtttatttgcgtagagttgttcgcagtattctctgatggtagtttgtatttctgtgggatcggtggtgatatcccctttatcattttttattgcatctatttgattcttctctctttttttctttattagtcttgctagcggtctatcaattttgttgatcctttcaaaaaatcagctcctggattcgttaattttttgaagggttttttgtgtctctatttccttcagttctgctctgattttagttatttcttgccttctgctagcttttgaatgggtttgctcttgcttttctagttcttttaattgtgatgttagggtgtcaattttggatctttcctgctttctcttgtgggcatttagtgctataaatttgcctctacacactgctttgaatgtgtcccagaggttctgctatgttgtgtctttgttctcgttggtttcaaagaacatctttatttctgccttcatttcgttatgtacccagtagtcattcaggagcagattgttcagtttccatgtagttgagcagttttgagtgagattcttaatcctgagttctagtttgattgcactgtggtctgagagatagtttgttataatttctgttcttttacatttgctgaggagagctttacttccaagtatgtggtcaatttttgaataggtgtggtgtggtgctgaaaagaatgtatattctgttgatttggggtggagagttctgtagatgtctattaggtccacttggtgcagagctgagttcaattcctgggtatccttgctgactttctgtctcgttgatctgtctaatgttgacagtggggtgttaaagtctcccattattattgtgtgtgagtctaagtctctttgaaggtcactccggacttgctttgtgaatatgggtgctcctgtgatgggtgcatatatatttaggatagttagctcttcttgttgaattgatccctttaccattaagtaatggccttctttgtctctttttatctttgttggtttaaagtctgttttatcagagactaggattgcaacccctgcctttttttgttttccatttgctgggtagatcttcctccatccttttattttgagcctatgtgtgtctctgcccatgagatgggtttcctgaatacagcacactgatgggtcttgactctttatctaatttgccagtctgtgtcttttaattggagcatttagtccatttacatttaaagttaatattgttatgtgtgaatttgatcctgtcattatgatgttagctggttattttgctcgttagttgaggcagtttcttcctagtcttcatggtctttacgttttggcatgattttgcagaggctggtactggttgttcctttccatgtttagcgcttccttcaggagctcttgtagggcaggcctggtggtgacaaaatctctcagcatttgcttgtctgtaaagtatttcatttctccttcacttatgaagctcagtttggctggatatgaaattctgggttgaaaattcttttctttaagaatgttgaatattggccccccctctcttctggcttgtagagtttctgccgagagatctgctgttagtctgatgggcttccctttgaggataacccgacctttctctctggctgcccttaacattttttccttcatttcaactttggtgaatctgataattatgtgtcttggtgttgctcttctcgaggagtatctttgtggcgttctctgtatttcctgaatctgaatgttggcctgccttgctagattggggaagttctcctggataatatcctgcagaatgttttccaacttggttccattctccccatcactttcaggtacaccaatcagacgtagattcggtcttttcacaaagtgccatatttcttggaggctttgctcgtttctttttattcttttttctccaaacttcccttctcgcttcatttcattcatttcatcttccatcactgataccctttcttccagttgattgcatcggctcctgaggcttctgcattcttcacgtagttcttgtgccttggttttcagctccatcagctcctttaagcacttctctgtattggttattctagttatacattcttctaaattttttccaagttttcaacttctttgcctttggtttgaatgtcctcccatagctcggagtaatttgatcgtctgaagacttcttctctcagcttgtcaaagtcattctccgtccagctttgttccattgctggtgaggaactgtgttcctttggaggaggggaggcgctctgctttttagagtttccagtttttctgttctgttttttccccatctttgtggttttatatactttttgtctttgatgttggtgatgtacagatgggtttttggtgtggatgtcctttctgtttgttagttttccttctaacagacaggaccctcagctgcaggtctgttggagtacccggccgtgtgaggtgtcagtctgccgctgctggggggtgcctcccacttaggctgctcgggggtcaggggtcagggacccacttgaggaggcagtctgcccgttctcagatctccagctgcatgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttggagcttccaggttgctttgtttacctaagcaagcctgggcaatggtgggcgcccctcccccagcctcgctgctgccttgcagtttgatctcagactgctgtgctagtaatcagtgagactccgtgggtgtaggaccctccgagccaggtgcggaatataatctcctggtgtgccattttttaagcccttcggaaaagcgcagtattggggtgggagcgacccgattttccaggtgctgtctgtcacccctttctttcactaggaagaggaactccctgaccccttgcgcttcccgagtgaggcaatgcctcgccctgctttggctcgcatattccgcacgcacccactcacctgcgcccactgtctggcactccctagtgagatgaacccggtacctcagatggaaatgcagaaatcacccctcttctgcgtcgctcatgctgggagctgtagaccggagctgttcctattcggccatcttggctcctctcccccacaaaattttaaatgatataaaattatataaattaggaagtgaaatttccctgtttctctccattcccctgtgaaggta

SEQ ID NO: 8660 - DNA, 606 bp, artificial
  synthetic oligonucleotide
gtgcccaatatttcttcagtatttctctacaatcatctcttagacaattttcacagtgaccacatcacactttttccattgttttcaaacctctgaaccttcaccatctcatcattttttcctatttagtgctaagcccttcatctttgttttggatccctttccctcttgcatcctctgtggccttattccatcagctattctcaatttcttctgtagtttcaacttctcttccagctccttttccaacagatttcaaatatactcaaattcctctcataaaaaggcaaaaaaaaacacaacccaacaaacaaacctttccttaccccatacctctcaccagttattgccctctctctctcctgcacttcccatccaaactactagaaataactgtgtacattctttattcccactttctcaccatccactctttactggagaggtagtgacctctcctatgaaattgctcttgccaaggtcataaataataccatcgttgttaaagggataattctcagtctttacatttaagttatctcttactagcattcagtcactttctccattctaaaatattttttttcctgtatacaaggaaaatcc

SEQ ID NO: 8661 - DNA, 787 bp, artificial
  synthetic oligonucleotide
taactggttagggggtttgggctttgggtgctattgttttctggttgcatgacctttagcaaattttttaacctctctgagacccatttaaaaatatttcaaatggctgttataatggcaacaacatcattaggctgtactgaaaattaagtgagaacatgcatgtacagcatttagtaaagtgtctggcactaagtaatcaataaatgttatcatcatgttcctttattattggctttttcaagaccatcagaagaataataaagggtttggggctgggaagaatgtagtgtttcaccttagatgacaggttctattacgctgcagcattaaaagggttcagtggtggtgcaagaactgacatacatattaatgggacagaatagaaaaataagaagcagaaccaagtgtacagagacattgagaatttcataaatgtggcatttgctgttacttaataattcatagacgctaagaattgatgttgggtcattttaaactgttcactaacaaaagaatgggaaatcttattctcatgccatatgatataatgtgaagcattagtacacaccaccacctatctatccagtatgattgcagttccataaaatgggtatgcagctgtacacatatttgcatgtatgtgtatatttctagtttcaatgagattcaagaaactatgaacactgtttatcaatgagagtatgattggaagttacttgtatctttttatacctgtctgtacttttgataatatcctaaatgggcatggattatttttacaaac

SEQ ID NO: 8662 - DNA, 885 bp, artificial
  synthetic oligonucleotide
gttacttatccaacatatcaaatatacaaaatgttatagagagctatgaagtgaacacttgtgtatccaccacccaggttaagcaataaacttgacaaatgtttgagcccatcccctcatttcacttgtccttcctctattcctcagatgtaactcataaccagagtgtggtgtttatattctccataaattgcttcataattttatcatgaataaaagcattcttaaagtattatatatatgttatatgcatatattttcatactgtaggtgtctttattttccatatgatcatgatgtatatttccacatatatatgaatatatggtctgattcttataggtctagggcatttattttcatgactatagaatattctactgtaagaatgaacaacagtgtattttttggactaatggtactggacatttttgtttttcctatagttttgctctcacaaacaatactgaagttaccacgattacagatgaggccatgtacggacatgccagacaatctctagtttcttgctactcaaagtgtgatccatgaaatagtagcttcagcattacctggtatattagggatctaccaagaaatgggtgtgtgtgtgtgtgtgtgtgtgtgtgtgtgtgtgtgtgtacttttaaagaaattagctgccatgaatgtggagcctggaaagcctgcagagaaggctggcaggctggagacccaatgaagagctgcagttcacatctgaaggcagtttgctggcggaattccctcttcctcaagggaggtaaatctttttattcctgaaggccttcaactgattggataaggtcaactgacgttctatagggtaatctgctttattcaaagtctacagatctaaatggtaat

SEQ ID NO: 8663 - DNA, 1009 bp, artificial
  synthetic oligonucleotide
ttgcatgacctaggtttgaggtttctgctcttggatgtggccattgaaggggagaagggttcacatccaaccagtggctttctccagcacaggggtgacaggagggtgggatcataaggagtcccgcatagaggggaattctgagatcattaatggaatgatgccattaaagactcatgagcagataactaggatgaatggaatccatatttgcaaagatcagcagcagctatgcactaaggctgagggcaggagatataggcaggaaccccaggggtaaggggatcagttggaggcaagttccgggacgaactattaggagggcagagtaacacacaggtgccagagatattctgaaggaaggcataaaagttagttggagatgagggatagaaaagggcctctttgaggccactcaccctggagttcctgcagttgcttctggactccttccacactgaggttcctaggctccaatgaggacagggagggatccaccacccacccacaccagcaacccttgtaagaagtgcaactttgctgggtgactgtaatctcagctacttgggaagctgatgctgaaggactgcttgagcctaggagtttgcacccaggagtttgagttcagcctgggcaacataatgagaccccaactctaaaaaaagtacaccctgttggaggtgtccataaacttgatgccatcatatgcaatgggcaggaaagcaagtgacatatgggaaataatgccgattctcagggatgagccctttggattccatagccccaggctccctgccaccctgtccctaaggagagtgtgccaaggcccaaggaaatgaacagagcagctgtggctggactctcctggctgtgactgccatttgctgctttctgtcctaatcaaactttccactccatgctccacgctattaacacataaatgaacaatgtcaagaataaaagaaagtcatcactgcagatctacataaaattatagcatgatgccatg

SEQ ID NO: 8664 - DNA, 287 bp, artificial
  synthetic oligonucleotide
tcaagtttgtttgcggttagtgagtccctgatttgaggctgatcatcttgaagattttggacttcttgcaaagctaaggactaaacccaggagagtacatattcacaacaacctcttttaggaaattcgtaccatcttttacaggtgctggaacttaggctcagattaactttgccaataccatatattttgagggtacccaagttgtgcaagataagcaggagtcctggtttcctctggattagtggttctcaatgctggttacacattagaatcatatggaaaaa

SEQ ID NO: 8665 - DNA, 1054 bp, artificial
  synthetic oligonucleotide
aagtataaaccttcttctaaaatgacaatccttcaatattttaagacagcattatttatttaggacatatttattcttccctccctctctgccctatttgtgaattaatcccagtatgtcataatttctaatccttttttagtgttattagtttgcctaaatccctgccactcataaggtataacctaaacacaatcactttaatactgtaataacaacaaataagtaaaatgggaccacctttttcaccctgctattaactagctgtgtgactaagaacatatcacagcctttcagatttctgtttctacctgactttatatgggttgatggagatcaatgaaaaaatatattttagatgggaatatatacggaagcaaaattttggtggggtacttatttttttaaattgtggtaaaatccatgtaaaatttactatctcaaccattttaagtgtacagctcagtagtattaagtatatttaactccttattttgagtatttatcttctattaatacagtctacaatagcttcaccattttttggtggtcatatcatactgttgactcatgctcagctaactttcgattaaatacgtggttctttttgatctagaactggttaaaatatatccctctaggacatagttagatagaaattctattggatcccaaacagatctaatatatacttatattttttattttaagtttcaccttcttagagtcaaacaaccatttccaggctttcaagatctttttggatcttctagaatctgccaccaggaggctcatggaagaggggtttccactgagaacaaatttataaaatgggtgttgttttccagaggctactgtacactgccacattctcctcaggttgcatttcctctaaatttgacatgaatttgatgatgtccactttctaaaagtcatacctaagacttggagaggttaaacagtttgcccaaagtcacacagttgataagtgtcaaagccaggattcaaatctaagtctgcccaagatttccctgagctcactcttagaaaggct

SEQ ID NO: 8666 - DNA, 3408 bp, artificial
  synthetic oligonucleotide
cttccgtcacaccattagatttacagtataatttgcttcactgtgcctgtagtatataaaatactatgagctacagagtacagatttataataaacaatggaatggtcctgtggctcaggattctgactagtaacatttaaaactgcattccttcccttatttaaatattttataattttactatcaagcactattattgagttgtttagtatagctgtgtttaatttgtccgtatatccttaacactaagcatagtgcctggcacacacacatagaagtgttcaataaatgattcctgaatacatgaaaggttacccactagattttctttttctttctttttttgtttgagatggggcatcgctctgttgcccagactggagtgcagtggcactatctccggtcactgcaacctcccactcccaggttcaagtgattcttctgcctcagcctcctgagcagctgtgactataggcatgtgccaccacgcccggctaattttttgtatttttagtacagacagggtttcaccgtgttagccaggatggtctccatctcctgacctcgcgatctgcccgcctccgccttccaaagtgttgggattacaggcgtgagcctccgcgcccagcctacccactagattttcttatggtggtcttactatcatttgacttgaaactttactgaataatatggagacaaatgatagtcttgttagggcattgctacacaaacggattaatagctaaataaaaagccagaaggtcttccaatctaaaacaggataaatttgatatattttttcttaaaaggaagaggtaaataagcaattttttttttactatgaatatatcagaacattattcctgggtgaaaattcatttttgagccattaaacatttttgaaaaatgaaatatgaagtgtcctacaaaatctcataattccctttactgtgaattctgagtgtatatgtgtcttttcagatggcatttcttttctttctttgttctatttctaggtttactgctcaatgtcccatttgtaatctttgaaagcttctaatattccgtttgctagtttctaatctccattgacatttgttcattatccaccccaagacagatgaaatcctcaagaataacagctacagttcaaaatggatcagcaaatgcttttccaaaccacttttaatgatcctataaggagtggatttgcaataactgaatcttgacaattctttgacatcttttagggcaatctctttaactaggacttaaacaagcaaaagatattggcacaccaccaagtaacattttcctttcttctcctttatctgccatcataattgacaaccatttatggcatatatatatatattctatatatagagagagattatatatatatatatatatatatatatatatatacacacagagagagagagagagagagagagagagagacacacaaatattttgaggcctaatagtgtttcgaacagtgcaatatataaaatgtttgccatttgttaagtgaaaaggtgagagaattttagtttggactgaatagtgaatgaaggatatatagctaaaatgaaatggtaagagagaatttttaggttaacaattatatttggtttttcatatgctagtaaattgtctcaacactaactcaacatagatctcattattcattgaatgtcaggtgataactatcagaaaaggtttcttacgatttatgagttattgttctagtgcacagccatggaaatgtgatggaaagactatcaatcagaacagcaaaatcatggttgatactttcagatctgaaatcaaccctcggagtgtggggagttttactcccttatttcaaaaatgtcaaaacccaaatcgagagggcatggggcctgttcagggtcacaaagtccagtgaattaattagcaggtgaacctatgttaactgcatcacactcctatgccagggtgctcctcattttactgcctacagcaataacataagtaaggtattgctcctactttatgaaattagctctctgaaagcctttaatatttgcatatattaaaagatactgcaaacaaaccagttgcatctccaggcaaaaagccatatttttttttccacgagatactggtcttaaaccttactgtgaacagacgatgagagccaaattgaattgtgatcttgatgcctataaaactgctcttgcctactagctggttatggacataaaggttgatataaatttttaaaatccagatttcatgtttccatccattaaggctgattgaagacactaaatggagtctttcaaaggttgactttagtaagagagttgataaataaaacattacagtgtacttctaacttccatatttaataagtggcatttatgtaatgtgcctatacaaatattgtaagggattttttttctactttgccattcctccaaagtgaaaggtgtgaaaggttatggaatagcacacagggatatatcatttaagaatgtgaagaagagattatttttatgcgataattttaatggagtatcttcctaagaaaaaggaacttactttcctctattttggtgtccacaatctttcactttggaggcaagttagcaacataaggtaacacagcaaattctggaaattaattacgaaatttacatggcaaaatgctttactgggatgctctgcagtggaatggtctccaccagctaagaacatttcccaaactgctttaaaacacatttcaatggcaaattttacagtttgctattagtaggctgtttacaagtatacagaactttgtgtgaataccgcttatattgatacagtcaagaaatatctttttatgttaggagtaatatgtgttggtaggtacaacagaacttattaaagccaaaccaccttaaagatggacctgtaaatcttgctttactaggtcacatcctcaaatagccaaagaaaactctccaaagtgattcctgaaatctgtacttctgccacactctcttcctctctttccctagtagagtcccctccaccagaccttaccttcctaaaatccgacagatcctactttaaagctcaagtatacacttgtaacctgcccaaatttctaacgccatctctctgtaaatattctacttctagtttctacactgcaggacgttgaacaccaaagggggtttactcccccttatttcttcggtatttcctcttttatctccgcccctttctccatcggtccccgttcccttatccttgaccctcttggcccacagcacttctatcttgcctcctctctcttccaaatcacacctcagcttcctacagcacactaaggtgtcctggctgggagagaaattatgtggtatttt

SEQ ID NO: 8667 - DNA, 503 bp, artificial
  synthetic oligonucleotide
tttgattgttttcaattttcacaaatatttatatctttttctaggtagcattctgggacttgtttctgcttttttttccctcaagcaatactcttacctcagcctctggagtagctgggattacaggaaggagccaccatgcttggcctgggacttgtttctttcacgtaacattctaagattcatctatgttgttgcttgtagctgtagttatgcactgtcgatgctgtaggatatctcacccttttccttattgatgggcacacctcctggtgcctttgtgcaagtctcccttaagtattctctcctttccagtcttagatccgttgctgtatttcaagtcctcatgatatatggtcagacgtatggcatccaccccactggtcttctttcctctgatctcaatccctccaatctattaccaagttgttgccagtcgtcactggctgtccagtgcttattggacaaagtcaaaagacacagttttgccctgttagtctccc

SEQ ID NO: 8668 - DNA, 1437 bp, artificial
  synthetic oligonucleotide
gtagtggtacggctgtgattgggcataggcaggtccagaaagcacagtgaaacgattggagaggggatccagacttccaatttatcaacactgttgcatcagagcctcaggtctcagctcacatttacggccatgggagatcccttatgactagctgatggagaaggaaaatgacagagcctgattcatggaggggttggctcaatatgcgggtacaagctgaaaatggaatgctgctgcactaagcctcactcaaaggtaactgaaagacatccattttaagggcaaagcttcccaatatgcatagggaataccagggcagagcatctggtaatttatcttggttcaaggagaattggctggaggtaggtatatatatatactcacaggcagtggaaaatgacttgtcaggttggtcagcgtcctggaaggagaaatatttgaatatcaaatacagtaaagtctggggagaaggcaggcatgtggatggactaatgggaataggcagaaagtgaaaatctttgtattgcccattaatgtccactagagagcatctaccacagaaaagatactaaacacttaagtagacaggataacccagccagttaccttcagccagtctctattagcagtctattatggtgctagcaaaatgggtacctgaagggagtaacccctaatgacaatgatgaatactatgcatggggccaacagcatgggtttcccgaatccatttttctatcaagtgatcccactattatgctgtgtccctctgtaccatcttttggaactcaatgggaaattttctcctaaatcacactatatgataaaatcggtgattaggaaaatacatgaaataaaagaaaatgataaaattattcttttcttctttactaattccataaggtaattcatcctataaccactgaatattgaaaataatgtgataagtctctttctcttccccccccgccgcaaacacacacacacacacacacacacacacacacacacacacacaactttccttgaaaaatgagatactacttatcaaggaacaaattcagtactttggctgctggaggggccactggactgaattcaggaaacctctctgggttccagtgagagatctaacccagtaactctgcaacaaccttgtgtaaatcccttcacctctcgtttttagcttacctgtcagcctgaattttatctatcctgcttctcgaatatccagaattgtgcaggagaataatgtgaggattagataaattactttatttaaacatcttctgggtcatcacattgaggcatgatggcatcaaaaggcacactggggctaattactagcaagagcagaagtcttggattcagtagccctaggtaccggttccagctttatggtaaggatgtggaagtggtttaaagcaccctgaa

SEQ ID NO: 8669 - DNA, 1483 bp, artificial
  synthetic oligonucleotide
gggaagacatagggatgtgcacagcagcagaggaatatcatggaggtacatacaagaggtggtaggactcatttttgaatacaggtgagacctattcttggctacccttcaggaataaccattgcctgctttttagtgtacatgctttcagggttttctttgcgcagaaatgcattatacaaacatttacatttttataaatattggctgataaccgtatacgaggttctgcaaactgttctttatttatttattttttacaatgtgtcatgaacatcttttccatgcacatgggtgaaaatcctctactaaaatatagagcgctgtagttgggtcaaaaggctgctggtaacgagattgacatctaaagcaaaaatatcagcttaaggttaaagcattgggcctggcaaatatctaccagggaaagcagggttgacaataatctcatcagagaagtcagaatggaaggccaaaggcattaaaggtatgggatatcgtgtaagcctctttggcccctacctccacccctcactcccctgacaccccgttgtccccttgggcgaatggatcctgtacatctctttgcatccaatgaaaaccacccattttctgttttttccttagctcctcctgagcccttgacacatctccacattctctcatcatctcctcactgctcagatgcctttcctgtaagtcctcctgagagtccttgggggaatcgtccgtccccctgtctgtttttctttttgctttccggggcacataatctccagccgggcgcttttcggcggcccgcggctggccctctggctttgcctgggaggctggcttgccctcgccttgtggcttgccctcaccttcggacttgccctgcttttcctggcttcccttatcttccagttgtccctcatcacctggctctccctcagcctttcgctttccctcgcattctgtcttcccctccgcgtctggcttttcttcctcgtctgactttccttcatcatcaggctctacttcatcttctggctttccctcgttttccaggtttccttcatttttattgtagggtttttccatgtcgagatttctctttttcctgtcctgggggatgacagtggagggaagaggagacaaataagagacatgggagactgagggcatggggtggaatgcaggtctggatactacttgcatctcacccctggtgagggttcccctaagctggccgggcctccaagagggccttctgcccagcacgtagcccaccactcctcccacacacgtgagccagccataccctggcaggccctgccaccttctctgaactgattcagcctggtaaggtgtgtgttcacgtgggtggggttatgtgcaggggtcccaatttggccttggccgggccctccacactctcaacccttgtgggcccctgtccatgcagccccctgctttcacggacctgcggggagtctggacaggt

SEQ ID NO: 8670 - DNA, 781 bp, artificial
  synthetic oligonucleotide
aatataactttctgaagaagaagagaaaacctgcctgagaaattgcaaagagagaacatgaagtgattagccatacaattgaacctaatcacacgtgaagataagggatacatagagagtggactggagagtggaccactgagcaatccagccggatttgcctttcctatgaatccctaaaccttgaccctaggtaatgtaggccaaaaaaggcctagtttatataaaatttatagaagggccgggcacggacgctcacgcctgtaatcccagcactttggaaggccgaggcggtggatcccctgaggtcgggagttggagaccagcctaaccaatatggagaaaccccctctctactaaaaatacaaaaattagcctggcatgatggcgcatgcctgtaatcccaggtacttgggagtgaggcaggagaatcgcttgaacccgggaggtgggggttgtggtgagccgagatcgcgacattacgccccagcctgggcaacaagagccaaactccgtctcaaaaaaaaaaaaaaaaaaaaaaaggcaaaaaagaaaagaaaggaaatttatggaaaagatattgttgtaatttacctaattggaagaagacttggaaccaacctgggagctacacttcccctcagaatcttgccacaaacaagacgcaatcttgtgggtggggcccagcgtcttaacggttccttctcaaagcagtggggagaggacttcaattggctcagcttggtcaggtgacctcctttgaccaatcatctccatactg

SEQ ID NO: 8671 - DNA, 4170 bp, artificial
  synthetic oligonucleotide
ttcttctcttaaatttgttcctacatactttcttcttttcgatgctactgtagatggacttattttcttaatttcatttttttggattgtccattgcaactacatagaagtacaaatgatttttgtatattgtatctttcaaccttgctgacctggtttatcagtagtttattgtggttgattctttcagattttacaaatggaaggtaatgtcatttgggcattatgccatttaaaaaaatatttacatataccagtataaaagtatgatacctttttcatggacccactttttttggaagcaaaatacccagatagttatttttccaaattgcatgtgagtttccattactcattcctctgatgtcccaacagcccccatccccatgtactcccagcactcacttctgagaccactccagtttcatcccagactgggcagagaaagcctgcaccatttcctgctgctcctgggagagggagggctcagagctggaggagagtgtggacactgggatggagaaggcactctgagtctcttgggggctggcatccctcacaaacagctcgtcattcacgatgcacagactggaggaaagaaaaatgcaccctcaaactggacaagtagataactccgcacccccaacaacaggatccttcttaaccactgccactcaacaaccaaattccttccatatccctaactgtgcctgcctcccagattttttggctggtaccctctaaccctcccacagagtccacctttggagggactgtctaccagcttcactagatttttagatccaaccccaacgcatttaccctgtacaacagcccaaggaagtggatagtcttattccaattttcagaaaaaggcactgaatcacagagtggtcgaataagttgatcaaggtcacacagtttgtgagtgttggagtgaggaacagaatctgtattctgactccagggcccacactcttaaacactaggctagactgctccttggatcttcctgtcggccttccacaatattgagaacacccggaggactgcacccaccacatttccacaacactggccccaagcttggatgggtgctcccacccacaacacagcactaacctggaactgctgccaggggtagcaatgaaggtccgggtgaaggcgagaacagaaccctgagactgtccttccacttcaaagacaacaaacaccaccaccttagagttgcacaggctttaacatgctcacacggtgatccccagtcagagtattgcttgacactcacacagaagggggggagggggcagaccaggacaattgttcacttggagtcaggcggatgtggcaggaatggggagggcagcaacaggaacaatccgctcccagtgacagggcccctatcatgtgtggggccctgggaaaaccacaagttcacttaattcctatttcacagtagcccaagagatagattattagccccattttgcaaatgaggaaactgaagggttaagtaaccagcacaagttcacagagtaaggacctgggatgagagctgtcaaactccacagtctgtgtccttaacgcacgcctgagctgtgcagggcagacaggcatggacctaggtcagatcagggtggtttgaaggcagagtgggggtgggaaaacacggaagaaagaagaggaaggaaaggaaaggaacgaaagcagggaagctgggggagttctgagagggagcccagccagggggagggagcagtgggggatctggggaggggactatacagacactcaccttccttgaaaaccccattgacagaaaagcagagcatcctttcctgaaaaggaagcgctcaggtgctcaggatcctccttaacctcctacccacctctggctctctgggcctgcccaagggaggaagcaggtgctcaccgtctggcaccacacgtccaccaggatggagctgaggtcatgctgagttttgggcaacgcactgagggagtccacaatgtcacgttttgtgcgcctcagcagttcccccttcaggtctgtagaggagaggagaagcaaggaatggcagggtgggcggggcagggcggggggctaccacatcctggtccttggcccctgtgattgttcccatcacacccccttaccttgcccactcttccccatcacacacttacaggggtccttgagtgttttcatattcctgctatcctcaaagtacttgcacaagctgctcctaggagaaaaagaggagcaggagtgggtggtccggccagtgtgggcatttccaggagttggcctgtgtctgctggggagacacacagccccagagcagagtctgagccgtgatactcacggggctgagtccttggggtcgaagggaatagccaaggagaagcaggcctcatcgtggtaagcaccgaggagaccctgtcgatctccagagtcatagatcgagtaatacctgtggggaagcagtgaggataggctatctctgtggcctgggccccagatgagacttgaaaactcccaggctgcacgggtggcccagcctgtctcagccctccccttcctcatggtcccagggatactcactgctgcaggaattgcaggactaaatgctttagggtctcagatccagtaaagttttcctgaaatcaaaagacaatttggatctatgcggtggacaaagcctcccttacagcaacccaaatcttgcttggtccttcttcctcaccttgcagggtttcattgtctcagagctgtcaatgtcaacaatcactggtgcggataactctcggccgtcctggagaaggaaagaggaagtcagcagtggagaccaaggagatggagctggatgatcgataagatgaacatgcccagggagacaagcatcagaggctaggtgggaaatggccctggaaattccagtgggtggctttctcatggggtgctggacatctctactatcacatgcaaatgtgtgtgtgtggggggggtggcggcggggggacacattttccagggagaatattcttgtctttttcaggaatccatgcctgtaaaatggatgagggtctgatacaagcatgtaatctaggcaagacccaaaggacttgagggcaggcgtggaggtccttttcttgagtaagaggagacaatgatgacggtattatacatacttaccaggcgtaacaacttggggaaacaatcccggatggcactgtccaaaaccaaaaattgaatgaagtgactgacagttcagggttgcacagtctctctcccactccctctcacactcctccctctccttcctcctggttagcttccatctagactgtcctgactcccttttctccagtgctacaagaagcagcactgggagcccaggctccagggctttcttcctctccctccctcccctttgcccaagtcaccatggaaggctctgcagggagcaggaaatggggtgggagcccagggctctgccacctcactggctgtccatcaacctgcctgaccaggccctggccaagaccaggtcagcccttagggatggcccaggatgctgggacacggaggtgagtgaggccggactcaggaggcaggaagcggaaggcaggggggacaacaacagaaacggggtgaaggtaggggagggacggatgggtgagacataggagaggagagacaagggagaaacaggatgcaatgcaaagggaagggaaagactctctactgcggaggtggagttcagggaggagaagaggagaaaagggctcccctgctgcagccctttccctcactgctccctggctggccctggggaccgaggcaggaaaggaaaacatgcgcctgttgggctggggcccactggatgcagctggagccttcctcacctgtgtgagctcagtctgagctgggcatgggaaacagagcagccacggggacaggagaccttctcccgggaggagtgaagagtcaggccccagctcagcatggggttcagagtctggggaccccctctccagaccactgcattctcttctgatggtccctgactcctgtgcccctctgtgctgacgccttgaccgaggaatgctacccatctcgggctacccagggctcctctgagggcccaggcaggacgatgtgaggtg

SEQ ID NO: 8672 - DNA, 969 bp, artificial
  synthetic oligonucleotide
attggctacctctgacttcttagccagggaacataggtgagaagatatccgaagacgcctaaaatctctacaaacacatgggtttacaaaaaacaagcctaaaatcaagactctcaggtaatgtcgaaatctgctgttgggaggcgatccccattttatgatgtttgaacacactctttctcttgctggatagctgggaagacaaacacaaaaatcattaaccgtatgtacctaagattaagttcagtttctttcaaaagagctccttgctaagtcatcgaagtctgcatacatgccttaaatttagaatgccaaggcattaaccacaaatcctcacattagggtgtgtgcatgtatgtgtgtgtgttaactacctgaatattcactacaatctataactgtggaggattttctcccatttaagagatagagacatgctgttgccattttttcttagatgattcaagactgagatacgaagcaatttcttcggatttatctatccatatacaactaggaagttataccttttcagacaattttgactaactttggaactctcaaagctaacaagacaaaaagttcccctcaacttttgcaaaaacacttggagtttctccagaaggctgtatttctggagggcaaaactgatcacttatcccttgagtctgtgagccctacgtgcacccaagatctaaacttgttcattgtctttatctcatcatcaggtagagaaggccaaaactgcaaagtttgcatggatctttaggtataagaccactgacccaaactgatggatgcagaaaaatgtctaataagcataaagtgaacaaaactaagatttttctagtgctaaatccaatattccaagattgatttttaaggtggtttttagtaattttccaacaagaaactagttttcccccccattcctattaagacttatgtgagaactacttatataaccca

SEQ ID NO: 8673 - DNA, 1915 bp, artificial
  synthetic oligonucleotide
gtttgtggaatcgattagtatgtatcctcctatctcagtcttgactctctttgctgactttcctaccctgggccccaccccgagaccgcccatttcagtgggcctctgtgtttggagaacgaacttcgaaagactggaacacttccgcctgtcaggccagaagagatttcctgacaccacagctggaaacccatgtgcatttcagttcaggaaagaatggtaggcttggtggggggagctcccgcaaaaggggaactaatacagaaacactctggtatttgtctgcctctcttgttccagcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaactacgctctagctcctcccactgccgttgtgggtaacgcggacgtggaagaacctcgtctgcggaggaaaaggtagatgttaaatggtaactacgcgcgaggttctgaggagccctgggaacaggaaggagaaaagaataccaaaagtgacaacagtttgccaatcgcagtctttaatctgataaagcggttatctcgtcttgagtcccaggtgccgagtcaatccccatacacagccgccgccattgcctcgagtccttgtgtctgactgtctgttcctgctgctgtatgacacagcacctcgaggcaaggaaataagaaaactgcctctgatccaagcagagaaggtcagtgagaaggtgcgcatcgcttgggggtggatgtgggtatcagaggtgaacactggatacgcgacctggtcatgggaggcgggcggtgagaaggagagagagatgggtaattggaatggcacacaacaattaaaaaaaaatgatctaccttttgctagcttgatttccatacactcggttcacctcagaccatgcttgggaagaaaaaggttgcagcttctagcagggaaaaggcagactagatgaggaagagagggctacttccacaggcgaggacagttgtctggggagccctgagagggagagaatgtaaaaagaggttgtaaatgtttgataatcaaggctctggatttgaaaagggtctcatgtcttggttactggtctgaccattaataaccacgtctctctctctgtcttttcatttgttctttgggtgtgtatcacgcgtttttatgtgtaaatctgttcctaagtttgcagcactccatgtttctgtaaagatctgtaggggacagcagacctcaaggggagaggagaaggaaaagaaaattggcctggtttgtacagagtgggcagtacttgggaggcagtacttggaggtggtagatggctaagattagagtaggcaggagtgtaagggagcctccagaactctctgccagctttcctaacatgtcctcccttacccgcattatgttgcagaaaatgataggctttgggagagaggaaggaaacataggaacccagatgaaatatggaaataaatacttttcattttttccccagcctccgtggtttgtctaggcatttcgtccctactaacaccactactactaccttgtagggatgtttgagttgtctctgtataggaattgtcagactttgagaatagagcagaggggcttggagatttaggagtgggagaaaaaggggagatagaaaatgtttgccaaacaggtacttatatccagaaagaaactgtgccctaggtgctggtctctaccaaaaacagcctcaactgtctcctgtgtcttcatttattggtctctgtttttgtgaatccctgtaggtagatctgtccccaggtctgtggaactgtcagttgtgaagtt

SEQ ID NO: 8674 - DNA, 1206 bp, artificial
  synthetic oligonucleotide
cccctggcagaacgcagtatagtgccacaaaccaagtcaaaggccatgcctatgtctagggtcagtactgtaaccaagtctgaagtcaaggttgttgctgtcattgaggcaaatattaggtcctatgccaagtcacatgataaggccaatactgggtccagacctgacagaagggaagagaccagcattgggatgaaatccagtgatgaggatgaagaaaatatatgctcctggttctggactggagaagagcctagtgtagggtcctggttctggcctgaagaagagacctctcttcaagtttataagcccctacctaagatccaggaaaagcccaagcccacacacaaacccacacttactataaaacaaaaggtaatagcatggtcaagggccaggtatattgtcctagttccagttgaaggaggggagcaatccttgcctccagaaggaaactggaccctggttgagaccttgattgaaactcctctggggattcgacctttgaccaagatcccaccttatcatgggccttattaccagaccttagctgagatcaaaaaacagattaggcaaagggaaaagtatgggcctaatccgaaggcctgccactgcaaatcacgtggctttagtttagagcctaaagagtttgataaacttgttgccctccttaagttaactaaggatcctttcattcatgaaatagctacaatgataatgggcatcagtcctgcttatccatttactcaagatataattcatgatgtaggtattactgttatgattgaaaacttggtcaataatcccaatgttaaagaacaccctggagctttaagtatggtggatgacagctctgagtcttccgaagaaccaaaatcaggggagtcatatatacatcaagtttgtaaaggcataatctcttgccccttgaactcccctgtgcagctggctggactgaaattactagggcacttgagtataaaatttgaagatcactatgtgattaccagttatattccagatttcctcaccttgttaaacaagggaagtgtcaaaaccaagttttatgttttaaaagtgttttcgtgtttgtctaaaaatcacgccaatacaagagaattgatcagtgccaaagtactgtcatcattggttgcaccctttaacaagaatgagtcaaaggccaatattcttaatattattgaaata

SEQ ID NO: 8675 - DNA, 1494 bp, artificial
  synthetic oligonucleotide
ggagttcacttaagagcaggtgtaccttcctcccctgcgtggctccacgaagctgggaaagaaacgcacaggacgaccaccctagaaccccgggcctgtctggactgaaatcgcctctcccctcccacactgcagtgctgacaccccctctcccattaacatccaggaaggagggtgagcagactagggagggggagagggcaaacacccagcagtccttataggggggcggttggggcgggggtgcagacacaccaagggacggtttggtatccatccgctgctccctccagcgcggctcttcgcgacctcgcgatcctgtcctccgcccggccccgcagccgcccgccggtgccatatattatagcagcgccagaaatgtggtggtcgtcgccacgttagggtccgcggggtcctcctgaggcagcctggtgccaacccgcaggccccggctggggctcgtcctggccccgcccacctctgggtcggaactatggtggttctgtgagggggggcgtcctgcactttcgcgccgtatccctccgccccccttcccgacaccctcgcggagagcggttcttgccgcatcctgcgcagcccctgcccagtttggtgcagaggcgtggggggcgggactcgtctttgccattcggatcgctgggaaagcggtgggaatccaactgaagagcagccagaggagagctgaagagaggagggggaggccgatgacctgggctctgggcctctgaaggcaagtaggggtgcgtgaggtggggggccgtggtgtgggggtggtccgccagggtggaccggctggcaacctgccccccggaccctgacagcctggcaacgaggagacgatccgttcggagccgggcgctagagagaggtgcgcagtgcccgagatccctggctatggggaggcggtgactggtgcgggccaggccggaccaagggctgaggggctggctccagaggcaccgtcagatcgtctggaggagaaccgcgctgaccgcttcccagccagctttgcaggcgcccgcgcgcagccctcgacggtttcggtaccgagagacggctgtgggggaggctcctgcgggagaaatggccaaacgggagccgtgttggggggcgcccgggaggcagttggggggcgcctgggggggccctcgtgggccagcgtcccagctctgtgcctagcccgtgggaggtgggtcgcgttcgctgctccgggccctgattccggaaaggggcctgtggggccccgtgtcctgggtgctgtcccttcccacagactccaggttgatgtcaaagtctgtctgcgcggtaggtctggcgtattctgacaggacacagtgagcatctgtagaggagaggcttgaaataaaggaggagcacgaatattccctggatttctggaggtgtgtggggatgtggggtgggtgccaaacactggagaaccgaatcggggtgggggactgcgaccagagcagg

SEQ ID NO: 8676 - DNA, 1480 bp, artificial
  synthetic oligonucleotide
gagtatattacctgactttctttgtaacttgtaccatgactggggcagagattgagcctagtgcccaggccaagcctgaaaagaaggctggggaagaggttatcgctgggcctgagagagagaatgatgtccctctggtggtcagacccaaggttaggacccaggcaactactggggcaaggcccaaaactgagaccaagtctgtgcctgcggcaaggcccaaaactgaggcccaagcaatgtctggggcaaggcccaaaactgaggtccaagtaatgggtggtgcaagacccaaaacggaggctcaaggaatcacaggggccaggcccaaaaccgatgccagggcagtaggtggcgctcgttctaaaactgatgccaaggcaatccctggagcaaggcccaaggatgaggcccaggcatgggcccagagtgaatttgggactgaagcagtgtcacaggcagaaggagtgtcccagactaatgccgttgcttggccactggccactgctgagtctggatcagttactaaatctaagggcctgtctatggatagagaactagtcaatgtggatgctgaaacctttcctggcacccagggtcagaaaggaatccagccctggtttggaccaggggaggagactaatatggggtcttggtgctattccaggcccagggccagagaggaggcctctaatgagtctgggttctggtcagcagatgagacctctacagcgtcttctttctggactggagaagagacaagtgtcagatcatggcccagggaagagtccaataccaggtccaggcacagggctaaacatcagactaatcccaggtccaggcccagatccaagcaagaagcctatgttgattcctggtctggatctgaggatgaggccagcaacccattctccttctgggttggagaaaataccaataacttgttcaggcccagagtcagggaggaggcaaatatcaggtccaagctcaggacaaatagagaagattgttttgaatctgagtctgaagatgagttctataagcagtcctgggttttgcctggagaagaggccaatagtagattcaggcacagagacaaagaagatcctaatactgccttgaaactcagggcccagaaagatgttgacagtgatagggtcaaacaagaacccaggtttgaggaggaagtcattattgggtcctggttctgggcagaaaaagaggccagtttggagggtggagcttcagcaatctgtgaatctgagccaggaactgaggagggggccattggcggatccgcgtactgggctgaggaaaagtccagtttgggggctgtggccagagaagaggccaagccggagtctgaagaagaggccatatttgggtcctggttctgggacagagatgaggcctgctttgacctaaatccctgtcctgtgtacaaggtcagtgataggttcagagatgcagctgaggagct

SEQ ID NO: 8677 - DNA, 3001 bp, artificial
  synthetic oligonucleotide
aattggcaacacattctccaaactgtttcacgaatgactctaaagaataacatctgtttggtcatctaaaaaattaggagctttaatttttaagaaaggaaaaccaaaatggtgatagatcccctttgcccgtaattacagctctagaattctcagatggtgactcagcaagagtggtaggagggagtagggacctagacttgatggttgtcagccagagcttctggaattttccacacattatcagcaatcttgtgtattcatcactatctgggatctctaagccccaagataggaagcccagtccttttctgagatggagagaaagctgtacctgggagtgtgtgtttggcgtgatagagtttgagccctaaatacacaaacacatacaatgttgttgtgttttagccatagacacacacacacacacaaatacacccacacctactatgtctaggcaattatttcaaactgctgcttctcccatgagcaatatgttttgtacatattccaaaaacagtaggtgtatgtgtacgtgtttttgtcaaaccatgtacaatttaatcttaaaattattacctcagtggttttctcgattataacatttcaaaaagtaaagatatgtatttataaaatgaaatatatatatatatggagagaggaaagagaaagtgatagaaatgattactacagtgaagcgcattaacatatccatctattcacatagctatcatttttttgtgaacgcacttgaaacctactctcttaccaaatttacagtgtacattatattactattaactgtagtcatcatgctgtatattagatctctaggcttatttatccttcatagcttcaattttatacctttgaacaacatctcccctcttccccccatctccactcctggtaatgacagctctatgcttctatgagcttgactattttagattctacatgtaagtgaaatcatgcataattcttctttctatgtctagcttattttacttagcataatgtcccccaggttcattcacgctatcacaaatagtaggggtctcctttttaaaggccaaaataatattccattgtgtgtatgtgtgattatatatatacacacacacatatatacataaataattatacaatgtaatatatattatatataatcacacacacgtatatatacgtacatgtatatatatatgaatatatatacatatatgtatatatataatcacacacatatacgtacatacatatacatatatatttataatacaatattccattgtatatataaagtccttgatataaaatggggtggtatttctatataacctatgcacgtcctcccatatactttaaatcatctctagattacttatgatacctaatacaatgtaagtgctatataaatgttgttatacaaattggttttaaaatttgtattttattgttgtattgtttttattttcttttcagaatattttcagtccaagattggttgcattcatgtatgcagaatccacagatacaaaaggtcaactgtacttatttatttaattctcaccacaacctatgagaaggatctattgttgcctgactttagaaaaaaggaaactgaggtacagtgaagacagagttagcaagtgccaaggcttagatgtgaacacaggctgtgtggctcctgagtaaattcatctatccagtgtgtgctgctgcctctcaaatgatgagaaaaatcttgctttttcaggccgggcacagtggctcacgcctgtaatcccagttacagggatcacctcgtgatctcagtgatagataacaccaggtaagcaaagtgtggagtttgcctaatggctcctggactgtttggtatattaatatattacaggaaagctgggcacagtggctcacgcctgtaatcccagcacattgggaggcctaggcgggcggaacacttgaggtcaggagtttgagaccagcctgccaacatggcaaaaccctgtctctactgaaaatataaaaagtagccaggcatggtgacgcacgcctgtaatcccagctgcttctcaggtgctgaggcaggagaattgcttgaacctgggaggcggaggttgcagtgagccaagattgcaccactgcactccagcctgggcaacagagcaatactccatctaaaaaaaaagaagaagaaaaatcttactttttcatcacggcacaacacaataaaacagtgggttaaattgtgtcccctctgattggaaatgtgtatattaaagcatttccatttgctcttgaccccaaatctacctcgcatttatagatttatctcttacctcatcagtaaagtttaggttggggtgttcacagtgtagaggagtccctcccagagagcagagtggttatccttcattaccccaacctgtacaggcttttcagaccttcgcctacccctcttagtctccaggatactgtgaacatagcagcccagaccccattccgctgcccctctcctctgtcagtcacctcctgctggccctgccccacgttatgccttccagccagtgactatcaaggggcagtagagctacctggtgttccatcatatggatgccccagagtatgttgttgttgttgttgttgttttacagtcctcttgcacttttaagtttttttcaggcagaatttgaatcattcgaatggttccataaaggttaataagctaggtttttaggaaggtattgtattttttggtttttgtatacacttctttgcaaaaaagtttgatagtggaggtgcattggtgccaccttgtaacagaagcctgaactgcagcctgaactgcagcctgaactagtgtaagctggaaggtgaaagggagggactgtggtccaaacttacaagatagaactttctggaagtctgggcgtaaaaggtggcatacacaggcaaaaaaagatactgaaggcctctaagcaggaagtacaggttttta

SEQ ID NO: 8678 - DNA, 433 bp, artificial
  synthetic oligonucleotide
cttgaggaaataacctgacatttaacataaaattgcaataaattcacatataattttctgtctgtataaataataataagtgactctatgtatctctccgatgagtgttgaaatacgcagttggtaggaaggtcttcctaacaatttgagattataatatgcattctttcatggttaccacatttgtatccagcctataatgacattttttaagaagccagaaatttataaagtgttagtaaaaaatatcaggcgcaagaattcagtattttcaaaactaataattgccctctagtttaccctatgataatgttactcagccacgttccctaaaataaccatatatcgttaaacatcattatgattattttccaagaaatgatacttttagttacatccttcaaatgacatgtgtatcaactttctctaaata

SEQ ID NO: 8679 - DNA, 987 bp, artificial
  synthetic oligonucleotide
gcaggagtgtggttagcctcccaggagaaacagcaaatgcacaggctctaaggcaggaaagtcctcagcccatttagaactaaaggaaagcagtgtcgctggagcttagcaatgaagggaaagagtacctgtgtcagagtagtggccaagagccagatcttacagggcctgaagggttttatttttttttaactacctgaatgcaacagaggcatttattggatataatgaggggaggtgtatgctctaattatcttgtaaaatgttctggctgggtgcaatgcctcacgcccataatcccagcactttaggaggccaaggcaggcagatcacgaggtcaggagatcaagaccatcctgtccaacatggtgaaacctcatctctactaaaatacaaaaaaagttggccgggtgtggtggcacacacctgtagtcccagctactcaggaggctgacacaggggaatcgcttgaacccaggaggcagaggttgcagtgagccgagatcgcgccactgcactccagactggtggaagagtgagactctttctcaaagaaaaaaaaaatgttccttggattgccatatagagactggattggagaagggtaagaggagaaaccgaaagaccagttcactgattattcagtggcctaagatctgtgatagatacaaaacaattatgaaacataatttaaggcatcatggggtgtgggtgggagcagaacatgggatgcctgtgcaggtccactgttgcatgtaacaactgctggggaaaaaaaattgaaaaattatggggtcctgtcagcccaataaaagtctgagaaggggagtatctgtagagccagagaagttattgtgaggaagatgaatctgggtctgatctagaaaggtggattggattggagggttttttttttgtttgtttccctttgttgttgttgtttgagatgttctggaaagggctagtgaagtaaagagagtaacctgg

SEQ ID NO: 8680 - DNA, 1958 bp, artificial
  synthetic oligonucleotide
actcagttgttaaacatttatcaatacacaactgcctttgtccttgttaggacctccaatagaaagcttatctttatatctgcccatctacatttcctttggttctgtaaatactgtcttttggaattcaaactctcactacctccttcaacgattatattgattcatagcttgtgtggtaaattttattcctttaacattcataagaattttattttctagttctgttggaacagtttactataaattccccatggaatgaaactactttttattctttaaaaaaaatccattttagtacctcaagtatccattagttaatagctaatggatctgtgctgaatgcattttcttcactgggctagtcgaatattaccggcagaacccccttcagctcattctgcattgttttgtgccctgtttttgcatctctccttctctcttaagctgcctcttaccctgcacttatgccatctatttcatagttcctttccttaaaatcttctaaaatttgtccttggtcttctagttttgtttcagccccatgctgtttaaaggatctccaagtctctgctcatgagagcatactattattattatttttcttcctgaagcacttccattgccccacctccatgggactacttccagatgacgttgactagatgaacccaatcttttcagtatcgtattcacagatattttcctgctttatccacagagatggaaaatcatgtctgttgtctatcagatttactcatttataatgctcacaggacatctttatttccaaaatgtgaggccctgaagactcacaagttatatcctccatgtacagtcagttgtccctcaatgtccatggggaactggtgtcaggaacccccaggaatataaaaatctgcagatgctcagtttcttaaaataaaatgacatagaatttgcccataacctatacacatcctcctgtaaactttacacaacgtctagattacatttaataccttatacaatgcctacatataactttgttaaatgcagattccatgtagtacttggcatattgcaaattcaaatttttcttgttgaaactttatagaatttgtttttccaaatatttttgatccacgattgggtgaatccatggatgcggaacccacaaatatgaagggcctactgtatttatattagtcccctaaattttgtgtgtcttgagaaaaaaaaaaatggcttcttggtgacatactccatcccttcttcaatcaaactggataatgaaatggtttcttatgctttttggtttatcctgttgtctcagtcccatgtttcctctaatagcactgtaatacaacttgtcattgaaggtatttactcaatggcaatagtgaatggtaatcttgtaatttatgcctgcatctttccgactttatcagcctgcagccagtttttcttttttttttttctttttgagacaaagtctcgctctgtctcccaggctggagtgcaatggcgcgatctcggctcactgcaacctccgcctcccgggttcaagcaattctcctgcctcagcctcctgagtagctggtattacaggcgcccaccaccacaccctgctagttttcatatttttagtagagatggggtttcgccatgttggctaggctggtctccaactcctgacccatctcagcctcccaaagtgctgggattacaggcatgagccaccatgcaggtattttttttccttctagagttaaacaagttactttgacaaatctgagtacatgtaactatttgacaagacttctgaaaaatgcagatatcagagtatcaaatgattgtttggggttactcagttgtgtgtcacaacccttccttatcctcagactgtcttaaattttcattgcataaacagaccagcttttctgttatcatttgctagactttcagagtctgtgacc

SEQ ID NO: 8681 - DNA, 771 bp, artificial
  synthetic oligonucleotide
tttttagagcattctcacttgtttgaaaattttatgaaaaaaaggagagaaaattttcctgaacacagttggtgttttcaaaataatctgtgaagtaaatcttcaggaaacagttctgttgtcagatcttggccattttatgtaaataatctacgtttttatccttctgggacaaatttcaagttttattaataaacatttctattttattctattataataaacattcattaaatatgaaaaaacatttgctgacaactaatgccacctgctaaaattagtggctatcactgttgatggtttgaagacttaagcaaaaggaagagctgtgaggccaaggcaggttgagtgacgcagagatagagtatccctgccctgacaagaggttgggaaggtgctggtcttccactgttatattcgagagcttcttaattcctatgttcagactcctaattctgttgcttactccaaaaatatagatggacaggtgaccaaggtggtgaccttaatatatcactttggctccttccttctatttcttccccaaattcccacctaatgactcacttctcagcatagttgggaggtctcttcccattctggaaaccagaatagggcttttctacagctctgtggtgagagattccaagaaaagcctagaagtaattgaggaggtgggaggagtggggagcagttctcaaacctgcctgctctcttctctttttcacccaccccggggaaaagtctctttgggacatttttgctatctct

SEQ ID NO: 8682 - DNA, 2002 bp, artificial
  synthetic oligonucleotide
tcctgtgcccctctgtgctgatgccttgaccgaggaatgctacccatctcgggctacccagggctcctctgaggacccaggcaggatgatgtgaggtggagaaggagggaaggaggggcagtgccctgagaggcctgtccttctgtctcctcaacctcctctgccctctgccttccactcctgcctcaggaatgtggcccgcttctggtcccttgactcaggaaacccaggtttctccccaaggagggcccagctcctagcattggccagaggaagagatggcatgacagcagccacccagggcctcggccctcagtatggggcagggaagcccccatgccagcctgggacaggagaggggacctttttggagcaagagaaggagaacccctctcgggacggaggagggaagccccatatcagcatggaggcaggaaggcctgtctcagcatgaggccctggactaaaggactcttctcggtccagggcaccagcacctgaatactgctggtcctggggaagtgggggagccccgcttcctggagcacactcacagagggcacgctagaggaggctgggtggagacaggtgggaaacacatcccagagcgggtgaaaaggggaccatgtcagaggaaggaaaggagatgtctaagcacagatgaatgagtgacacagagagaggagtggggcgagggggaaggagagggtctgtggtcctcccagaagactagtgctgcctcctcctgcagaagggcgctatcaaacacaggtcagggtcccaggtggtgacagagggtacaactgactttatgttgctggaggtatccgagaaggtcgtgcacactgggcttctgtccgcacacttctctcctggctctatccctttccacttgtccatctcccctgcagacatcacctgcaattatgcagaagaaccacgtagacccaggaaagagcagctggagggccctgcaccctcagtctcctcccttgccaacaaatccacttccttgcctcttgtcactaccctaatgaaccctcctccccctttttcttcaaagaactatctgagtattacacctcattttatttttcaagaaattcagcttgttaatgttgggggcctttggcataatgtcaagcatctggtaggctttgttgctgtttgggttcaagggcaaaagctatggggaggaatgaattaagaactaagagtgaaggcccccaacaggggatatcttagaccaattagcctcctagctaatctcttccaccttcaccctcaatcccagcatgagcctaaggcctcactgtaggtatgttctcttcatggacgtccagggaggcagccatgcactttctaggattcgatgccatcttagtatcacggttcaccatgtctccagaaagcagagaggagaaaatcagaagtctgagagggacccgcctggtacagcatcagcactaacccctccccaagttgccaaccgtaagtctccatctcacacagacacctctgccctcatctaccatagaattactttctcagccatacctgggtaaaatgggagtctctggatatcaagagcttcctgggagacatcacactgttggttcatggccagctgcagagttagagatgggtttcagaggctctgaagttgaggtggtgaagggggcaataggtggggaagaagcagtgggtctggctttgtgtgaacaacttgccatgagtctgtgttacctttatctgctccaccttttctgacttcagctccctgtgcacaaagtggggtatgccagcagggttgacaaagattgatatctgcagagaacccaagaggggctgagtaaacactaggaactctgacccccaagatcaagcaagaccttacccttgccctgccctcttgctcgatgctagccctggtcattcatttgacacacaccttttcattatcctcatcccaaatcttgccactgacattcttcagtgcata

SEQ ID NO: 8683 - DNA, 381 bp, artificial
  synthetic oligonucleotide
tttcacctcctgggagatgagtgttggggaacattaacagccaaggagaaaataagcacagcagaaagggtttgggtttaggtgatactaatctatgatgatagtccttgctctgcccttttcaggctgggtaacatggaacaaattgcttatcatctgtaaccctaaattcccacctctaattggagaataataaaatctaccctaaaagtttgctattatggctcaagggtcaaaggcaagttccctgcctcaaagaagaatcagataaatgaaaacattgctgaagaaaatatccagaatgaatcttggagagacataattatggaattaattaccaaaagagtgaaagagagaatttaaaaagatgtggtaagcgca

SEQ ID NO: 8684 - DNA, 3058 bp, artificial
  synthetic oligonucleotide
aatgtgtggaaaattccagaaggccatggctgatgccatccagcctgggtccctttctccctcctatcacttttggcaattcctcgtctgaggtttctaaagctgtaattctggatgcgatgagcaaagaggcatcagtctccatttcacttttggtttttctttcctaaaagttaaagcccctaatttttctttttgtttttgttctttattaatttttatttcaatagcttttggggtacaagtattttttttgttacatgactgaattaaatagtgaattctgagattttcgtgcccctgtcacccaagtagtgtacatggtacctaatatatggctttgtatccctagccccttcccactctcccccttctgcgtccccaaagtccactatatcactcagcctgcctttatgtcctcatagcttagctcccacttataagtgagaacatatgatgtttgattttccattcctgagttatgtcacttagaataatggtctccagttccatccaagttgctgcaaaagacattatttcattctttttatggctgagtagtattacatggtgtatatatactacattttatttctccactcattaattgatgggcacttaggttggttccacatctttgcaattgtgaatggtgctgctataaacatatgtatgtaatgacttttttatataatgacttattttcctttgagtaggtacccagtagcaggattgctggatccaaaggtagatttactttttgctctttaaggaatctccatactgttttccacagaggctgtattaatttgcattcccaccagcagcatataagcgttccctttgccacacatcgatgccaacatctattgttttttgactttttaattatggccattcttgtaggagtaaggtggtatcgctgtggttttcatttgcatttccctgataattagtgatgttgagaattttttcatatgtttattagccatttgtatatcttcttttgagaaatgtctactcatgtcatttgcccactttttgatgggattctttgtttttattttttttatccctgagttgtttgaattccttgtagattttgtatattagtcctttgttagatgcatagttcacaaatattgtatccctttctgtgaattgtctgtttactctgctgattgtttcttttgttgtgcagaagtgttggggtgatcagacccaacaccaggtcatgggggcgatgaactcctgcagagtcaaaagagtgagaaaaagacagtttgagagagaaagtgggactaggaggccattgcaagtgtggaggctgtgaaggccctgagctctgagaacccacgctgtttattggtgctcaaacaaacgaacaggtgatgaggatgtgggggttgaaaggaaacagtgtatcaagtgaatgagaaacctatggcggtttgagataatgggagtgctagaagcaaggagcgagcaagtctagcagacatgcaagccctgcctcagcttgtctcccaacactcagcttttctcccaacacagatttttggtttaattaggttccatttatttatttttggttttgttgtatttgcttctggagtcttagtcatagattctttgcctaggccgatgtctataatagagtttttccaatgttgtcttctagaatttttatagtttcaggtcttatattttagtctttgatccatcctgagttgatttttctacaaggtgagagatagagatctagtttcattcttctacatgcggcttgccagtttttccagcaccatttattaaataggttgtccattcttcaatttatgtttttaaaaaatttctcctattgcacaccatttaagtagaacaatttatgcttttgtatgctttttgaagatcagttggctgtaagtattcagctttatttctgggttctctattctgttccattggcctttgtgcctacttttataccagtaccatactgttttggtaactatagccttgtagcatactttgaagtctaataatgtgatgcctccagatttattctttttgcctaggattgctttaaagcccctaattatcgaaatcacaaaacatgttattcttcagagtaatttatgaaacattttggagagtcttttgccagttgtgtttggaaaattcctatgtatattaaaagactaaacataaatttcattttatgttaactccatatattttgttcgttaatccatctcctttgcttgctctgtccctcaccagtgttgactgacatgtctacactgtagagatggcccctcccagagagtaggccgttccagaccctaggaccttactcctgtacagacttcccagaccttctcccacccctctttgtcgtcccctctccaggactcaacgcagctgtccagatcagtatccctgaatcatgcgctgagctcagaggagcctattgcatagcaacagagcctcagagccaaatatagcccttgaaagaaagaatggttccagataacgttggtgctattaggaaagtggataaagataatcatgccttcaaaacatcctcaaaagcagcccaccttctctccctgccaaggacacctccttccccatggacccagcctacatttctagccctgtgtgccaagcactctgtgctctgagcaaactgcaccattggctgatccctccattttccaatcacccctgagtctcattaacatgaatgggattatatttgcacttggcttattttctgcacacacaagatggcagtttaccttcaggaccactctttaagggagtggtgtctatcctcttttttgagatgaggaaactctgtcttcaagatggcaagaaacaagtctgcttttccttcgaaaaggcagcttgcagtaattcatgaggagagtgcagagttgggaatcagcaggcctatgttctagctccagctcatgaaagcatgtaaaagtgctctaacatctcaggccagcatctcacttagccacagttgatggtccaggtcctcatatgc

SEQ ID NO: 8685 - DNA, 952 bp, artificial
  synthetic oligonucleotide
ccctttaaattctgcgcccgcgtcctggttgggagatgtggggaaaatcctgggagcccaggacagggagaggcaagtccccacagaagtgggaatggccaacagctccctgagaagacagcttccctcttggggaggcagaggaagtcccaagaatacacaaagacaggagagtggaagggccggccagtctggagatactaaaagagactccggatgaggataggggctgacccgaaagccccgcctgactccgggctgcaggagggggcgtgggacgggggcggagccgttggcgatgacaacagccccacgtgaccggccaacactgagtgttgtctcgctctggcgtcagagccgtcgtggctcgttccattctcggcggtggtacctgctcccggtggccctgaggacgtgtgggccaggggcggccccgaaattaggaagcggagggggagcaggtaaggaacccggcggggggtccctggggttggtgtgagggagtggctccggcctgcggatgcccaccccgggggagccgtgcggagaagcaatcggtccgcgatgcagcccccgggccccgcggcgggcccgcgagccttccttgagcggagaggtgcccggcccggagggagccggcggtcctggggctacgacccttcggaaacacctgcctacgccatcagcgcaagcttttccgacacccctgccccgcacttcttggtgcagaaaatggtggtcagcttgcggggcggggcggctgaggcggggggcgagggtggcgaggagggccagggccagggccagggccagggcctcggggcggggcgggggaggggccggatggcggtagttcctagctagcgttctgctgcagcagcccccacttcccccaccccggcagtctgcaggtctgcggggctaagtgtcgcggcggcgcacctcgcgtcaa

SEQ ID NO: 8686 - DNA, 1546 bp, artificial
  synthetic oligonucleotide
tgtgagaatttgtgtgtgtgtctctctgtgtatatacaaatattgcctgattccttccacttagagggcctgggagtcacaacaccccaatagcaataagcacaactaattgttcatatcttgctttcaaaatgccattattaaataaaaggaacaaggaatccttggagaattgttggatgggacaggaaaataacgcaatgaatctggaacatcttgctgtgccagaaagcaaagtgctaaagaaatgatggaggcataccaaaaggacgtggaagcaagcctgaagaagcttctacaagtcaagtaggagacactgtgagcatcaaaataaagaaatatagaacacagtatagcttgttgaatcaaaaaaagaaaacataagtcagtatataaataaatatacatatataaatacacaataaatatttacataatttcaaaattcctcaccataaaatattaataattaccatggaaaaacgagtaccgaaatggcctggaaatcactatcttaaacaaatggtcaatgaggatattataagtaatgggacaaaccaaaattctgtgccacctgataggacagaaagagaatactataggccaggcgcggtggctcactcctgtaatcccagcactttgggaggccgaggcaggcggatcacgagatcagcagatagagaccatcctggctaacacggtgaaaccccatctctactaaaaatacaaaaaattagccgggtgtggtcactggctcctgtagttccagctactcgggaggctgaggcaggagaatggcgtgaacctgcgaggcagagcttgcagtgagcagagatcatgccactgcactccagcctgggccactgagcgagactccgtctcaaaaaaaaaagagagaatactacaacatcactttggtaatagtcctgccaaagatgcataacttgaatccattcaagaggaaataggaagcaaatccaaaataagggacattctagaaaataacaactgtaagatcatgaaagtcaacaaaagcctaaggacatactctatatgaaaggataataaagagtcaccaattaaatgcaacaggtgattgtgaactggatccttttgctataaagaacattgctggaataacgtgaaaatttattgggttctaagtttagatggcaataatatatcaatgttaatttttaaaattttgatcatcatattgcagttatataggaaaatgtctctttgggggaaatatgcactaaagacatttgggattatatttagtttctatcgcaggtaacatattacaacacactaagcagcttgaaacaacactcatttattaactcatagttctgcaagtcagtattctgggtagcctcagctggttttctgcttagggtctcccaagactgaaatcaagttgttggctgtcctgggctattatctggagggccaggagaagaatccccttctaagatcattcaggttgtttgcagaactcagttccttgcagttgtagaactgatggctccatttctttgct

SEQ ID NO: 8687 - DNA, 1711 bp, artificial
  synthetic oligonucleotide
atattcttgtcatagtaaattgttaaatctaaaacaattttcacactatagctgggaaggtaatttggtacattctttatagaaggcaatttgacagtaattattcaaaattttagaaatattcgtactatttgacatagttatttcactatttacattctattctacaacaaatatctaaatgtgtgaaaaggtttatgcttaaagatattcatggtagtaaaacatataacagtaaaacaatgggaaaaacaaaatatgccaatattgattatttggcttaaataagttattacatattcatatcgagttccataaaaagataaaaatatgctataaagggatatttaatgataaagaaaacttttcattatttatactttaaataatagcaaattagattagaaacagcatgatcaatgggattctaatatttatacatacatatgtataaacatggaatgtagtagataaaatataatcatttcttatttctgaacatacttacataataggatattaaaacaatttctacacataaaaccaccagaaacaaaaatataagtaaatacaaactaggaaaaatgtgcagaacatatatcataaattcattttaacctcatttttccatgtcagaaaaacgtgatgatcaatttctatcacttctttcacaagtgtgcttacgatacaggataagctactataatgtagaggccccaaacatacgatggttcaaacaagagagaatttcttctctcaaacaaaagtgtagttttctcacacaaaatagtccagagatagaaagggagtttggggccgggcgcggtggctcacgcctgtaatcccagcactttggcaggccgaggcgggcagatcacgaggtcaggagatcgagaccagctaacatggtgaaatgccgtctctactaaaaatacaaaaaattagccgggcgtggtggtgggcgcctatagttccagctactcgggagtctgaggcaggagaatggcgtgaacccgggaggcagagcttgtagtgagccgagatcgcaccactgcactccagcctgggcgacagagcgagactccaaaaaaaaaaaaaaaaaaaaaagaaagggagtttggggcaagtggatttgtctactatatgactatatgaggttaggtgccttctgttttgttgctctaccatctcctagagtgttgattttgtatttcttctgagttttagaatgcaggacggaggaaagaggaagtagaaagcaaacaattctcttttgtagaaatgacacagaagttgtacactccacatctactcacattccattgcaaagaatttggacaagtagacatacttggtttcaaaggatgctgggaaatgttagtttctagttgagtcatcaagagtttttctaggcgaggtggctcaagcctgtaatcccagtactttgggaggctgaggccaggagtttgagactagcctaggcaacataacgggacgttgtctctacaaaaaattagccaggtgtagtggcgcgcgcctgttgacccagctactagggcgactggggtgggagaatcgcctgagcctaggtggtcgaggctgcagtgacccatgagcatgccactgcactccagcctgggcgacagagggatatcctctctcaaacagaaacaaacaaagccaagagctcttctaaaactttggggagcaa

SEQ ID NO: 8688 - DNA, 2261 bp, artificial
  synthetic oligonucleotide
gataatttttttaaaaatgatttcaagttggagaaaggaacatttgcactcaggataaggttcagtctcaagttaagttgtttcacacaccccctgcttatttctaatatattttgaaacattcgcaccaaagggtagatggttttgaaactactttctgcataatatgtacttaacttctgagctcatactaagaagatatttgtagggatggtttgaaaggtttggaaaggaaagcagggaataaaagactccctttctctgatgactgtgatatcaaaaacatcaaagttacataaaatggtgaagatctgacgaccagactgctccctgaagattcactttacagatcatttcgaaaacaccaactgtgttcagaaagagtcccgcctttcaggcgcctgtagtcccagctactccggaggctgaagcaggagaatggcatgaaccctggaggcggagcttgcagtgagccgagatcgcgccactgactccagcctgggcgacagagcgagactccgtctcgggggaaaaaaaaaaaagaaaaagaaagagtcccgcctttttatatatttttttcttttcttttttttttttttggagacggagtctcgctctgccgcctagactgaagtgcagtggtgcgacgcggctcactgcaacctctgcctcccgggttcaacgattctcctgcctcagcctcccgagtagctgggactacaggcacgtgccaccacgcctggctaatttttttgtatttttagtagagacggagtttcaccgtattagccaggatggtctcgatctcctgacctcgtgatccgcccgcctcggcctcccaaagtgctgggattacaggcgtgagccaccatgcccggccaaaaataaaattttaaacgagctagtatgtatcaaaagtaatggcttgatgttgtgtggagcccagaaaaaatattttgtgtggtacaggtcaacataaacaatgagagatttcattgtgcaggataaagcatttccttttttttttttttttttttttttttttttgacagggtcttgctctgtcgcccaggctggagtgcagtggtgcgatcccggctcactgcaacctccgcctcccaggttcaagcgattctcctgcctcagccccccgagtagctgggattacaggcgcacgccaccacgcccagctaatttttgtatttttagtagagatggggtctcaccatgttggccaggctggtctcacactactggcctcaagtgatccacccgcctcggcctcccaaagtgctgggattacaggtacgccaccgcgcccaaccagcatttctttcaaaattaaaaacttataatttataattttctgaagcatgcagattttttaaggaaataaaaagaaatatatacagtccactccacttccttgccccgctttctgacaaatgccctcctgcctccccaccttagccctcactctaaattttctagaagggtaggaattcaggggctacgtgggcattgatggctgtgcacacgcaaggggtagaagtgggagtgcagcgcaaagcatgttgccaggtagaaaaggagagaaagcagaaaaggccaaagccaaggcctgaagtgagagggggcagtggtggaggatgatgcagaccctccctggtaaccagaggagggcaaactccaaccgcagagcagtgatgccacttgtgggccctcagattggagaggaccgagaagagtgacagggctgtgcgctctggggcacctcatgcagacgggagtagggaggctgttttttgcgcgtgcatatggcggtggcgggtggggggaagggggagatcctgctgcactggccgcccaagttggggggcgagctcggtggtgacgcgcggccctcacgtgacccagagctgcagagcgacgcagccttcggtgcagtcgtcactcgcgtctggctaccagctccccgctgccctgagctcggcgggctggcattcggcccggggaaaagcggagcaggtaagggctccggggcccgtgagccccggccatgccagcagcggctgaccgacctcggcgacaggcgcagaacagcgcagggggtccccgccagctttctccacaccccaacatgcttgggaacacagaggcccccagggatggggaagcaggggcggctgggtttccaggggcggcagagccaccaagagcgatggaaacccacccccgagtccctgcaggaaaacagcgaa

SEQ ID NO: 8689 - DNA, 2493 bp, artificial
  synthetic oligonucleotide
atgagtaatagaatttttagggtttctaatgatatttttccttttgtgcattttccaacaaaagcatgttaggtttggaagtgagaaaaataatctaaaaaaaaaaaaaaaatctccagtccttcccataggaaaatggcttagcatcagaatgaggaacatccctaagccaaaggaactaggtaatatggttgtcacaaaactaatgtatcaatctatccacatgatagcttcaggaaaagctgagcagcatcagggaaattacagccccaactgagtagcttcagcgacattacagatgcccagggaaaggagaagcatgtttctcaaatgaaccttacattttgctgtcagacaatgtctcttcttcctaggattttagtgaaggtcatgaaatgaaaatgaaatgaaagtagtttcataacatgcttgatacagtttggatatttgtctcctccaaatctcaagttgaaatgtgatctccaatgctcaaggtggggcctggtgggaggtgtttaggtcatgggggcagatccctcatgaatggcttggtgctatccttgtggtaatgagtgagttttggctccattagttaccataagatctgattgttaaaaagagccaggcacctcctcttttctctattgtttcctctcttgccgtgtgacatgccacctccccttgccttctaccatgagtaaaagcttccagaaacagatgctggcaccatgtttcttgtacagtctgcagaactgtgagccaaataaacttcttttctttatgaattacctcgccttaggtattattcctttatagcaactcaaaatgcacgaacacaatgtctctctctgtattctcccaaatacatccccttaaattgaaagtaggctcctctgtttagccacctagttagccaagcagtgacttccacaagggatggaaacggggagagactgcatgaaaccacccagggctcagcatcacagcctctggaaggggagaatcctgacacagtgggttcggggtacaagttgagtcagagtctcactcagcccagggcccaggaacaatcaatatatgcacattaaaacactcttaaagtactttccttgtgcaattaaaaataataaaaggaatggaaaagatacacatgcccagcacttataacacaaaatcaggtcaggttctaaatgggatgcatccctaaaccaaccaagggatttgtgtagtagtgtggacacatgaaaactaaattccagaaatcactgcctttttgcaccaagattttccagattaggttccagatgtacaagtataacaatgtaatgagtaatagtgtaaatgaaagatggaaaactaagcatggacaaatggaaagatgtttcatgttcattacttggggctagatggcacctgggaaactctaagactttggacactttagatttaaaaagtgacagcaaatattatctgcagattctgttagtgctccctgcagcatataaactgagaaaatgggtatgtggaggctaaagttactctatcttggatgctaatctgccatatttacttctgattaacctcagttccaggaaagcctctaaaattttccagtttatctattgttccttgtgtaagagtacatatttaccataattcttgcccttaggtcaaaacaatcttgatgttattgtacttcaattttcctacacatttcttcttaatcatgtataccctttccttatgatatgtaagccctggatttggagggtaattaggtgggaatccaccatcttgtctcaccactgtctgaggcacagacatagcttctgtttgttagtccctattacatgtttctttctaagaaactggatttatcagcctctttctttggcctctcagcttccttggactttggggggtaggttttcctagacctgtccaccacagaacacggtgtgcctgtttgagcaagtctgaaagaagatacacataacaaggaggcatatatggcaggtcccactgatgagatgtgaacatgtgtttgttctcataattattttttccttcttttccatgaagtaggcatctatagataaaatcatgcaacaaaagaatatcatattttactttaggaggaactataaagaaaagtctcaaaaattaaaaaaaaaaaactgaccaagatggtggagtaggagatatcagccttcatcccccaacaaaaacaaatacaaacatctattcacaaaccaaaatagaccagaaagggctcaagggtccagtaaaaagtctgcagcagcacaatggagaaaaaaaaggagattacccacagagaaagtatttctggtgagaacagcatacttgagacaccaggagacagctatgagcaaagaagaaaggtgccatgtcatccatgcacagggaactgtcgtggtacccagaggagtgctccacagaggacaccagtatcccttgccactgaggtaacca

SEQ ID NO: 8690 - DNA, 148 bp, artificial
  synthetic oligonucleotide
tcatactacaatcatacaatggaatacaatataccagtaaaaatgaatgtactaaagctacagcaattagaatgtagataaatttcagaaacaatatttggtgaaaattgcaagttacacagtgatacctagttaaacctgtgtacat

SEQ ID NO: 8691 - DNA, 2668 bp, artificial
  synthetic oligonucleotide
cgctcttggcaaagtcgggtaccctctttgatcagctgtcacacctggcgataatggcatcagagagagataccctgcgaggatgccgtgagatgcgccaggtaaagcacctggggtcagaaagccaccccctcctcctcttctccgtgacccccctttgctacacaaacacaccccgaccccgaccgtccccagcctcccggtccttcggggttggatggtgaggtgggtcaggcaaggggggccgagctcgggtgacgcggcgctcacgtgacccgccgggcgcctacgtgggcaccagcccccgcgcccgcccgcccgccctgcggtccggtcctggcgcccgcgcagaaccagctgtctgagctgcccgggcagcgggggagcagcgagcgggcttccgcgagccggagaaggcacaggcctgtcccgggtcccggcaggtcagtgtgaaggtgggcgctgccggcggaaccacggaaggggtggaggtggctggcagtaggagtagggaggggcggagaaaggatccgggagactggtgaggagggggaagcggagcggtcggaggcaagggcgggggagcctggcccgccttctcgacgaccccctgcactgagccgtccatccattttagtactggaaatggagtacgggggggcaaccccgcagtgcaacagtgaaacgtagacatattctggaaataaccgcctctcacaatctgctcccatggaaacatctgacctccgcaaaaacggggtggcgctgggacaggttgcctccaggggaaggggacacagagacaaacgcagtttggaaagcatcctggtttggtgcccgaggcctggaaagaaatggcggctggggtgcgggggatgtaggggaggaaaacgttgggtaagcagggcctggactcaggaaagggaaccgagtccctgtgagaccgctgactgcgcagcccctacccctgtctcctgtctgtccgcaggtctgcgcgtctgttcccagcgctctgcgaggcctaaaaaggaggagcaacctgtccagaatccctgcaggtctgtgaaggtggttgtgggggagctcaatggacagggccctataagggttgagagtgtggagggcccggccagggccgaactggggcccctgcccatcccccactcacatgaacacacaccttaccaggctgaaccagtgcagagaaggtggcagggactgccagggaatggctggctcacgtgtgtgggaggagtggcaggctacgtggtgggcagaaggccctcttgggggccctgccagcttaggggaaccctcaccaggggtgagatgcaagtactatccagacctgcattccaccccatgccctcagtctcccatgtctcttatttgtctcctcttccctccattcccatcccccaggacaggaaaaggaggggaaatctcgacatggaaaaaccctacaataaaaatgaaggaaacctggaaaacgagggaaagccagaagatgaagtagagcctgatgatgaaggaaagtcagacgaggaagaaaagccagacgtggaggggaagacagaatgcgagggaaagagagaggatgagggagagccaggtgatgagggacaactggaagatgagggaagccaggaaaagcagggcaggtccgaaggtgagggcaagccacaaggcgagggcaagccagcctcccaggcaaagccagagagccagccgcgggccgccgaaaagcgcccggctgaagattatgtgccccggaaagcaaaaagaaaaacggacagggggacggacgattcccccaaggactctcaggaggacttacaggaaaggcatctgagcagtgaggagatgatgagagaatgtggagatgtgtcaagggctcaagaggagctaaggaaaaaacagaaaatgggtggttttcattggatgcaaagagatgtacaggatccattcgccccaaggggacaacggggtgtcaggggagtgaggggtggaggtaggggccagaggggcttacacgatatcccatacctttaatgcctttggccttccattctgatttctctgatgagaatattgctggccctgctttccctggtaggtatttgccaggcccaatgctttaaccttaagctgatactttgctttagatgtcagtctcgttaccagcagccttttgacccaactacggcgctctatattttagtagaggattttcacccatgtgcatggaaaagatgttcatggtacattgtaaaaaaataaaattaaaattaaaaaaagtttgcagaaccgcatatacagtatcagcccgtttttataaaaatgtaaatgtttgcataatgcatttgtgcacaaagaaaactctgaaagcatgtacactaaaaagcagccaatggttattcctgaatggtatccaaaaatgagttcaatcacttgctgggtaggtacctccatgccattctgctgttgttgtgcccatcctcatgtcttccctaggtgtaactacgtgagtgggcactgctaccccttctcctgggtcctttaccatcctatggctcccccataggatgcgattctttttcttttctttgctctcactcatctctaccttttcttaaaggatatgtccttttgtcataacaataatttt

SEQ ID NO: 8692 - DNA, 1993 bp, artificial
  synthetic oligonucleotide
ccctctcgtcccggtcttttttttgcctgtccaccatctccctattaccctttggtcgagagggaaagcagaagaagtaagttccctctaccctcttaaatcggtgtgagtgtcggcgctgcctagtaacccggggaatggggttgacagaatcgggatggcggagtccaggcctttccctaagctccagccccgccccccgcgcccacatttctgtgcaaaatatggtggtctttggggcggggtggggaggcgagtacctcccccgtcccccgggaggggggtacagacatttggaaatagtttctaaaaatgcttcgcttccacttctcatctgaaaagaaatggcaagctttgcggggtggggaggtgggagcacggaggacgaagcttgacgcaggggctgagacgaaaagagaacccgagagctaggggagcgtgcaggcagtggctggtgcccagaaagtggggggtggggggtgtcagtcagtccgtccctcctccccactccccgccccctaccctgtcttgcgtctgtgtgcaggtctgctggtcacagcggggcacctcgaggagaggacgactaggagcacacggcccggaaaggtccaggtcagggaaggggtacgcagtgggccgggactggggcgcgagggtggacgccgaaaggcatggagtctgcaggccgcactgtcccgcccctgtcactgcgggcgaggcctgtagcaaagcctgctgggaaaatggtgggctttcgggaaggagggggcgaccgggaagcggcggagtcgggagagccggagagcctctgggaaagcgcaaggttgaggacctggcccccgaatcaggaaaaggcaggtattggaacccacggcctgggtgttagtccagccgcttagtattctgactctattctgcctttcttgtctcctaagaataactgtgcttgaagaagaaaattcccaacatggacaaaccacgcaaagaaaatgaagaagagccgcagagcgcgcccaagaccgatgaggagaggcctccggtggagcactctcccgaaaagcagtcccccgaggagcagtcttcggaggagcagtcctcggaggaggagttctttcctgaggagctcttgcctgagctcctgcctgagatgctcctctcggaggagcgccctccgcaggagggtctttccaggaaggacctgtttgaggggcgccctcccatggagcagcctccttgtggagtaggaaaacataagcttgaagaaggaagctttaaagaaaggttggctcgttctcgcccgcaatttagaggggacatacatggcagaaatttaagcaatgaggagatgatacaggcagcagatgagctagaagagatgaaaagagtaagaaacaaactgatgataatgcactggaaggcaaaacggagccgtccttatcctatttaatgtgttcggcctttaattctgttttgcctgctaatagtattgccattgccacctggactttctgtttgcattttcttaatgccttttcccatattctgaattttaactttttgtgaggctttattttagatgtttagcatgtaactcgcttaaagttgaggtttccccctaaaatctacaagtttccctctttcagtcatgagccctacacatttgcatgaaagatgtacattatatattgtgaaacgaaaaaagcaattttcaaatggtatatattgtatcccatttttgtaaaaaaaatgtatatttatatattaatatgcaaagaaaaagctaaaagtatagacttcaaaggcataacagtggttgtgtggtaagataataggtgattttttaaatttttgttttatctgaatttctcattttttcaggacaaacgttttacttgtgttgcaaaaatatataatgaaaaaatcacacaattttgaagaaaactgtcaatcagcttataacgacaatgtggcacttaataaatacttgtcagaa

SEQ ID NO: 8693 - DNA, 892 bp, artificial
  synthetic oligonucleotide
gtctgccactagatgccgccaaatcccagcaaaggattggctgtttggtccctgggattctgggattttgtttccctcccccctcccctttctgatttgctgaacggtaatatctataggcatcatggatatcgttcattcctaggaaaaaataaaatcaacttctgtaaatagcactagtaggcaggggactgtgacccaagatccaaataattttgctcatttctttccttttctccttgggttaaaaaaaaaaaaaggcccctctccatccctcttttcttttgtccttgccttgtttaatcaaagagttaatgaatgacgcaagcactgatgctgaagatcctaaccctttttcctcaccttttcaaatgctcgcaactcacccaaactgaaaatacagatagctgttccgtcagtaaagatagataagaactcatcagtaaaacctggaccctggtattgaaaactgattttccttttctcttgaaatttgtatcagatatgtgtttttgcaccctattttctgtagtggtattggtaaactttattgtgtctttggagtaagagaaagagacctaattgtaaacctcattccaccacttactagtctcagtaccctgggcaaatgatttatgttttgtgatcctcagtttttttgtatgctttctatattttagatgctgtgttatatcgttcacgttgatttttttattcatcaccaagtccttattagatgagcactactggatcaaagtcaaacaacaaaaatcatacccctttcaattatctatcttatatacttgtacaccacacaggagggatttttttagagcagtggttcccaaggtgtgtttcctggatgtaccagaaacatcagcgtcacctgaaa

SEQ ID NO: 8694 - DNA, 3192 bp, artificial
  synthetic oligonucleotide
ttgaagaatgagtcctactcgaggacatgtagttgtggattagtccactagagggcgtactgcccagggaccaactaaaggactaaagggtagggactgataaattcaaaccactagatgagacaggagccctgccctcagcagaaaggaaccttagcaagggacatgaaaccaaggaggtagtttgtgagatatttttagtgcggacatacggtaggggtgcccctggagcagctgaggtgggaggtggtgtgttgaggagagaacattccttgtgctagtgtggcccagacaagctagagtcaggattttaagagtgggttcacagcattgtttcccatcccccagaggtcattatgctcttgcctctctggctttagagcctccagattagacagaaaacatggagtcagagctgaagacagaccagaactctgtgtctctaatggttaagcaaccagtatgtagctcagttaagcctttcagctttgctcataattggacacttgcttctgtgaggctggcccaggcacctctgttgtcatgacaacttacctagcacctattgtctgggcaattgggggtaaactgcctctgttgtcatgacgacaagatttcttttatatttccccaggtgatcactttactgtagaagaaatgaggttaacagaaaagagtgagggagaacaacaactcaagcccaacaactctaatgcacccaatgaagatcaagaagaagaaatccaacagtcagaacaggcaagtggtggtttctcaattccaacttagttatgggggtcctcttataatgctcccctagaaagacaccaatgcctgattgttgaattcttaaccaccaattagtgtatgacaacctgggctaccttcctcccggttgtgggggagcaattactactcaaagcaatctctttttatttatttatttatttacttattttttgagatggagtctcactctgttgcccaggctggagtgcagtggtgtgatctcagctcactgccagcttcaagtgattctcctgcctcagcctcctgagtagctgggattacaggtgcccaccaccacaccggctaatttttgtatttttagtagagacagggtttcaccatgttggtcaggctggtctcgaactcctaaccttgtgatccacccgccttggcctcccaaagtgctgggattacaggcgtgagcccccgtgcctggcaaagcaatctcttattagctaacttggtaaggttctactactagctaacatatcttcagtgcttattctatgtcaagcagtgtgcccatgcccttaatcaatctactatactgacttacagaatcaaagagattaaagtaatcaaagagattaaaatcaaagagattaaagtaatcaaagagattaaagtaatcaaagagattaaagtacttagcttaacagtgaccagcttagtactagaatccaggtttctttctttctttctttcttttttttttttgagaaggagttttgctcttgttgaccaggctggagtgcaatggctcaatctcggctcaccgcaaactccgcctcctgggttcaagcgattctcctgcctcagcctcacaagtagctgggattacaggcatgcgctaccacgcccggctaattttgtatttttagtagagacagggcttctccatgttgatcaggcaggtctcgaactcccgaccacaggtgatccgcccacctcggcctcccaaagtgctgggattacaggcgtgagccactgcgcccttatgaatccagggtttctgattgcctatctagtccttgcagccctggggtgggtcttggtttgtggggaggcggagtagggaggaaggagtccaaaggagaaaggcagtgggccgctccctagttgtactcaccaagcgttggcgcctctgccttcttcgaagtcgtatgaattctttatgctgacgagaaacaaaatttatggcagcatactccagcaaggcagcgaacacaaagagcagacacacagccatccagatgtcgattgccttcacgtaggacacctacaacatccagcgacagaacgatcaaccttcttgaagtccttccgtggcctactgagtggattttcaacccctatcgattgcctgctctttttgagctttatcctgaatttcttctggtgtttaaagaagccttccatgacatatcccattgtctgaaagcccagatggaaaagatcggactgcccatcatactccacctcttcgcactctccaccctctacttctacaagtttttccttcctacaattctttccctttctttctttattcttcttgtacttctgcttctgctttttattattgtcttcattctgatcttcttctgattcttttgtttcaataaacagcaatgagcatgaacactgcatttgtcttccctctgttatctcctagggtcctcacagcctcagtggtaattggtcaggcagcgttcacaattccgatgtgagacacatgaggacacttaaggcccagagcagatggtcttagccaagattacccagtgagaaggtggcactaggacctgagggttctgggctttcaattcagtggcattgccatttacttaggctgtggtctcactgacaaactaggagttccttcctttccctcctccacccctgttcttcccttggtcctgtggttttccttgttgctcttttggaaaggctctgctgatgaatttagctcagtagtaagctggggcctcatctctcaccctggagagaacagggcagggatactgagggaacaccacccacccctttaaggatgcttcgctagttgcaagatgtggttggcatccacctatccagtcctttgtactctcctctcactgctttccttggcagcctctaagtacttttgtctcccactttctggcctcttccaggcattgcagctggatggggccaggagtgggggacagagctcaggtttagaccttttcatcttctcaaccaaattacctgctacttagttttgagctgctgagcttaccacatagcgcaccccagcaagaacagaatttcggacaggccacttctttcatcagccactgctatgatgggaagtgagggtgctgcagaccccaggtaaggagcaagtttcactggataaat

SEQ ID NO: 8695 - DNA, 2332 bp, artificial
  synthetic oligonucleotide
agggaaggtgtagtgactagcatccagatatgcatcatttctctccttctgaatggaccttcagaatcgttactcatcacatcagccacttgagagcaattcactagctgtgcagaagagtttcattaaggtttccacagagtttgcattgactttccttgtctcttggctcttgtaactctgcaacattcttgttaggggatgataggaccatgtcatgcctctcctcaaaggtaaattggtttttgcttgtgatcatgttcatgaatatcttattttactcatttggggattgtgataatgcatgctatgtaaggcatgaagcccttacataacataaaagcaacagaacttggaaaaatgaatatttactgtgtggaatggatcacactcccgctaattcatgcatgcattcaacaaatatttattgagtgcaaatcatatgccagatgccagatattctaggctctggagatacaacagtgaaaaaagcagatggagtccatgccctcatgtagcttagattctagtgggtcactaatgtaattccttcccaaagaaggcttctgcctgagtcatcagcaatgccccagggcctgagtgcctctcacagcatatgagtagggcatttattatatggcctagaaaatagactatttttttcagcaggcagtaatgagcttcatttttatctatcccagaatctttctgctagtcacatcacacaggtcatcacctgctagacaccctttcaagaagcttatccttcaataatccaaccctacagaacacgcatgcccaagaaccctgaaaagataatctcatgattatctcatgatgcatacatatttgtctgcaactgttaataagcaccttcctcactagaagagttaggcgagattaacagcatccttagctgtggtgcttctctgagtggtttccaattatttaggatccttccttccttccttcttcccccttcaatcttttcactttatctttccttcagtctatctttctgtctgttctcctgtcttttcttctgtttttcttttttggttttactatgaataaatttaatgtttgttgtaataggacactggacactaaagtaaagaacagtttggttgattactacatagaattgtgcacaaatctgaatttgcattactaacaccaatcacatagttatagttggcaaatgttatatgccaaaattataaatttaacattacaaatgatgtactagcctaaatttgcacttctgtagtgttcattatctgagtatacacgtgtgcatgcagacacacacacacacacagaactctccttgataatctgaagatgatatccctgttgctaacaattattatccaagagtgtgtggccaaagaaattggagtgtgatgactagtccattttatcctgagtacaggtagatcttgtctttgttttgtggctgaggtctctacatttactgtgctaatgaagtgcttctagccagtcacttgcccagaataattggaatccctaggtaagatgccaaattgagccacttctctttgtacaaggtaggggaggtattcattttgcagagttatgtcgcatatggccccaaatcacagattctaatcaatgacaggcactcctaaagagtcatctcagatactaatcagacaataggcaactccaaaccacatagcaggtcacacacatgagcttttgctgccacccactcctgcactgtcagcaacatcatcgtcagacactaagagagtgttgctttgagaactctgacttttctttcctgcccattgtcagtttctttctgtaacctttacattgcctttctaaccacacattaaatcccacgtgttctataatcccctcactttccacagcagtgtgcccactgctgagtcaaaggcaggtgctgtttcacaactgcaaatccagtacaatcagcctcaattatgggccagtttcaggaaagacaaataggatgctgaggacttgacattttcagacaagccatggcatagatccaggaagtctgctcagttgcatcaccttaagcaaaagcacttgggagaccaaattattttccgtgtacagaaccaggtatatgaaatggtaggataaagtagaagaggactatttagaaagttcactgagtagggatgaacattttagcactgcagagaaacacccaggaggaaactggaagtgagggccagggagctcagctcatcctgagctctggaggtagagaatttgaagtggctcttttctgatggctctgattctggctaaatgtttgctgagattctgt

SEQ ID NO: 8696 - DNA, 1461 bp, artificial
  synthetic oligonucleotide
tctgtcaactcgtaagcatcattgtccccagaaacaagctcagaaatggcaagtggagagacagacttcatagacaggattcctgacactcagcggtctctccacaacacagtttcctatggataggctgggcagagcctaactcatgggaaatacttgctaaacgtgtgttgcatgaatgaacaaatgagagactgtgtgaacgaactgaagagagaagaggctcagggtgagagctcctccactccctttctgcttcactgctcccatggacctaagcagaaggacatgtgttttttttacaggacagttttattgaccaggggcacccttcaaataatgctgatgaaagggtttgccaggaccccattcccattcaatgaatgcagacaggatcttcttttgaaacctcttcatgaaagggggcagacttggctgtcagactgcctaggtttaaatcctgacactactactaactagctccatgaccttttccaagtgtcataaccagtctaagtctccgtttccctatgtgtgaagtgaagtcataaataatacctacaaggccgaggcagggggatcacttgagatcgggagatcgagacaagcctggccaacatggtgaaaccccatctctactaaaaatacaaaaattagcaggatgtggcagctggtgcctgtagtctcagctacttgggaggctgaagcaggagaatcgcttgaacccgggaggcagaggttgtagtgagctaagatcgggccactgtactccagcctgggtgatggatcgagagtctgtctcaatcaatcaatcagtcaataaaacctatgccatcagaattgtcatgaagattaaatgtgacaatagatataaagctctaaagtagggtcaggcatatgatcaacactcaaaaaaccccaactgttactattctccaccttgcagcctttgtttcccttcatctgctctgtgggctaaaatggttttactaaactgtgtcccctagctcagggagatgggatggtggtggtgtggtgagacaccagaagagagggcgtgggatttcaagagagcaccatagagaactcacccaatgcaaagaccaacacttactaggccatcagaaccgcagctgataaaatatcctggaagagggcttagctctgggagaagagaggtggttggaaatatttgtctagggaagcagggacaggaattgtggggacagagaaaaaaaagagatcgaagggaaaggaaggatgggagacaggagaagaaaaggtttgggagagacagggaggggctaggaaagcccagaaggagctaaattgctactggaacattaagcacaaatgagggggaataaaattaacatctttattgaaaagaaaaacaaggaagtaagaaatatccctgtttggggaaatattgtgtagaatggagcaggtgctgggggcctt

SEQ ID NO: 8697 - DNA, 1749 bp, artificial
  synthetic oligonucleotide
atgttgttccgtattctaccaccaatgtaacctctctgtgcctcagttgccttgcctataaaatggagataacagtaccttccttataagagtgtttcacagaatcaatgcataattatctataaagcagttagaacagggctggacatataccaagtaatcaaaaactattagctattagtttcagtctgtcttctaagatttgtttccaactcccaagctgccagggactcctattagttgcctgccctgatgagggtgcctgccctctttaaggcaggtgccatggcaccttgtaaaggtttctttccatggaacttgggctcagccctagccaagtgtgatcagctctgaagccttggagatttctaggaagtgctgcttgtgctggctccaatgctgtgattccttcaggagcttaaggcccagtagtcttctccacacagagggcagaaggaactagatttggggaagaggtagatgcctgagtagaaaaaaaacataagctgttattcttatgctcttacccaacaacattcaacatggaacacttctgtgaccaaatgtgtggtgtgtttcccaatttctcacacaccaagcaagcaactctgcaggagacaccagctggatgtcctccgattcaattctgatgctacctacctggagatagcgtcagatcctgcaggttgagggctcagtccccaagcctgtctcccacttccagtgccaatcacaagccccaggttattttgcctctgcttctgactgactggctataaatcggggttcccatgaacccttccgcaggtttgatcagtttgctagagcagctcacagaactcagggaagcacttacttaattttaccagttagaaaggagattttaaaggatacaaatgaatggccagatgaagagatacacagggtgagagctaaagtcctgagcacaggagcttctgtctctgtggagttgggatatgccatcctcctggtgggcagatgttcaaactccatgtatggctatccacaggcttttcaaaccctgtctttctgggtttttatgaaggctttattatgtaggcttgattgattaaatcattggccatcagtgattaacttaactttcagcccttctcccctcctaggaggctgggggtgtggctgaacatcacaatcctctaattctgccttggtctttttggtgatcaactcccatcctgaggctacctacctgctgccagccataagtcaactcattagcatacaaaaaagcatcactttgaagattgtaaagattttaggaatagtatagccaagaacagcaggaaatgccagaaaagggtcagagagggagtcttgtcttgcaagggctgaggaaggcccttcttgccctcaacaagagcatgatccccactgacacccacctatgcagtttgccaaagaggttacctcagaaggttcatcagcccatggcctaaaggattaagagagtttcaaatcgatgaaaactccagtgtagagaaaagaggaaaaatagctgtgagctccaggccaacttttggagaagcaaaaaattaaaaatagctgagctttaaatctcttttttttttatttggtgtggtggggggtggttggagcttgaggagggctggagctgagcaggatgcaagaaacatttgttctgcttgctccaggaagaagtgagtgtgtgtgaattcaattttttggatcactgcccagagtggtcac

SEQ ID NO: 8698 - DNA, 2238 bp, artificial
  synthetic oligonucleotide
tgggtgaaaatactcaagcattgggtggaatttggacaaaacaacctactagtgaaatcacaggattctatgaggaagtaaaagtgaagaggggaagaaaataatctctccattccagggaaatagaatattgtggttaattatcatgtcactatgcaacatgcatgaaatgcttattctccataccataaaatagacctaataataataacccttagtttttctttgatgatccagaaattaatttgggctcttgcaatgtctaggggttcccgttataaacattaatttttattataatagtgacatgtggaaatgccagttaaaatctctgccagaatgtcaaataaacatgctttattactgtaactaaagaaatattctagaaaaaaaatttaaaaatgtatcatgcagagacacaatagctttccaactcaatttagtatatacaaaaaaattaccttaggacaaagagccatgccatcacaatctaaagaataacactacagattagaagactcatttggctgaaatacagctaataacaaaagctaatgacttagtcttcttaggtggctataaaaataccatagacgggatggcttaacaacagaaatttatttctcatagttctgaaggctgggaaagagccttcaagatcaaggtcttggcagattcagtgtctggtggggcccccttcctggtttacagatagctaccctcttcttgtatcctcaaagcagaaaaagagagagaaagagaggtctcctctctttctctctctctctcttttatggaaagcgggggcaaggagtttctctctgtcacccaggctggagtgcagtggcatgaacatgactcattgcagcctggacctcctaggctcaagcaatcctcctgcttcagcctttgaagtagctgggaaaacaggtatgtgccaccataccctctttctcttcttataagggcacgaatcccattatgaaggctccactctcacgaattaatagctaactgtaattacctcctaaagactccaccaccaaataccatcacatggaagattaagtttttaacatattaattagggagatatattcagccaatagcaaccaaaaactgctgcatagttgtcaattaaacaccaatttccacagttcattgccaatagctatttttcttattttatctctacatgaaagaaacaaggagagtgtgggactgagtagtaggatcttggtgatcctccctgtcaagtacctctttctttgttctatttagtatggacacttagattgtatcatttaggtaattttaaatcagacttttaaagacttgggtcactaacgaaaaccaacaactctgattttaacaacaattttctgtagcttttgtttattcagtaagtcagagactattgtggaggcacaacttctcagtagttcctagggttacttccttttgggaggagcaacaaggatatgacagactctgggaaaatttcttccaggccagagctgcttgctactgtttgcttctgccccttccactgtctgatgcctaaaccctgctttgcttaaaaccaaacctttcctttttttgcatctcaggtttcattacttccccatccctaactctctgtgtcctccaaactacagtgttaaaaccatagccccagattgcctttagcaatttgcttaacttctcggttcctgagttttttttttttttaatttttaaattttttttttttgaggcagaatattgctctgtcacccaggctggagtgcagtggtgtgatacacctcctgggttcaagtgtttattgtgcttcagcctcctgagtagctgagattacaggacatgccaccacgcctggctaatttttgtatttttagtagagacggggtttcaccgtgttggccaggatggtctcgatctcctcatcttgtgatctgcctgccttggcctcccaaagtgctgggattataagcttgagccagcacgtccagcatcagttttattgtctataaaaagaagggattggatctaagcatcttagagtctgttccaacatttgacctaaaatggcacacatatcaccatattttctgcacctcacccctaaactggactcaaccttccttttttagaatttttctaaaaaacctgtttgttttaaagagacctttttgcatctattaaatactgcaatctgtcgccaatgatatcacaaga

SEQ ID NO: 8699 - DNA, 3228 bp, artificial
  synthetic oligonucleotide
tctcattgtttacagttgaaataatgtcattatactgacttattttgttaacaaacttttcctgtctttcttacatgatcaattttaaattcctagatagtaagctcactgtatacatctttgaagccccttcagtgtgcagcaccaggatcctccatggagataataaatatttgtttaccaattaaatgattaggtaggtgcccagaattaatgcctctgaattgatgccaaggtacaatagatccatagttctgtaagatgccaaaatactattatttataaggtaactaaagagcagaagttatgaacttgactcgatcattttctggatggggagtaatgggaattccacctgttgaaagtcaagggaaatgctccagttttcctccccctactctcacattttaaaaataagtatatacatttccccattcctacccaaaacaagagcagaataatgatatccagttgatgttgtcggtgggtgctggcctctccacaatcatttatcattgtttgaaaatgaatgtcatgtcctttagtacatacttaaattaaaaagaactagcacagtgtaaaagcaaatgaaatcattttttcctcccccagaatatgccggatttaatccaaacctttaaacaaggtaacattaagcaggcaaatgaattctttgataacactaaatacgtaaataggaaagtcaaatgacgtatgcatcccttatgggtcctctgtcgggcgagcatttggaccaaaacgcttattctgattttgatcccattcagagaaagatctgactctaactgagtaaaatattcgagagacgcaattcccctttcctacccccacaaactcattaatgagcatgctctaaggatagtttactaacttttttttttcccatcagggtctcagtcttggagagtaaggtgaattaggaatttccataaccaatactccccagctctttgttctttaacacacttgaaaccttctgaatctgcagtacccacaaagccttattcaaattattgtatttagttgggaatgcttagaggtgggagtggaggtgggggaggaggcagtacaatgaagaaaaagaagttgaacctttgaaaatagtacattttagtatgatgatggagagaagagaggcagaaaagcaaattcgcatcagttcagttgccatggagtggaatgatgctcaaaatcagtagtgcagattgctcggaggcaagtcttgaaagggatgtgtactgcagggatcgataggggaagagcaactggggagggctaggcactggatgagagtggcactgttggaagtctgtacaggggaggagccatggttggacctgtggggaaagcccatcttgtggcgacacactggtaagggctactcaactcactgttgaatgctggcacaataattggaaatattgcactgaagaattgggcgcggctatatttatgtaaaattcaacacggatgagaaatgattgaatgtttgagtgtgtttccaatacaacccaatacttggcgttggtgctggtggtgggtgcttcgtagcgcggaaaccctctgacgcactggattcattttgcagagctaacaagttatcagctacatccatgccgactccaaatgccacagctgtcatgccactgaaacgctattcctacattcatgcccacatttatatcctatatgcaactcaaagggtccaatgtggagtcccacatctaacctttcactgctcacaacgacagctctagggctataagcccaaaggcacactagatagcaatctggcatcgtccccaggacacttcttcctcagtagactgcccagggacagataggtagataaggtttggatgacatcaagcgagctgaacacaaggaaaaaaagcttccttgggagacaagaatgctggcatctctacgacaggggcactgttagcattacggacctagaaagtgagatgtcacacatagtcccaactacctccgacccaggtcctctcacctcacccccagctcttagagctagtcggctgtggcgcatgcgcactgagccacacccgctccccacggagccctgcgcctctctgctcggctctggcagcagctcgggattactcagcaacgcccccctgcactgtcacctgcccccgactccgacctcgggagcggctcagtcccttttctcaagctacgagtggtcctggggatcaactagactttcctttctccctcttctcacaggccccccacctcccggccttccgggtcctccagcccctagcccctgttcctgcccacgcacaggcaccttacccaacacaatgggaaggaaacaggagagggccgcgggtgccaggcaggtcagctctgcgtgccgggaatccggctccttagagtcaccgtcactgctcctgctgcctcctcgtcctcaatggggcagcaagtgcggcttggacctcggtggcctgacagctgccgctcgcgcccgccgctgccgccgcgcagcgtctcgagcccgcgcccgcgcccgccaggggagggggcggggcccgcgccgcctcctcgtgcccctttctcggcggtggggacccggtgtagccgcctcccgccctccatgtggcaagcgctccctggctcgcccactcttctttcatgctcatcgtccaaccctggtctcccttgtcctccttctcctcccctagccgattagtaggcacagcggcaatagaccgtcaaatattgctcttccacttagctcctctgcagcctgggcctaagccctcaagcagggctagccactgccccacttcctgcaattatcctctgatctacctcatttatcctagctcaaaatcctttaattttgccaagagggtagtacatacaccctcttgtttcaaataactcaggaaaacacatgatcacaacacattgctaggccctctaactggctacagcttatgaaattttcaggcaattaaaaaaaatgtccacatctgtagcgcaggcatagaggacacactgccctttactcttaccagatacagttctagagggccacacagggggcattacttgaatttcccggaattgctgctggggcagaatttgatgttttaattgtgcctagccgaccagctagtctctttttgttgttttctgtagccctctggtacttccaactagtttgtgattttc

SEQ ID NO: 8700 - DNA, 927 bp, artificial
  synthetic oligonucleotide
atatagatttttagatcttaaaggaaccttaaaacctgataatcaaagctaaatctggtaattcagattctcattttatcacaggcagagaacttctacaaatttatgttactagcctagactcaagatgagaaatcaagtcctcttcagagttctccaaatttgcctgatcatatgaatcacctgggggccttgtgaaatacggataaaacaaattctatccacctgacctactaaatcataatcttgatgtgtggtgcctgggaatttgtattttaacaaggccccacagcaacgtgagtgtattatgatcaggtagttttgggggacattgcatctggtttgcaactcactcatctttccatcttgacacttgcccttcacaattgccacaatttatggcattttaaagactaaaatgttcacattttataaaattaattaggcagaaggttttgagtagtgaatgaaggcaaagttgtggacttagccttaatcatccaatttaccctcatttatgttcaagttgaagcacttcgactttcagtctgtgttaaattattctgaggctgattttcataagggttctttttagcatggcatttggtttcttgaaatctgaggacctctcagctgcagttaacccagtgtatactcaagaatctcttcttggagaatgtaaacattccattatccagtcacctttgataaaagaccactttcaccaaaaaagagcctcataactcacattttatagatgatgaaatgggcactcagagaagctaactgattcacccaaggtcatatagctgtactgtggcagggccaaagcacaaacctgttcatctatcttgtgttgactgagcatctgcttcccctgggaaatacactcactgatggggatacaaaggtgaagaagacttggtc

SEQ ID NO: 8701 - DNA, 4165 bp, artificial; identical to SEQ ID NO: 6757
  synthetic oligonucleotide

SEQ ID NO: 8702 - DNA, 658 bp, artificial
  synthetic oligonucleotide
aaaatttatttctaaagtatttcctgagctgtgactggtgctatagaactgcactgaccattacctaaagatgtggagtgcttctggccactgaccttttaaatgccataacagcctgattgaatatttgattgcttataaacctctctctggcactgcacttataatcttgaacttttaatattctgacactgtgaatctttaatcaggtgtgactgtcataacaaggcaatgtaattttccagtctttgcacagatgttttcatagtttaaatagaggtgcttataatattagtctacaaaggaactttttgcatcaaccaaagatcagaataaaaccacagcagattaaaagaaatatattttcactggatgggtgatgaatactaccctgataaatgacctggtttatatagttagtaaatttatttaataataaatattatgaatattaaatatgtttatttacttaataaatgtattgagtcactattctgtgccaagcattgtactatgggttttgatatgatgttatataaatacaggtaagacacaaatgaatgaatgtttacaatatggggcatgtagcaatgggggtaaacatgaggtgctctgatacctaatctaatattggggagatccagggagaactttgtgg

SEQ ID NO: 8703 - DNA, 2907 bp, artificial
  synthetic oligonucleotide
attatattgtgaaaatgtctggcactttgacctagtgctggggaacagccaaggtgggatggggcagcataaaaatggctgaatgcttatttcagacagctgagatggggtggagatggggcagctggagatggggcagccactgacaatcatagatggtaagtgctcagtgagatgttgttctgtgtatactaatgagagatgtccagttcctttctgtgtggggaaatggtgcagccaacatcccaaatagttggttccacagtaccagggcccagggctagtaaccccaaagcgtggtgcatgattttcaaagccaagggaagaattgtagtttaggctggagggaacactgagccagaatagcaagtccagaacaggttgtgaattgaggggagtctaaggaagttgaatctggaggcaaagctgagctaaaggaccagcgatgctagtgtgagggtcatagtagcccagaaagagggaataatccaggaagacctggattccttccacagatgtgggagcagatgtaagtgtcacataccaggagggagcagatgtcagtgtcacataccaggagaaaggctcttacaatttctgactcaagcttctgtggacactggatccactccagctaggacacgttggggaatggaacctggcttttctttcaatgacttgaagaggcttaagattggttattgagtctgcattgataatccattttcatttcttccctccccttcaaacattgttcattcactggccttagaaggggtgaggatctataatgaggtctccattggttgcatcattttctgcaatcttaaaatagatcacatgtctctaggccagtcttggctctggttgctgttgagggtctgatggtccttcctgggaagctttcatctggatatggtgaacatctctagagggcctagcagctggtgctaaaatacatgttcaagggtctgctaattttctatcgactgaatgttgcatagccctctcagcagaatgacatttcacagctttcagctgacataaatcattgaccttaagagcctcagggttcagtacctaatccatcaggctagccaggcacttgaagcactttaagactttgaatagaaatagacccaaagacatgctgtccccaaaagccattccattccagcatgattaaatgtctgtgctcccagaagttttctatgatagtttagaagattggcatgaatataaccaaacttttttttttttttttttttttttttttttgcgtgtgtgttcaggcagcaaaatcttgatggagatgaatttgtgccattgcaactttctggggatatctttcagatgcaaactctttgtcttagctaagctgccatttggccattttatcccccagaggaaggatttagagctctgagatcaaaagcccacatttgaaaataactgtactttgtgttttagtcaagtttgccagtaaggagatgcagtgcaaactaggagaggtgagccaattggcacctttagctcatctgtctcttggttccattctgtgctaagctccccagagacattctctgcttagaaaacaatcccctatcccttctggtacagttgaacagtgcagccaatctctgaaatgaaaattattttgtaagttgtctgtaaggttaaagttcagttaactatactgcctaagtggatttgcacagtcagcttaccagctgatatggtgtggcaaaaaagatggctaattaatcaccaagaaattaatatttcccatctctgtggagttgtcactgggattacatttctgatctccccttacatctaggtggtgccatgtgactaatacttgctgatggaacatgagcagaagcaatttgtgtcacttttaaaagcaggtgttcattttataccctcccatttgatttcttgatgcagacaaccatagtaaccttggaattcagtgtgttgaagatggaagagctacaagaggtaaggaacctgggttcttatatttccatctgaaaagttatttgctgaccaggagtgcccaaactagactgttaggtgaacaggaagtgcatttctattgtgttaagtcactcggtttctttgttacagcggctagcattaccctaaccaacatacatggaattttgatattcttgagtaaaacgggatttgaaagggctatgattgggtaagctatacacttggctaaactgaagttttgaactgaatggcaataaggtatataaaatttatcctgaatattttactgctccctcctttccctagttcatttatgcattccacaaaaatgtattggaggcatacaatatgccaggtactatgctaagtatgcactggagatacaatagtgagcaaaacagacttgattcctgttctcatgaaccttaaaatctataggagagagatgatgagttcccgagttcaggcgggggactagagagggaggggatggagtagaatagtgattctctaacctggtcattggactatcagccatctgatcacctggaaagcttataaaaaataggaggtttcagattctgtccctacaaaatctgagtcaagaggattggggtggaatccaagcaaccaagcattggttgagatttagaaggtagagttgagaggactttaatgactgataggcaaaggagaaggaatatttggtgttcgaatatgaatttctggcttgaaccactgatttggaggtggtggtatgtgcttgagataggcaacacaggaagaagagcagatttctgttgaggtggaataataagttgagctttggatgtaatgactttgaagtgctcatgcactatccaggtagagatgtatatttggttgtgtatgatgggagtagag

SEQ ID NO: 8704 - DNA, 1516 bp, artificial
  synthetic oligonucleotide
ctctgcttctgtgagttccattgttgtagattccacatgtaagtgagagcatgtggtttttgtctttctgccagtgcatttgctcgtaactactgttctactgcattcaaataacaatgcctaacatttactgagtgcctaccttttggctaagcactgggctaagctctttgtatgtattagctcacttgcttaatcctcttaatgatcctgtaaagtaggttttattatgagccgtgattttcagaaaaagagactggggcacagagatgttaaataacttacctgagtcacaccattcaacagtgccagacggaagtaacctttggacacagagcactctggctccagagtctacactgttagtcactctcttatactgccttccagctgtctgctggggcaaggcagaggatgtgtggtgtgttcctttgggtgtgttccttttgggagacagtggggagggagaggtaacaactgcaattcacttcctgccaattgttaccttgtgagaatcaaagctaccagtttttaagagaggccccagatctggatctttatataaaatttccttattttaaatattgggaacacattccaatttttaaaaagcagtatgcccaattaaaaacaatctgtcgataggaagcagtaacttatagttaaggatatttattaagtactacttatgaataccgtgctaattctaggtattattattcagtgtaagcctatagactccccattttatgtattaattctcagcgttgttaaaaagaaacgggcagctgtggtggcccacgcctgtaatcccagcagtttgggaggccgaggcaggcagattgcttgatctcaggagttagagaccagcctgggcaacatagcaaaaccccatctctacaaaaaaaaaatgaagaaattagctgggcatggtggcaggtgcctgtggcccaagctactcaggaggctgaggtaggaagttcacttgagcctgggaaatcaagactgcagtgaactgtgattgcgccactgcactccagcttggatgtcagagtgacaccctgtctccctgtctcaaaaaaaggaaaaaagaaagaaagaaagaaagaaagaaagaaagaaacgggttctctccctgatttcatcggtagcaaataagtttaattgatggtttatgtatatattttcttttatttatttttatgcatattttagagttgaatttctcagtgaagctgtaagactgttggaagaaaaatgtaaactttcagaatttaatataccagggatgtgtgttaaattctcttaccttttttccagatgtgaataatttgtaggtagaaatatttatttatgtaaaccttgaccgcagtgaacaaaacacacatactacacatacctacacatgtgcacacacatgtgcaggcaacacttttgtgagccacatctgacccatgggctgtcagtttgcaacatctgtttcaggggacatatcttccattcctttcttctgcct

SEQ ID NO: 8705 - DNA, 772 bp, artificial
  synthetic oligonucleotide
aactttttattcttggaggaggtgacacatcaagtcttctgaatcaaatcataaaggcttttaaatcaagccctcattctaaggtccaggtgacagcttctgaattgctaaaatgtgtcccatgtgttcctcagcctgagtaggtggccattggattgccatctaaatccagtgccgaacactcaatatcaatactattgctttcgtctttgaggctgaataacacgtcaatattggtaatggaatgatttactgttctttagggtggttgcatttcgtggaggcagcctaaatggaattaactgtgggctaattaagtgctccctgcttctctctcaagttcccccttgggcattggctgcagtgagttgtgcaagtcgcaggaaactgtaaattatgactcagcttaaagaaaaatggattgcttttctaatacttattgaacacttaaaacagatgtttaaatctctacaagttttagataattaaaattataaatctgtgctctttgaacaggaacagagtagggatcagaggtataaatagtaccatgctgggaagattcatcttgtggcttcaggtttattactgtaactagggctgtccccaggtaaagtagcaaagagaagaaatatgtttttgttgcccctgcatctccccggactccagatctcctcagtgctctcaggctgccgggtacctcttactgtaggaccatctaatgctagttcttccctctaacatcaaaggtttatctgttctgtctttcatt

SEQ ID NO: 8706 - DNA, 1066 bp, artificial
  synthetic oligonucleotide
ctagtatttagttagtaagcctgtgctggggtggtgtcttccaactactctaaagacccattaaataatatggtataatatcactatttcaaaatgccaaacatctaggaattatagatgctaaaataatgtaatccataaggaataaggactttaggagtctttattgtctcctaaaagccctttgaacctgcctggcataatagacgaggtcaaattctattttttttctgtaatagataatatattgaaggagctcttgggtaaaaatgttctaaatatctaccctgacaaaagaaggactcctatcatttttaaaactttaattccatttcagaaacattgatatgcaattgcttgctactgaactggaatttgtctacatgtgaaatcacttttttgaagcatgttatctgctaatggaatcgtagaacattttctggagaggaaaaaaaaaagactaatcttttggctccacagcatagatagtagattaccatttggattaatggcttctgtattatattgttttatttttaaatgctaaggttcttattttaaagtcacattattcagaagctcttcagatgtgttgacatctcagttttgagtataatgaatgtagggttttatgcccttgtgaaaattccattcctagtaggattccaaatggggatttaaaaaaattatccacatggtctgaatggctaaaatccagcaaatatatctagaacatgacaatgctgggcgagtcctgctgagatcattgcttgaggtactgagaacattcccagacaaaccaatccaactgtgactaatgaacaagttccatttatgatctatagcttgagaatgctccaggaagaatctcctcttctctaccattaccacccccaccaccttattctaggctctcacttgcactattgcaaggaccacttacctggcttcttaaattctattttgtgcccacccaattgccactcacagtgatcttaaaacttaaatcatttcctgactcccttgcataaaattcttcttaaatggcttctcctttcacataagt

SEQ ID NO: 8707 - DNA, 2548 bp, artificial
  synthetic oligonucleotide
tagcataaatgaaaacatgcacatgcacatacacatacacaccaaaggccaccaggactgggacctgtgtattgatacagtttggctttgtgtccccacccaaatctcatgttgaattgtaattcccagtgttgggtgagggacccggtgggaagtgattggatcatgggagtggatttcccacatgctggtctcatgatagtggtaagttctcaccagatctgatggtttaaaagtgtgttgcactttcctgcttgctctttctctctctcctgctccgccatggtaagatgtgcttgctttcccttcgccttctgccatgattgtgagtttcctgaggcctcccagtcatgcttcctgttaagcctgtggagctgtgagtcaattaaatgtcttttcttcataaattacctagtctcaggtagatctttacagcagtgtgaaaacagactaatacaggtatgtatatcacccctggaaattgtaatgttgccttcccacctcacatctatttttggttgctcaatatgattttatagcaacatggcttcttcaccaataatagccacttcagaaatctttaaatgatatggacttgttgagttaaaaaataattcaactatcttcgtgcccagtagaatccaggataatagaatatggcatctgcccttcacattgcaggattatctgtgcctccttggatttccctccagtgcatctgtttatattcaagtcaggatctttctgctagatgttggtatatgtgtcattcacacactctcagttacatcgtaaggtaagcattggctattcaagaattggtttctgccttcactagagtcacagaaaccctatgcatagggcaaagcagaatggctcagttgtccaggtcattttcattgctgttcccttggcccctccctttttctctgcctgtagtcctcttgggatctgcctattggcttgagttttcatatttccaccttgctctgaccctgatgtccatgacttcctggtgttaatctacttactggacttctgactccctgaactctgtgcctcatgttgcctttgcaccctgactccagcttgcctagttggctctgacttgctgctttgctctgacctttggtttctctcttcccacctttacctgaattctggaatgcttacactagccttcacctttgcccctgggtaccaggtcctaccccaggactacctcactcttctgccaattccctttgccccgtctcagatttacctctgccctccttatcccagctcccactttttcatccatgacccactgccacatatattactcaaaactcacaatctagaaaactctcccatccccaccattgccaccagcaaccaaggacagaagtttatattttgaagcagtgtcagcaacattctgtgagctgttaggaggaagacacaggacgtgacctcttagcttagatgaacaatattgccacttaccaaatgggaaattataacaataattactaagaagggatttttatgagtacttagtgcctgaggggccaaaggaccttgtcatcacttgggtgacagagagagcagaggatttgtctgaaaaagaagatttttaagggtcatatcatacttgtagttcccattttgagtttggttgaggagaaagagagccgcattgattttcataattaaaaacacgtttttaccattgtgggggcagtagggtaggggtacggggcagtgagcaaaagggaaatcaattggttaggaatctcagagagttaatggaataggtgaattgaagtccactagattgcatggttttctccttgatatgaaagatttacagttccagaactcacattagcattaacgaggatttcacatgtaaattctcagcaaatccaaagaactgttaattccttacacctggatggtgttctgagccatagtttttttccccttagctttttataatccaatggctattaaagagcacaactttaaaaattgcccatccaaatgacacaagttaaaacaaagacaaggtgtttacaaaaacctccttgcttctaaaacaggagaggcactaatatgatcctcgttattagtggcattcaaagaaaaggtgttatgtaaatccaaggtacagtcttatcatttccaattattatcattatatggtgtttaatttttaaaattatgctgattattagtccaatgtttttgcaggaaattatagcagttacctacttctagagatgaaagagaaaggttatcaacttcctgtcttatttccttgtccacatggagaaagaacgatcaattttaatacagtaagagtctaccaaaaatgttttacttccttaagaatgaggagcagggaaaaatatgaaccatgggtcaaaattgtaagaaggcagatttcaggtgagtataagaaaaaaatttaaaacattagatctgcctctaactgcatagggatcctttgttgtggagtgcatttcctgtcaatagagctattcaaaccaaataatagtat

SEQ ID NO: 8708 - DNA, 2657 bp, artificial
  synthetic oligonucleotide
catgtacaggtttctaggtcaatgtaagtattcagttctctgggataaatatctaggtgtgcatattattagttttatggtagtggcatatttaattttgtaggacttcatcatactcttttccagagtagctgtgccaatggcattaacagtcttcttgagttgttatttattttatgctaaccacatcccaggtcctatattaagtacctcacatgcatcatctcatttaatgctcaaaaaactcttccattttaacactgtggaaattgaagcccagaaaagttaagtaattttttcaaaatcatgaatcataaacctgggaagtggcagagctaggtcaatctgattccagtgcctgtatgcactctttaacaatgatgctatcctacctactcctttggaaaatgactttaagtatagcagatggaaagctgtccaattcattgtagagcaaataagtaaaacagcaaactccttagaaggtattggtttggtatccatgttttttctactttggttaaattggaattgatactcctagtagtttggctgtggtagggtaggaaagagagtagatgtgtaatcagaacacctgagctcatattctggctttctcacttactagatgtgtggccttcagtaagtcacttaacctcaccaagattcagctaggttcttgtctataaaatgggggctaatgacacctttctcacagggtttttgtgaagattagataagccgatggatgtaaatgcactttgtaagctccaaaacactatataattagaatgggttattattgttattatctcaaatgattgtagcaggattgcagatacaatgcacagtacaacttggctgtgcaaagaaaatcaaattttacaaatgaatctccatctaatctgacctttctcttgagcccagagaggtgggtgggtaccaaaatcttaaatatctaattaggtttaaaacttagtctgatttagtactttaaaccaaaaattatcaaacttttttgtagagaaatgaatagtaaatattttagcttttgtgagccatatggtttctattgcaagtatagtcatccctcagtacccaaagggaattggttccagacctcccccgacccccacccttggataccaaaactcacagatgctcaagaatcagatataaattggtgtagaatttgcatataacctatgcacatcctcccgagtattttaagttatctctagactgcttataatacctaatgccacgtctaaacattacattgtttctgtggattcaatgtagtactcagtgcacagcgaatataagttttgctttttgttactttgtggatttttttccctgaatattttctatccagagttggttgaatccatgcttgtggatatggattcacatatatggaggtatagagatatggagggcttattgttctcaactctgagagctaaagtgtccataagagtgtatgtaagtgacctggagtgactaagttctaataaaactttatttacaaaaactcacggcagatttggcccataggtcatacttgaccatcctctagttttaatgatccctttagatagttttcagtttttcttggaaaaaaatactatctcagataaaagtcttctgcttcttgttataaactggtgtctgagtatatggggagaaggcttttggaaacttttagtgttaggggattgtattagtctgttttcatactgctataaagaaataccagagactggataatttataaaggaaagaggtttaactgactcacagttctgcagactgtacaggaagcatggtgctgacatgtttgacttttggggaggtgtattagcccattctcacactgctgtaaaaaacttcccaagactgggtaattcattaaaaaaaagaggtttaattgactcacagttctgcatggctggggaggcctcaggaaacttacaatcatggcagaaggcaaaagagaaccaagtaccttcttcacaaggtggcaggaaagagaacaaagggggaagtgccagacacttatcaaacaaccagatctagtgagaactccctcactatcatgagaacagcatggggaaaaccactcccatgatccagtcacctcccaccagttccctccttcgacacatggggattacagctcaagatgagatttgagtggggacacagagccaaaccatgcagcaatgattggaattattggatctttgtagcctctatattgccctctggctactctggtggctggctgatgtcccttgtctcctatttgctgcttgctgtatttgcatttatagctgaagtttacaatttcatcaatagtgattgtgttcctctttcttggtttggccagagcctggaaatatggcctggttgcctctgcttcctctcactctcattatagatcggtctctgccagatcttccattagcccactggctggtatctgtagtgggctcatttctttgccacagtggttctcatgacagacttaatggcctttacctcaatgtccattccttatgaaaactaagggctgttggggaaagctaaatttcagggatccctctgcctcaccaaggacactttcatgtagttggccttacactggaagt

SEQ ID NO: 8709 - DNA, 609 bp, artificial
  synthetic oligonucleotide
atcttaagttgcaatcaccattttgtaaaatcatgttattgataacaatgtttttcttggtatttatcttcacattttaccatttctggtacttatcatttcttcacataaattcaactatctgtctggtatcatattccttttgcctgaagaacttcttgaacatttcttatactgcaggtcttctagcatgaattctctcagcttttgtccagacatgtctttatttcttcttaatttttgaaagtaattttctcaggtatagaaatatgggttgatggcttatttctttcagtgttttaaacatgtcactacattgtcttctggttggcatagtgcttgtagtgtttaaaacaccatcactcccaaatccatctccatgtacatctgtcacattcacagaagacatctgacctcttcattatgtctcctagggtagtcatatcaaagcatttacatatcattttatttttaatagctgtccctttctcttttttattacagttatggcatcatgctagtttttttacaaattatgcatataaaaagttatctatgaatttcattttgaaatattaaagtgaacattacaaatatttgtagggaaaa

SEQ ID NO: 8710 - DNA, 4184 bp, artificial
  synthetic oligonucleotide
gtctacttgatgatttgcctagggatcttattggctaggatcctgaatgagctcccctcactctgactgctggctccttaacaccccaatgtaagtgaagggtcccgtggcttgatcaaatggtctcatccatggacagccctgctggtcagctaaggcccagggtccgggggctagtgccatgctaaaggccagactggaggtgccagggatccaaccagaaaggaaagacttgaccaggtggtgtccttccaccaaggggccaccccgtgttgctgcctgccgtacccagctggttggaagcacctggcagttggcattgaggaccactaacagtaaagtaggtgcggagggggttggcgggaggtggtagtgaaggttgcacagggccagccggctagcgtagggaagtttgcatgagctccgtaggcaaggagaaatggaaaattggctggctatctcccttcaaaagaattggctgttaaaaaaaaaaaaaaagaaaaaaggaaaaacagaagcagaaacggcaggacatcttctgttttaaaaatacagaccattttccccctcccatgtatataaacaacgaaaaccaggagggtagcttggtattggttcccgcccgaaggtcctttcctttcacacccgacctctctagatccccgacttaaccccgattgaagaagaaattttccaggatgggggtggggttttgctggatttgtcgaaagagatggtccacaggggaagagtgcataaacttggcgagaggcgagagagggagaataaccttaatcatgcacaggctccggccttaacagttgagtgggtggtggaccgaggccaagcggccaaataagtggagtagaaaggcgcgagtctgcgctgcgtgccacgtaccaaacgctcaattctccctcctgggccctgtatccatctctcgttcgctctctgtggctaatgcagagcgatggaacagcctcgggagaatagctggagaaagctcagagaaagacaaattaaaaggagctcagcgcagcagcaaatgctggagaacagcgctcagctgacccgttaaatgagtaattcggtaaaggtgtgttaatcagtgcggcgccccgagagcccagcgaaacactctgggaagatacctggcgtggcaacgggactcttcaacgctgcgatctagaaacgctgctagtcctgggtcgtagtccctctcccctgtctcgcttaaagagaggggttcctgggttgcaatacgttggagagcaggtgatcagatgcatggttggcgagcccctggcgcatggcagaatgattgaggccagggtcctagctgcaagcccatccctgcgtcccagtacattacctgcctgccccatgactggcggggctggagaaccctgagacttaaggatcttataggtggcaggggtggaaaagaagagttctctccggtcctggaaagctctaattgtcagaaaaactaggtggtttgcgtctttaaaagcaagttccagtctgcggggaaccaagcaggtgaactcctgactgaactagatacctgttcagcggctagaactggagactgggagagctggaaaacttttagtggctttccatacctgcactcagttgagcgctcgccccaatcctgtacgccggcctactctggtaaggacgctagacggcgctgccgggacacgctttccttctccggagaaaggtaagagagcgctttttttttttttttaaaccaggggatgggggacttggggttggcagcctttctcaatctgcctcccctccccgcgctcccaaatctaaaggggtgtggaagaggaggaggagcagaagcagctcttttcgtgacgcgccagagcgcttctctctaattcccacctcctccccggtgcaatcagtcagccaggaggctccaaactgttagcgacaaaaacgcagctctcggtcactcccactaccctcccacccgcactccaggcatattttggaggcggcagcagcggtggcaggatgtgaggcgagcctggagctcatttccaggcgcccttccctcttcggaactaagggagacttgtgggcttttgcacactggctgtagggttcccgggaaagactggagcagcgaacaggagggagagaggtggacaggcagagtctgcacctgccgcctgcacctccgttagggcgacagggcagctggtgtttcgctcctggagtgtgcctacctcgcaaggggggcgagggccacaggctgaggcgcccgcgtcccggagtgcaccgcttggccgaggcaaggtgttgctggggcaaggctgctccgaagcgaagtcgcgcaaaaggaagagtctgggaggcaggcgacttaggagagtctagtcactgagagacagaggcagcatctgccattctaactacggagctgagtaatttagaaaccctccttaactctccctttccagctctccccaaagtccacagaagctctgctgaactctagaaatcttccctggctggggggaagtttactagtatcctctttggctaagacagggagtggaaaaaacaggcggggctgtactgtccgctgtttggggagacgcggtcttcctcgcgcccccttcagccactccgactgcctgggaagtcccagcccgcgctctccggaacccggctcgccgtctcgccctggacatggaactacgcatctgagacctgctggacgttttgctggccgttttgcaagactcaggtaatgtccactcgcagagctggagagttgactggcaagggccaggggagaacgcgctgcgctctcagttggcagcggggcaggccgcagccaatggaggctttatctttcctgcagctctggtctccgcgcctggaaatttgccagttggctttctcttcctttagccttcccagaaagtttagggaatagagctccgaaggccaggggctcttcgcctgggaggagcgtgcgccgtccttcaggtgcccgcgagcccaagcgttgcgtttccgcggcgggatcttcatgctctctgcggctggcgcgcgggctctgcagcctggaaggcaatttccaactgggcgcttctgactgcccacatttctgccgcagctgggagagcaactggagctgggaagaggctcaaggcggctcctgggtggagcagcgaggggttccccagcaatacgctgccgctcctgggattcccaccaagcactaggcaggggagatcgctggatatctggggccatctctgtgctcctgcactgagagcctgaaggtacttcccctgtggttcccgagacgccccctttcctcttcccgcaagaatccccgatacccctagagtgggtttcccaggtccccactgctgctcaggcgtgaggatctgcccgcgccaaattgcgcttcagactccttgtgaaggaaaactagagtgggagagtagggatagccactcgcgagtggctcgccttgcctctctgggcctggcattggagcaaacagcttgatctgtcaccatcagacgtttaagaaaaatgctttggcaaggagaccctggcaagggaaatgtgtattataacaaatgtctgcttcaggggtttctcctggtccctgcagccatcccctctccatctgtgccgcccaaggacttagagacattagtaaacaagtattcaagattttccccttgccacccacaaaagttgtgactgcacagaagtattggaaaagtacttctcagttgaaagctactctagagcctatcacaggtgttttttttagggggagtctatttaggagtatcttgtccccgaatgaggaagcgggacctgcccaccaccactaccttcaatcgaatgtgtagacctccaagaaggaatcctcctttcttttcctggccaggggaatcaagctgtagattattaaacatgcggcatagctgggaacagaccccaaggaagtaagggagggagggaggaaaggacacttctctgagcctgcaagttcagcacgggcgtcctacagttcaggaagactacctcagtgacagagtccctgggaatgaaggagttaagtttttgggacaagtgtctgggactggggtccattttcccactgacatcctcatctcccaccccac

SEQ ID NO: 8711 - DNA, 780 bp, artificial
  synthetic oligonucleotide
ataatgccaatgatttcttagaatacaggactcttctgcatcccattaccagtaaaggtacacatacacaggcaaggaaaataagtatattcttcaggctatgggggcaagtgtctgaaattattctgatctacctagaaactatcttactttttttccttctctgctttatgagttgagagagcctggttgatctgcttcctttcgtttgactttgtaattattgttcaggcaaatataaatagtactagtattggactagtaggtagccaagaaagagaaactggaacagctatatgtgcccacctccccactccccactcccataaccaacagaaagtatagcaacaaaaaaaggaacaagcactacagtggatttccatgccccgctagcatgcatgtgtaatatactatagcctatcagatggtttccacatttgtcctagctgtaagtcacaaggcattttgatacaaataatacttgcgaataagctgtataaaatactcaccaagcaacactgaagctgtccctggaagtgacagtttgcagtcatgaatgatgaaatatcctttgtgtataaggcaattgtgttggttatagaaaaagaaatgagacttcctaggtttcttccttctgtggcttttttttttttttttggaaacaggaaagcttcctatacaatgatgttaggacctatatttcatttcatttcaactttcatttacagttgttgttgtaaagggaaaacattttaatcagtttctgcatgaaggtcagat

SEQ ID NO: 8712 - DNA, 1365 bp, artificial
  synthetic oligonucleotide
acgttttccagaatggagagagacattcaaggatgaggaagtaacatgcgcagtaatgacagagtcaggaacaggctagtattagaaaacagaaggaagttcaaagtagctgaggcatacagtgggtgagtgagagagaggcaggagatgaagctggagagatggattagcctaagtccaaagagggccttcagacttcatgtacatgtacgagtttgggtatcatgatagagtcagcaggaagccaaaggagaactatatgctgaaaagagacatgataggccaggcatggtgtctcacgcctgcaatcctgtaatcctagcacttttggaggctgaggcaggtggattgcctgagttcaggagttcaagaccagcctgggcaacacagtgaaaccccatctctaccaaaatacaaaaaattagctggatgtggcagtgtgcacctgtagtcccagctactcaggaagctgaggcaggagaattgcttgaacctgggaggtggaggttgcagtgagccgagatcaggccactgcacgccagcctggggcaacagagtgagactccatctcttaaaaaaaaaaaaaaaaaagagagagacatgataaagtgtattatttcttaggaaaataaatctgatggcaaaatgagggatgggttagaggaaggcagaccacttttgaggctttggtaagaatgcaattgagaaaagtatggttctctgaagtaaggctatggtcatgagacagaagagggaacagctatgagagatgttaatgactgatttggatatatgccatgaagaagaagagtttgggatgactttgaagcttctagcttgagacttcaggtaaatggaagcaccattaacagaggataccaatcatgagaggcacagcaggtttttgggggaaggtttttagttccttcccctaaagaagaagaataagagtttgggatgactttgaagtttctagcttgagacttcaggcaaatggaagcaccatgaacagaggtgccaatcatgagaggcacagcaggttttttggggaaggtttttagttcagttttggataagctgagttttaagtacctattgaacatcaaatgagaaatgcatggagtttccattttaaccatttttcatagtaatcttttaatgtaggtaaatgatgtgagatattctttttgtctataaattgactgactgaaaattgtggggcagttatgtttcagaaatatgtaggattgggtattatattgtctttttattctaattttgatgaaatgtcaaccaatggctgtcctccaaagagttatagttgtatagttaattcttctggattaaagaaattcttcgtatact

SEQ ID NO: 8713 - DNA, 152 bp, artificial
  synthetic oligonucleotide
ctttctagctgtataatcttcaggcaacttgtttaactcctttgggctctagcatccttatctgtaaactgacagtattttactcaatattatactgtggaagttagatgatgataataactagcatttgcttattactatgcatcagatat

SEQ ID NO: 8714 - DNA, 1000 bp, artificial
  synthetic oligonucleotide
cttaagtcttcaaacatctctcctccaattgtgtttgattgttaatttactcagcaaattcatttccaaatttcaagccagctgaagttgacttactaggaatttcacattctctaggtcataattaacaaggcttgcctttatttttctgcaataagccttggttttttggtgaaggaaatgcacatgccctgctggaagcttaggcagattatgaggggccgtactttttagcttagctagaaatggaatctatgtgggaattgaactacctctatttcagctaacagcagaaagtacacctgcctttgcttgtatgcagattcatatatattggtgcagatatgacattattaacaaacctgtacatgtacccttttagaatattttgtcttccattaatggaaaattaatatatccaatgacaaaatatcaaatctactactggatattttaacatatattatgacaaatcagattcccttaccactttgtactgttgggaatgagtcctcaaatgtaccctctttccctagggcatgacacactggctacattttcataatttaacaaagtataaagggactttggcagatatcaccgaatctgtcagatttaactgcttgtaaattcaattagtcgggggaaaaacagctctggagaatatatcaaaattcaattagtcagcaaatcgaggtttttagcctactcttttgggtaatctatcaaaagggaaagggtacttcacacttatgatcaactaattaaatgcattaggccctgatgggatagtttttaatattcaccaccctttcaagtctatttggccagaaaacctagtatgaaagagttccaacagtaggcgttatctaaacaagtgtatagaatgtctaattaaggtacaggctgaaggtgtttccttgccttcttcttttaattgattgaaagagcctggctctaaattttcaataccttttaataaccaatttaagtgttactg

SEQ ID NO: 8715 - DNA, 289 bp, artificial
  synthetic oligonucleotide
gatgaacctacctcattgtctgatgtccatgaatggcagttgctatagaagtctgtgcatggcagttatatgaacaataaccattgtgacaaagggaaccactattaccctaatggaaagagagaaattagagacacagtagccacacaaaactaaaatatattaaatattagtgttgtctacttctttaatggggaaaaagagcatatcattagtgtcaagcgcatcccacagtaggctctctttagaagaataactcagtgcaataatgtgaattgctttgtctttg

SEQ ID NO: 8716 - DNA, 379 bp, artificial
  synthetic oligonucleotide
aatttaaaaagtgtaaatcagtgtatatatgtggagtggtgttactattatttatagtcacttatcacccttgatggggcaatgataaacagctcatagagaagcatagaatgactagatccccaccccctcccatagaaagtggcatagcaatagctggatggatcagaaagaatgtgacaaatagaaaaaaaaaagtttttcttccctctagtctgtcattccattttaccaaagctggtgtactttgggatagtgtgattgttaagcctccctgtgggttgcaagtatgcttttaactgtgactattgatgctgctgctacagaccccctctgattttcctttacgtgctttatgctgtgaagaggttttttaaaa

SEQ ID NO: 8717 - DNA, 2649 bp, artificial
  synthetic oligonucleotide
tgatacagtggttttaacaatggaaatttatttggctcagacctaaagcctttatataaaagttagtaccaaaattcaataaataaagctatcggttatttggttgtttattggatagagatcaatattgccttgttaaaggtaatctgagtgttagaccagtttgtatgatccatctttgctacaatttccacatgtttaaagcacagagatgtataattgttagtttgtctataaaatcctatgtatatattaaattgtctaaagtcatataaaatcataccctctagaccatagacaaatgggaaatcttctgtgtattttgatatttaagccaagttcattccacttgtgttattgggtaagttaatagatcatttcttattagagtttttgagttagggagacttaaccctgcctttcacacatccattatgaagacattgtaaaaatacttcagggtaccacaggaagtacaattttttctttttctttttttttgagacaaggtcttgctctgttgcccaggctggagttcagtggcacacacacagctcactgcagcctcaacttcctgggctccagtgatcctcccacctcagcctcccaagtagctggggctacaggtatgtgtcaccacacctggttgacttttaaatttttgtagagacagggtctcactgtgttgcccaggctaatcttgaactcttgggctcaagtagtccttctgcctcagcttcccaaagtgctgggattacaggcatgagtcaccacacctggctaaagtacaactttttagtctttgaaaagtaaaacatatttggatctatgaaatcaagaaaacaacttaatgtgtgtacctctccccttctatatctatataataatattgttatagtgtagttccattcagttattttagtttggaatcatgctttttattgaaattgttggtaattttatttgtatgtattaactgaacattgattattttgctacccagaatctattcacctttctttttgaaaccacacttttatttcctttgtagatcacccctccccacacccagcccacgtgcttaccataggcatatgaggtaggcctaagccaattagagccttacatttccataggcttcaatgattaatttaagggtgggcacattacccagttagagcaaaagagatacaatgaaacttcagtggacacacctgggaaagaagttcgtgctgttgtcaataaacttggagttatgtaaatataacttctggagttgctacagccatcatgtgaccatgaaagacaaatctgaaatggatgagagcagaggttaaattgaaagaatgagggatgagatctttagccatccaatcagacctatttaactggaatttttcattatgtgatccaataacttatcgttttgcttaagccacttaagggttctgttttctgtcacttggaactggaagaatccatttgatcatccctgtgcaatcttaggggaaggcatgggctttgtataactacccgtagtgccaaatctttcaacatggaaggagagaaagagacagagtgaacaaacatattcaggcgctttggcctgaattaacggaatgggtagaagtgaggcatattttttctctttaaatggtagtttatttcacgtttgtttagtgatgcattatgccacgctctgtgccagacacgacattcagaggtgaatgataattcaactctgaagttcacaatgaagtgggagattattccaatacaaggaacactttccagggtaacgggaacatatccaagagacatctaactaggatatgagacttgaactctgctctattgtgtcaatagtaggcagcgaagtggagaaggccattgcaggcaaaggaaataacatgagatatattctttaagagtccctgagttttgagtgccttatgtagctactggcaattgtagtagggatttatagtggaagaaagttttgtgcatgactaagtagtagtacttgggtcactgagacagcaattaaagggctgatactcctatttataaatgataccagtgcctagatctatgtctgaatgatagaatgtggatttagcttctccctagaatccaaaccatattatctgaatgcatgtttgtgcctcctgcagagtgccagtgcagcacaaatgatataccagagacgtgatctctatcctcaaggagggcaaaatctgaaatgcgccactttgataggaagcagaagagtggtgggatcgaggctgcaaaatttacatattcattgatatgtgactgggtatttacttcatttgcaaataataggtaagtgcattgtgcagaatagaaggcacatgaaattatgtaatttgaatgggaaatggggaaaatatctgtaaattactaagatgtgtggtgtagtaatcagctttctcttctgacaaaatatggcacatcaaccctctcatttattatgctctattacgttcttttaccagtcacgctacaagtttcacacactcccaccatgaaactgccagtcttcctactccatcactgcattgctagtgaaatgacttttaatgtgcaccgagtgtcagcagtcttctaggtgccctggaggaagaa

SEQ ID NO: 8718 - DNA, 1982 bp, artificial
  synthetic oligonucleotide
tctgaatatttgaagtttctgatatatcgaatcattttggttttgaagtaaagattaccaagagctttcactcagcctgtgattttccctaggcaggtgagacttccaatcttaatagggcttacttaaatgatgcaaaaggcatgcacatgaaccagtaatttttattaataacattatcatcattgtaattacttgcaatcttggaaagatcctggggttataatgtaagaaaagcctgtatttgatttctggctcttgattcttagtgttgtgccccattaggcagcatagggaatgcctctgagttctaatcccctcctctgttaaactgaaaataataataatagtttctttatgctattgtgagaagtaaattagataatatatgtaaatgcatgaagcatatattaagtggctcaataaaagccgcctttcttctcagcttttctttagacaccttttccaatctcactgtagcaagtaaaaattattaaaattggaaccacaaatctttttaaaaaatcatttcaacttttaagattcagggggtacatgtacaggtttgttacttggggcgtattgcatgatgctgaagtttggaatacaaatgatcccattaccattgtagtgagcatagtatccaatagttagtttttcaactcttgccctcatccctccctcttccttcaagtagtctccagtgtctattttgccatctttatgcccatgagcacccaatatttagttcccacttataaatgagaacatgaggtagttggttttctgtggaaatataaatctgactctgcttgatgtgtttagaaattgttatcccctgtcaatgggataagttagtctctagcttatacagtatatgcatttgttacttgcctgcagtggaatatatttgaaaatggatcaccaattgatagttagactgttgacttctggaatgaaatgtgagaaaatataaccactcaagctacattcttctattatttgctaaatatccaaattgttaccataagggagaaatatgcctcatgaattgccatgtgactttggcatatgactgtggtaatctcatttttaagaactgcatgtaaatttgaagtaagaaattctagtttcaattaaaaacaaactgagctgaaatatccaaaattcactggctatgagcttatctttaacagttactaatttatatggccaagaggggttgtatttgcaaggccatccccttaagagctgaggttaaacaagtgagtggcatgggctataaatgaattgaaaattgccttctgttccagcccagtgcaatggtttgtgttttgtaataagccctagttggtgaggtaactcatgtcaccaggaggagctgtccacagactgcttgatttgtcactgctgtctgaaggacacaacaggctggggaagctggcactctgcagaatttttatggtgctgcatgcatgcattggtctcccttatcaagctgtaattcaataataaatacaaaaaaatttttgtttaaataaatctagggttgtgacacaacctgaccaaagctaggagagttaatgctgatgctgggatattaacttagccagggagcagtttgggtgaggggaagaaaaagatggatgctgggagagagtctctatttgtgatagagtattcatctgcatggctgtttttctggaatgctttggtctgtgccattggctcaatgtagtcatttttcaacttggtgtctttttgttcttcacgccctcaccctcctttttaaagagagaccaaagagcatgaagggtgacgagaaccactacaagaattttgttgcgataagcagaagccagccttatagagtgggttctgccattttctcccagaatggtgaatggttacaagaaaattactgggacaggtaatttggggaatggatggatttgtgaaacatttttttttttcacaaagaa

SEQ ID NO: 8719 - DNA, 876 bp, artificial
  synthetic oligonucleotide
aggaaggaatggggtaagggaatggcaatctggaccagaatgggccagaagccaaggccaatatacagtgggaaaatggttattcaaactgggggaagctaggtcagtatagcaaaggtgaagccaaggctaaggacaacagtccagattcttcctagcaaagtgtctcacagaaatagagagcctgaatccttgagtatacaattaacagcacaggttttgaaatcagtctaaatacaaatctcaactctgccacctaccactatggtaccttgagtaaaagttccttaactgtgctaaggatctggatccgtttttttttttttttttactgtatctctctctgttgcccaggctagagtgcaatgacactgtagcctcgacctgctggacccaagcgatcctcctgcctcagccttccaaatagctggaactgcaggcatgcaccaccacacctggctaattttttatttttatttttagcacagaggacgtctcaccatgttgcccatgctgatctcaaactcctgggctcaagtgatcctcctgctttggcctcccaaagtgctgggattataggcatgagtaactgctgctggcctaagacctaattattgataatgaggacagtatagcatcttaccacataaatttgtggtgtgagttaaatgaggtaacacatgttaaatatctgatcaagtgccttccatgtagtaagcactcagcatggtaatgtaattagtgttagtattgctgctgcttctgttcctccaccacatcatcattcacacgattttggaatagcaaaacaacagtatgtggtattccaagaagactgaagcaaataatttgagaaatcttttttcttatggaaaa

SEQ ID NO: 8720 - DNA, 8333 bp, artificial
  synthetic oligonucleotide
agagtttttcacaatcacttcatttccacacctctaactgacttttgaacacaactagaggaggagtaggaggggacactcattccaaagtgtccaattaagcccaatcctttaaaagtattatgttgtcatgatggctgttaagagcatggtgaaaagatattagaataagatgtggggaatcatgaccgtgagacagagaaagtagtcaaaggttttccaccttttaaaaatgtacttgatcccccactaattgcacaaactctgcccctcagacctagatccacccacagcatcaggcccacacttctggcttcaatccactctattctgtcctctatccactccaataaactgaaacagttcctattagagttcaccaatgaccatcattttgcaaaatccaatggtaacttccctgtcctctttatactcaacctctcagtagcatctgatcctgttaaccatgtcttcttgtaccaccatttctgctggattgctggatatcatactctcttgtttttctcctagtttactgtctagtcattcccactttcctttatgtgttcctctttctctgacttttaaatcttgaactgcaggccactggggcagaggaagcatgcacactagtgcatggtgtttggtatctcatcataccactttggtggaagagcagtggctgtagaatctgtttctttttttaactttgattttagattaaggagtatatgtgcaggtttgctatatagatgaattgcatgtctcggaggttttggggtacagattatttcatcgcctatgtaataagcataataccctatagattattttttgatcctcaccttcttcccagccttcatcctcaagtaagccctggtgtctgctgcagaacctctttctaggtatatgattagtgactgaacctccagtgccctgtctcctggtgctagaggattatttatttatatattgcattaacttctagttacttctttgcacctctgccctctttctgcattttgcatccctacaggactatgccctttggaatttatcctcctgaattcactttttacttaactaaagtagtatattagagaggacagacaggtagtttcaataagggaatatcaatgcctataagctctgttgtcatatcaaggaaaaatgacatatttcagtagaattaggaaatggactttctcttgtttaagggctgtgaggtggtaatttataagggaagattaaaagaacaaagtacatataacttggcttagagggaggtctaaagatctgcaaatatctctaactgcacaaacattagcaagagaaaatattgatttagcttagtacaagctacaaggtgctgtaactaagaataatgaagttaaattttaagaacacagagagaatgccatgaaaatattagaataaaaatagagtgagctatggaatattctgcaaagggaagcttttctaataaagggaaaacagctctgtgagatgaaacaaatcgttgttatgcaagatcagtgacatcctcaactccaagtctgcacaaatgtaagaacactagttttctatcttgtgttacattaattgggatgacagttcctatgcttctcaacatacctataaataggttctgggtcaacttctgcctgtaggtattccttgatcttttaaagacaatgattacccacttaattttttcacttcagagaacatacagaaaaagagaggtccttcacgtcccttgtaaggtggattcctaggtattttattctctttgaagcaattgtgaatgggagttcactcatgatttggatctctatctgttatcggtgtataagaatgcttgtgattttttgtacactgactttgtatcctgagactttgctgaagttgcttatcagcttaaggagattttgggctgagacgatggggttttccagatatacaatcatgtcatctgcaaacagggacaatttgacttccttttttcctaattgagtaccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatatgtcccatcagtacctaatttcttgagagtttttagcatgaagggttgttgaattttgtcaaaggccttttctgcatctattgagataatcatgtggtttttgtctttggttctgtttatatgctggattatatttatcgatttgcgtatattgaaccagccttgcatcccagggatgaagcccacttgatcatggtggataagctttttgatgtgctgctggattcggattgccagtattttactgaggatttttgcatcaatgttcatgaaggatattggtctaaaattctcttttttagttgtgtctctgccaggctttggtatgaggatgatgctggcctcatataatgagttatggaggattccctctttttctattgattggaatagtttcagaaggaatggtaccagttcctccttgtatctctggtagaatttggctgtgaatccatctggtcctggactccttttggttggtaagctattgattattgccacaatttcagatcctgttattggtctattcagagattcaacttcttcctggtttagtcctgggagagtgtatgtgtcaaggaatttatccatttcttctagattttctagtttatttgcgtagaggtgtttatagtattctctgatggtagtttgtatttctgtgggatcagtggtgatatcccctttatcattttttattgtgtctatttgattcttcttttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttctctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccaggtagttgagcagttttgagtgagtttcttaatcctaagttctagtttgattgcactgtggtctgagagatagtttgttataatttctgttcttttacatttgctgaggagagctttacttccaactatgtgttcaattttggaataggtgtggtgtggtgctgaaaataatgtatattctgttgatttggggtggagagttctgtagatgtctattaggtctgtttggtgcagagctgagttcgattcctgggtatccttgttgactttctgtctcattgatctgtctaacgttgacagtggggtgttaaagtctcccattattcatgtgtgggagtctaccaagggacgtgaaggacctcttcaaggagaactacaaaccactgctcaacgaaataaaagaggatacaaacaaatggaagaacattccatgctcatggctaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaagagcatggtactggtaccaaaacagagatgtagatcaatggaacagaagagagccctcagaaataacgccgcatatctacaattatctgatctttgacaaacctgagagaagcaagaaatggggaaaggattccctatttaataaatggtgctgggaaaactggctagccatatgtagaaagctgaaactggatcccttccttacaccttatataaaaatcaattcaagatggattaaagacttacatgttagacctaaaaccataaaaaccctagaagaaaacctaggcaataccattcaggacataggcattggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctgcaatgaactcaaacaaatttacaagaaagaaacaaacaaccccatcaacaagtgggcgaaggatatgaacagacacttctcaaaagaagacatttatgcagccaaaagacacatgaaaaaatgctcatcaccactggccatcagagaaatgcaaatcaaaaccacaatgagataccacctcacaccagttagaatggcgatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacacacacacgtatgtttattgcggcactattcacaatagcaaagacttggaaccaacccaaatgtccaacaatgatagagtggattaagaaaatgtggcacatatacaccatggaatactatgcagccataaaaaaggatgagttcatgtcctttgtagggacatggatgaaattggaaatcatcattctcagtaaactatcgcaagaacaaaaaaacaaacaccgcatattctcactcataggtgggaattgaacaatgagaacacatggacacaggaaggggaacatcacactctggggactgttgtggggtggggggaggggggagggagagcattgggagatatacctaatgctagatgacgagttagtgggttcagcgcaccaacatgtcacatgtatacatatgtaactaacctgcacattgtgcacatgtaccctaaaacttaaagtataataataatataaaaaaagaaaaagagagtatttgtgtggcacactggatatcacggcagactagccaggggctctggctacatctgaccctgctaaaccactccaaggactgaggggatagatatgttggctcacctggaagcaaatcttggcatactattgttcttcaacacactttttaggaagcactgtgcttttcatttagacttgggaggcagccagtctccaacccccaactcccaatcccttcttctattcctcctgtttcactaccttcttatggctctactgaaataagtcccttccgtctttctctttcctcatccccttctcaaagcagaaaaaaaaaaaaaaaacatgttttgctttgacataataatccaaacaatttctcccaagatccttacaatgtggaaagagagccatagtcagtatatcctgaggaggtaggtaggcatttttctagttctctaggacacatctagcttaccactactgtttacaagtctgagttgaagggaggcaatggtcaattgttacaaacttcataaactgaccaatgaatatttgcctggtccatatttaggttgttcttttcatcatgaaaagttccccagtttactaaccactagcaaaggtttgtctcttaaaagttgctaagtctaaataataacaacaaactaaaattctagaattattgagtctgattttatgagtatcaattacagtattttaattatatattcctgatcatacttaaggctgatgactatttaaaatttggcaaaaagaaaacacaacagtcttagagtactaagccaagttgtaatgctcaggccactaaatgcattaaaccttgtactcagaacacttgtataaagcctggaacacttatcagaatgtcaaaacaatcaggaagataacagtctttgcatctgagagattcagtgggataagtggaaagagcacaggaccaagacttaggagttctgggttctctcaagtcttgttcctgtcatttgcaaacattgtgcacttaggcctaccagatcctcccaagtgttaatagttttgtatttaaagacgaatgtggttagatatggtgaactgaacataggcctgaatctctactccatccctaaaccccactgaaatgacattaaaggaataaaaagggtataactcattaaaaaaaagactgagtaggaaatgacatcagacagggggtggtaacaaaaatttggaagctggaaagcagatggacaagtgttacactgactcagctgaccttgggaaagctaagcctaagcctgaagaggagggggatgcaaaggcaagaagcaagcccatttccaccatagaaccccagaaagtttcaaaagttagaaatatcaaataaattttcaggcagggaagtaggttgagactgaaaacaagtgaccttatgaaatgtctttaaagcaagtagttagacccctagatatctttcccacactgtactcccagataattgaatcctccactcctattctgattggagacagaaggtttactctttggggaggcttaactactcaggctctaggcttaggaacagtaggcccagctgaggacagcaaagatgacttgtactgaaaacagggaaaataagggaaagtctacatagtcaacaatgaacgtcccaatgccctttttccatactcagtttccagaaacaggtagctaaacttctaccatggtatagattggagccagaggacagataactctaagagcaatacttccaagtggaacatgagcctgatagcatgctgacaacttgaatgtgtagttagaggaggttttcaattattcagagaatttggtgatgaattaattactggtatatagaaagctaagcaactgaaaaaaatgagccaattaatgagctccagaaaaattaaaatgtcatacaagcaaagaaaggtaatcataatagagtgagtagctcagctataaataatgtgacataatcaacaatattgtaaacactgaactgatttaaccaactatggtgtatgtgctgggtagaaggggccttttaggaaagtggaattctcttcttataataggaagtcagcaggtactacctaatattgaattttaaaaaataacagtgtaagtgtataatttagatgtgtatgtggaggcaaacatcagaagaaaaagagcagagagttggatgttgtttactttgggagaaaatatatcagcagttagacagaacagagcaggggactgctctttgcattacaagcctagtagtactgcttgacttttattgtgtttatttatttttaagtgacaggtctcactctgttactcaggttggagtgcagtggtgtgatcatagctcactgcagccttgaactcctgggcttatgcaatcttcccacctcagcctcctgagtagctggaattacaggcacatgccaccagacttggctaactttttaaaatttttattttatgtatttcacagagatggtgtcttgctatgctgcccaggctagtcttgaactcctggcctcaagaaatcctcctgcctcagcctcccaaagtgctgagattacaggtgtgagctaccacacctggcactgcttgactttttaaagtatgtacatttattacttagattaaaaaattaatcttaaaaaattattaaatttggctaaataacctttggtctttcctattttgaaaatgtaatgactatgcaaaacattaatagtttcttctgagagcttgaacctcacactctttcatgaaattagatattacttaggaagagaaaacattaagacttccagatcctcatagacttcctagtacatgaagtgctcaagctactcatgtgggttgtttaaactgcagtttaaatttagtttggtgcatttactttctgccacata

SEQ ID NO: 8721 - DNA, 705 bp, artificial
  synthetic oligonucleotide
aagaccctattggtcccaggcctactttagaagtgtcttttaaaagattgctaggccttcctaagaattaaatagaagaaaaaggcagtctgtacagatctcacctctggtaaccaaaagcaagcatctttgcagctaactttgcttctgttgcaattgatacagggacaaatggctgtaattatataggggaggataccaaatctctatttagagaccagagctctattagcagtgcattttccagggtctgatgactagtaaacaggaaataagcctatctaccttgaatgagcacagctatccccctggggagttccattaaggataacagtgatgatggtatgtgccactactgggcactcttctatgcagcgcatgctaagtggaaatggcattcttttctcagactctctgctcacttcctgtactgtatataactgcattatgagatcttgggtgtccttctacagaggtaggaccaagtgttctttcgaggattgagagaagagagatttggaggtgggacaatctagccaaataatcttagtcactttattattcataaggatgttaaccaagagttccttagtagcaaaatgagattctttatgttgtcagttttccaaaatatattccacttctctctgtctcagagcaggccttttcagagtagaacattgtgcctccactgaatggtacctt

SEQ ID NO: 8722 - DNA, 1991 bp, artificial
  synthetic oligonucleotide
gcatcaaatgaatcttaagagattgaaataagatccatggtagctttggaggatttctgcaattgacagtttgacacagcatggcttcagattatgtcaaaactgacaaaagcatgtgtagcctgcttaaaagaatattttttcaattctgtcttgttggaaatacttgccatgaagtaataataatacctttaatatgcaaatgattataactgcatttattacactgtcaaatggaaactcaaataccagctctttgttttacaacccagcacatcacacaaaataagagaaatgactgctttcatcatagagttcataagtggaagaacaaattctcttttccctgaggttgctttcattttctctcagatatgttctttttccacaactctgaaaaaaaataagaatttagttgatcactgaagcattctgacattcagattttctccttagtctttatctccatcctgatgatcctatatgtgtccaacacttttgcgaagaaaaattgcacctttgaaggggactttacagtaaagtaccccatataactatctttattcttatccattgtttgatcttactgctcatttttaaaaacttcccaggggtctcattttttcctcatcacttaaacaggaataatgttttgtgctgttcatttctccagcaacctccacttcattcaccttggctcatttcattagccaacagtccctgaagcactgccatcttccactccttgctggagaggccctgcctggatgcggtggtttttccaccattaggcacatgcggtgggaggggtggagaagcagggggaagtagtttcttcgtatcttcagtgaagatactttaaatctgtgacatttttttttttagctttcacattcttttttttcttttattattattatactttaagttttagggtacatgcacgtaacatgcaggtttgttacatatgtatacatgtgccatgttggtgtgctgcacccattaactcgtcatttagcattaggtatatctcctaatgcatccctcccccctaccctcaccccacaacagtccccagtgtgtgatgttccccttcctgtgtccatgtgttctcattgttcaattcccacctatgagtgacaacatgcggggtttggctttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaacagtgccacaataaattgacaaatggggtctaattaaactaaagagcttctgcacagcaaaagaaactaccatcagagtgaacagacaagctacagaatgggagaaaatttttgcaacctactcatctgacaaagggctaatatccagaatctacaatgaacacaaacaaattcacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaatcaaaactacaatgagataacatctcacaccagttagaatggcgatcattaaaaagtcaggaaacaacaggtgctggagaggatgtggagaaataggaacacttttacactgttggtgggactgtaaactagttcaaccattgtggaagacagtgtggcgattcctcaaggatctagaactagtaataccatttgacccagccatcccattactgggtatatacccaaaggattataaatcatgctgctataaagacacatgcacacgtatgtttattgcagcactattcacaaatctgtgacttttgaaagatgcttccagcatatgggccttctct

SEQ ID NO: 8723 - DNA, 902 bp, artificial
  synthetic oligonucleotide
tatgttttactcctgtaagggatacttaccctgcccattttccagggttattgggataattaagtaagataatacacatagaagtacttggaaagattactaacatgtgtaattgtaagttgttgctgcagtatcattgcaaaggccttttgcctacattgagcctgaatgtgttccttgtcttcctcaggatgtgaagtagggagagaaaaaataccatctccattcttgcacactcgtcagtctgcctcctcaacctcacatagctctaattgtacctaatgaaagtaacatttttaggtcccagttgcaggaaatattttaaatagaaccagcctggggcatttttcaaaataaaatctaaataatgcaagattgttagcacgaactgtgccagggctggattacacaactaataaaaatcaacctgagtttcagactgtcaggcagcattgattatacctcccccaggtcacctgaggtgatagcaggactcacatcagaccttgtctttaagttctagggacctcggtcatcctcaacgacttcatactaggacttgttcatgagttaacaaagcagtttgtcagcatctattcacatgtcagcatctattcacatgtcagtgaccacaatgagagtgtatacatactgggccctggcttaaagttgtttgtggctaaggattaggaaggacacacttcctccttcaactcatcagccatctccagggtggcttccttgcctttaacaccaccccaaatcaatacaaatgctgctgacaccatctacgttgtttatactttggagaggtcagggaacgaacacatgaatggctcttgtcttgtgcctggaaacctggctttgaggtctctgggctttgttatagaaggcatttgtct

SEQ ID NO: 8724 - DNA, 383 bp, artificial
  synthetic oligonucleotide
ttgaaaaggctgttaaaatacttccttattttccgactacttatctttgtgggactagattttcttcatatatttcaaataaaatgatatatcacaacaggttgaatgtagaatcagatatgataatttagttgtcttctgataagccaggcattaaacagattttcaaaaatataaaaacaataacactcttctcatggcctttttgcttttgcaaaatatagtttctgtgataaatatgttatgtaataaaatcatataattataattcattattttaagtaaattattaaatattttaaatccctcagttttaatttttaatatagtaaatacataacctatataaacaaaagcttcttagtattctctttaatttttaa

SEQ ID NO: 8725 - DNA, 616 bp, artificial
  synthetic oligonucleotide
gggttactgacatttgtgtttggattttttatgtgagtttttgcacacaaattgagattgctacaaaggctatccagtataagcaattgctgagtaaccaacacagggtctctgactggtaataacaatggattttaaacacttagcaaccatgactggggaggaggctttgcagccctagcaggccaaggggctgggaggaaaagaaaaataaaattggctgcctactggacaactgtgcatatttaacaagaaatagtttggggtgcaaataaatcatctgagttgattaaatccagtctgtttagggaattggtatgtagcttgctcccttggtgaaggtttgacctaaggaataatcaaagcttttctgaaatgtctgtaatcactatttggaatccttatgttgccataagacttctaaaagccacatctgctatacaatattgtctggtgatccatataaactctttaggccacaggtttttaatttgtttgtattagttttctattgctgtgtaattcattgccacaaacttaatggctattaagccatttatttattttcccagtttctttaggtcagaagtgcaggtacagtgtagctggtttctct

SEQ ID NO: 8726 - DNA, 263 bp, artificial
  synthetic oligonucleotide
aaatataataggatgcagtccattcagaaaagaaaccagttaacaaattatgccttcaaaggaagaaaatttcctgtgatccccgattgtggtctaaattatgtttattatacgttttataaaattctgaacaggtattgaactattttaaatttcttggatttattgcttttatacaaaaacaaacttacaaatgaaatataaataaaaccacaaaactaataaatctaaaattaattttaattatatttgtcttactgaaa

SEQ ID NO: 8727 - DNA, 1586 bp, artificial
  synthetic oligonucleotide
gaaaatcctgaaagaaagagtattcatttggtcagcattcatcacatgtactaaaattatttgtttttacatttttctccattaccatagtatgagttcccttggggaaaagtcagtgcctcagtaatactgtttatctgctcaagttcctgtcttgtaggaggcattgaagatattttttgaatgagtaaatggcaggatgaaaagatgagacctagatcttatcctcaagaagcttctagtctgttagaaaggatcacttgtgtacataagtagtagtaatccttattctagcctacatttatagactcttctctcctctacttcccaatgtacccagtccatagagaatatgacacgtatgcttacacctctctttcataatttcttctgctgagaataccctttcctctttttccacttatgaacttgtattcatttatcaaggtacaactcttaatagtatcttatcagtaaagtcttctctgagtcttttccccatgtagaacaaatccctctctcctctgcccacttacagcatttttcatatacctcgcttagctcttagtacattaaatcataattacttatcattttttcagctttaatgtgaactccaaaaagagtgagaccttatctaattgatctttgtaattctagggcctacaaccgtgtctggcttatagttagtgctcaacacatagttgactgaaaaaaaaaatgaatgaatggatcaatgactcaatgaataattgtgacaaataccctaaaagaagtgggaaaaaaactgatatatgattgttattttgtatagtagggtcccaagagccaaattcaaattccccctttttggttaaagctctccctgcctcagtctcactccttttttttcagttcctataccttctgtctgttcttgactttgccataaccgttgcctgttatgacagattccgtgagcatccagcacagatgtatgtataaaaacaagtaagattaaccataggtgagattttgtcacttgaaacataataatatcatgtataactaattgttgcatgttctaattaattgcatattttgattaattctttggcagggaataatcctggactaattttcacagaattagaaggcagtaaaatatactcaccactgcaattatactaaacatagttgaatggagaagattggtttgaatctacactaatcccaagatgtacatgggaatttgttctttaaaaaaatacccagcatacttgtcatttatcatattgttataaaactcaagaagagaaaagaccccaattacttttgctttccagttgtttggagatctgataaaaggaggtattttgaaaatggctcaacaacaactgacaaaagtccctaatggatcatatgctttgtcatcctcagtagcatcactggtttactctgcaaacattagcagtttccttaatctccacagtcattggcttgagagtgaaaacactgcatcacctagttagaaccacaaaaactagattggttttatatttaagtgctttgaaaatttagaataacacctggtaacttataacaat

SEQ ID NO: 8728 - DNA, 921 bp, artificial
  synthetic oligonucleotide
tgcacaagaatggggaagttttgagcactatagaatttgcttacttcttttttattcttattaatatcaaatacaggtaaaccagactttacaagcaatgctacaaacagtgtagaaagtgtctctacatctatcatataaattcatgtttattagatctcagtgagagtaataaagagtttcaaaataaattggagctgcagttcttttcaaagtgaccccggtaacaatgtgtctgaattggaatactttatctatattgatttttattttcatgtcaagtttgaaaaatatgtcaggtgtactttgaggatacataaagcatatattcctaattgtatttatttttttgctactgtctatgtcaggtgtactagaaacatagggattattaaaattaactaaaacatggcattattacccatttagaaacaggtgctaggaactctcaatcttgggttctatgtacccagtttcaatcttactggtcaattctgtttaaaagcaatccaaaccagaattttctctgaggagaacaacagtaaaatataaagtgttaccatgggttaaaaaaaatagttgagtggatgaatatttagtcacagccattaacctttaattttaatggttttgattgaggaagaagtttttgtttttagcatgacacttaagtaaatgaatggtttgatcaaaatttactgttataggctaaaagtatgagattaataatagaatatcagagatgccagtcaagccactgaagaaatggattcaacctaataaagagcataactcatcaaacttaaccatgacaagcctaaatattcccatttcatcaaaataaaatggctataattaagtgttttaaaattaatgttatcagctcttcattcatccagtcattctaggccctgcttccca

SEQ ID NO: 8729 - DNA, 1915 bp, artificial
  synthetic oligonucleotide
atgaaaaactctgatattttctatggatatcttctctctcagaacttctagagcacttctagtttattctctaaaatacagcacttatttctcttatattttgtttatagtgaactgttagaatgaaatagaaactgctctcattgtacgagtggctttaaacatcgctatctcttgacctctccttttattcccatggacttttctaatggcctgcttagacttatccctcctccaagaaagtgtcagatttatatttcttttagttttcttgtctgccagttggagataataattactatttcaaaggactgtgaggattgaatgataattacttcagaagtgcctggcattgtttctggtacacaataaatggtagcttttgtgtataagacagatattaaagtgttaaagagaatgagaaaaaggaaagatagagttgtaagtatctcttagccttcttagtaattccccttggctttaggcatgcctcaagtttcaccatttcttccatgaacatctgtgctttgattacataaacattcttgtttcccagattagtctatccataataacatctgtgaaaagatgaggtatgtgtgcaagcataatatctataaagagaagttaaaatcacttctgcatacatattgtttgcaggtatccatgtcattaagtactaattaatgctgccttttgcatgtgtgctgaatggaagatacaaagaaatttggtgaattacccattaaccacattcaacagagagagaggtagagttttttccctacttataattatgaacttatagacactatctcccgattgccctttgaaaagtcctccaatatataattactaatataaatatagtcacgtggcctaaaaaaccctctataacacttttaaatgcttcctacatttccaattgtacctctttctataggagatactaaaaaactgcttcatccctggcaaaatctccagtgttgagtcctctcttttattgtaaatattaccattgaaaaagttttgcatcatctagtgatgatctaaacttatgtgcacattaaaatgaagggtggaaaaacctgttcatatacaaaagaagaaacccctgcaattttgaccaattttagaaccaaataaaactatgtattatttttgagaccgtttatcttttttaacttctttttttctagtgatgaggtaaaaacagaatacagttatcagaaataataactgcagattcaagaaagtttcagaggtgatcctatctgttttcctgcccaaactagtgaataaaattgcacaactaataatttaggaacactgcctatggaagccatagtgaagtcatagtaaaaacatgaattttcagcaattgacatttcatataacaaatcatattttgaccttttgtatgccagtcataaaaagatacttgtgggaatgacctggtattgttgatgtatctgaaatattttttgtacttttattgggctctatctttgttgctgctgggagagtgagaactctctttttcacttacatccaatagataaaaggggggggacattgattgtcttaaagattcttattattatgaataataatcttaagctctcaaagaaccagaattctcaattaaagatttttctatattcaactctacctgtcatgtgtagcttgcatgtaccagttgcccatcccacaaaagaatgaaaaatgagaatcctgacagatttggtgttggattttagactttaatgcctttagccctgcaatgggcattttactggcattttgaagatatttctttttaatctgcaaaataaagatttgaagtgacttgacaatgatagtaagatgattagtggtgcacattcactataaaaatacaatttgaccattgtag

SEQ ID NO: 8730 - DNA, 1965 bp, artificial
  synthetic oligonucleotide
taagtgtttagcctgaaaggggaagagcttttagaagggaagggggtgaaagagatcaagaaatctgtctgcaaatgttttaagcattggtatatagaaggtgtattgggtttattctgtgttgttccagagaccagaaataggaccaagaggtataacatacaaagaaacaaactacagctgaacataaagaagaaattttaataaagttattccaaaattgaaatgattgatgtcaagaggcagtgagcctattgcagaaaagttatcaagcaaagactgaatactgggaactgtggagggaactcatgtattaggtaggaagactagagtctttgtaattatgactgtctaagactaagtactattgaaatgatgcaaattgatcaggatcttgttagtcttatattttaaaaggactatgaagccagactgcctaaattcaaacttcagctttgtttcttattacctatgtaatcttgggtaggtcacctaatttcttaatgcctcagttttttcctataaaatggagataataatagtatataccccatacataaagttattgaaagcattaaatgaattaatactggtgaagtccttatagtaagcattttgtaaatgttatatattattattttccagaaatatagttggtgataattcttctatctcttcttcaatgaatgtagcctttagtacaattagattaatttacactagacataaaatagaatgctatggtgacaaaatcctttaaaacaccaaaacaaacaaacaaaaaactgaagtggtcctgtagatattcttcacaggcaccctgagaatggcataagatagctatatctctgggatgcaatgttggaagttgtgactttaggaggacatttccagctttccagcttatatatttagagattttataaaaacctcatagggctttttatatttcttaggtcacttgatcctcatattaactataaaactacacagggcagttaccatatccattttgaagttgaggaacctaagcaatagaaaagttagaaaaggtaacagaattgttcaaggttacactataaatttttagtggagccaggatcagaacccatgtatcttaagttctagctcagagctcagagataaaccaaatgggtagtaagttgcttttagactatctagtctgtggaagaaatttcataaggctgatgaagtggcttctattattttgccagtaacttgcctgtttgctttgcagcaaaattgacatcagcctgaaaacccagccacccagcttaatttcctttttggctttgcataggttagggggagtcaataaaatcagtgacttatgctgagtgtattatccacacagacactatggaaatatacttgccagctcaatccattttttatgcattattatagatgattttgaagcttgtggagaatatgtggtcctcttaccaaggcagaagctggctatgtgagttttagatctgtatctatttgtacaagtactgtgatagcacgtggtattgcagaatcgaatttttgaagtgagtgagtcttgctttggtgatcctgatgctctgtatctctatctaccctactctcacttcttcccttcggtacctggcccttgtcctttcaaccttcctctcattggtgtacctattaggttggtgcgaaagttattgtgaaattacttttgcaccaacctaaatatttacagccattcatttactgtggggtaattaattgggttccatccctaggagaatatacagctcgatgttctctttaattggcaaatcaatgtttgctaccatttattgagaactaaactatgtaccaggcctctgcctagcactttagaagcatgatcttatttgatcctcataataatcctaaaaaatgggtactattattatccacagttatgcatcaaggaaatggagtccc

SEQ ID NO: 8731 - DNA, 1972 bp, artificial
  synthetic oligonucleotide
atagtccttcaaatatttgaataaactagcaggatcccccagcctcttatattctttaggataaatatttacaattcttgaaaatttcttataggaactatacactattatggctaccctcttctggatatacttaatgaagagtgttaatgtacttcttaaaatatgagaccatataccagatgtggcctaactcatacagaataggatattgacttcctgtattctaatcactatgtaaaatgagatcatctgtgtgaaggcactttttacaatatgaagcaacacactcatggaaggtatcgttattattataaatgtaatttgagattgtgtgagcttattcagcagccacatcacactgttggctagtgttttaaacttgtggtcagctaaccccccaaacctttttcataggaattactgcatgaaagagccccataatcatttcttccatggtcagtgaaaaatacattctttttttttttgtttgtttgcctctgagaaaataggcttaatggtgtctagatttctggggctaagtaataatttaaaattcttgacaagttttaggtcctatccacctacacaaaccactttgaccaaaatcagtgctttaaaaaaaaatgcaaatgtagttagctaagcgtatttttttttgtctgcatgacaacaaatacctgatttaaaggcttttaaatcagtttgtggcattggtgtggggatggccttaaacttttgatttcctctttagtagctaatggtttcgtttcattaagtgctctctgtggttaagaactgcacatttttcttggaattttgcaaacagaatgagcaatttaaattatgcagaagcacagaaaccataaataatagcagccttaagattgtatgattagtacaattaaagcagagatatggaaaaacataacttttccatcatattattctccctctctaggaacattctggatcaattactactcaagcccataagtcaaagcaatctcttaaatccaggattagcagtccgtaatgaaaggagcagaatttttgtgaatgcagttattttcttagcctatttgtactccccaaaagttcccagttaattaactggactactttaatcagtgaatggctaccacattacacaatgtttgatttatattaatgcgctttggtcttggtagaccagaatttccagttctctaaataagagaaaaaagaaggaagctggctttcttattggacagtgaaaagtacacagcagttttgattaaactgaaataaaatatctctctaaatatttacctcaaggagacagtggtgtactctaaagaggtggatgactacaacataccctcccttaccacatccatgagtgtcctagggctgctgtaacaaagtgccacaaatgggtagcttaaaacaaatttattgtatcactgttccagaaactagaaatctgaaatcaatttgtcagcagtactgtttccttctggaggcaaaaagggagaatctgttccatgtttctcttctagcttctggtagttgccagcagtccttgatgtgccttgactggtagatgcatcactcagatcttcgtcatcacatggcattttctccttgtgtctccttttgtcttcaaatttcactcttcatgtaaggtcaccaatcattggattatagggctcaccctaatccagtatcatctcattgtaactctgcaaaggccctatttccaaataaagtcaattcacaggtatctggagtttaggtacatacattttggagggaactcagttcaagtcatagcaccatacctacttacatcaagatctgtatgacagtgaacatctggattagaagtaaaaccttcagtctcaaaataagaagtttgctgagctaaaatctgaatgcctggatatttaagttttcatatcattggagttcctggaaagatacactatta

SEQ ID NO: 8732 - DNA, 2836 bp, artificial
  synthetic oligonucleotide
actgggaaaaggagaaagtagctaaaaggaattttaactctacaagtacaaatgactgacttagagtgggctgagctaatgcccagtgcttttttaaagttatgtattttcttcctggtatataaaagaaagtccaattaatcaaggtgattagtaatcactgtgtgtttaaatagcaaacgtagacaacatttgtctctaggtatatatatttattttaaaattaccttacatgatatctttacttaaattaagagttcagttaattaatatttatgctattatcttaataatttatttttataaaacaaaacgtttcatgtacagtatagagaaattcatttttttattgctctcttagtcttgaatacttgtagcagccccaaccagatggtttatattccataacccaaggtaccactgattacttgggggcaagatttggaaattttaggcttagtgcctaagggcaaataagcttatttttcctcaataggactgaccttacaaatctaactctgtaattgtacaggtcctttcccaattttgaaaagcattatcttcaacattgagccacccaaccaggacccctagcctaagataccacagtcattctgagtccagtcttaatagttgatacaacatgtctggtgttatgtcttacctctcctctttgtaacacattacttggagctgccccacactccagggcctattcatatttctgtaatctgtgccccactccatagggccctgccctacatcagatggcctatttctaaggaatcctgaaactcctccacaggacagtttgtactatataatgtgttctctcctcaagagtatttacattttaaccaaggattctagaaatacaatgcccctgcaggcaaggaaacttatttatccctctggctactataaaatttttctttttgctttttgcttataattttgattacaataatttttaatttatataattttgcttataattttgattataatatatcttggtgtggtattctttgtggttattctacatgggattcactgactctcaaatttgtgtttgatgcttttaatcaaatttggaaaactttaagccaatatgtcttcacataatttttcagtgttcccaccctccacatttttggagcttcaatgacatgtatattaagctgctggatattgttccacgggtcgctgataatctgtttaatttttttcagcttttttttcctcaatatctttcagttgtgatagtctgtattactcaatcttaaagttcattgttctcttcttctgccatattgaaatttatattgaccatccagtgaatttttaatcttttaaggtctagatatatttaatttttatatcttctatttatgtatctgttatgttcatattttcccttaaatccttgaacatagttataatagctgtttggaagttcttacatgataattctgtcatctctatcagatttctacatctgtttctattgactgattttttttcctaggtaagcatgacatttattactaagcatagacccttctacattctctactcattgccctgggcattcaaggaggcctctccactctggatgatcataactcaaacattttcaagccttgtgtaaagctttggggattgctcagtttacagctctctggtagttgtttttttttttttttttcttgccttgtagatttttaccctatgcaagtgcagtttaatattaagacaaagattaaggagtttcccaggcagatttatttctatttctctgagtaacttcgttttctccaccactctgctttgcatatctcaggtacctcagcctccccaaactttaatctctgtctcttcaagtcagcaaggcgaacatgctctatttgggttctcctgcactgctctgaagttcaaaaatgactccaggtggaaagctaaggtaactatcagggttgccttgcttatttcccttctttcagggatcaaagtcctgtgttgtctattgttcagtttgaaaaccattatttcatatctttcatccacttccctagttggttatggtgagagtccagtaccagttactctttcgtggctgtaagtggaagttctaagaagtccttctgaaaggtctcagtcattcctcagagttggcttccccctatgtcttaggataaaaatctagtttcttagcagtctcattttgatcaaagagaattccagacaataattgttccttgttagttgaaatccagataaactccaagtgtcttgcaatgtctttttgtacacaccaacccacatcattctatgaggttacctcagagctttagttttggagaaaagcttttgagattacagcttcaaatgagaggtatgttaggttgtcatcactgggcaactaaacatttgtgagttgtccttttgtctgaaagattattgggagtttcagacagagaacaagacctttttctccccttttaaagagcatgcctcagccctttgtgaacttgaaatgcaggtcttattttattcatctctcatttgcatgttgtgcctttagttgtcagtgatcagtaaaatcatttggacttcagaagcctttgaaaaagtgattaaacaggccaagattatgttagtcatttagtttatccttctttaatccagaggcattatttactgtccactctcaccctaatttaggattgtgccttacatgaaagagctaatgaaataaatgactatcactgtcaaattttgctgtgtcatagggggacagtacgagaagctttgtatacctcctattcccttggcc

SEQ ID NO: 8733 - DNA, 2677 bp, artificial
  synthetic oligonucleotide
gactagaagggagaggacagatattagaatgattgtgaaatgagtgggtggtaagacagtggaggttatggctatcaacttattctgtctatagtttagagggagtggcaaagaaaggtaaacaatgggagtgggtagcctgaggggacagaagagtcaagggaagtttcttttaataggggaggaatgaacctattgttgactgaagagtagccagtggagagggagaaagggcataatttatggaacaggaatgtggcagagaaaggaggaataagattcagaggacaagggggaaggttcaaattagaaagaagaaagacatttattaggtaacccatgttcttaaccttttctcctctccctgatctcatcaaaatgtgtctgattcagtaagcaccttagttgcctaagtataattacttattatacttggtatatattacatggactgttactcataaaaatataatatttaaaatgtgagatgactgaaacactaaatataattaattaggaattataagtaatgaatgaattaaggtgccagcgtattagataatgatataataaatatgttttatctctctgatagttgaattttcacagaaatgttggaaacagagaaaaaatttacaaccccccaccccaggtgacccttagatacagacagatgttagtgtgaaactgtcattcactcagcaaacatttactgaaagtcagctatatgccaggttctgtgctacacactggggatacagaaataaaggacagagttcacatccccaaagatctcacagcctagtggatgaggcagagaaatcaacacagtataatacagcttgatgaatgctgtgattgaggtaaaaaccatgaaacactgttgaactacataaggaggcagtgggcggggttcagggaaggcttcccaaaggaggtgatatttgagatgagttttgaccttctactgttgcttttatagggatctgcaaaaagggccaggaattcccccaggtgtcacattacaggcaacagctgcaactcactatcctggcttcatcctcagtgtctgacatcaaggtcactgagccaaaagtcttaggtgggggggagtatacaatggcactaagtctaacctctgggctattgggtcataggagaagatgagggctataggttccagattacaatctgaataaatagccttctcttttccagggttgggaaagtaagaaagtggaaagggaaagtggagaggagctagaagaaggaaggaaggaatagctacctctttattagatctttctgcctgctaggaagaaagccttctctctgcatatacaccactcatattgttttgtttcaatctttattcttgggtgtttttccacatgaaaagggcagtgaatatatctcacctcagtgcagagacatttagaaatgaaaaacaacttcaaccaagctctatttctccttctttgaaactggaagactgattgtaggtcagtttctattttatctgagccacttggcccatctggaatagtcactctaggaaatcgaaaactaaatttaaattttacagaggaaattttgaagtgactccctcaatctggtcagacacattctgttgcattcctctgtccaggcataacactgagcctctgacgaaaatctgaatgacaattgtctgttcttagtattaaattatttgccccccccatttccattaatttgcagactcaggcatactatagcaaagactcaacttgaactaattgccttttaaatttacctctcatgttcctttccttagcaaatgagaataaccatacattgaagcaggaaagactatggttagacataaggaaaaacaacctcaaccaagcgctatttctccttcccttgaagctggaagactgattgtaggtcagtttctattttatctgagccacttggcccatctggaatagtcactctaagaaatcaaaaactaaatttaaattttacagaggaaattttgaagtgactccctcaatctgatcagacacattctgttgcattcctctgtccaggcataacactgagcctctgacgaaaatctgaatgacagttgtctgttcttaatattaaattatttgccacaccccctcctcatttccattcatttgcagactcagacatactatagcaaagactcaacttgaacaaattgccttttaaatttacctctcatattcctttccttagcaaatgggaataaccatacattgaagcaggaaagactgcagttagacataaggaagagcatcatatagctacaacattgagactggcagtactagaagacattatggaacatttttaaagtttcttcttttctttttttttcttttttctttttttacttgtttgtttgatgttattcttgctgtttgggcagatgggttgttcataaaagaccacatgattattaaagacaatttgaaggggtaaagagaaagccatttatcctggatggtttaccagtctgaaggaggaagacaaccttttacctcaaaaattatatgattttactctctgattttcaggtgacctcaggtccacattagccctgcaatgcggaaagttttttcttgtaccagggacggactccttttagagattcctttaatgg

SEQ ID NO: 8734 - DNA, 2457 bp, artificial
  synthetic oligonucleotide
catacttttcacagactgctcccagccagtgactaaggacactaggacaggcccatttctgggagatgcagtgttaccagccagcctttgctcccaaagctcccaagatggtggtgggccgctcccaagatggcggcaagccttttgttctctgacttggggttcttggcctcagggattccaaggaatggaaccttgggccatgcggtgagtgttatagctctattagaagccgtggctcacggaagagaactgtggaacccagcgactagtgtttagctcccgggcacttagctgcacaggaacaatagcaagcctctagcctgatcgggagtggcaatgagtgcctcgctggatcagaagcgtagcggacaccctgccagatccggaggggtggaagccagcgatgggtctgtgacaacagtgatcagcagtggtggacagcgagcgaaagctcagctggagccagaaaaaaacaaggaccagaagagtatgcagtttcaagatttaatagagtggaaacagagctcccatacaacgggaggggacctaaagggggttccctctaccggctcgaaatgcctgggtttatatcccgatcattgtccctccccctgtactctcaggcttagatgatttgattatttctttacctcctgcttttagcctaattggtattttagtgagctccctttactacctgatgcgtcaggtgtcagctgagttacaaaccccgtgtttaaaggtgggtgcagtcaccttcagcagctaggcttaggaattcttagcctaggaaatccagctagtcctgtctctcagcaggactcctctgatggatggcttttactctaggacttcccattggctttgccaaaactttttaagaattgttctgcagtttaagactcattaactaactctccattcttccctttctcctcaatagtcacaacagtatcacaatattttggctctgccaggctcctttgtctctctccccattttccctcacgggttctttagccctcagcaaatctcttgcaggtatgatcttgccatgacatctgcttgttagtggacttgaaccaatatatcatacaactctatactttgacttgccaatgttgcttggtcacaagttaaacctgatgagcagtccaatgactcagtagccatagcacaatgtaagaaaaagaacttgcaattattacttcagttctctaagcctttgctatatcttgcagtgttgttgggaagaattatgataatgtaggcaaaatctcaataacatggtaagaacttgatacgttcattcatattaatgagaagataactgtcctactaatggcagttcttatgaagcagcttcttaaatgaatgacagccttttctcattaagaaaactgctagataatatacaaaagggaatcaggaatttttctagtacccagaattgtattgttcttttatgatagaaatcatgagcagtagaacatgttcaatacaggggtctgggctcctggaaattctgcctgtggcttaacttgctaggaatatgtccagtttcttttctgcaggttgtctcaggctgatatggaattagaatttttaaaaacaagataaaaactgaaatagagagaaagaatgaatttcaagttctagatgcaacttaataatcaaatggatatgcttaactaccctcaacaacttcaccaggtctgtgatactacaagtaatcagcagagcacttcacaaagtgaagtgctttcttcacaaaaatagaaaagaaaggacagattctccttccctcagggctgcatcactattgcattgtagagtttgctatactaaggaagaagctgttaggtgtttaacgtagttggcactgagctattgtaatgtattctgttttccaaggcaacaaaactgtgattcttcctttggcaaaaggcacaggcaagctgatcactaatttcacttacttgccctagtgtagggaatttctgtgaagccactgaaaaggtcagggaaggaataacagggcaaggttaccagtgcactcaatcccaagtgtcagtgtggtcgcagagccctaggctgaaggcaaagaagaatacagtacacctagtggtccctgagggtaagaagagtctgtaggctatttaaagctggggttaaagcctttcagattgcctaagtaccattttctgtgttaatggtagatgataataggaagctacaactgaaagttagtgtacatccaatatgcaactgagggcactatatcattatttttaactttgtgctttgcatattttctatgtttctagataaaaagaaatgtgtcaagatttcgacaataaatttccataacatggtcacctttatcctctttctttagtctgccaatatattcactcagggcccaattctgttttccagaatttgttaattgaa

SEQ ID NO: 8735 - DNA, 2627 bp, artificial
  synthetic oligonucleotide
taggaattgggattcttccctcttcactcccattaagaatcatgcagtgaaaattaatctaaaatttcagtataactaatgttaaagtttattccttcagttttcttattgaatatagagcagcataaatgagacaagtatgctttgtattatttactatgtttaaatgttatttataattactctcatgacagtttctctccatgtgtctacccaataactcttttctaggggttcataactttgaaggtctgtgaaccccttaagagtctatgcaaaatatttactataggagcatatttctaggcaaaatacacatgaaaaggtgtttgacatgtttagtaatcaaggaaatgcaaaccaaaaccacatgataccactttatactcactaggatgcactaggatggctataatttaaaaagtcagattataggctgagcacagttattcaggcctataatcccagcactttgggaggccaaggtgggtggattgcttgagctcaggagtttgagactagcctgagcaatatgataaaaccctgtctctccccgcttccctgccaagaaaaaatacatatatatgtacaaatcttagccaggcatcgtgctatgtgcctgtagtcccagctacttgctacttgggaggctgaggtgggcacatcacttgagcccaggatgttgaggtggcagtgagtcatgattgttctactacactccagcctgggtgacagagcaagaccttgtctcagaaaaaaaagtcagattataacaaatgttggtaaggatatgaagaaatgggaaacctcatatactgctggtaggaatagccctcctagggatataaacaaagtaaatcaaaacatatatctacaaaaaactggtccatgaatgttcatagcagcattgctcataatagacaaaaatgaaaacaacctaaatgtctatcaactaaggaatgaataaataaaatgtggtacattcatacagtgaatattatttaaccataaaaaacgaaatattggcatatactacaacctgagtgaaccttgaaaatgttctcagtgtaagaagccagaaacaaaaaaaacacatactatatgattcaatttatataagatgtccacaataagcaactttatagaaacagaaaatagattactgggtgcttagcgccagtggggaggaatggaatatagatgtgatagctaaagtgtatgggtgtgtttttgtgtgtgtgatagaacacaacataatataaaattcatcattttaaaattcacaatttaatggcattcagtacattcagaattcatacaaccaccaccactttatagtaccagaacattttcatcactctaaaaggaaacgttgtacccatcaagcagtctggggcttctttataagataatgaaaatattataaaattgaccatagtgatagtttcacatctgtgaatattctagaaaacaaagaattgtatacttttaatggatagattatgtggcatatacattttatctcaataaagctgtttttcttaaaaaaaaaaaaacccttgaaattaattgcctgacacagaacagattttcagaaataaataatggatatattacaaatgattctaaagtattaattgccatttgtactttgaagtttgtaattagtaacactttattaggcaattttaatttaatatttatttgaaatcaatacaactgaattcattttaaattgttatagaagatacatatttaggattactgtcaacgtatctgtgtataaaagaccttaagggtcacttttcattctacagaacaagaaactggtcccaaaatggatatgtgataggtacactagtatatagttagtagcagaagttccatcaccaaaaagctcagagatatgttttgtgatcaaaggtactaattatatgagcctaaggtaataatctccctttttgtatgtgtgactgcatgtaacttttaaaataaacagctttatcagagtataattgacatataataaatcacacaatttaaagtatgcaatttgtaagggcggattgatatatgtgtacacctgtgaaaccatcacccacaatgaagataacatattaatcacccccatgtttcctggtgcccctttgaaatccctccctcccgcccttctccaacaacagggatcttctatcactataaatcagtctgccttgtctagaattttatataagcagaatcatacaataggcacttgttttgctctggattatttcatgtagcacaattattttgagatttctcccatcttgttatatgtgtcaatagttcataccatttttattgccaaatagtattccattacgtgattatacaaaaattactcttctattcacctgttgatggacgacatttgggttgtttccagttaggactattatgaagaaatctgctaggaacattcatatacatatctttgtatgcacatatattttcttttctcttgcctgaatagctagacatggtgtgcttgaattatatagtagacataaatttaatttttagtttattctttaaataaaatttaaatcatttttaaacaaacttttttagaataatttttgatt

SEQ ID NO: 8736 - DNA, 2681 bp, artificial
  synthetic oligonucleotide
aaaccaattttttggcccatagtataccagtttgtactctccgttctaggtagcagttaaatgatttcattgtgctttacaaaagtatgcagttaatcttccctcacttggtctccttaggagcttctgacaatatagtggaagcccaagaaagagcaagaatccttatggaactgtcataatttttttaagtcagaacaagctctggcttgttttgagaaacttaagatatttcctttggagttggaccttttaagctttatcacatcatagcctggcctcattggcagtagtattcctacttggaatactagtatggcttgttttatggaacaataacttcttgatgagctgtaagtcaaatatttaaaatgccttaagtgatcatcatggagaagaaacatgatgcatcctttcattaagtgaaaagggctattgtaaaatgaaaactcacatctaatatatccaattaacaggatcaagttttgtaacctatccatcttcttacctatctgtcttctgtctgcacctaccacttccttattctcaggtgaacaatttgccagtaagtgcaactagcatttcagtaagaagttcatcctaaattttttctttggtgagccaagagtctgaacttaggttcaagaaattctgataattatttctgtttctctgcacatacttcctttctcataaaacaggggcatatcattgaatctctctctcttcattctcagtgctgctgcttcactctgtcccaccatacctgaatagaaaactttctaagcctactcaggatgctataacaaaacaccttagactgggtaatttttaaacattacaaatttagtgctcacaatcctagaggccgggatgtccaagatcaaggcaccagcagattcatgtctggtaggggcctgttcctcatttttgtctgagatatcagaatggccttcaccattcatatttctactaatattctgatcacgactatttaggcaatctctaagatgactgaggaattctctacagctctcttcttccaagccctcaccagaattgcccttaaggctcttttcatggcaatatacctcaaatctcttctaccctctatccattacccagttccaaagctggttccacaactttaggtatttgttacagcagcaccccacttctcagtaccaatttctgtcttagtccatttgggctgctataacaagataccttagactggatagtatataaacaacagaaattgattgttcacagttctggaggctaggaagaccaagatcaaggtactaacagatttggtatctggtaaggacccattttgcatagatggcactttctttgtgtcctcacatggcagtagcagcaaacaggtttcctcaggcatctcttataacaggccccatttatgaaagttctaccctcatgatctaatcacctctcacatgcttccctcgttttttattttttatttttttagaaacagggcagggtctcagtctgttgcccaggctgaaatgcagtggctcagtcatagcacactgcagcctcaaactcctgagcccaagtaattctcccacctcagcctccagagtagctgggactacagacacaccaccatgcccgactaattgtttaaattttttgtagagacagggcttcactttgttgacctggttggtcacaaactcctggcttcaagcgaccctcctgccccggcctccccaagtgttgggattacaggcttgagccactgtgtctggccaggcctccctcttatataatcaccttgggggttaggttacaacatatgcattttgaacaaacattcagaccatgacagaagccctcaggtgggatctcctaacctgcttcccaacttgtgagtcagaggagcaagctcaaacattccctgcattccctctctccagtcccttggcttcagttgctatttgtcccattctataatgtctgatctttgtgttcacagtgaagaaataggtgggttcaaactaagaaggtaaaaagagctacacatgtactttgggtgcctagaaaaagttacaagcccataaatatttgctgttcttgctacagctctctttgtgaagcatatacaagacacagcccaactaaaataactttccattttttagtcagtaaatgtccctagaagtatagatcctgctgagattgaaaattgcaattgaaaatagaagacaaaagaaaatccaggtgtcattagggtgatggcaattctgccctctgattataggatagatgtttcccttttgatgtgactgcctgggctgaatcaaagaatctggttgagtctctgggcctaggttcacagttttcaacttgaacagccatcattacataatatctttcaaagacatttttataaaatggaccccaaaatcacaaaggtacttttttcaccatggttttcttccataaatttactgctgaaaaaatatctgctacttgagagcacaaattgttcctgctgctgaagttttccatctacctaatagcaactctactctgtaaataacatagaaattgctgaaaaacttcccattccacgacttttaaaacatttgaaagctcttctgaccagagagagagacagaaagaccaaaaaatttatagcataaagtgaa

SEQ ID NO: 8737 - DNA, 5261 bp, artificial
  synthetic oligonucleotide
aaagttccaaagggctaatggccttaagataacagaatggattggagaagaaggggatggtacaaatatgggacgtgtaatgttggcagagagatcgtttcagggtaaaacagtatctgagaaattccttgaccatggacagattagggttattttcataaagtttgaagtcaggaaagagagagagaaataagaacatgttggaaggaggcagggagatgatggttaatagggtgaaaggaaaagaagtcccgaagttggaaaacaaatgccctatttcaaggctgtgctcgggtcacagccccatgcctggaggccatctatttgccttctcttctgctagaggagctgaccttccccaagctggccacaaaaatccccataatgccagcttacaaggtaaagtttccatgctcttccatgccttctttctcccttgaaaataacaataaatttaaaaatctgtaagttccctgtcaagttctggtcaaacacgtagtttcccctccccgcacctggggaggggggcggtcccaagagccatgtggctaatccctatggagtctccaagtggctagcctcccacagagccttgcaactagtgagcccaatgatctagcctggattgttttcctggcctggacttgccctttagacaggctaaaacggtctttgccattaggggccacggggcattttcccccacaccccacgttcagcaaatcgtattgttaaaaaaaaaaaaaaagttttgacttatgaacagctcttccctttagcaaagattctcttcagagttcctttaaatgttgtattttttgactccgtgtcttatttctaaaaactaaatgtgtatgtaaaagtgtaattttctgttaactagttcacctgcccttctctagttaagaaatgttaatttcagactcacatttaggaagattcagtagagttttactgatcatccaggaattcttaaagtgtgttttaaaacggtttattttgtgtggtaaaattgtcaagatttgaattattggaaagtgtaatagctgaaagtgtaatttcaaatatgtatcatatttgaattatcgagaaaattcgatccagcacacccgggtttgtttttgggggaaggtagtggttggttttctctgcaaccgttaacagagaattttctttatttagcgagacccggttcctcacacaggctgtggccattacacagctcactgagacttgaaagttaaggaatgtaaagaggtcaaactctggcattgaaacagacaggaaataaacaaaatctaccaatatgtaaagatattacagaaattagaagaatgagtcagaaatggagagctctaggtcagtgggaagaattattcgtataaatcttcttagaagaggtaggtaattattaatcaaaaaataaagaaagaaacaggaaacaagtccccccacatcgctttccgaccccggagttagggtgcgcagaatgccgtctgggagctccagagaaagtaagcagtgtcgggacatttactaaagtgctctctgcagagcatgagtttagaatgcggttagtttatgcaccgactccccttcccaggaatgtttcaaggggctctttctcaaagctgaatcacgtttgtgagattcttttaagccatatgtcagtcccccagcgctttaaaggaaaacggaagcaaacaacttgggcacttggaaaagttttgcaatgaatgagcgaatgaatgaaacccggccggaacgctggaggctggaagggatgcaggaattttctccgcgcgctgcgaatacggcatatgcaaaacttaggacccagggcaggccgggctttggagacgagtcagtcttactcaaccctgcgcacctgagaacaggtgctgttctgagtgaacgactgggacctggcacgaactagcctggggccagaggagataaggcctgccgggagaagagttcccagcggctctgtccattctgctcttgccctcggctaatggctttgaaggccaagctgtgacagccccggggcgtactcggtgccttcctctgttcaaataggtgctcgcctaggactgattcccaacccatggcaagtcatttccttctgtaactcggtaggtctttgcaagaaatggagcgataaaatcagagggacagaaagagaaaacagccaactagaaaagtcagaagtgtttcttgggaagtctagggcgcgggttgtttggactgtggcagggctgtggggcccagactgggagcggcgcggagcgagaccggttttccggggctggcagctgcctggaaaaagtttcctgtggaacactcgccagcgggggcgggggcaggggcggctggcgcagcagtggacgtgggagggggcaggagggccgggggaggccgcgaagggcctgctcgcaaaccgttatagtccttcagcacctccctcggccggtggccctcctagcctgcctccccgccgggcggctgcccacctggcgacgtgacgctgcaccaatccctttcgagctgctcccgggtcccctctccttgcaccgcccccctccccaccctgaaagaggcgcaccctgacggggcagacacagcgctctcgacacggagcacccttctagcttcttcgtctccaggactgacgctcaggctcctctctcgccttagcccaacttgctttcccgcctcgcaaactccggtttccctccactcccaactcttttcactacacgtttcccctcctctatctcccacgccacgaaccccgatccccagactcctctctcccgccctcctccttcctctctcctcccttcaactcttcatccgcttccacctcagactctgcgcgcacccaattcagtcgcccgctcccgttcggctcctcgaagccatggcgggacctgggggctggagggacagggaggtcacggatctgggccacctgccggtgagtagaggacgcccgtcgccccccgaaatgctctcttttggcgggttctgcgtaccagagggagggagcggacgccctcaaaacgggctagaccaggacttcgacgggtcccccgggcgcggaaggggatcctgggagccggcatgcggaaaaggcgccccctgggcaccgggaccgcaccaaactccaacgaaaggcaaaggcacggggcggtgggaaggagagacagagaaagagatggcagtggggtgctgcggaccctaaacagcggggcattttaaatatgtgacccgccttgtctagcggagctccagtacctgtcctagcccgctcgttccaacagaggtcaaaaagtgcaacgtcgggtggcttcctgagagtactcctccttcctgttatcccgccgccccatcgtttgctgcttcttttgccatgggagatgcttacttgcggggtgacctttactttaggtgacagcgactagaaaattaaggcgtttgagtcccacttttcttattttctaatacactttctaaaaccttattcttgccagggcaatgttcctgatttagtgttgtgagagtgaaagaactcgacgccttttggggaaggagtgaattctgcacactcgattttttttttttttaatattgtgttccttacccaaccagatttagctttttcttgtggttttcatttgtgggctcatcttttcccgaatgcccagcttccctctagagttgtaattgattggtaagctattatcgccgtcgtaattagtagacttattattttggcagcgcagtttatttcattggcatctggtttctggctaatattggatcccacccaaatccgtgtttcaagttccctttttagattggcatttcactcgcaccctgtcttgaatgcaaaaggcccctggattctccgaaagggaataagcaggcaccgcgctggaatgatcaccaggcaactgtagttcagggcagtggcctgcttgctttgaaaaaagctaaatattaaccttaaggttataggactattcaaagtcgattgacttaattttacacatatttggcatttaaagaatgtgtttttgattatgacagaagcctgcctccctcaaaaatagggcattcccaaagccttccctatataattttacattagatgctatatgtggagaggtaaggtggtacacatgggtaacattttaccaaattgttctctgccatttaaaaaaaatcagtgcaaacttgaattacagatattagtgttgcaattatttatgcagcttcataaaatatgtcacagaactttttaaaattaaatcttttctcattctgcatgcacccagaatttcttcctttcagtgtgcatacatgagatttccggaaaatggaggcctcaattggtggtttcctttctaagcagaactttcatattcagactagatttgcacccaagtaaaagtataaaaccaaggaataaaatgttacccttcctccaacattctctgcctatgattgggaaaagagaaaaaaagcaaactagggcagatatgtgaaactgttgcgggcaggtgggcaaactgaaataaactcccttctaaatatgactaaatgggtgagtggtaaagacgtcatagaaatgataggacagggaattccaaacccaaggaaaaaaagaagaaaaggttttactgccacaaaaaaaaaaaaaaaaatgtggggaaatggcccagactacctgacccggtcatggccctgggacataagaatttggtggagcccaggagataagaggaaagtctgcagtctttacattgcagttcagtggaatattagtttcctggaggttggtggagtgggtgtgtgaggagcgtagaaagataagattggtttttaatgtaaggggagtagcgagaagatacaaaacttcaggacattgatgcttggcctcattttccagacttaatgaaagtctcataaagtcctcagattctaacaatttctaaattttatacattagccattttgtctcatgtgtgggttttcactctctgagcaaattatgcataattctcccctgtcctcaaacaccctgattcaaaccctaagaaatctagcagaagagcagtagcatgccctttagaattttctttactatcaaatttttagtcatggaaaagttattgttgctttggtcactgagttatatttttcagcgatttggggtttctttacatttgatttattttctgactttttga

SEQ ID NO: 8738 - DNA, 2290 bp, artificial
  synthetic oligonucleotide
aaaaaccacacctaagaagaatttcccaaatttgatacacttaggtgtatcaaaactttgtaatgatgggatgcttatacagatatcaaataacagactctcttcagtgtcctttggcagctaaatgactgtccctcaatctaatgtaatgagtacagcctgtggcctagcagtatatacaaggctttatgggagttaataagtgtgaagcttaataatcttgtcaattaccaaatagcgcctgtcaaacatctaaacatcattgatttgcttaaaccttcttaaaacaaatctaaagttgatgtctgtaaaataactttgaggatctcaaaaacaggctacatctcctctttgggcaattgttattatagtaataagtaaatcttcctgatggataagatgtgagatggagagtaattgccatgttcccttatatgtccccaaacctatcctcccaccactactaccaatctgtggtagatccactccaatctcagccacacctccaaaccctgaatgttctgatcccatctgtccctttgggcttgttgagcttgacaatggtgatgaagactaagaaggaagaagcaaaatgaaaactttcaaatactaaccaaatcaccattacttcccatctcaagcactggtgaaggaaaggccttgcttagagacattgataaggactcgttagcctttcaaagtcctttctagccacatgtctttgtttttctgcatggacctgatgctgacaaaaaccatcttgtcagccgtgttgtcttgtccctccctggcacagcatcaagtactcccaggtgctgtttacaatcgcattctccgtggcctcgaagggtcactttgtttgctatgagaaagctggcatccaagcaaatgactagaaggacaaaattctatgaatgaaaaacgaggttacagaatggacatgagtgtagtaagtgcctcatggccttctgccaccagaaaaccgattgaaaagaacgaaagaatgccctgggggattatgtggttttgatttgccaacagaaagcaaagcaaataacgggaaggactacgtaggaactgctgaaggatcagcagtcttcctacaacagtttctttaactgcatgatttttttaaaaattagcctaatcaagattacaaggccatcaaggactgtcctgtattctttccagagaaaaacatggtaattaactgctgcggaatggtggattttcccaacacagctgtcacaactgctattttaaatcatttgttatggtttaaaatgtgtaatccccaagaaattgatcattactgcaattcaatgctggtttttcagtgccttaacaaccctgggctttgcatcagaccattaaataacaaaacccagtcataaagtgataaactactaatggctcatctcagtgatgacttctgtcttctattaaacaagattttatttaaaaaaattttacactgaaatttctggcatgacaaaaacaggtgcactcttgcattctctccttttcatctgtcttctctctatgacatttccccctttttcctttcttcccttctttagtgtctgtgccttcctgctcagcattacctcatagcctttgctcataatgtcccatccactgggcccaacctctgcttctgaatctgttcaaatgctatgccatcttcagggtccatttgacattttacctcttctgtgaagtcttcccagttactctattcatcattcactaaactagtactcattaaaagggccttatgtaccagctatgatgctaggcactagagataccaaggtaaaataaatatattactagactttaaggacttttatgtttcacctgattttattgatagagtgactaaatccttgatacagtgatgtgcttgataactacgctttaatgccctattgttttttttctgacattttctgtatttaataaatttgtccacataccttactcaatactgtcagtgtggtccagatttgagaagactaagctccacctagggccatcacctggtctctgctctactcctacccttctctctcatctctccccacactcctacatctatctcgtagatctgcttacagaaatcatagtgagtaactggaagaaccacttacctctatctgagcatgcccaaaggcagaggacagacttataaaacaaaagtggaaatcttcaaatgctgtgtgcccaaaggaagtaggggctaaagactatggtagacttgttgatcagttagaagtcagcaaattta

SEQ ID NO: 8739 - DNA, 1258 bp, artificial
  synthetic oligonucleotide
ttttagatttctttgttcttgcttatagttctggtcttcctccagcttggttcccaggtccaaacactacatatgttatcatttcggaggttcagagtgtcccgacagaacattatttttaatattcatggtaaacaatcagccaaacctactgtagatttataatagcactgctgagtctcattccaaaataaatagcaggaaaagcttatttcccagtattcctggagtagacttcatggtaaagtttgctaggctggaatgaaaatctgttatccattgtggcttttgtatcagctttccaagttaaagcaataacttattaagcttttttctcctgattgattattttgacatataatgatttttggcagttgattttggagtgagtgcccaggtgagcagaactaatggaagaaggaatagtttcattgggacaccatactggatggcacctgaggtgattgactgtgatgaggacccaagacgctcctatgattacagagtgagtgtgagaattcagccagtggaaattacaatttggaaaggatttttgattaacatttatttttaatgataaaacaaaaaataaaaagcaggcagctccacattttacattaaatgctagtaggaaatacaagcctctatttcggtaagtggtttgattatattcataaaataatattttctgagaatgtggacaaagtatataccactgagagttacctgcatttgaggcagaatgtgtggtttatgttgcttgcaacctattggtaaaaatattatataatgtggatttatatgtatataaaaatttaacttccaggagcaaagggcattgtaaacttaaaaatgaataaatgtaaagccaattattaacccccacagtaacttagctccagaaaagacaaaaaataatttgattactcagggtaatggagaaaatccttggcatgtttcacttccaaaaccacagaaaatcagtgtaatagacaaattaagtaacaattcatgctatttattaaaatttccactgaaactgcaatttgaacaatatacatatatccatgtacacatttcaaaaggttgatgtggaaagaaaactctgcatttgctatagactggaaaaacctcactcactctccacataagtccaaacaattaattgtggtctccctgagtggaacctaggactcaaaacttgaagttgattaagattcatctcttttccctttccttaagtgccctttacatgatc

SEQ ID NO: 8740 - DNA, 567 bp, artificial
  synthetic oligonucleotide
gcccaagagtgagacagcctgggtaaatatcctggtttcacccctaaatagccatgtacctctgtaaaagatccttacccccctgagcctttatttcctcatatgtacaaagtattggtacatttttagataagggtaatgctaactggtttttattttgtttgttttttagagacggggcctccctctattgcccaggctgaagtgcagtggtacgaccatggctcactgtaaccttgaactcctgtgctcaagtgatcctctcgcctcagcctccagagtagctgagactgtaggtatgtgccaccatgcctagctatttgaaaaaaaagaattgtagagacgggggtctccctgtgtttcccaggttggtctcaaactcctggcctcaagtgatcttctcaccttggcctcccgaagtgttgggattaccggcatcagccatcatgcccagcccacttactgttttatcaaataaaactgaatgttttcatggcttaatacatcagaagtttatttcattctcacgagagtccaaagtagttgtttgtgatagatatgtgattt

SEQ ID NO: 8741 - DNA, 941 bp, artificial
  synthetic oligonucleotide
ttttaaaatttatacatttactcctctacccctttgaatatcccatgggttatgaaattctgaataattgtagctataaaaggttttatttatcctttcccgaagtataattcactgttttctccttttcagaagctcaacctattaaataaagtgaaataaatgtaatgcaaatacaacacactttttgtcaccagtgttaacattttaaaatgtattatcatgtagtatctattccttatggctagtaccatatggtgagacagaaggcacagggcccttttttaccattatttaaatggaaaaatcaggctaaatagacaactacccatgtagtatgattagaagaccctcaatttgtttctgatagttagggttaaatatagtatttgtcttatatcctgtcaagaaaagcccttgttctgaactccatgctttagagaccccttttggctttcttcttgctatgcccttcctacagtaccaggagcccagttcgtgggtccagaagaatgtatacacactcagagttcttgcccattgtggtgcatccttaagatacctatgacccctgaattctttaccccagtggccccaagcctgcttccatcacctacatgctcctctgcactgggtctgtcattttgaggactaacagcactgttggtgttacatatgcccagctagccatggagtggctatacatgggtaacagttaaagaatgggttggggtgtccatatgcacgtacagatgagtcctctcatggtgagggatgaaatccagggtagaaagtggaaagaacaggattatctgggaccatggcctatagaggaggtagtagttcttctcacactcatggtgcagaaggtagagcatttcagggattctaaattaaaacctgaccattctagtcattataaatgtgtatttgttatggaa

SEQ ID NO: 8742 - DNA, 1198 bp, artificial
  synthetic oligonucleotide
aaaagatgttctttactgagtctttattatatggtaaaggcatttctacctttgtttttcccagaaaatcacacactcttgtagtttgaatgtaaattaaacagacacatgttgccattccgctttcaactgctttaaaaatgatgatcttttcgctttaagggaattgcagtttaacttggtgatcctcttccctttgagggaaaggtccccttgctattcccatcactgggagggggcggagcctcgtcggagccgctcggaagggagctgtacccggccagtattgggggaggggcagcatttcaagaggctgcagctgacaagaagcttcaaggtaatggctgtcttaaagccagttattttctgggaatttcttcgggccttggtgttaaagtaaaaaaaaggaaagaaaagaaatagagattgttgcctgagagaggtgggaatggaatggttttgtttgaactgctgttattggaacggaattaatcctctgaatttttgtttcgcccgatatttttaaagtcctccgtgtgggaatgggcgatcaaattacagtttctaaattaagacttcggtgagacgtgctgttcgtgttaattttttacgtggcactacatatttctatctttgttacagattttattatattttgacttaaacacattattctacacaaaaaatgatagaaaaatgtaaacacacaaagagaatgacatatagggacacaaatataaatgtacatgaacatggaaagggattcagatatgccgtcgagtggtaacacttgtaaagatgtatattcgttttccttaggaagggaactagactcccgagttaacagtcagcatctctgagtgttcatctctgagtgttcagattatggaagtttttttaaaatctatttttcactacttccagcatttttagaattgtttctatttgtgcttgttttcataataagaagagcaaaataaagccaaaacagtatacccattttgtttcaaatacataaacacacatagacaccacagacacgctcccatactcccttgtcttttgtgaatagtggaatttttcctggacctgatcaagtgggtagcctggttgctgtgtcaactacagccttgcatgtgtcctccctgcagcccgctctttcagtccacaggtacagccatggtcagcaagaaccact

SEQ ID NO: 8743 - DNA, 1728 bp, artificial
  synthetic oligonucleotide
ttctgggaacataatttggcataggataattgtcttaaactctggaagttgcttctcttttttactcatacccatgaagagctttctagaataccagcttcaggaccatagaaattttttcttttgttctgttccatctatagtgccttgaacagtgcctggcacataagaggtacccggtaagtatttgttaaatgaattgaaagaatgagtagtatagatatcaaatctcttgggtcctgctctgtcttgtatgtgaaaaaaaagtaaaattcctgtgatttctgagaccttaaaagcactatccagttctaacagcacacatctcagaatgtagctgctgaagcaagctcagcaccatccaagcatcagggacacttttggccaaaaataaatagaaaaaaagatacagtgcaagactttaagtttttttgggttttaatttaatttcacacaaaagcagaataatgttattaatttttggaatttatttattggaaattcataaggaaaaatagtcttttttttcaaatttggagcatctccatattgttgccattttattattggtctatctaaatgtgatcttataatcttagaacctctaatgtaccacattgagaagcatagctggacataggatgggaagtagaacagggcgtaaacttacagcaagagactgaaactacagagacagaaagactatgcttgtaaatggagagtctgctgctagagatgtgggaaatcttgcttctgagagtgtggagaagtggctagatgaagtttaaagtcaattcaggactgtagtgccagaaacacaaggttcaacagacaagtaggaaagtttaaatatgctggataggaagaaaagttacctctaattgtatctggtgacaggagggtgcagctacacacttcgtttaccaaaaacttaattaatggttaagatatgtgttaaaataacaaaaacctggtggaacattggaatgagagtgggttggagatcctccatgttccttactgcttgcttcactgttgaaggaaactgatttcagagtaacgctcctaatctctctcccaactttccttccttaggaaggatgattgaagagcttggtgagctttgggagaagaaattaagtatgactggatcagacccttcttttgtttttggctgtctgcaaggagggtccattctggttttctctgtgccataatttaaaatggacctgtcctgtgctgctgaaagatggtgaaagcagtgattttctagcaatgccagagactggataagtaaatctgtttagttcagggagcaagtatttgcaagcattttgggtacagattattagcaataaagctaacattttaatgtctatctctctgtcactcgtcttattttttagtcgattctgacctagagaacacaaagaagtacttaacaaatctctgttgtattaatctcagacagaaaaaaaaggtagtttaaatctctgaggtttctagaaggatttaatataaatataaataataagcatgaagaggaatgtgagaaatacaatttttgtggattattacattttagaaactttgggggatatttcagacaaagtttgaaatataaaaatcattctaccggacatgagagcatattcctctttctgtgggatttcccttgaaaggcttttgtcagttctattctttaatgagcaagatgaaacaattagt

SEQ ID NO: 8744 - DNA, 724 bp, artificial
  synthetic oligonucleotide
accctgttcttcctgggatacacagaagtaaggtcaggctgggacaagagtcatgcctgtatacaaggtaagggatagttttcagcagtttctctgcgaggagaaaagcaggacagatatcttgacgcacattcgggctgtcatagtttcgcacagatgtaaaatactgtggtcattttgtgggttagttttccagtgagagcatcattcagcaaggtagatgaggtttcagtgtagctctgctacggaaagtggtgtgtgacattaaaattatccttagctgctctgttttctggtctctctttctgaagaaataggcaaaatatccacatctcttcaataagagggttgatagaaggacaccaaagtgcacattgtttcatctggaatacaaaggataaatacgggtgacaaaggtaggtcctggtcatctgaggtaatttctggtaatatggagccacacaaggtccatgggaccattggatttcagtctagaaatgctgggttccaatgctcagaatttaaattcccaggaaataaatatttagatacttatcttcactttttcacacaccgcatggtgaagagaaatgagatttatcgtgcaccctcaattctacaataagaaagcaaaaaaagaaagaatggcctgtgaggatttgaagagataccttcatcagtaataaagaacatgaacgtggaaggccttctatattttaatgta

SEQ ID NO: 8745 - DNA, 463 bp, artificial
  synthetic oligonucleotide
gcattactctcattaatcatgtgcttccagcctagaagtgtcttgggtgagtacatgtaagtacccagctgtagccctgcagagagctggcttttcagaggtctctgatgtgctcactcaagacaactgagatcattagcagggctgtttcccccacaagtagcttctgaatgagaacaggccctgggccctgggcattaatgagactcttaggatctttctcaaattaacaaatgaactccccgcaaatctcagcatgtgtgtgtgtgtgtgtgtgtgtgtgtgtgtgtgtgtgcactaatagtctcatgtggtaatgtggaaactgcagtgctatctgctagaaccttacccaactacctttttattccactgggtacatgttcatttctggtttgccatgtaaaaacttattctcaattatctttaatcatgaaatttcatttagcagcattccaatgtg

SEQ ID NO: 8746 - DNA, 1512 bp, artificial
  synthetic oligonucleotide
aagaaatctgtatagaatgagtaaattagttaagtattaataacggcagggctctttagcccaagcaatgagaagaaacttgagggaaggaccctgactacagttatccccagtggcctaaaacagtgcctacctcatatagagacttcataaatagtgaataaagaatgataaaatagagagccaaaggaaattagtataaacaaaatcagctcataaccatcttaaaaagtattcttagaacaattactcccttctatgtatactggatctaagtacatctattaaatattttatccttaatttttactattcttatcagctttttcactttacattcgttcctgatatatgccttgcattaaacaaacaaacattaaacaaagtttctgaaatctctaccctagatgtatattaggccaggtattatattaaaactagctgcattttaagaagtctaatctaaaggcagccctttacaagccagttctagttttctattttcatttgcacttaaacactaattcacccaccctacactcagggagccactacagataattatgctaatgctaatcgcaatagcagctaatgtttactgaggactttttgtgctagagtctgtcctggaggctctgcataaattatctggttttgttcatactacaggaaacccatgttataacattaacatatgttaaccaactctaaattactttctgttcctggcccaaagcccaaacccccaaatccctgagctttgactctgcaccctgattcttgccactttctcttttcccttgcctctaggcatcctcctttccaggggaccacaagcgctctccccctccctctttgagaaccatgacaaccaccgattccccctccccttcccctgtcatccctcccccagacggcaacccggcgggcacaaggtcggacgacctgctacgtaactcgcgcgtgtgactgcctagtaacagtgtctcgagtcggaagcgctcggagcgaggggcggggtgggagagctggcgcgcgcacgcgtaaagtctttgcagcctcgctacggggcggagtcttgcctgtcagcaggggcagagtagcgatcgtcgccaaagcgcgcggttttatttctctccgctttggacggggcaaactagcttttgggagtgaagcgggtacgcagttatccaacaatgtctggtgagtcaggacagcctgaggctggtccctcacatgcagggctagattggccgaaccctgagaggaatcgggctggggtcccgggaggggtgatccgaagagctggttcccaagggcccaggtcctggatccaaaaggttcttgagcagattatggactcacctcgccagtgtgtcaccccctcggaggtggtgcctgtaactgtgctggccgtccagaggtacctgttagaggatgagccacgcgacacggtgcccaagcctcccctttattgctatgatgtgacgatctcagatggggtgtaccagg

SEQ ID NO: 8747 - DNA, 1032 bp, artificial
  synthetic oligonucleotide
aagtaaaggggtcagtttttaataggatggttagggataatatcactgagaaggtgatatttgagcaaaacttgaagagaggagggagaaagtcatttggatatataaagggaagacagcaattgcaaaggtcctgatacagggccatgtctgtcatgtttgcgggagatagaatttatacatatgaaactgaggtgaaggcaatacaaaaaatgtgtaataaaacaattctatggtttttttttttttttttttgagacaggctctcaattgctcaggctggaatgcagtggtgtgatcatggttcactgcagcctggctgcagtgagctcagctgcctgggctcaggtgatcctcccacttcagcctcttgagtagctggagctataggcacatgccaccaggcccagctaatttttgtctttttggagagacatgggggttttgccatgttgcccaggctggtctcaaactcctcggcacaagcaagctgatggtcttgccctcctgaagtgctcagattataggcattagccactgcacctggcccatttctataaattaaatatataagtgcttagtaatgggaaaaatattccatgacattgaggttttttttttcacaaaatatcttaagggaggtgagtttaaatccaggttttccaggaagttattaaatggtttggtaagatggagggcattctaggtgggacaatgtgttggttaatataggtgtttacctatgttccaggcacatagtaagccctatatatatttcagctgttaatattagggatcaaatgtagtttatgagaggtaatagacttagctggcaaggtttagctggcaagaaggagtcactttaggtatgatcaagctactatttttaaccattaaaatagatctttgaagttaccattacatgttaaacaggatttctttcctcttttttatattctagataccaaaataatttccctttctcatcttgaaatgacctggactaacagaagaaattttcctgcattgctt

SEQ ID NO: 8748 - DNA, 933 bp, artificial
  synthetic oligonucleotide
atttaaatctattgcagtatttgagttgttttatatatggatatttttcataattattagtgtatgttaatgtattattcaacaaacttaacctgtatattttctaaatttattgaattaaaataaattctgaatagaaccagttgatttgtttttcatttgagactctttttataaggattggttatactcttcttatcctttatagagttgctgtacctcaaccaggagcttctgtacaaacaaagggaattaaaccgggcatgccaagcatcttcaaccgtatgttactatttgttattattatttatgaaaactttatgaaacattattctatgaagattactatttaattactaagcacaagtaatacatgcttagaatgtatactttgcatatagtaatattagcttaggtcactgtcaaaagtgtactgatcaatttggtatcatcccaaaagtgaaagtaattttaaacaaacttatacttaccagtttgtttcattagtaatagtatatctcttcaaatgtactatttttaatagaagaataagtaggaagtttaatttttaattgacaacaaatatggatagctcttaaaagtaaattgtatcttctttctttgctattgggttggctgatttgaactttggcctcatttctgaagtgatttcgtaatacaattttttctggtggggtgtccgtagagtagtttggtttaagtcagatcttatcaggtatcatctctctggattagactttttagcactttatttccttgctttgcttttggtgttattttgttttcatcctccacctagacaaaagtgatactgtcattttattgaatactaccttgttaaatttgatgtctcaacgaacctttccaaagtatttaaatatgacttttgttgattgttacatgatataaaat

SEQ ID NO: 8749 - DNA, 807 bp, artificial
  synthetic oligonucleotide
aatataaaaataatttttgctaaaaaaaatcactgaatctaattcctcattttcaaaacacccacttaatttataggaagatgtgcttatttataggagccagcctctctccccacctactcaccgcctagccccatgggagtggagggttggagtggaaatgcacttttgcaaaccctgcaaaaatctgaaattagtatccaccccttcacagatatcctcttgtggatggtagaattatttagttggtttacatatttatggagcaatcaccagacagtaagatcattttgtttcataaaacacaggaaagttcctaagcacataacaaagttttcatttatttggatctcgacggttttttaaatcttccttttgaaactagctaagtgagccagacttatccataccagaaaaacctgtgaatatgtatttaggatttatttattgcatatcatagttagagtgcaattccttttttcaacccactatacaacagatgacacagcatttttttgttccaaccttataaaagaaaggcccaacagacagcatgttgaacatttttatggctaattcaaacacttcagtacttgtctcaagcacattttattttggtttatttttccatattttttaaattttattttattttaagttccgggatacatgtgcaggacatgcacgtttgggtaacttgttatactgacatctgaaatcaaatttccaatgtcttctgacaccatatggcaactgcttcaattatgagaacaccaagacactcagccaaggtcagccaaattgatt

SEQ ID NO: 8750 - DNA, 2728 bp, artificial
  synthetic oligonucleotide
aataatgccatgagtgaatcgcctaggcgagtcaggctcctttcagttagtgggaaatggagaaagattatgtagttaaggtcatgaatagcgcaggaacatccgctagggtaagtcaggtttgtgaaaaatgcagaagaaaggcttggttctgaggtgtgtgaaaacagtcattcttttgtgaggactaaaattagttttagaagaggcatctgatgcggtacatgaaacctagggtaacggtgaggaaatacacatgtatgaggcttcttaggagcagggaaagagaaaggtgccatttgaagtcagtaagaaagggtaacagcgcgcttttcctgcccttcccccctctagagaatcagtaaatagcctgattctactcaaattccttccctacccaaattcccttgactacaactcagaccctttggatctgcgctttttagaagtactgtacttcacattctggcaccgtaagcccgaaatgtcctttaggcaaatgttaggagggaaaaatgtattcttgcaattcaaaaccgactcgaatcctgccagaaagctttatgtttgcggactttatcgttcctcgcctgtccgttttttataaaacgacgcgacacacctagccacacagcctcagatcctattctaacatcgatccatcctgttacccttttaagaggcggatcccgcagtgtcctttcctccctcccagccacctctacccccagtcggctgggcggagcttcacgctaaagccccagagcccgacgcggcagccgcggtagcggagaagactggagctccgaggagctgcatctgcggcaacctgtgtgctgacgctacgtgcctcctggctccgacgtagctcgcagctccccagtctcactccattccttccccacctggcgcgcacctgctcaagaccagggtcctgccaagcgctaggagggcgcgtgccaggggcgctagggaactgcggagcgcgcgcgccatggggccgccgcctggggccggggtctcctgccgcggtggctgcggcttttccagattgctggcatggtgcttcctgctggccctgagtccgcaggcacccggttcccggggggctgaagcagtgtggaccgcgtacctcaacgtgtcctggcgggttccgcacacgggagtgaaccgtacggtgtgggagctgagcgaggagggcgtgtacggccaggactcgccgctggagcctgtggctggggtcctggtaccgcccgacgggcccggggcgcttaacgcctgtaacccgcacacgaatttcacggtgcccacggtttggggaagcaccgtgcaagtctcttggttggccctcatccaacgcggcgggggctgcaccttcgcagacaagatccatctggcttatgagagaggggcgtctggagccgtcatctttaacttccccgggacccgcaatgaggtcatccccatgtctcacccgggtgagtgcagctactagattgcacccctccagacctctgccatggccagtttctcttattttcctcattgccctcctcgtcctatccccttgctccgaaggaaagtgggtgctctttctgtccccacggagtggggcagggtcctccccgagattcaccaggcctgggtgttgggcaaaaaaaaatccttcatttgcctctctggtggaaaagggtaaaacaaaccgggtgcagaggctggcaaatcaaggactgtttgagctctttgcgttcccttttcctggtttttcacaagggtgtctagccttggattaagtggtggtgggcatcgggtcttaaatgaccgaggagatcacctggaaatctcttcctcactctgctttttaacaacctcagactggcagcagattttcccctcctctccctgtttttctctccatgtttcctgggtatcaaatactagattgtgctactgtgccctgttaacctcattgcaattttggtggaaactttgcttagttcttgggttcttctctgcccagtggtctcaagtcccaagtgacttggtatcagtgcttttgtttgcttctgaaaaatctgatttaggttattgagttgcaaaacaggtgactaacgttcttgaaaaagaagaggtttctgcatgaggatagcaaaggcctagactttggaaaaaaaaatagtccaggtagttcttaaattcttggagatggtatgaggttactatttttccccgtcggttatccttccacaaacttccctatttgtgattaggtatccataccttatgtatatagttatcctagaccctaaaggacaaaggggaaaaaaatggagaaaaagaaagagacacgtgtaatagcagtgtatcatagtttttaagagctgggcctcaagtcagagcttggtttaaattcctactctgttgcttactagtcctgtgaccttgggcaacttatttcaagtcttagagtctgggttctctcatcagtcaaatgagaatgaataataagaaaacttatccacaagtttgccttcaggataaaatgaaataatgccttaaagagtttagtgcagtaaagcacatcatccactctcagtaagggttagctgataggattagccttctgggagtcactggaaggaagaagctgcttatttgactactggaggttttctgtttttcttaaaaccttatgactgaacctgcctagagagcacttgtattgagt

SEQ ID NO: 8751 - DNA, 624 bp, artificial
  synthetic oligonucleotide
tatattatttaaagaattatatactatatatactagttttgtatactgctttctattgtaagaatttctccatgtatctagaaatagaagatggtcctcttgtagttgaaggttgtggtcattgactgagagttggggattgagcctctctttctttagctaccagaaaggaagtgaaaaaatggagatggggagggttgtgaattggggcatttaaataaaaaatatgcttcaccgaggtttacattgaaatatacttactagccttaaacatggtctgatctaacccatatgcattgcctattgtggccttggtatttcttagggtttgatcaccacttgtgcttcagttcattttctcccccaatattcccataggtaatgcctttttatttttctttttttatgtcttcttcacaattgaggtttgcacctggtttccctgttgcttttaagtagcttttctattataatgatggctactgaactataaactattgttggtgtttaccccaaagtttatttgataaggcaccataggtatttcctgggaataaataatttttgtatatgtaagttctatcgaagtataatatacatcccaaaaaggtacataaatcattg

SEQ ID NO: 8752 - DNA, 2967 bp, artificial
  synthetic oligonucleotide
tgcatacaactgaaaataccaagagctgggcgagatttggagcaactggtacactcattcatttgctggtgagaatgcaaaatgtatagccaatttgaaaatgtttggcagttccttatgaagttaaaaatacacttaccatagcacctagcaatctcactactagatatttaccctaaagggagaaaaaatctacgttcacataaaaacacaactgttcatagcagctttattcataattgtcaaatactggaaaaaagccaaatattgttcaactggtgaatggataaactgtggtacatacatatcatggtatactatttagcaataaaagtgtgatgggaatcccattgatacatacagcattatggatgaatctcaaatgcattatactaagtttaaaaagccagactcaaaagctagataatgcatgattccatttatatgacattcggggaaagccaaaactataaaaacagatcagtggttgccaggaggtggggatgagaggaaaggttaactacaaagagtttagaggagtttgttgggagtaatagcactattctatatcttgattgtgataaggattaagtgacgacatatttttcaaaacgtgcagaactgtacactaaaagggtgaattttactgtatgtgaattataccttaattttttaaaaatgagaaaagttatagagcttgcacaaatggtattttatatatcctaaatcaggaaaaataaatcagtgctacatgtttccctttgttctgttccccttttgtttcagtttattcttttacctttttaaagtctggatacttttaaatcacctttgggaactttacagttacataatcattcagtgatataatgctcctccttttataggaatttaggctggttaagtacatgtatgttctgatcttgttctgtagtttaatgtattttttcttatctgtcagagtaacaataactacttgcttgtaggaaattggccctgatggagatagttgtgctgtgtgcattgaattgtataaaccaaatgatttggtacgcatcttaacgtgcaagtaagtttgattttcttctatatcttcaataaaatagctgacccacaaaaatgactgtgatggaagaaaactattttgaatatttccaaattaatgtaaaaaatgtttattttttaacttatcttcatttaaatatagaatggtttatttttatttttattcatttcttaataccactgaaattggtataagtctaattgtaatctgcttcaatttgttctaaactaattccatagaaaactgagaacctagccagcacaattgatatatatgtattatatatatattatatatagtatatatactatataatatgtattaatattatatatactatatataatatatattatatactatatataatatatattatatattatatataatatatattatatataatatataatatataatatatattatatataatattattataattataatatatataatattattataattgtaattatatattataattataattatataattataattataatatatataatatgtattatatattaaatataataatatatttatatattatatagtatatatcttacatagtatattatgtataatacatatactctatattatatatactatataatatagtatataatatataattatatatactatataatatagtatataatatatagttatatataaatatattttatatatagtatattttaaatatagtatataatatacatagtatactatataatatatatactatatataatacatattttatataattatatatactgtatatactataatatataattatatatactacatataatatgtattatatattatatattatataatgtataatatattatatattatacattatatactatatactgagtatatatactatatagtgtatagtatataatatatgtatatgtacatgtacatatatatactatatgtacagtatatatactatatactgagtatatatactatatagtgagataatataccatatattatctattatatagtatacaatagtgtatatatactatatagtatatagtatatatatactatatactatatatactatatactatatagtatatagtgtatatatactacatatatataaattgtgtatatattatacatatatgtaaattgtatatatataatacatatatataaattccaactaaggagtgaacacttccaaatagatgctcataacttgatttcattttattttttcttgatagattagaataaatttaaaattaatccagtactatccttatatttatgtgtatttatattatattatgtatatatgtatattatatatttatgtatatatatgtacattatataatatatatactctacataatatatagtatatattatatacattatacactatataatatagtgtatatattatatacattatacactatatataatatagtgtatatattatatacattatacactatatacattatatataatatatactatataatattataatatgtagtatatatagttacacatgtaaatataaggacagtactggattaatgttaaatttattctaatccatcaagaaaaaaataaaatgaaatcatgcatctgtttgaaagtgttcattccttagttttttaaattatccctctcctgaaggttgttcttaacactacttcttttagctatttaatacaatagtgatgctcttggaacatatcacattgcctaaagcatcagtacagtgttgttgtactcaatactatattggactatattattgagaatgactgtaccatttatcagttagggaattctaactgtttaagatttga

SEQ ID NO: 8753 - DNA, 755 bp, artificial
  synthetic oligonucleotide
aaaagggtttgaccagtaataatataacattaaaatagaccttgatgccagtccatcttcatgctatacatgacagaggaacttttattactttaaagtttttcttcagacttctctttgtcagtgtgattgtcaggatgctgttaataagttaagtgcatctttcttttgtcaagcatgttaagaatacacagatgcttggaacgcctcagcactatgattatcaaaccaggtacatgtgtcttatgtgacgatatgccggggacgagggtggatgtgtgatgcctgtattcttgccctatattcttagatagttaacctcttttcaagttttgtgggacttctttgggggcatttttaagtgttttttaacggctgtactgaagtataatttacccattgtaaatatatcattggaatgtgtttagcaaatgtgtagatatgtacaactattaccacaatccagttttaaaacactccatcaccccaaaacattccctcatgcccatttacagttagttccccctcccatttccagccccacatcaccaccaatctgctgtttctatagatttgtctattgtggacatttcatataaatggaatcatacattataggccttttgtgactggcttcttccccttagcataatgttttcaaggttcctccatgttgtagcatataacagtatttcgttcattttccttgctgagcaatattctattgtatggctatatcgtgtggctatccattc

SEQ ID NO: 8754 - DNA, 6224 bp, artificial
  synthetic oligonucleotide
ccatccagttctggatagcttttgccacactgtaacctttaagggtattggaaaaggatgtggtttgatggggaaggaagtaaaaaggggaaggaaaggtaaaaagaaaggaagatatctctcaacgtttgctacatttactgatctttctccaggaagagaagaagaaattacctcccttagtacacattcaaattgcgatggcttttcccaaagatacattgcagtctggactctgaaaggattatctctttccaaactgtccagatagctgccttgggactacttactgccatttagtagaagagaatcccagattgccccttttctcattcacaagaaaaatccctgcttggagcacacgcctgcctcactcgagatggcacacatcttggaaggttaccccagagatgctcctccagggcagagttccttggcttggcatctgcgtgtgccccaccccatttttttttaatccacatgactttgaggctctattctcaaaacagcttgccaagagccctttgcttatacatggcctcccaactccttcctccctctaaactttttttcacttttaatgcactctttaattccggtggacttagttattgcaataaataaaaacatctgtcaaatatttcctcacagcgatatcatgcaaattattgacctcattcaccttagtgttcaaaccgctgcgcatcattgccaagatacaaagagatcaagtttgcttccaaagggatttttttaagagtttaagaaaaaaaaaaatgcacataaattgtttagattccaaaataggaagctggacaagagattttctgtggttcattacagcagtttaataaacagataggggcgacagtgaaggaaaggagcggtgcacggagtgaagaaaacgcgtggcttctggaaattttatattcttcctatataaccaaaaagagcttaatctaggcatgaattttggatttagagaaggaatcgtatcactgactgtgtgaccttggataagtcgcctcacccgacagtgctttcctttattaatgtgcaaagcggggacgaatgtccacttcgcaagactgctgtgaggattacgtgagatcgcctgagtctatagtgagagctcattaaatgttagttgttgctactgctacttcctggaatgaaccgatattccaaaattccagaaactttgttttctacagtttaatgccttcggctgtaaaatgataaaaagaagcaacacctttacacctgggactcacttatttgaaccaaaaaaatgctttaaacttcagataggcaaaacacacttaactgatggctgggacccgctttgaaagcacccccacccattctcaccccagtgtattgtgggaagggtagtcccatgttccagtcgcttgagcacagaaaagcgcgtaggaaactacaactcccaagaggtaaagaagcgggactatttcccagtctggcggtagcgctgtgggagggaattggcaatctctctgcctacgtgggagagaagggagggttgggggaagtgtggaaaacctgaacctgagctgctgtcgcctgaggaagatttggtgggaggagaagcagaggggaagagacgggttgagagtgaggtgaggagggcatctaggtcactgctcccggggggcacaaagttcgcgatgtggctgaagcctgaggaagtgcttctgaaaaatgcgctgaagctgtggctgatggaaaggtccaacgactacttcgtgctgcagcggcgtcggggctacggggaggaaggcggaggggggctcacaggtaagctgtggccaccctacctgcctctgggctgtgttcgctgttacttaaaaggtggtgaggacaacagttactcgtcgctaccagtttcccgatcctaaatcgtgggcggagggactggggttcttctcccgacaccacctttccgccaccacctccaagtcctgagaatgtctcactggacgacgagttgctctttggttgggacaggtgaagggaggagcgcggttctttctgaggccaaggaagaaacgggtacctaccttgtcgcttcccatggggggagggaggctgatgatgagtgttagacctagacaggtcgcatttaggctggtgacaggggccagttcgcagttgtgaacttaacttttttcacagaacccataccgatcatcagcaccctggggagattaagcgtatgggggatgggatggagtgggtacgcggggatggtgaggagaaagggaggcgcccaatcacatcctgagaaatagacttcaaaagaaatattagggaggagggagaactggagtcaggagaggtggaggggtaggctcagaattgctgatctctcccaatttagcatcttttactttgtctccaagttttcaatctttgggatcccctctcaaaggctattaacaacgtcgtaataaattaatctcttgagtgactggtgctgccccttcattcaaagctgtgattgtaagccagacggtaagagtttaactcttcctgtctaacccaccctgaccccaattcttaaaaagtgttttttggccaaatgtttaaagtttccagagaaagttattttgagaccactcatcttgggtagggatatttaaagttttggacgttgggaaagcaagagctctttttctaatcaatctctaatttggtattgtgaccttgaagtggtagaccaggcagcgtgatgtaatggaaagagggaagagtcccgaaaacctgcattttagtcccatcctactctcttacttgttggatgacattcctcaaactctttcatttactcaaccttaagcacctactgtgtgccacaaggttcacaagattcagtttcttggctttgcagtgcttataatctggataagaagggtgggaaggtctaaaggaaaaagaaaaccacctagtaaactaggcaagttataattcatggaggagatgaccttgctttttctctcttggaaaatggtgcctacctcacagagttgagaggataaaacgaaagataatagcaccaaatcaatgtatgtcgtcaagatggtgataaacgtatgctgttatttcgttttcaagccactcccggggtgcaaagaattctgaggttctacaggacattttttaaaattttgctagacctattaatcttatccagcttctaaaaaggccctctcgaaaatatggcaacaaaaattgccctgttaaatgtgacattttgtcattttctaatttttaaaaattacaaatgctattttgcagaagagtctttccatttaatagatgcagatattttcgagatcaaaattttagaatcgatgttcataattacccagtgacataaattatccacttgagtccattgagaatagttcaggatatatttaaaatagatttcaggccgggcacggtggtttatgcctgtaattccagcactttgggagaccgaggcaggtggattgcttgagaccaggagttcaagaccagcctggacaacatggcgaaaccccatctctacaaaaaatactaaaattagccagccatgtggccccagctacttgagagactgaaatgggaggatggcttgagcctgggaggtcaaggctacagtgagccgtaatagggccactgcactccagcctgggcaacagagggagactctgtctcaaaaagaaaaaaaaaattaaaatagattttatagtcccgtgttacagcctcaggaatagtcttataatttattttcgttcctcatactaaaactgtgttcctttaagtaggtaaatcaaattcttgaaaatataatcactgtaatgtagtattgcatgttttttttaacttgttgcaagtttccttttttttttttttttttttttgtttgagacaggatctctcactctgtcacccaggctggagggcagtgatagtgatgtgattatagctcacagcagcctggaactcctgggctcaagtgatcttcccacctcagcctccggagtagctagggcttcaggtacaagccactaagcctggctaatttctttttttttttttaagagacaggctgtgttgcccaggcatgatcttgaacacctggccttaggatcctcccactttggtctcccaaaggactgggattgggattaaaggaatgagccacctcacccagcctgacatgctttcttcttaaagcatggaccaactgcactagtttacctctatcctgcccactccatttactagtccccatagtctagaataagagaaatttgtctgaagaaataaactaagatttctaccacatatatatgttgtgactagtgatatccacacttatttagtggtcagtttataactcttcatgattattttatctgtggtattgacaagatgcttgaaattaccacatgagagctaccactgtaattccatgtaaattaaacaaaatggataagaaagaaacaaagaggtgcttttaaggttcatttggttctttttggtccagagcataagtgtgtgctgattttcctagctgctcaattactgtattcttacttaaaatcatgaagccaaaagctttgttgtgctttaccacaaatccacatttggattagctctcacaggagcttgactgtgtgccagcataagtttgcctctgttcactttgtttgctaaaatccagtgttatgtgttatccctttaaaagattagtttatgcattttgtttaatgaagaaatgataatgatcatctagaaaccttagtggttatactttaagatttcatttctttgccatatgataattggtggtaatcaccagcaatgtaatgactcttaagtgtggacttgataaagttagttgactccatttttttctaataatggaatagcagcaacagagaactcaaggattattaaaacaagagatgagtttgtaagttagaattctgaggtacctcttttaaattgttgaaacacttctagtggatatctgatagattactgaccatttgcctaactttatcttaattgttctggctcacagcaggatggaatatcttgtggaaatttttggtatacataagcggttttatagataaagcgattttccttcatttagagaaataattcacccttctggattttacggtccccttatgttatctcttgcttctcctagctaataatgacttttctatgacacctacatttagcacctggttttaaagagttaaaactaatttatgcatatttgtcttattaagcacaaatcaatttgctttgcttggcagatgggaactactacacgaatggagctatggggctacattctactaagtactctagtatatgggatttaggaaggtctgccaatcaggaagccttcatataggtagtttttaaagagtattttagtcttgaattttccatatctgaatagtgtaagcaggttcttcagtgttagattgataagctccctcagtagaccttttttgtgtggtgtagaacaaagctacgaagtaaaacttattaaaatggagaatttttagacattctgtttctgatttcctttttcatcttggtaccattactttgaaattaaattgtctgtaaaaaccagaatatgataatatttgaaataagcttttcattttatgatatttatatagactgagcaaatcactgtgtaaacaatttgtcataaacccatacataataaacaataaggtaacctttttaaaacctcttagtgaccatcccttgaaaatataaagcttctttcccctatttcctcaccccagactcaaggagtccaactctgaaaatgtgcgccttagttattagcaaaatatccctgcatttcatgcttacaaaggacatatctgataaaaaaattttggccttctaagtacctgtctactgagatgagggtgcccaagtgccaagcatgacatttcatttaaggtaaggaaagatctacccgcccccccccatacacacacacacaaacacacacacacaaaattaataagttaacattttggcttattaaaaagaaaatcccatggggcaacccctagagagggcagatcacgctttgtgctcccatccctctctggaacatcttggtccctgtgaaatcaagttaaagattacttttaaagatctct

SEQ ID NO: 8755 - DNA, 1500 bp, artificial
  synthetic oligonucleotide
ccctctcttctaaagtagatatattataattttttaaaaagaacaaaagcacatgagtttctggaacattcatatgtgtgaacatatagcatacaattaattttttaggttgtgtggcttgttttttatatttccgcctaaatttcttttagtgttgccagtgagtctttcctcctggccctcttaaagtgaatgtcacttaacctaaatgaggttgacattatacctgctgacatcacgagaattctgtaatctcaactctaaatctggttagtaaaaattattttttttaaaaaaaggcctttctacttaaataaagatgattgtataacttatttcccccaaattaacctgatgcagaaatagtgtagttacctactaatgaagcttccttataccaaaagaatcaaacttaaggccttaacatttcccccatggcttttatttgtggtccattaaagacagttattactcttgctatggtgacttagtagcatgaataaaattctgattgaattgtaggaaataggccatttgcaatgtcaacaaattttttaatatgccagtctccatatattataaaatatactaaaaagtcagcatatttcttttgaatatttatataatccatagtgctgagaagactttaatggtatgtgagtgataggaagagattgatagatactgaaatattcttcaagtcaaagcaactagggctaataatgtttaatctcaccctcagcaaacctcttaacactgattcagcgggtcacatggatttaaccttgctacagaatttctaacctcctgtatgaaatttctgtaagtttactaggtcttttgatgaatggggttgctctgagcaaaggttttgtggcttctgaaataagtagagtggccacagttaaaatctacatttacttagcatgcataggattgtcacatacatgctgttttcagccacacatattatagacacagcactaactgcattatttggagaccaaggattgaattacacattatgtattttctggtactctacatattttcttaaaagatactggttattctttaggcaccagttactagcatcttgttttcagaattttatatattttctcatgagctggatttactttactcccctttcattaaatgttttgttctttctatttatgagaagtactgttcatgcccacatagagggataaagtaggaataaatgtaaatattttactcctttatgaccatcattttttaaagtgaaaatgttatttctttttaaactatgcttttaaataacaagagcagttttattgtggagttttccttaagtgttttattttcttgtgttattaatcaggagccaacagagaagaaataaccaagcattgggattggttggaacaaaatattatgaagaccttatctgtatttgattcaaatgaagatattactaattttgtacaaggaaaaataagagtaagtggcacggat

SEQ ID NO: 8756 - DNA, 324 bp, artificial
  synthetic oligonucleotide
tcttttgcttttatttttttaattttccagcactttgataagctcattcttttgtctttggcttttattggttctctaaggtgtcagttttattgttgcacttttgaagttaatatgtcttctttttttcctccaactgtcttaaccattaactttaaagtctaaaaacaatgaaagccctttaaggaacatttagaaaaaaagaggaaataaagtaaaatcacatctaatgtcatcagcctagcacaaccacagatttgcacttctggatactaaacattttaaagagggttcattattcaatcccctgtctatttctttatt

SEQ ID NO: 8757 - DNA, 1457 bp, artificial
  synthetic oligonucleotide
cagtgtggggtcaggtccacaaaccagggaatgggctgagagtaagcactaggaaagatgagttcaaatttcctaccttcttccctttaaagcctcattgcctgccctccttcctactcagtcccctcattcacccaacaaacactcacacaggcagaaccttcaatgctctgaatttttccttccagcagactcccatccatctgtgtgaaatctcacccactcacagcccccatctgatgaataagtctcactgagagaatgtcggaatgtgctactcttccctcggtactatttacatttagacaactgcggccttgactatcataatccaaatgtctaacatgaaaattaatcatatggcaagctagagctggggtgaggtggaaggtaagggggcagggggtatctttaagtactcattctaatgatgaagcctggatttggcctcccctcattccctgcagtctcacttgggctatgtactatgagccccctttcgaaggagttaaaattaatttggaaaagtgttctgaagtaactctgtggaggagaaacagaatgaatatccaagacatttcctctggactagctaatccttttgccactgcttgatctcaccttcctttgattgtttctcctctacttcctactttttactgttggtatatttttatgtgttcattattcaatgtcttttgaaaagtaccctgaactctttggagagtatgtgctatgtaaacacaataaagaaatgaatacaatgtctccttttacaagagaataagttttactatttctgatagtacgaagtttacccctcactcagcactagcctgaagagtaagtaggtatattctgagggacatcagattccactctaaagtacttccctaactacctgaaatcccattaatttgatgacaaatatattttttaatttgagccttataggtttttcaagaatcccttattaaaatgcgaataccaaagcaggcgaacagatcatgatataaccttagtcccctttatattaacccaccacttctatcgaacacatttttcacattccaaatttttccatgcctttgtttatgcttttcttcttccagaggtaatgctaaatttaatataaattagaaatataacattaccttatattttcacataatctctcatttgatattcaaatccaagcctacttgatctttttaaaaacaatttatttttttccaatgtaagaataacaagtttaatattgaaaatctgaaaaaggcaggaagataggaagaagaaaaatatcaaccatagtcctaccacctaaagaacactcactgacagtgtggccatgctcattctttaagccttaatttaggtcccatttctggtgtggtgccttccttgaacttcctcccccagatcttccatgtcatatctgtaccactcagttgtacata

SEQ ID NO: 8758 - DNA, 1454 bp, artificial
  synthetic oligonucleotide
actgagtgatatgcggagatgatatagtataaatttacgttctcaactacaaatgttttaaagtgattaaatgaactgacagtggcaatagaaatctagcacaagctttaacagttagaaaggagaatttcctaagtttgtgattctactgcaaaacctttaaagaatatatgtctgaatgccttctatttaccttgcatggggtttgattatacccaggtaccttcgtggttctaatcaataaatcaccccaactccaatacttctgatttaagagtgagtttaggttaatataaattggaggtctcggaccagtgaaggcctctgggtctttatatttgctgttctctttgtgtgaattgtcatcccttgctccctgcccctttatttagctggttaaactgtactcacccttagatctcagcttaaatatcattttgtctaggatacttttcctaacctctgggatcagattgggctcccctgatgacttgtctcaaacattctgtaccttcttattatgcttatagctttttattacttatttaatttgtctgagttgccagctaggctgaaagctctgtgagggaaggaacagtatttgtttcataaccagtgccctggcacataagagatgcttaataaatatttgttgaatgaacaaaaggaaagcaaaatattaatgaaaattatgaagccttaaatagggttcatgagcttaagacaagaaaaagacaatgaagacatttttacctgagcattcggtgtagtttatgaggtgtcatcccacatccatcatcggtaaaggtcaaacaagatttattcttgacctcctcaacatctataaagaccgtcctggcagatacatctggatctacagcattatctgcaaaaggtagaaatctgcgatattagatccccttttccaatattgtatcaaaatctctagttcagtgacgccaagacataagaaatgtcctttatttccttcatttggatgtttgagaaggtatcagggagcattaacggtagtgcacttactaaattatagagaacaaaagagatgatgccagattgagttctaaagctgatttccagatttcatacgagcgatatgcaatctgcctttccaccttcgaacttcagggtctttggaaaaaagtattaataactactcccatatacaaagcattttgctccatttttgtcttattacttcttgccttttagcccctttactgtttgtatacacatacagtaaagagtggctatggagaaaagctgaaggagcaactttggtaaaagatgatgcatattacacacattacagtttatttgtgatcattttattttcttctttcttacatcacctcctctgttaaagaacacagagagtactgccattcctgtttatagcctaagaggcactgaaagggttagagtttaaaatcaaa

SEQ ID NO: 8759 - DNA, 1963 bp, artificial
  synthetic oligonucleotide
acatgttttatctcccctactagaagagtgaatctgtgttgtattcatttttgtgcctaccacagtggccttgcgcacagtgggtgctcaataaatatttaccaaatgaatgattcactagaaaattaatgcttaagtggagaaaatgattgaaggaaaacctaaaatgaaagctttggattgccagttaacactttgctctctcttttccctattattaatattttcacaaatagttgttatttggtcttaaaatctatgtttgtatacatgtatgcatgcatgtgtgtgcataatacatacacatactcgcgctcatactggacgtcttagatccggcttaggttctttaaggtaatgcttatggccaaaatcacaaatatccaaaattacaaattggaaactcattaaatcacctggaaagtacagtaagcacagcacaggtatatcacgttctgcaccgtgccaaccatgagagaacaatacatttcgctttcccatcccccactatgtaaatcactactttttgctcccttgtagtctttcttgtaaattacatacttaacttggattgtattccattctgcagaggttcagtgcacagccccaaggcacagtaccaaacctcaaagatacagtccctctgctctagggttccaaacgtatcaattccactttttgcctttcaccttctaattaaattacacatattgtaaagcattccgtgttatggttaatcatcaaaggtctctatcattcttatcacccttccaagtaagtcccctgctacccattgacttcttacccaagataactctcatggcatggccacagcgactgcttaagtagagaccggggttcatttggggagctttgaaaacattttcaagagtttgttctgtgcaaccttgcccataaacacttcttccttctttcgattttcaaagcatgtataatgcgccctgtatgctgctgcgttttgtgcaggactgcgtttcttctttgctttccacacagtagcacactactgcaaaaactggtgtaattggcttgaagggatcaactgaaaacactttaaaagcaaacaccggtggagcgagaggttaagtcctcaatattcattccagcggtgtgagggcgctcgtggaccacggacccagccctccgcagtagcagggagccaaatgcactcgtgtcatctcttaagagatgtcccatcattcctaacttttcttgtctcaaaagttaaggaactccgctttccagacctttccccaggacccgcctcggtcctctacgcccctttgctagctaggcatcctccgtcggtcgccagcccctgcggacccagctgcctcagggcccgaggtttttatgcatctccttttgattactaactaagctatcctaaagtgcccgaacgtcacgagcgcgagagaaaaaccacactggtgtctttaacgcttcagacacacctcgtttcctccgttttatgagcggaacctagttcctggcgagagagccatccccctcctccgcctgcggagccggggccggttccgaggcccccaccccagccccggcccgccccgcgcggctctgcgcattcctctcgcgtccgcggcaccacgctggcaccactgcctcgggcgaacacggccgggcccgccctcgccactcacctagcagctccgcgatggcactgaagggtcgcgtgtggctgctggagttgctctggaggtagcgggggctcatctgggggcgagagaaggtcccgacccgcgtgaggcctcggcccgccgggccctccccgcgcgccccccgcagcccaggggcccgcgcgcgcgtccgccccctcgggccccggacctaccgtgctcaggcggatcccgaaggcctgcgggccgccgccgggccgggccagcccgcagcccggcgcgccagggccggcgggggcccctcg

SEQ ID NO: 8760 - DNA, 520 bp, artificial
  synthetic oligonucleotide
ttttatagtgaaggggacaagggacggggcttgggcatgattcagctgaggagccctcgctgaggaaggagaggagtgggacatggcagggctggctgagggcatggataggagacaccggggccttaagagagctctgtgggtgaagcccgggagggcagagcagagccagggtctcaggactaaagtctgaaagtgtggcctgataaaggacttccctccccagccagagtgatggctgcatgagagccaagtgggcaaagttgtgtcctgaaaacagaagcaagcctgggggagaggtcagagctcaccctgtgtacctgccagtctgagggagagcaaagtgctagagtctccttcacttccctctcagcacccttgcgccccaaccaggtctgtgtgcgccgcttcccttttcccacttggaaggaaactatcacagaggccaagatgaacccctgggactccacaccactgtccagctcaatgccaagcataaggccatcctaaagaaagccgc

SEQ ID NO: 8761 - DNA, 617 bp, artificial
  synthetic oligonucleotide
caatacagttttccatgaatatgtgtgcctgtgtatatgtatgtaatacaaatgtccactgggagactgcagcaaagagatgtctctcatgtgatataaactaatttatccactgtagttatcactgagcagtcaccctgttcttttctccttttctgaatcccatttgtctacaactgctgcctgacgagctactcagaaaagcatgaccactgataccacctatagtgtcaagtaaactgtctctgcatgcttcaaaaatgctcgctctttagggtatcaaatcagtactgagtcccaagaataggcaaaaagggcttttcctattctgtattacactgtgttgacttagatctaaagctaacccacttacgcccagaatttcagagcctttcttgaatgttccctgccatttctggtttgttcatccttctctaaccacaaggggtcactcagtacacagggctgggaacacatcctatattatcacctctgttctctttcttcatctcttttggttcctctccccagaataaacaaacaaacaaacaaacacttctcatagtttatcaatggtaacaaatggatattagtatgtggagagtggagggtagaca

SEQ ID NO: 8762 - DNA, 2214 bp, artificial
  synthetic oligonucleotide
gttgagaaccaatatgaaatctcatcgcctctccagctcaaatgaatttttagcaaaaaagtaactccaagtaatcattactcttcattgttttactctttttatcctgtgtttacttagaactttccccagatacctagaacttatatcctatccaaagtactatcatactttgataacctttgtcctctactattaggtacatgactaagatttgtttttatatttagtgatcctacattacaattgttttaagagcataccagaagaaagaacaccattctgataataaggaagtctggatcctggtcctagctctgccattaattagctgtgtgttcttaaagaagtcattcaacctctctgagccacagtttctccatttaaataaagtaagtcccttttcaatgctaacaatcttaattttattaaggaaacactggctgaaagccttgagatttcatttatgacaaagagaatccctgccaagagaaaaaaatcactataatttttctctacagcccaaattactttttgacaccttcctcaactctacccgagaagcactgatcactgtagaaaaatatgcgacaggaagacaactaagtcaagcattgtttaatctcattcctgagtgttttctagttactgacactctcacatctcagcagttcttataacctgtctaggtaagtggtttttggtgataaactacctggaactaccttctctagatccaatttaatagctaccttttgaatcacatgacccttcttttctcttacctgaccacacaaacatagtaaattctgataatcagtaaccagttctgccactaccatttactgacattgcttcttttaatccttacaaaacccctaaaagatagatattatccctcattttaaaaatgaagatacagactcagagagattaagtaacaattaaggtcacacaacaattaagtggtaatgccttgacttgaacccgtatctatctgacttagaaactctccccatcaggcagttttaaaaaatattaaagcgatatagaatttaacctccctctgataattcaaaatagtttcaaaattgatagaatattttttccttaacacaggagagaaggaagtaaagatgaatgatgatataggtatgtctggaagggaaagaagctgaagaagttcatggttgatgacctctattaatgcagaaaatgaaaaatctagcatgccaaataataaaatttgtattattttaaggccacatctttaaaagtagttaactctggttaactagctcccatttgtcttaattccttaggcttcattatattccatatttaggcaaagtctataaaaatgatttccaccccccaatttttaagtctataggaaagttgagagaatagtaaaaaccacacacttgtatgccttttacctagattaacccactgttaacattttgccacaaattgctaaatcttcctctttgcaaatttttgctgaaagtaaaccacagacatgagaattctctaaataacatagcctgaatcttctaagaataaggatcttttcctacataatcaataactatcacatctagtaaaataaacaattccttaatatcatttaatatacagtccatattcaatcccccaatattctaaacaatatctttttagttttgatcagtacctaatcaagggtaacaaggtagacttgaatgttatgccttttttaatctaagactatccacttatttttgtttgcttgcttcgaattttttttctcataacgaactttttgaagagtccaagccaattatctttcagaatgtctcacacatagaatgtctgattattttcctgagattagattcaagttaaacattttgggtaagaatactacatcatctttcagaatgtctcacatgtggaatatctgattattttcttatgattagattcaaattaaacatttttgataagactactacataaatggtattgtatacttcttatcatgtcagatcaagaggcacataaagtccagttattctactattggagaggctaagtttgatcacttcattaaagtggtacaagttagatagctgttgtaaaggcacattttgtcctttgtaactattcagtaatctatggagtgatatttttgagaccacataaatatcctattctccagcgatcttaaac

SEQ ID NO: 8763 - DNA, 9587 bp, artificial
  synthetic oligonucleotide
caccttaaagaaaatgtggcaaaattataacaattgttaaatctttggtagatacatggatgatggttcataagtctatttttctgtttgaaatatttcttaattttaaagaagtaatgttttagaatgacagaaaataagacaatatgtgtgctttgaaaatggagatgtgctaatatagactaattgtagcctttattctcccagccaacttaattggctcctttataaaaattgtttaaattataaattaatacacactcatataatcttcgaaaaaaatattcataaagtaacagtgtgagtgttactatggcacttgaacctatgtgaagctgctgtgattcatatattttttaaagtaaatcattttaaaaatgtctatacttagtaaaaaaataaattcaggctggtctgactacagtggtatttattaatacaactaattaatcacaaccagttacagaattctttgttccttctccactccctttgcttcacttgactgtcttaaaaaaaaaaaaaaaaaaaaaagaacattcatggctgggcccagtggctcacacctgcaatcccagcactttaggaggctgaggcaagtggattgcttgagcccaggagtttgagaccagcatggggaacgtggtgaagcccagtccctaccaaaaaagaaaaaaaaaaaaattagccaggtatggtagcatgtgcctacagtcccagctacttgtagccccagaggtcgaggctgcagtgagctgtgatcataccactgcactccagctgggccgacagagcagaccgtctcaaaaaaaaaaaaaaaaaaagtacattcaacctaactcatatgtataaaggacaccaggactgatcactgcctgctctagcacatagaaatcttgattgtcaaattcatacatccaagaggggcaaaaactcccagctcaggtccagatctagatctggccttcctgttaggcttcctattgagctcactgttatgtaagacataagttatagaaatgattttaaataacccaagacatcatggaataactatattagcacatctccctttactttttttttttttttgagacacaatcttgttctgtcgcccaggctggagtgcagtggcgtaatcacagctcactgcagccccaacctcccatgctcaagcgatcctctcacctcagcctcctgagtagctgggaccacaggcacatgccaccaagcctgactaattttttaatattttttatggagatgggggttcactgtgttacccaggctggtcttgaactcctggattcaagtgattcttccgcctcagcctcccaaagtgctgggattacaggtgtgagccaccgcacctggctacatctcccttttcaaaggacacatagtatcttattttctgttgttggttagttaggctaagtaaattacagccaactcactctacgaaatattaggttgctgttaataatgcaaaatataaagatcatcacaacacagaaaaaaatttccaaaacagtattaaataaaaataacaaaaaagtatatgaaaaaggatcacaatcatgtaaaaacatgggtacatgtggataaagataggaggggaacagaattatcagttatattatggtagcagaattgagtgagatttttcatctttaatttctttcaatgttgcattaataaattatttaaccagtgttttaaaatactctatataaaagaattagctaaactatatccatttttcatagctataaatccacagaaacctttgggtgtattttaaaaaatattttagatctctcaggtttcattattttttttccctttaaaaaaacctttatttcaccattattctttttttttattattatactttaagttttagggtacatgtgcacaatgtgcaggttagaagtttcattactttaaaaccgaactaggagtcaaattcagttgtctctcctttgggataggcaagttagggaagctctctttctgcttcaaccactgcctccagattgcggctgctatcaaggcagaatggacaagaatattagaataaggaagtgacttctagtctcggagatccacttactgacagcacaatcctgggaaagtcacagaacctctctaatccttatgttcctcaacctctaagcttctgtatttccgacattgttcagggaagccaactgcttaaagattaatctcagatcctggacccatcccccaccccgctacttcctctacctggggaaaacagttcttagtattggacgccaccttgccagggacagatgaaaccttgaagagttgattatatccctaaagataaataacatttgttccccaagaagaaaactaatattcactgaacacctgtgcacttgacactgtaccaagtatttcatatatgctatattgtatatcttcctgggtcccactagaccacagaaccaatttctggagggagccagggcaatctgcattttaaataaattatttatttaaataaattttaaataaattatttatttaaataaattttaaataaattatttaaataaattttaaataaattatttaaataaattttaaataaattatttaaataaattttaaataaattatttaaataaattttaaataaattatttatttaaataaattttaaataaattatttaaataaattttaaataaattatttaaataaattttaaataaattatttatttaaataaattttaaataaattatttatttaaataaattttaaataaagtgcacacacaagtttgaaaactaaaggtctagggacaaatcattagggtgttgtggtgtacattttttaaaatgtaatggaaattatcagagtatattgcaagtagtaagtgttaagtgttgtttctgtaaaaacagttgtcggttatatattgtctacatgtgtactaggtcacaatataaaatttatttcttactgtcggtcacagtcaaaaggtctgaaaaacaccggctgagcattacagacttagaataatgcacagtgaggcagaataaaaacaaaaaagcaagaagaaggagatggcataatatctataatttaagctccacaagtatctagtgaattagcaaaatgcaagacagctaaactctgatcattcacagtaataagcggaattaaggtattggtaatttggccaaaaggccaataacgttactttagccaataaccttattctacccccattttttgtttactgtagataagaacaagtagaagggacaaattaatcaaacttcactatctcttatgccagatgggatggtcgttaagaaatgcatggtatatagaaagaagggaagcagtttagttcattcataatcaaattccaatacctgaataaccaaaagtaaccattcattaaaaccttctgtggggtcctactattgatcatggctaatcagtcctgaatactccaaatatttattacgccatccccccgccgcccctttgtttaaaaccaagccacggaatttatgggaaactagggtaacaactctatctctaagtgaacttaagacaaccagattccctagcagtggcaagcgagcggcgcgcctgcttttctccactccgaggcgggaaaagcagagctcccggagtcgcgatgttccttagagtgggaacgacacgtagctcaagccagtgccccacaggaaccgggtggcagttgaccaggtgctcccccggggacttggggcccggaagccttgcctacagaggagaataaaaagcgcgatcccacctgcacacatacaaacacactatcgcccgcgacaagccaagacagaagcacaacacgtgtttctgtcgcgtgggggagacgtgaaaggctgggggcgtggaggactgtagcaaaaccttctctacccccggcccactgaccctacccttctgcccccgtctctccagatcggctggagttcgagtcctcagatcgggaattcacgcgcgggaaaagcgcaaaagagagcgaagcctgctgacgaacgggacaaacgaaaaccccacaaacttaccttactggcaagtcgccgccgctcgctgtccggccctgaactatacgggcaggcctccgagactgctagacgccagaggggcgggtccggacctgctcgagccggaaagaatcggcctccttagtgggcaggttcccgctgaagtgaagctaaccgagactgaggcttaaaaggggtcgacctggttaactagaaagggcgaccagtgaccctgacctggacgcgctcggattggtcgattccagtgcagtctcagatgagactcttctatgattggccagaaaagtcaagcgggaacccggaggttggcaggtggggggcgggaacaaaacaaagttgttaccctagcaacggagagacgccacgctctgcacagtctattttcggagcctagccagagacgggaaaactgaccaaggtgaggaaactcgaacctcaagacggggaaagacagggtcctcagatgctgtggctatcagaaaaactagggagaactctagatatttataactctgcgagataccccaaaaagccacaagttgggcaaggtggagaagacccgttccctaaatcccgctatcctagactcttcactaaatcccgctatcctagactctagaaacaggacgctgctttaacaaaactcggttttacaggatgtgagtgaaagatggatgctgatcgactgtcagaaggcaaaagtaaacatctgaaagtttcccaactggtcttctctcaactctcacatgcacttattggttctcccttcccattaataatgactaatttgggaatgtaaaccatattttcttataggaggacctgggtgctccaaactggagcagccactgtacccttctgttttatatgtgcaggcacgatttatcctggcctagcatgccttggttaggaaatgttttgggggatatcacacttcagactgaaaaaaaaatggccccagtacttactacgtgaataatgtcctttgtgcgacaacttgaacgctgtggtctgagggttccagtgttgcttggttagataagctgaggagtgagaagtaatcagaccttcacttggtgggcccgagtgtactgtgcagagactacttgtacctacaagacctgctactcgccaagggctgattgggagagtaagtattacatgtcgtttgactgtaactatcaaaaggtggggaagtgtgaccaaaaaaattaaatctgagtgaagggagagaacctagtttgaccaaagagggaggagtcattactccttaagagcttcttgtgataaggattcagaacagagaccatatttcctgaagaaaggaaaaaaataggactagggagaaaatttaaagcacagcaagaaaatttgccaggccgagcgcggtggctcccgcctgtaatcccagcactttgggaggccgaggcgggcagatcacttgaggtcaggagttcgagaccagcctgggcaatatggcgaaacctggtctccactaaaaatacaaaaattagccgggtgtgttggcgcctgcctgtctggatgctgaggtgggagaatcacctgagccctggagatcgaggctgcagcgagccgtgatggcgccactgcactctagcctgggcgacagagtgagatgtggtctcaaaaacaaaagagttctcatactccacctgtatctaaaaagagtccctccaacttctttttagatagaggtggagtatgagacttgagatagataaacgaagagaaaaaaatattaagtgtattgtttgtctgaaatgtactatagagcattcgataattcaggatgggttctacagataccaaggatttgcctctccatattaaaactaatttttctgtcaactcagcactttgagagtcctaagcgagggatcacttgagctcaggagttcgagacccatctgggctacacggtgaagccccgtctctacaagtaataacaaaaattagccggcgaaaccccgtctctacaaataacacaaaaattagccaggtgcagtggcacagcctgtagtcccagctacttgggaggctgaggtgggaagattacttgagccagggaggtcgaggctgcagtgagccgagatcgcgccactgcactccagcctgggctacagcaagaccctgtctcaaaaacaaaaaaacaaaaaaacccctccattttcaaaaaggattgggatggtacagactccttatgaataaatgactaaaacagaggaaatattaaatcaaaagacgcaatttttttttttttttgagacggagtctcgctctgtcgcccaggctggaatgcagtggtgcgatctcggctcactgcaacttccacctcccgggttcaagcgattcttgtgcctcagccacccgaggagatgggattacaggtgcgtgccactatgcctggctaatttttgtatttgtagtagagacggggtttcaccctgttggcaagctggtctcaaactcctgacctcaagtgatccgccggcctcggcctcccaaagtgctgggtttacaggcatgcaccaccgcgcccagccaaaagacactttttttgatttagtaatcaataactatttaatttcttgacttctttttctatgaaagattctaggtactttcaaaaagcatcttccttaaatatattttaaatttgaaacgaaaactgttaagttcccatagttacttatgagttagtacatttgatggtagcgaaagttagagacctgaaaaagaaaccattcttagtattgtaaagataaattcaaaatgaattatttttaataggtgggaaatcattgatgagtatagttatcaaaaaatgcaaagcagaaagcaattagtcagtatattataatttaattcagacataggcagagatgatatcactgttgtgttctcaagaattttaatggaggaattgctaaataaggcactatataaataaagttgcttcaatctaggaaagctgatttaaaaaaaataaataaataaaaataaagttgcagaagaaatgccaaatttatttagagaataaatagattttgagtacttgcaaatcattgtgttaaagtcagtattttacatagggatatatctatttacttaaacaagttccaaaaggatattgcttggtgactttttttggggggcagggaattgagtttctctctgtcacccaggctggagtgcagtggcatgatctcggctcactgcaacggccacctcccaggttaagtgattctccagcctcagcctcccaggtagctgggattacaggcgcccgccatcatgcccggctaatttttgtgttttttagtagagtcggggtatcgccatgttggccaggctgatcttgaacttctgacctcaggtgatccacccaccttagcctcccaaagtgctgggattacagacgtgaaccactgcgcccagccctgcttggtggttctttatcaccctgattttatttaccatatatacttgaattaataaaatctattatctatttgaatagtctgtaattcagagttttcactaatttaacctagacttttctacaattaactgatgtcaaaagccatctttattgatactgtgaaggagacaaataaaatagaaagcatgatcccagccttagaaccagtctgactttaactcaaggttactgatgttgcttaagtgctgtgggtctggagccaatctggttgaactttttcagcccctgactggctccagtgttatggtaatgagctggttctggagtgtcagttgctttagctcattgtggctagtagatggtccaatcatgcctctatttatgaagaccccaagtactcaggttaatgtgggaaaatcaaaggctctgtctggaaaatgttgccattagcattggcctagcaaaagagaaggagagaaagaaaaacaaagggcctaaaaaatttattttctaaatacaaatctcaaataaaagacagtaatatattttgtttttactgaaactcttaaattttccttactttaagtttattcttggcctatttaagtgacagtgccagattcaaacattttaggcagtgtggctccagaatcttctttttcattttttattgttattattttatttatttatttatttttgaaacaggatctcactctgtctcccaggctggaatgcagtggcccgatctgggctcactgcaacttccatctctgggactcaagcaatcatcctgcctcgggcccctgagtagatgggaccacaggggcacaccaccgcgcccgtctaatttttgtattttttgtagagtcggggtttcgctatgttgctcaggctgatctcgaactcctgagctcacgtgacccgtgagctcaccttggcctctcaaagtgtttgcattacagacgtcagtcagccaccatacccggccagaatcttctttttaaaaatcgctacactgtactatccaataagtcagggcaaaaggaagaatgcactccaaggtacaaaggcaggaaattatagagtatgtttaataagcagtttagtttttaacagaatatgtaggagaataatagaagggaaggacagaaaattacgttgggactatatcctgaaggaccttgattgccagactcaggatgaacttaaatgtatatcacatttagaaataaaagatagagctataaactaacactgcatagttcattgtagtgaagatagttccctacaaatagttctttgtagttcctaaaaagtcctcctgttttagtttttcagctgtgatccacttgtgtcaaatgaattttaataaatgttttttaataaagttgaataagttattctaaatatgttagacttcttaaaaagctagtagaatcttcctttccattgaattttgaatgtttttttctaaaaattcacaaactgtttttctcttttgatactttgaaccatttaactagttagtcacaaaatatttgggattcttttgtttatcaaaatacaatatcaacaaacttgtcatgattgatttatttatttttgttgtcatgatttattaatttgtgtttacagattattattacatttgatatggcaaaaatattttggctaaagtggtaattttattattatatttctattttaattgagctatagtgcaaatctatggcattttattccagcataatttggaagtccaattgtactttaagaagtctaactcctaatatgcttcagatatataaagtgttactaagaattattgtgaataatttaacaaaaacaagtgtacacgttccaaggaggaccatccccttcgaagtagtcactttaggagactaatctatttactctaatgttgttgttattgctaaaattgcttttgaaacttctgttttagaatcaccttgaggcatgtagcacattcttttgaatatcctcaaagaagaaaatct

SEQ ID NO: 8764 - DNA, 1576 bp, artificial
  synthetic oligonucleotide
gtttttttatggaaatcctatcaaatttaaagtatcactagtcatataggttatacaagtattaattacagaatattgaactttttctcctccctcagacaaatggtttatctactattggagccatgggtcctgggaatattggaccaccccaaatagaagagctcaaaggtaagttatttaacaaagcaatatagatcaatataatcttttccttggtagagaaattatagggagagtaataagtactaatactagtatttattaagatgaactaaataacaatgtattgtatacttggaaattgctaagatagtagattttaagtattctcatcacaagtaaatgataagtaggtgaggtaatccatatgttaatcagcttgagttagtcatccactgtgtatacatatttcagaacatcatatggtatatcataaatatatacaatttttatttgttcattaaaaatggagaaatgaataaataatttttaaatagaaaaaagatgaactaaaataatcatggaaatgatgaatagccatttacatataaagatgctgtttttactctaccactgcaggtaaatagtttttctaataatggaaatatatttgccttgaattatccacattccttgcatattttctgagatagaagaccaagaaagtcacgtgtggttagatcattttttattttttaaggtctatttaccaagatgcttagcttctttaccttctaccttcctatattctagcaatttcatggaattcattcattgaattgtttaataaatatttattgagaacctattgtatcaggcagtatgaccatctctgatactacaatgcagatcaaaacagaaaaagtccctgttctgattgagctaatagacttttggagaagacaataaaacaaataactacacaattttatcttacattaagaggcttatacattaacatctttgagtttacttataaaaaaaagtccaataaataaggctaaataatatttttacatttccccagcattttgagctatacatttttacagagttgaacattttacaaatctttaaaaatataaaaggctctaattctgttggtcatgatcaccattaaccagaggataggaagggagaggaagtgaatttcattcatcaatttagttaattgcaaaagattaatctggacaaatgtttaaaataatggctaaaatgaggtctaaggatggttttaaaatttcagttattattgctatacatactcaagaggctatttgccttacccaagagatattcgctccatggcagtctaattcacatttcatgtatttctgtgctgcctgtatttctgataatgtaggtctaataatctttaaattctgaaggcaatgattcatatgtaaaatgttatatataaatctgtagttaggctttacaaagcccgtgctagatagaagctgatcatttcaaaagaattgccagaattgaaaacctaacaatcgggtgcatttctgggaatgcttaaaatgactcaaagcagtgctctgcacctaatgcaggtctccaccgg

SEQ ID NO: 8765 - DNA, 1625 bp, artificial
  synthetic oligonucleotide
gagaacgaagagagtaaatttgaagttatgtttatatagtgtccacgtatcatatgaaaagtaataattaagtcacttatttgtcatattgtctaacaaatgtcaaatatccatatgcagcaaacttcaaatttgagtaatttttcccttttcatcctgatgtttgatgttaggtagatagaacatccatgaaagctttaaatgaataataacttcaggttattatgaggaaaattgctttataagattttaaaaatcttcatcttctaccttatgaaaatacatttcaacatttctcagtggatgcagaggaaaataggtaaagaacatgaacaggcagttcaaaaaagaagaatcacaagtggccaagtaaaagaataacaaggagctgagctaaggcactggccttggggagaagtatgagggtctttatttgagtgagttttggatgaagagttggtatttggttagataaaatggatgagaggagagcgtcaaagatgatgctgaagttattagcttgggtgactgaggaaatgataatgccattaactttgataggaattataggttaagaagaagcagtgagtttgtttttgttttctttctttctccctttctttctttctttctttctttctttctttctttctttctttctttctttctttttctttctttctttctttcttccttttttctgagacagagtcttgctctgtcgctcaggctggagtgcagtggtgtgatctcggctcactgcaacctctgccttccgggttcaagcgattctcctgcctcagcctcacaagtagctgagactacaggtgcatgccaccaggcctggctaatgttttttgtgttttttgtagagacgaggtttcaccaagttggccaggctggtcctgaactcctggcctcaagcagtccacctgcctcagcctcccaaagtgctgggattacaggcctgagccacagtgcccaaccaaatttgttttttttcttcgccaaccaccgcccccccggccccgcccattgttcactgcagcctcaacctcccgggctcaagcaattctcccaccttactctcccaagtagctgggactacaggtgcacactttatttttgtgaagactgcgtctaaccgtgctgcccaggctggtctcaaactcctggactcaagcaatcttcctgcctcagcctccctaagcactagattacagttgagagccaccatgactagctggtttttgatatgtacactttgagttgtctttgggacatccaggcaaacctttgtagtagacagttggaaaattgcgtctggagctcaggataagagcaggagcttgagcaaatccattaggagcaatgaacatatagatcaatcctctgtttgttttaacctggcttcaccttcataaataattggtagatgttatagcctattaagagaaaagtgccccatagcaaatagctgcttattgttagccatgttcaaactcagagaaatcccttttttatttttgggcattcctattggcaaatggtcagaagttcaatcaagtcctttagtcttactatccagagatctacaatttcttcattaaggtagcattaagcat

SEQ ID NO: 8766 - DNA, 844 bp, artificial
  synthetic oligonucleotide
tgctatcctatatatagacatcaacttccatcagaaagagaaagcatgtagagagtaagagatagactttgtgttgtggtaaaaatacacatagtataaaatttaccattagtgacatttagtatattcacgatgttgtgcaaccatcaccagtatctaattccagaacactttcatcagtgctaaaggaaacaccatacccattaagcagttacttccctcttctccatttccgcagcccctagcaaccaccaatctcttttctgtctgtatagatttgcctattgtgggccgggcgcgtggcttacccctgtaattccagcacgttgggaggctgaggcgggcagatcacaaggtcaggagatcgataccatcctggctaacacggggaaaccccgtctactaaaaatacaaaaaattagccgggcgtggtggcacgcacctatagtcccagctactctggaggctgaggcaggagaattgcttgaacctgggaggcagaggttgcagtgagccgagattgccccactgtactccagcctgggcaacagagcgggactgcgtctcccacaaaaaaacaaaacaaaaacaaaaatttgcctattgtggacatttcatataaatagaatcctataatatgtgacattttgtccctggtttctttcacttagcataatgttttcaggattcatccatataacagtactttactcctttttatggctgaataatattccattgtatggatacaacacattttgttttttccattcatcagttgatgcacatttgggttgcttacaccttttgactgttatgaatagggctcctataagcaaaaaca

SEQ ID NO: 8767 - DNA, 450 bp, artificial
  synthetic oligonucleotide
ttttctagagtggctatatcattttacatatttaccagcaatgaatgaatgatccagtttctctacattcctaccagcatttggtggtgtcactatcttttatgttagtcattttgataagtacgtaatggtgttaatcttttatttttagaagaggtaaaccagagaggagaaactattttgaatttcttggaaataagatctcctattgtttcagtttaagctcctcctaactggttttgcctggaaagctgttttgaacttttacactaaatgatcttctccattcatctgggagccagcttccctaacaccacaaagtaattaccaatcttgttctatgcctaaagaaaagctgagatagctatggattcatttgaggaagcagaacaagcaggcacagaaggggtataagaggtaatttcggtgacaatatttgcaaataattac

SEQ ID NO: 8768 - DNA, 1145 bp, artificial
  synthetic oligonucleotide
tggccagtagcctgtttttataaggcctgtaagctaaaaatggtttttatattttttaaagtggttaaaagcaacaaaaacaaagaaggttttgtgatggagaacttttgagggcaacaaagactaaaatatttactatctggcactttactgaaaaagattattgacccttatctatggtgatgataaacaataagctcttacatttatagcacacatttcagtttacaaggcacatccatttttctctcagctgacttccagaacaaccttgtgaagtagatgaggtgttattcctctccacagagggggaaacttggtgaggttaagccactcatatccttgctctatcacttgatagaactcagatggtctgaatgtgattcagtgttttgaccctatagcccactgactctctcaacactttggaagaactactaaaggctctgtgaaaatgcaatacgatttcaacttaacagatcaacccaaagttgagaaaaaggccaagagagctttggctaactatctctggaattgctccttcagttttatatctcctctgacaatggtcatatatttttctaaatgaaatgccacccatattgaagggctcaggaactgtcaagccaaaatctttcaagtgccgtagagttggacagtttgctatacttcaaacacatcgggtcaaacaatataataaaaattgactcctttgtgatatgtccctttataggagctgtgatattcactatttcccctaatatcttgtgtccaacctgcagtttcagccgtgttatggacagcatatcatccaattgctatcctgtcttcccaccaatttaccaggtgtcatatttccctagcctgaagtagctctgcaatgtatgttgggaaaagcatgggggaggttgaaactaattcggatatttcttaatagcccgtcatcctggccttctgtgcataagaaaaggcccttggcaccagagtggccaatcagcagcttcaaaaatgggctccccaccttgaggtcattgttctctccatccaccctccatcccacatgtgcctggctgaatataatttcatgcactgctcctacctgatctgtaatcttctccagtcaattttggatgatagtctcatat

SEQ ID NO: 8769 - DNA, 1800 bp, artificial
  synthetic oligonucleotide
gtcatgtgtgtttttagaaatacagataactttatcagtgtgtgagggatgggttatagggggacaagaccagaaaagggcaatcctgttgggaggctgttgctgcttttcaagtgagatgatggtggcttaaactggagcagtaggtatggaaaggaggggactgaattaagaaaaaattagtaggtaaaatcggcagggctttgtgatcaattggatatgaatatgagatatggtttagctctgtgtcttcacccaaatctcatcttgaattgtgatcccacatgttgagggatctgtaatccccacgtatcgagggagggaggggattggatcatgggggcagcttcccccatgctgttctcctgatagtgagtgagttctcatgagatctgatggtttcataaggcagttttccctgctcttgctcactctctcacctgccaccttgtaagacgtgcctgcttccccttctgccatgactgtaagttttctgaggcttccccaatcatgaggaactgagtcaattaaaactcctttgtttataaattacccagtctcagatagtatctttatagtagtatgaaaacacactaatacaatatgtgtgaagtagctatcaacaataacatccagatctttatcttgggtagctatgtagataataataataatagcactaatgaagatggtaataggaatagtggtgccatcaactgtgatagcaaattcaggaggcagtgctagtttagtggaaaatggacaattctcttttggacatgttgagttgaaggagcccatggagcatacaagggaagatacctagcacctaatttgaatagtttaaagctatggggaggatctgtgataaagatttagatttgagattatactaaggatattagtcatagcctcccatgatcataccatttctaagggaacttgctgcatgcactgactattgcccatgcagccatagtttgttctacacaatccatcctatctggcttggctacagctgatggaatctaccaggtcactgacccaagggcagtcaatctgtaagttgaccacagcctgatgatatagatctggtgaaaaagatgaactgggttatttagaatccctgtctcaggattttgagctaagaactacagagactccaggccagttaacaatgggagtcaaagctggaagattgttgaaaattgggacatgacaagcagagaccatttgaagctgaggtaagaatgggatggaaatgataggaaagcaaaggatgtttggtggcagaagaatggaatagacacaggagaaaaagacaacaaagagagagacaaagaaagtgagcacatagcccaaggaaaaaacagagagactttttcattctcaaggctgcttaactatctaagtgttctcatctcagtcagtatagtctcaaatgaaacccagccatctgaggatagtttgagtgagtttttttttccaaccaaaagaggagtcacccacatgaaatcactcaaggagaaactagtgcatgataaaagcagtgagttaaggagagcagtggggaatactaacagtgaacaggtaactagaggaagcgggacccatagacatacagagggatggacatagggtactaccaagagaagaggaggccgtggaagtcaagagatcctgtttgtttttctttaaagagagagtgatcagaagtgtcaaaaactgcagagaggtctgataaggactctgagcagtgcccactgggctagaaatcagtaggtaactggtaattttggt

SEQ ID NO: 8770 - DNA, 959 bp, artificial
  synthetic oligonucleotide
gtttcattcattccctcggctttaaatactatctttatgctgacgattttcagtgaagactctaaaaagactctaaaattaggattcatagatctacctgaccatttaaaaccgccacttggatatttattagacatgtctaacatagcacatgcaaaacagaactcttgacaccctccctccacccaatctgttcctctcccatctttcccattttagaaaatgacattaacatatgtcagaaacctgagagtcatcgttgattcctccttctctcacttcccaaattcaatccttcagtgaatcctgaccattctatatccagtatgaatttctaattcatccacttctcccatctctactattactaccctagtccaagggaccattatctcttgcccaaattgtaaattaaggtaatcttttaaaaatggaaatcaaattatgtgactctccttatcaaaattcttaaatgcttttccaccacatctaaaataaaattcaaacttttcagtctgttctgcaaatctctgcatgatctagcccagtggtctaaatgactcttgctccattctcatttctcctactcttctcccttcagctgactatgctccacccatattggccttctgtacttgcactatgtatcatgctctttctagcctcagaactgtttcatttatagttccctttgcttgaaacgctcattcactgggttcttcccatgtctagctccttttcaaccttcaggacttgaatcacatgctacttccttatagaggtgttccctgactacctaatctgaagtcgttcatactattttctatgagttttttttcaacgatattgtcacaatgtacaagccatgaggtcagagaccttgtctttcttatttgccactgtattccagcacctagcatagctcctagcagtatgcctgtcactgggctcaaaaaata

SEQ ID NO: 8771 - DNA, 616 bp, artificial
  synthetic oligonucleotide
agttgctttcctcttgatgatgagaaaatagtctgcgtgttgttaccttggcaccatacaaatgtccaggtccccatcagctattcacctaatagttttaatcccacttgatgattcttgtctgaatcaatgaattcatgacaggcttaaaaacgatttttaaattctatcaccctatctctatttccaagccagtgttgttcaggaaagtagaatttaccttgttcaaccagggcagcccagtgcagtgggtatgagcatggacattagagccagagggtctggattcaaatcctagtcccacctcttgctagctatgtgactgtcacttaacctctccatgcctcaattttcttatctataaaatgttgtgttatgataattaaattaagtaatactagtaaagcaataataataaagcatgctgcctggtaagcactatgtaagtgttaaataaacaaaaagcaaaactatgcctatttgattatattgaaatatagtccttactggaaaggcagaataaatgcttaattctttccctttaattaccaattctcaaagtaaggatttggttttatagctgccacaaggggtgacaaataagtggaaagaacat

SEQ ID NO: 8772 - DNA, 1217 bp, artificial
  synthetic oligonucleotide
ccagggaacaattctgattggctttccttggtaatgtgcctataatttggtccaatcactgtcactaggagaatggatactctgtgtttgtccaggtctacttcacgtgcttacccttaaggtcaggagtagagtctatcatgaacagaaggggagagagaaagcctgctgggaagaccaaaaacaaacaaataaaacaaaacaatacctaccagaggacactatcctgcttatcttctgattcacctcccagatctcatactaagtcctaagcagagagagctttgtaagaataagtaccaatttaaaggactatttcactaaaatctctgtggggcattgagtacacaaagccacatcagaagcattggttttagtagtttcagttgggtaggcggcagcttgtgacagcagcagcagcagcagccacctcattgtatggatggttttgttatgggcattagaagaggattatcaccccagggagctagaaaaggaacagaggaaatgctggaagccactggggaggcaaaggggttttgttaatgaaccttgggacagacctctgggagacttgcagaaatagttgggttggtggaagactttgaagaggggccaatacaggcaggggcagaaacagagaaatttctatgcgagattatgttgtgaactcgattttattttcagcctgtttcccagctcacaaggacatccaccggccacagaagtgcaaggaacagggacagtaaattacccagtgatgcccggtcccctagacggctagcactgtgctgaagtcacagaaagctatgagactctgactctctcgggaagctggaaaacagggcagaaagcagattggtaccagttctaggttccactgatacaggctggctggctatgatgtggctgcacctagctgttctgattcaggagacacttttcccactctgattttctctccacctatttccctcttcctggcttgaagcccagccagagaccaacaccactattagaatgggcttctcctgacactgccttctgcctggcttggacctctgcagcctcactcttgcctatcttttcagactccagaccttgtctgtgtcctccagtttggctttacaccctggattcagaccttggtttccccctcataacgcacttttactagctccctggtcattcgttctagcttccctatttgcctgctg

SEQ ID NO: 8773 - DNA, 1472 bp, artificial
  synthetic oligonucleotide
acttgcccttttttgactgtcaggagatgaaatattcccccctctgagtttgatcaggtactataccacctctgccaacagttggcactctatctgcacaccctacccagttcagactgggttttgttttgtttttctctctctctctctccaagcaaaatcttggtgcacctcccaactggtcagggtcccttctcctgcagaggccccctcctgctgtatgtcagtaggaggcccaattctggaacttgctctgtgggactgcactggggagaatttgttgtaaagctcctgcaggggctgatccctccccacccttgccatccagaccccaggggagggcatgtcagtgttagaagacatagtcctagtttctctcagattttgaagtctgtaaagtggtgtggactccctcaggctataagacaagtttataaatataagatgttatctcactgttaaacagtactacaattgggttttatttgaacaaatgaatcagctttcttcacgctactggaagttctcaaacgaggtgccaaacttcatttttagtgcctgttgaataaacagcacactcagctgcctttctcctagcagaaactttcagctttgcaattccagtcacctctcaattctggtggaccctaggtagccaaaagcagtcagcctcctttttctacctgacagagtgacagctctggcccagggatttcatttccagttcataggcccacaggcagcttcaggttggcatagtcctaagtcattctgatagaaacatcagagcataacagatgcttcctggattagcttcacagtttctttaacccaccactcttttctgtaatcgtcaggactaccatgtagggtcgggcaggttggtcaatgcatgacatccagctgaggaaatgagggtaattctaatgtgtaattttaatgtgttggtcagctgtttccctgatgaaggggtctctaggtgtgtctcataagaggaccaggctgcctttgatagctcaacctccatggcaagataatgtggtggaggggaagtagagacccactctgacgtaaaatacctgtgcaacccgagtagtcctctcattcacatctccaggcctccacttcctcatctggaaatgggggagttggagtagctgatttttgaggagtgctcctgagatgcacaactccagggggcaccatttacattgtccctgaatgaacgtgaggtgtaaactgcctccatggccccaattagatgatggcagagctaattgttcccccttttgatgtgtctaagccaaatgctgtccttctcttcagggtctctctcacatctgaggccagttggcccagctctccatcttcttggtacacagtactcatcccttccacaccttcattttatatccattgtgctatacataaactcttaatattctcacttatttattttccttattagactg

SEQ ID NO: 8774 - DNA, 3699 bp, artificial
  synthetic oligonucleotide
ttcagattttgaggcacttctcccttggatccatccttttctcctacagatttggctagtgctggcgtcagtggtgcaggatagatggaccaatatttatgaggaaatctcccaccttgctccatggaacaaacaggtcactgagcagcagccaaaatctgctgctgcacagagcttaaggcctgggcccagtgatcctgttggcctctcctttcctgggtactgtgaatcaggtgcaccagcagcatttcttcatgccagggctgagacattaaaattaagtagtgcaactatgtctgctacagaaatcaaaggggaagggcagtctcagacaggaaggactcagtaacagcttcagctgtctccatctgcctctcctccacctccacaggctttcccgagaatcctgagctgagatgaatgctgccaccccgacacctggcctctgagaagccactatttccctatctaagctggccagtcgtggacaaatccctcagttccgcagagatgaggttggaattagaagtcaaatgcaaatgcatagaaatggaggagttaacagcacaggcatcttcaagcgaatccacaaaaatttgttcagagcttatagtctacccagccccagttccttttcctcagtaaagccttactttgcacagaaggtgaatgttaggtcaaggcactcagacttcctgcccaaaagtcttttgagtttgtcagcagcaattgcatgaggaaaagacgatgcctgcacagaaaagaggtaaggacatttacatgtatatatgatccttaatcaaatgtatccactaccaccataaatgagcaccagtaccttgtgataatgccaccagttgaagtgggaaatatttttcattcttacagttaagggcccagctgactcaactggtttggctctgttctccagcctgtgtgcagcctgatttgcacttggattggctgatggatagacatcatcagagctccttggccagtttttggttttgagctttacctctgtggcagaaggattaatctgttcagagagagtttgtttttggcttttgaaacagccatactcctctcctctgggaatgatgggttgtttcagaaatgggagctttaaagaaagctcttattggatctggacttgggccactcctgcaaccatttgtttcatctggcccatcactttgtttgctgccacctacagataggaaacattgcctagtacggaaatctgcaggccccttgcatccaaagtgctagagcctaccttctggaaactgatgtctactgatgattgcaatattgagacatgcacagatgatgcataaatgctgttaacctgtgaaaaagagccaccctagacctctggactgatgggggcctgaataaggtactaaatgtaatctgcctacaccaggaaacccaacatatagccatgactcaaaaatgagccatgcagagctgagagctgtcaccaaattttagaatgtaaacattccataatcattgacaaagaggaaaagctcagtaagtattttcagtgtatcttctgggaaactagcagagagacatgtctacaaaatctaccttgaacccctcatgtgaattaggcaataccataaccggtcagcaggaaggacagtgtaatataatagttagaagcttaggcttgctgtgagacagattgggttcaaaattctcttgaagcattgaccaagatttctttttggaaatcaaagagagagtagggttgtgtctcacttacttaacttactcaaactctctgagtcttcattttaccatttataaaatggggatagtaatagtactacctgttgggagtttcagataagataatgcatgtaaatatttagcataactcctggcacaatgtgagattcactaaacatgaattattactgtttacaaggttcagggaacccatgaacccatagcagattttggtcactgcttctaatgccaaagagtatgactttttaggcctccagaattccagtttagactgatatcccccaacatagaaacacagtacgcaatcacagggagactggattttcaaattagatctggggatgtatcaaccatggttctccagagaaacagaaaaaataggatataaagatggatcatagacaataaatagatatagatatggacagaggtatagatagaaatatagaaagaaggctgggtgtggtggctcatgcctgtaatcccagcactttgggaggccgaggcgggcagatcatgaggtcaggagatcaagaccatcctggctaacacggtgaaatcccgtctcgactaaaaatacaaaatattagccgggcatggtggcgggtgcctgtagtcccagctactcgggaggctgaggcaggagaatgacatgaacctaggaggcggaggttgcagtgagctgagatcgtgccactgtgccactgccctccagcctgggcaacaaagcgagactccatctcaaaaaaaaaaaaaaaaagaaagaaatatagaaataaatttattataagggattggctcccgtaattacagaagctgagaagtctcaagctctgcagttggcaagctgaagacccaggagagctgactgtgtagttccagtctgaaaggtggccagcttgagacccaagaagagtcagtttttcagactgagtccaaatacaagagaagaccattgtcccagttcaagcagtcaggcaggaaagggtttcctcctacttgtggtagggtcagcctttttgttgtattcaggtcttcaatcaattgcatgaggcccacccacaatagggagggcaatctgctttagttagtctgccaattcaaatgctaatctcatcgagacacaccctcacgagcacactgagaacaggatttgaccaaatgtctccatatcctggggcccagtcaggttgacatatataataaaattaaccatcacagggaacatatgctaaacccttagtagccaaagtgtggtctataaaccagcaagcagcaccaccatttcctgggagctagttaaaaatgcagaatctcaggccccacctcagaccttttgaatcagaatctaaattttaacaagatttccagatgattcatatgcacactgaagcttaagaagttctgagctaaaacaaaagctgtgattcccaaagtgtagttcttgaagaaccagtagcatcagcataggtgacaaaaggcttgttataaatgcggattcatgaaccttaacttaactgactaagcagctatgggaacgaggtctgggaaacttttttaacaagcacattaaatgttgagaaacactgagttacagatagactcctccataaggatcaaataagctgaggcctgaacaataagatgttccttcaaatcaatggtttggtttttttaagctgacagatttgtctccaccattcttctcttctctgagctctttgatgcttatgaccttgtttccagtcacatatttggggcattcagccaggaggtcctgctgggtatcccagatggttcaattttccatcagactctaagctccacagtcaccattctcacctcccaaaaatgaccagtccccacaagagatttttgacctggcccagagaaggtattggagtcagtactggaggaagaaaagtatctggtatg

SEQ ID NO: 8775 - DNA, 2761 bp, artificial
  synthetic oligonucleotide
caatgttctaaaagtaattagtagtagaacaacaatattccataactctattgggggtgtgaaggagtggaagtgggtatgttattgagtactgccctctcatctatcatagtagaaattcaatagataagtatctcaagttgataaatcaaggaagagagcagaggcatattatttagtgaactagaggtcaatcgtcagaagaattaaaagagaaagattaaaaatggcagctttgtgggtctgaaggtggatggggtggcagaaagggttttgctcttcattgtaagtttttctgtaccgtttgatttttttaaccaggttcatgtgtcatttcaattaaaaaaaaaagtcatcttctctcacccctgtcagtctctacttgagcatcatttgtatccttccttgttctcatcacaatctgtaattattttagttatatgtctgatgattcagttaatgtctttttctcccattagactgtaagctccgcaaggacaagaacagagtctgtcttcgtcgccactctgtccccagtgcctggcatagaatgtagcccaggaaccaggatcacaccatgcatagcactccgggaacttcttatacaaaggcctctccaagcttcttctaggaccaaccggcagttgagatagaagatgttctgttatggaaaggcagtgtcctccaaaacggtaagagcagggatggccatgagcagagaaaggcactacagccgaatagtaccccagaaagtgttctaaaccttccctggtgagggcatgagctggggcaaatcaggttattcttccagcattgaaatcctctttaaaagaacattaaagagtgccttcaagtgggcattttgcagggagtaaaaggaagagggaatagcaaaggcgcctcttagccctgggagatataggctgttggcatttccacactagctaaagaggcttctctcagtctgcctgggcttgtgtctgccagcaagtacaggcaggtccagtagatgcagctgatttttgtggtcctccctgggcagttctgaagaggtctctggaaactgcttgatagcaaagctgaagattatcttgtggtcagaacaagagagcctggggcatggagcagaggaattgggctgtcatatcttctagagccacttccataagaaccttgggtatgctggggtgaatggtatgggcagacctgtttgcttcctgattaaatgaggaaaggtgatctgtgaggccactccctcctggccatagcctcacacatgatccctgaagagtcatagacagggagatttcaaggttcagacaaccccattggaccccttgggctgtctagggcttcctggagagaacattcttcttttttaaaaaattattattattattattatactttaagttctagggtgcatgtgcacaatgtgcaggtttattacctatgtatacatgcaccatgttggtgtgctgcacccattaactcgtcatttacattaggtaactctcctaatgctatccctcccccctccccccaccccatgacagaccccagtgtgtgatgttccccttcctgtgtccaagtgtgagagaacattcttccaatgaggggaaccaaaaagagggaagcatggaaaaaagccaatgaggaattacgacgccaccactggaggaagtgggttagagtcaagatggctcacagggagaagtccttgcttagcaggcctagaaacctagcacctgtaattgtgcctccctctttctaggaagacaacaaactgtctttcagctttgtctaccaggtactggaacctctctgtggccagattcctggggccgggtgaattgtcaataggcaactgcagtcactcagaatctttctagaatgagtaactcaaagacaggggtttgtttgatccattttgaactaccgcagcatgtagctcagtctttggctctcatcgggagacttccaagtaaactgaaaaaaggcaggagctgctgggtcaactggcagattcatccaggtcacagaaagatggggaattgtaagagaagaaatgaacactgaggccatttctcttaagtggggagggcttggagtagaaagcatgaaaaatgcccctcctgtgctgggctcacttctcagggcctaggacaaaggcaggacatggtgttcctgctttcacagtgattgaaaaaaactggtggcagcacacagcttgctgccgggcagacagcttgagtgtcttcactactactcttggtggttcaagggcaggtttgcctcagcccttagaacacagttccctggattccttggccctcccacatctcgagagcagcagtaactacttcactgtgggctgtgaggagtctcttagttggacaatgttagtatatgcaattgattcagagcctaacttcatttcttcctaacttctaactggtttcttccaagttcctacacttggcctggcttccttttccctgagttggtcatcaagtacccaaatggaatccatattctataaattcttcctctccgatctctggaggcagtagagtagtgcttaagggtacatgctctggggtcacactgccagggttcacagcccaactcttgtttgccagctatgcacccttgtgcagtttacttacctttctgtgccagtttttcatctctataatgagaatgacaatagtacttaactcatagatctgttgtgaggattaaatgagattgtaatgag

SEQ ID NO: 8776 - DNA, 1611 bp, artificial
  synthetic oligonucleotide
tttttttttttttggctgcctctagatttattaatttcagagaaactgaagagggtccagggaagaaccatcaaaatgattaataaaaggaagaagctactgagtgatgctaggagcttccagtgaaggacaagaaaaggggatggggaggaggaggccctgaaggctgaaagcaaagcacccaccagagactgcagagctgcggggatctgtgggaggaggggcagttagccagggcccaggtaccttcattgagcaccccaccatgggcccagcactgggccaggcattctgggagatcaaaagaggcctaaggcttggcctgtgcccacaaaggtagagagacagggctatacccacaaaaggacaaagtacaatccaagccaagaaagtaagcgctgtgacaaggaactcactcgctgctatgtgccaaatgaccggtgcagtgagaagtgttcagtattcctaggaggaagggatcttctcaggtggtggggctggagcctaaggggagggacacaatgtggctaggcagagagggtggaaagcaacataggtctgggaaacggtaagaccaaaatacaggaggtagggtatgggcaaggaagaaggaggagccatacctggctggggtgagcagttctctgaagggagtagtgagagatggacactagcagaagaatgtggattttctgctgcaggtattgggcagtcactgaggctcctgagcaggagaatgtcatggtaccagttgtgctttggcaagatcaatctgtctaggcatggtggactggaagtggaggtggggagaccaggcctaagactacagtcactaagaaaacacctgcagctgtagccattgaaaatgtgcccaagtgctgacaggggccaggtctcagatgacaaagctggctggggcccaatgatctctccaaaaggtgcagtctggactccatactctgagaccacagcctcagttccctcaagcccacccagcccgaggagctggtcatcattcgcagcacatctcagcaaacttaggcccataccaaggacagatttctgggcagatgatatctttgttataaatagagaatttgactccaggtgggaaattcaatttgtggaagcagttgaaatcttctgaaatcaagatctgatttcctgagcaaaggtccttgggtcttaatgaacaagagaaagagataaggaaaagaagacactataattaggcattccccctaaatgggaggcttcttggataaccagggacctgcctgcagtgccttaacgaatgcttcccatttctgaaccatggcttttgaggcaaagaatgacattaaatatcgatgcagcacttaggaatggttgcaaagtgcttttctgctcttgttattcattagccatccctatctcccacccgctctcctctccctctctttccctctcaccaaccctgccatgagcctggcaaagtttatgcaggttgaaaagatgagaacttgcagacagaaaggttaatcaattgattccaggtcaaacacaggaagttactgacagtccagtggtgagaatattcttgtcaggcctttctggaatttattgctttag

SEQ ID NO: 8777 - DNA, 6917 bp, artificial
  synthetic oligonucleotide
atctaggaatcaaagggcttattgaagggaggtgcatctctgcatgctggaaggaaatcttgtcaacccaatacttaagtaagtgaaatgggcagaagcaaggaaggctaggaatcaaaacagccagcttccctgggctgttttaaagagacctgggctttattaatgtaagtagtggctgcatgaccccagtccccagagaggagccaggaattgagtgacctcattcttgtcactggggcaccatggtagtatgaaccccagttttgacccaaggatccccctcccatgactgggcacttttccagcaagtttgagggtctgggaagggatgaattttgacagggaagcagggagctagctgagacacacaaacctggcaggcagtgagccctgctcagcagctgcatttgaggggagagggtgcctgccagccagcttcgcgaaggggttggctggcactttgcagctcatcagcccagggttgttccatgcctggcccttcagtgtcttccagcccaaaccaggtaggcaggctcagctagcacacaaagggccacttaaaagccctcttagcataatttcccagccttttgtccttccttctcctagtgacaaatcttttgaaatggtccttttcttccacattttccacagggattctctgtcacccagcgttcctgctagctcccagtttccccagtagctcagtagctcaggaggcttctctcccttttccttcacccaccatataccaaacaccagagccctggttggccctagatgctttggggtgactgggtgtcttgctgaaaggcaagatggaaattaaagggttggaggttgcaaaattataaagtgggttccctccttgacctttctgatgatatcatcccctttctatcatcccagggccagcttagcaacctgcagagtccccttgctgccttaggcagatgcagttcatactccagccattgatgacaccctgcccttcaggcatttatctttcctgggtgctaatgagtgggcgggctgccccagcagaggcaggcagtttagtaatgtgtctgggagaaaggctagtaacctgtctctctgtgtaatctcagctgaagtcttggagtcatggcctttttggaaatactatcactctgcagtcaaacaagcatgggttcaaatcctagattaggttctactagttgtgtgaccttatggaaattacttagcagcctctgtgagcctaccctcttgggtttattgtgagaattaaatttgataacgcatgtaaaatgccatcacagtgcctggcccataaagtgataaataaaagcaataataattattattatgaattatcatgtggttggaatccaggttccactacttactgctacatgagtcttggcttcctcttctgtaaaataagaataatgatgttacctggtaagagggctgtggtgatcctgaaatgagttaatacatgtaatgctctcagggctggctggaggtcctaccagcagagttgaactaattgtacccctgagatgaagaactgctgtccttttcctaggagtggtagcagcatgcctagctcacagttaagtgttggatcaataaatggtagtcagtattactattattactagaggccaggatactctctgtctattcatccgtggattctcagttaatggcgagttggttgcctggttattaagtgctgatttcagagcaaagtgctagtgaagccaggctgcctccattcactctcagtatgtagggaagaaaaacagtcacttattatgttcatctcaatgtattggtttcaatgggaaatagacttctggctggaacgtcttcatttgtcatcaaattgtcctcagatttgaagagactgaactcttgccccaggggccctcaccaaatttcagtgcaactggatccagggtctcccttttgcatgaaagtgtttattttgctgcattttggtacagggttaagaacactgaagaatcttcaccatgctctctctgtaccccatctccatcatttctattggacatgggaagtacacacaacttgtcaaacaacaaaaataagaacaagaaaatcccagctacatgattttctggggtgagagttctctctccttggaagtgaaacaagctagtgttcatcaagtcctgagaactcactttaatcgagagcaagaaacaatgcaaatgctgcatcacttcagactggaattaggcagaatatgaacagaaaaaggaacctttaaatagatgactaggaggcaaattcgttttgagaaagaacgacagctaacatttactgagaccttttatatctgttatctcattcaacacttccaataactccataaggtagattctgccatcgtcttcatttcacaggtaaggcttaaagaagttaagtgagctacctgagatcacatcactagtaagaagcagattctgaaagccatgcacctaatcgctatcctaaaccagacagtgcctcactggtcacccaggagccctcagatgtgcatttgtccagtgacacagttcctctcaatactctttcctgcttcaccaccccttctttattttgtttaccacaaagcagcttgaatggagcctgagcatgtgctttgagtgagcccagaaagcagcagaggagggccaatcagattcgtgagaggcatttattttagttcttaacccatgagctttattgtaataactgatacaaaccaatttgttgggacctgtgttattaatattaataaagactgaactaggtgaggctcaggagaccctggaggggatcccacctcctgagacaccaccccaagaaaatctgccagggacagtctggctggaaatattattattcatactggacagctggttcctggctccctctccagtccctggagatgggaggccaattcttccctgtttctcttcatctctttccttcagaaggattagaaataaagtctgagtcacttttctggctagccttttttttttttttttgcactagctcagtgtgtctgtggccccacatgtgactgactccatgtgtgtccctttgtgtgtgctgtgttcctcagagcatcttctcaggttgggctctgcctgtgcatttgcagggaatgttgtgtgtttctctccctgcatgtcttcactttcacttgtcatccgcttttaataattccatcagcttggtttaccagcttaggctactcccatccagatgcagggaatttccatccttttttcaaggtgggaagtgccaggaagaaagcaaaagtgtgctcagtggaccgatggccaaatctgctagtcagctactccactgctgagcccagctgtgggaagccacggagccctgtgcccggagctctcctctgtatcctggaaattccgtgcagcctaggagaacagcccttgtcccacaattgcccctcagtagccctccggcctcttctgaagctttaaccaagtgcttgaaaagaaccgaaagtgaggaaatattccaactagaatggatccctttgtgccaacagcctcctttagagttcaggaacacagaggaaatcgaggagggctgacttttcaccttagaactcacaaggcccaaatgtgccaatgtttaactgtctctccgaggtgcttctgacacccggaaattcaccatgtatttggcatcaccaggagctcctcaactccactgcttcctcctgcttctctcttccctggccttaacttcaccacccagacccactgtccagcttcccagtctctctgggtccccactgaggctgccctttttggggaaggaagagtggccttttttcttggccctcaaaactcctctgaaggggtctggagcccgctgggagaccaagagcttctcttgaatctcggctgctgcatgtttagtattcacagcatgtctctaaaaaacgtcctgagatcattcatcaggcactgtgctgtgtgcctagctgctctccttccgggtgtgtgtgtgtggccaggaccctccctccatctgctggtgaacacacatgcacacacaccttaacctttttcccttttcaccaaaccaatcgcattttctaagcagacctttgccagctggcagatcgctcccttactgaggtgggctcctggcgttgggcctgggctcgaagccgctcacactccagtgctggggagaggcgctgagagcaggagcccgagccgaaactcaaggtgcgtgtggatgtttgcgatggtgaccaggaggggagctgcagggagggcatccccagcagaaggcgagcaaacaaggggcgagaagcaaggtcaggggccagggaacggagtctccgaagcaagcgttcctgctgccccttctccgcagttcactccccgcccccctttcccgggttcactttggaaattggcttgccctctcggcagccagcagttcccggcagagtccggccgtaacggtcagattcaagaagtgaggcagcgccaggctgggtggctgggttgctgggttgttcttgggagattctttccccaattgtcaattttttgcttatttttagtagtgacccgagccaggaactgcgcctttaagccgctttcccattcggggaaatcgacgccagcactcgagggtcgggaggcgccggagaggcccctcattctgcactcccctctttcctccccctccccctccccccgccccttctcccctcccctcctcggccgtccggccgcctcgccgccatccgtcacctcgcagcctgccgcactcctggagcgagagagcgacgagcgagccacggcgatggtgccgcccgcggcgcagccatgaagcccgcccgaggagcccgcgcgcgctcctgccatcctgcccgcagcccgccgcctgcgcgccagctccccgcgtcccgggccagctgctgccgccctgccaacctctgcccgccccgccgcccggcgccactgagccccaagcccatgccgggctcgggggcacgggtgccctagtcccgctgccgccgccgccgccgccgccgctgcgccgccgctgccgcgccgctgaggaggcggaggaggaggaggaggaggaggaagaggaggaggaagaggagggggaggaaggtaagaggcgcgctgccttcaggggggcgcgcccgctgtctcagcccaaccgggggtgggtcgcggcgggagcgttccgccccgggccggctggggggcgactggcgcttgggcgcccccgggagccgggggcagggcggggggcgccgaacgtctggccgcccggagtttgggcgggcggggtaacggcccgttgcgtgcccactgccccggcgagtctctggcttggcgggctcgtttggcctccgcgggtgcggggtgaggagtcgagcgcaggggagtgcagcgcgttcattatggagcctttgtgtgcgcgcctgggctgtgggcacagttgggagagctggcgagacgcggggcctggctgctaggaggtggccacttagccggggtgcccggcgaagcccgagcccaggggctgccagaaacagctgtctgaagcatgtgcgtggttcccggggccatgttcacaagcggacacggaggcgcacacacacgcacacacagccgcacaacatacccggcgctcagccacacagtcagccccatgcaaagaccacacacacacacacacacacacacacacacacacacacagagagagagagagagagcgcgagctacacttgccccctcccaccaagatgctaataaagctcaaacacatatacagatacatgcacctccccctagcgctgctaaaacatgcacacacaaacacactcctctactccccagcctagtgctttggaggttggagagtgtgtgtgtgtatgtgagtgtgtgtgtgttttctcagagtggtcttgagaaactacatgacaactgcacattactgcagatccagtacctgctgcttccccccaatacacacccagcaaccccccgtcacacgcagctactgtagacacctccaccagagcccttaagaaccccattctggcaaaaagcgtgcccaactctggtagtcataccctccacgctcgagctgttgggtttcctgcacacacacaccacagccccatacacacacactgaaaccactgcaggggcaaatgtttgacaccttcccccagaagcaggtggcacctccacccttgcagctgcaactaaagagccccagatgacagcaaacgccgaattctgctagacctgcccctccccttggcatcttggtccaggtgcaaaaccctggagtccaccgggtggtcttagcatcctgcagctcttacggagggcggggcagtctctggactcctgccttcggaggaactgctataagcgcaaggctcccttgggggcgcccttctcgaagtggagggtgggggattctatgctgactcagagcgaagcaccaagtgagttttcccagctggagaccggggtaaatggcgaactccacctgggcctagaggacccgggatagtgtgccagttcagccacagaggccctcagcttggaggccctgcccctccctcgccttccttgcccatgaagctcactgcaggagaagcagggggaacccagctgccagcttcttgggagctaagagaggcttttcgggaagcctttgctgtttccgctgagcaaagagatcttgctctacccggggagacctcaacaagacttggccgtgcccaagcaaacatgccagcgtctacccaatttcatggcttgtttttttgtttgtttgtttttgtatttcatgtgaaaggactaattcaaccttagcagctt

SEQ ID NO: 8778 - DNA, 1728 bp, artificial
  synthetic oligonucleotide
catgtctttccttgatattggctgaagtctctatcccacacccactcttccacccaatatggaggctgtgtggaccctcagtggaccatggcaacagtgttcttgccaaagtcaaaaattgcctaaaagccctgggatattcactggactctgacaaagccccaagattatttcgacacctcagtaggaacttgcttaactcgttgaattggattaggtgagaactactctcagctccatcccatcataccctccttcataaaggcttttctctctcttccttcccctagctcatctttcttcttgctttttcttctgctcccccctccctgctctttctcttccagcgtacatttattctctcaagttaatcaaacactggcccctacagcccattgtgcctcagattgatcacttaagtagcgttattgattgcccagaaaaccttaggaggtgggagtgttctgaaagctaggatctgacagctgattggctgcctatgtctcactcggcagcctcagctcctctgccgtctggaacatcttttgagaaaggtgagggaatgaacagcggagatccttagcgggcttcacttatctcatccttccttcatactggagttaaggcatgggaagagaagtctattgaccactccaggatctagccctgtactaatgttatggtgagaaggggaaagcaaaggccctgctctctggaaatccgtaatttaacagaaaaataatactcattcatatgaagtaactaagaataatacaagatggaaaacaattatgtgccacatttttttgctctaaacagtaagcactgtaggggttcaaagcacagagagaatgagagtgtgggctggaatgaggggagaagtcttcccagaagaagttgaacctgcgttatgttttgagtaacatgtgagattgagattgttgactagaaaaggaacaggcttctgagggggaggcacagcatagggaaaaggctggagatggaaatggtcagggtgttatcaagaaagggtcagaaagaagtctgactagaggagagggtgtatatgcaggcacagtggggaaaaaatgattggctgggtatgggactcccagatttgaagagtctctgatgtcagaagaagtttggacttgggtaaaccttgggggctgtcggacaattatgcatagtgattcaggatggttagctatgcagttggaagcagaattgattggaatagggagagacttgagaccagcctataagatactacagcaatctaagtgagaggtgataagggtggtggcagtgggcatagagaggagggtcaaatccaaaaggctctcaaggcatcggtgtggctgataaaccaccaagtagattttcttgacttgtttttgtctcactcgctccttcctcttagcctcaatacttacactttctttgcctcatgccctcaggaccttaaggtggcagagtttctggagctaagataacattgggcattataatcagttatcctttccaagtaaagtagatgcgcacaggggccttcagtaccatgacctgaaagagtgagcaatgaggaatctggctgcagaatgcagttgagatgatagccaagctggggtgctgagtattacatcccccaacagggaggccggaggcaggcgatgcctgtgtctggtctgtttcaagtcccccaaggcttctgagagctggtaagag

SEQ ID NO: 8779 - DNA, 1676 bp, artificial
  synthetic oligonucleotide
aaaggcaaggaaaatcacatggcctcttctgcagtgcatggagcaagtctgtattttccctggaccctcagagcaggaatgggcccttttatagtcaccactgggccttggggcaaggggtaccatagattcctctggaagcaaagaaaactcccacctttagccaagagactctaagaggagttgacatcagaaaggccaagaaaggactgactctaacacctcccctcactgaccacattcacagtccatagcattctgggaaccagaaagacatgaggctggagtccagctgatatctgttgaaattgagacaggttggaggtgtgtgtgtgtgtgtgtgtgtgtgtgtgtgtgtgagagagagagagagagaaagagagagaaagtatacatgtctgaaggtaaatctgcaaggttgaatttttcctgactggagaggcctgagagacacccagaattttgcaggggtacatcaggatcacaagaagtcacttgtcagtgaggagaagtaatacattctttatagcgtgatagcccttttgtcatcaatgaaacagataagctgtaggaagatggagcagaattgtttttttccatttagtgtgcaaaagtgtaaatgtgagtgtgagtgtgtgtgtgtgacagagagagagtgcaagcacatgtgtggtggcctccgaggactgactccaacacctccccccactgaccacgttcacagtccataggcacaggctcaccaagagacctaagcataggactatagataagtagtcccttgctacttataggggacttcctttcccctcacaccttatgactacatcactaaaggtctatttatcatagttccttttacatggaacatcgtgtctggccgatttcccctagtttgaatgattctaataccaatgactcaagatcctcactaggcagtttattctgctccctaactgcattaaggttaggaaatgggtttttccccctctctcactagattatttctgtttttagatgtgaagagtctaggcctctctctctctctccatttttcctcacccacaccaaggtcactgaggcctgcagtattattccacattcctactcagacagagactcccacagtttgctttgcagcctcaaaatgtcctagccaccctgcagtttaggtaccgaatgccagctcctgttctaagaccaagatttccttagatttcctttccttcaacatatattgatggccttcagctttttcctgtctggtaggcccttctatctttccttttgacttctttgtggcttctccactacaaagactcttcccattacccagaaactgcagaaaacctgccaatcttcccactcccgcattgggtttctgcagatcacctctttggaaagttcaagactagaactttgtgcagtcaaaaagcccacccctactctacttctccccatcctaggcagtctattaaggcagggtggtgtggttaaatgaatgaaaacattgaggcatgggcaagaacaattttactccccgaagtatggtctcaggatttactagatgccatggaaaactgaagacaataacataggccttgcccttatgaaacttgttctctagctagggaaaagcacacaaacgaacttgcaggtgaaatatttttttcatt

SEQ ID NO: 8780 - DNA, 1038 bp, artificial
  synthetic oligonucleotide
tccaggacacagggctgagggtcaccagggcagctgcactaactacggagccagtcccctcccgatcctccacccctgctgcctactttgccttcattctgtgaaacaaccagggtccatctgactcagaggcaggaagtcgggcaccaattcaaaaaagcccttaaaaaaaaccaaaacaatgacaacaacaacgaaaggatccccaccaaaaaaaagcccttgacaaatcttcatagagaaatggcctgggaatggagaggggcattgaactagaatggaatcctggactagagtgatatttaaaatcttgtattgcctatatggcaggtgcactgacgaagcagtgttctggaaggcccctatggggccaggcattaacccctaagctgccggatctgaagcagtgttgggggtgtgccaggacaattagggacactcagaggggtttgaagcagcagttgtttacccatcactaagtaaggaatgtaagatttgaacaagtgggatggtggtataggtgctcatggagggaatgtcagccctcatcctagggcagatataattagtcatggggggaatgggggggtttcacaggcacatagctaccactgggaggctgaggggtacaagaaagagtggaggcaatgaacgaattctccctttgctctcatagcaaagggtgggtcagacactggctgcactgttgaatagcagcaccaagcccatgtccatagtgccagccctgcctctctgtttaacccccatgcctacacagtgccatggccagagtcctggaatcagggcccactcttggaggaacatcactccctttccatgccacacagcttagaatgtgagcttattaaaacaacaaggaaccctggaaattagctaagtcagtgatctcttgatatatgggggaaactgaggcctaggaagggaaggtgtggggtcatacctctaattagtgtaagagctgggatgagcagcaagatgtccctgttcccagcctggtgtattttctatcgccttctt

SEQ ID NO: 8781 - DNA, 3063 bp, artificial
  synthetic oligonucleotide
gtactgtaatttagattgtacgtatacttggggtggcttatagggggtgagaagagcaagctaaagaccttcccaaagtctccactagttctgttgtatatctcagccatctgggcagaatacagaacccccagcttccaacaaaataaagcatccagccccatggccaacctctgctgtctgacatgagccctgtgctttctgaaatgggtgtctttggaggcctcaagtggtttctacccagacacctgcagtccttgagttgggtgggctcaagtgggaagaggagattgccattgccaataatcagaaaaccagagccaagtctgccctgctggttccattcacgtccccaaaacaatctccgaggtttaaggccaagtcatcactaactcgtgtgtcatgggcactgctgagggagaacggtatttcacagagcagagactcccacccaggtgcaggctgagtgattcaaggaagatggaatttagtgcaatcaatttgggacagtcagccaggatttcttttaagctttactttccagcagccccctcccaccttggagacagactaatccctgacatttgtctagtggctttatacttttcaaagctccttcacatctattatctccatcgaaccacacaaatactcccatgaagtaggataagaaggtgttattatccctgtttgaccaacaagaaaactgaagtccccaaaggatacatgactcatccagggtcacacagttatgtagtcaaagaactagtgattcaaatgtgtttcctaacttccagccctgtaatttttccacctccatgcagactcccctccatggaaccacaaaggtgccctgcttctagcacagtgcctagcgtaaagtagatgctagtaaatatttgctaaatgaccaggaggcagaggttgcagtgagctgagatcgtgccactacactctagcctggacaatagagacagaccttgtctcaaaataaataaatacctaaataaatatttgctaaatgaatgactgcatgaataagctggggcaaagctgaaagaaatacgagttctaaaagtgctctttttaaaattatcaaactaagaaggggcaggaaatgttgtgttatttcatcattttgaccagaaggaaggcataagatatctttctcatttcacaaatgccattgccaaggcatgaagattggggtagctcccatacagaggccatggagcttaatgtcccaacaaagctgccttccactcatcctttaaaaaggaatgggtggtgtgagtccttactccagtagcaggaaggagtcagaatcagccccatgggacgaggattctctccacgttgtctctgcaagccctgtctctccccatgtcccctaacagtggctccagaagttctgccatggaaggggtgtctgagaacactggttgcctgctcctttaggactgctgcaccgtcaccccctagacacttctagcataacccagacctcgaagactcagtgactgtctcctggaatgccacctggactgagacttcttccttttcttttttctgtctcccatagcgtctggcacatagtaggtccataataaatatgggattaatgaattgtctgaggtaaagagggatggccactccctggctctaggcactgcagtcaggatcctgcctgccagggccccatctccacaggcaaactgacttagagttgccgtttgttcccaatccagtcagaaaaaaatggggaaagtggaggtagggacacaggtattcaaatgctgctttgcaatagcacaaggtagcttttgagacaggtagcccggaatttgagatcctttggggtttaaatcagtcccaccacatattattagtgcttgtactgggggctctttgctttgctcctctgagcctcaattttattttccgtacaatggagaggatgctggaatgagaaaataatggatgtaaagcacagtgcctggcacttagtaagtaagcaagtggcagctggattgtctgcatatctatgtcctcccagcctatcccttcccaggtcccccgagtgggctggtccccggtggcgaggggaggggtcctcctgggggcgccgactgtcccgggcggcggccggattgcgggtgggtgagaggcagcagacgccgtgtttacagctctctcgctagttcgccacctcagccgcggctctagggctgagccagtcgcctccttctttaagattctggtcacagcaggggctgggtttctaaggcaggtttctaaggtgtcttcctacagacaccgctgctgctaccttgctaccttcagcgctgggcacagccaggggcagcgcgagagggaggcaacgagagggttcccgggccgggcagcagcccagccccggcccggaggggggcccgacggtaagtactgcgctctgagcagccgggttggggggcacctgaccattgaggcaggggtctgtggggttagggggtcggcagtcgagcgctagggtccttaccggcccctcaaagtgacttgagggcggcgctggcatgggcccccctccacctggtctttggagtgagttggcgcgtcggaagcagacatccatctccgtccctcaccccgagatcccaaggattcgtttgggttgcctggcagccctccggtcctttcgaggccacgaaagaggaaattggaaggcaagatacgcggggatgaagttttggacgctgttggaaaagtggcggcgcgagcgggaagttttccgctgcggggtgcgggggatcggggagataaggggcgaggggaatcagaagctgggagggaaaccacccgagtggagcaggggcggaggcggcccctctgagtgctaggaccccactctccccgccgttacgcttcggaagtgtccgggacttctagctgcctctcccacccctgcccctcagcgcctctgcttccatggggccgggataccctagctggcctgccctccggtagggcgggttggagcctcagcgttcgcgaagctccgcgggg

SEQ ID NO: 8782 - DNA, 1797 bp, artificial
  synthetic oligonucleotide
gggaagttctctgtgaggaggtgatatttaagtggagacctaaaggataaattcagccatatgaagaatgggaaaagaggtttccaggaaaaaggaagaccaagtggaaatgccttaaggtggcaaagaccttggtgtgttgagaaactaaaaggaggccaggagggccagattgtaggcaagaggaagagtagcatggaggggtgggggagttggcaggtagggcagaaagagatcacgcagggccttatgggccacacaaaaggagtttggatattattcgcttgcagtaggaaatgtctgaagggttttaagcgggggagtgacaggatctgatatggactttttgcaatatctgtagagaccagacttggaaagggacagcagtggatacagggagaccagtaaggaggctgctgcagcaactcacaggagagatgatggtggcttgaactgggtgacagccatggagagggagcgagcttgtcggatcccggatgagctttcttttttccttttccttttccttttttttttttttttgacagaatcttgctctgtcacccaggctggagtgcagtggtgcgatctcggctcactgcaacctctgcctcctgagttcaagtgattctcctgcctcagcctcccgagtagctgggattacaggtgcgtgccaccacgctcagctaatttttgtatttttagtagagacagggtttcaccatgttggccagtctggtctcgaacttctgacctcaggtgatctgcccacctcagcctcccaaagtgctgggattacaggtgtgagccactgtgcccggtcttggatgggtttttaggtgacagctgacaatacttatacaatactgagggactaggtggggaggtaagggaaagggagagacaggcctcaagaatgactctcaggtttctggcttaagtaattaaagagatgatggtgccatatgctgagatgaggaaggctgagggaagcctaggcttgagagggaaaataaatcaagagttcagttttggacatgataagtttgagattcctgtgaggcataaaattaaacatgtcagagtatatgagttttggagctcacagaggaggtgtggttagaatgcaaatttgggagttgtctgaatatagattgtatttaaaaccaggggactggatgagatcaccttaggaaaaagaatagagagagactagaaggcctggaactgagttccaaggaaccccaatatctagtgattaagtcgggaaggagaaacccacgaaggagactaagaaaaagtggccagagaggttggaggacagtctggaggtagtcctagaagccaggagaggagaatgtttcggcaaggatgaagtggctaactgtctacagctattgagaagttgagtaggtaaggaccgagagatgaccatggaggccaatgcggaccttaacaagagcaactctgcagagtgatagatgtggaagccaggggatagtggattggggagcaaataagagatgaagaagtcttgtgtccttaatgcaatgtccttaaaagaaaaaaaagagatgaagtggagacatatgtgtagaaaacgtttttgaggaattttgttgcccaagggaccaggaaaatggggcagacactgcaagggaattgtggagtagagggaggtgtattttgtttgttttcttaaggatggattatttccatcagcatgctagcatgattctggagcggtggagagattggtaatttaggaaagagaatgaatgcccaaaggagtaaaat

SEQ ID NO: 8783 - DNA, 1952 bp, artificial
  synthetic oligonucleotide
gcaaaaaaaaaatgtacctattctatttaattcaacaagtatctatagattgcctactctaagcccagcaatgttgtcgggaagtacaagacacagttcctgttctcaagaacctaaccatcaggctgtggagacatgtatatactcatgaaacaggtcagccattgaagaccagaatcaagatacagaccacaggtgggataggagaggagaggataatggaatctctgaatgcttgagtggcagtaacaaacatctaccattgattaagcatctacaatgtgctttacatcatattgtttaattctcacagccacccctgcaaagtaaataagtaatatcattcccattttgcaaacgaggaaactgaggcataatgaaagagaagtggcttgtccagtgtcactcagctataaagcaacagagccagggtttgcacctgggcctgtttgatgccatgcaggggaagtagggcctgaaagggaccatgtgggatggaacaagcaaagccccacctaagctatgaagccctgctatcatgaatgaaatggaaaaagactgaagtactgttttgtttcgaatctgctaggcattgacaaaaaagacagacggaatggagctttattcctgacttgctgggcctgaggctttagatgtttacaacagtttctcgctcagtcaagaggagcagccagagtacaaactggtcttgcagaaatttgatgaattttgcaatcctccaagggaaagaaaaagatttttgtaagctctctcttcaactagagggcacagaggaaaaaaaacacacacacacacaacaacaacaatttagtacaggagtccgtggctgacctaaggctctggagtcagccatgcagtttggcaaaaaggttttgaatctctgatcagaaatcagaggaaagggggaccagctaacattcagtaatagaccaccaggagcccctactttaacttcaaatgagacagaatctgcacagctgaaggaagcccccaggcctagaggggttcagctgccaaaggtataacaatgaagaaggagttggaggggtcaagagaagaaaatccccaggcacgaaccacaaaaagccatggggctggcatgcatagccctataaaagccctataaaaagctgatccgtagtgctgcttctggcccaggtggctcctgaatgcacaggacttgtttggttctttatttgaggccgtaataaagacaaaaaaagtgtcctacagaggagcaattatggttgatcaagccaacaaaccatttgtgaaagcagtagtagactgatgttaccggtaccatcaaagggccaaggcccataaaggaggttgagttccatgaggacctcttctgttagacggaagaaagggaggggagggaagggaagaagaagatagatagagtggcctccacctaagagactgacatttttggcagaagtagatagaaggaatgaaatgagttgaaggaattgtcccttggatggtataataactaccatttatccaattcttagcaatgtcaatcagctgttttaagtgctgtatatttatcatctcattcatcctcccaacatttctatgatgcatatgtactgttattttcccattttatagatgaggtaagagagactcagagagattaaatgtcttgcccaaggtcacacaaccagtgaattgcagatttggagttagagtccaagtctgtctggctgtaaagagtgttctgttagccaccacactttgctcctgaagccagtgcactgtcaggagacttggcctagtgtgtttagggcaattgctcctcgagcaatgaatcctgctgcctgtgctggcacagccatcctcagcacataggctctacactccagagccattgagctgtgctcaagtgatgtatttgttgtgtatgttcatgtttttggaat

SEQ ID NO: 8784 - DNA, 1535 bp, artificial
  synthetic oligonucleotide
cttcttaaatgactttgttcacataaacatttgaaaagggccaataaggagaggggaagctccttcagggcaaactatttccatttcttttagttcttttaaaagattatgtattcctgggagagaattttcatacttcacagcctgtttgatcactggcataattcttgccagaagagtttcatattcttcattcttttgaatatttgctatctggagagttttggcttccatctgttgctccctggctctcttttttggtccctcaattaaaacaaatctgatgagtatgagtcatggtgaccaaatgacctcctttgggtttttcctttgaatttctcttctcacttaaataccaaattaccaataatcattgtacgtggttcccaggactctctgattttgagttccataatgcaggcttttagttttccttgagaattttgtagtctacagataaaattgctactaaggtttggagatttctacagagagtatgtgagaaggaatatgaaaagaagacctaaaaaatgacaaccccagaggtaatgattataccatcttcggatacctgtgtgaattaatatggatggtttgtgtcagcctccacaaatgatgggaggtgaagtgtccatgcagacactcagattgccctctatcctaatccatatacctgaataaagccaggggaagattctggtgttgcttcttgtactagatgaatacctagtgcatgatacactactctcctattccctcttttctctgtaggagcgctaaggaattcatcgttcttacagttctgcacactcatcaggtgagtgagcctctttgccatctgcccttcctcctgactgagaagagatgacatttccatattggaaagcaacagtgatggggttgggggttcagagactacaaccaacatatgagccaaggatttaggagtgaacttaaagaataccttctgaacagcatgtctctgctcatgtccaaagctgaggactttgaagggctgtgctgtgctgtgttctgtcctgtgccttcttctttacccacttaagctgcccactgcctcaattccaaatacagtttccacttctttttggctgtactccattaaaatgtatctgtccaatgtgaactctcataaagtcctggacgatgataggtgccaatcttattcattcatataagttacctacaatgtatgagacacagcaccatatgtgagagaatttaatataaatttgctggggggtacccttggacaaacagattcatttttgtcctggtacagtcacttaactggctgtgtgaccttgaatgagtcagttccccattctggacctgtttcatcatctgtacattgagagatttaaagtataacagtgttacctaaacatgcctgatcataatcgttgccaggactacttattaaaagtaaaaatttctagccccctctcctcaagagttggatttagaaagttcagtgtccattattagttgtacccttatagcaatcttaacttaaa

SEQ ID NO: 8785 - DNA, 1447 bp, artificial
  synthetic oligonucleotide
tcctgtttgaataccagtgaccactgtgggtggggggcaggcctgcctgccagctggcggaagctcttagaggagttgcaactttcctttcttaaacgatttcccagggggagatattggtagcagattaagaggtggagtgtttgctgtttctaaaagagaaaattatttgctttatttttgtctttgtgaaacccagaaagctttaatgtgttgatttttccacctgtgattcacaggattcccattggtttaggaactggcttggagccgatgtttaattggcttgcggctacctcctcaaccaatggttgctgcactcctcagatgttgttgggtaaaaagccaaatggacgggcagagaagggggcagggaagacaaggcatgcaggggagatgtggcttcctgagaaataaaaggggtttaaaatagagacacagctttccaactgagtcttctatgttctgagtgattctcaacattgactacacaatagaatgtccttaagtgctttaagaaaaaaacagatgcctgggtcctactctcagagattatgatttctttggtcatgggtgaaacccaggcatcaggatttatttatttttttcagtttcctaggtgactgtgtaatgcaaccactttgagaatgcacaggcttgagacctgtattaccagagctctgggaggaaacaggctgaacaggggatcagtgggtgttgtctgagtgaggagcactatgcttatttctaggggtgatccagccacagttgtgggaatgaatgctgccctggagaggctacattgtcattggggagactagattcacaaagacacatgacctgcctttaaagcacaatatcagaacatgtatagagctctggaatcagacaaggctcaaatcccagccttcctgtgtgaccttcagaaagtgtcttaacctctctgaatcccgattccctcaactgcaaaatggaatgcctatctcaaaaggtttttatcaggattattattattatttttaattttagagatgggggtcttgctatgttgcccaggcttgtcttgaactcctgggctcaagcagtcctcccaagtcggcctcccaaagtgctgggattacaggcatgagccactgcacccggcctgttgtgagtattaaatgaaaaaatgtacataaaatgtcttagcatactgcctggcacacagtaagtactcaatgaatgagacctgttattttttcaaaagcaaaacatcagtaaagaaaaagtaatatgaagtaaatgttacagacaagtgtgatgtggaatatggaacaaaagaacaggaaggagttaatcagatctggcttcccacaagagggtgttttaagctggatcttgaagtgataggcatgaattagcagagagaagtgggatgtgttcaaaggcaaggagcaagcacagaaat

SEQ ID NO: 8786 - DNA, 1346 bp, artificial
  synthetic oligonucleotide
cctttcccagtgctgtggaggcaagaaccaaatatactgatcccttgggtctctagaccatcatcttttacccttcccctccaggccccttgattccatccttttcctgttttcagggatgctagagtgagcgaaggctaccccagggaaaatccttttcctagttggcatttcagagtgctaagtgcctgttagctcccagggcaccctgggaaggagatgtagctgaagcatgtcaaattaatccctgctgtaccttcttctggctggctcatgcctccaactccattctcctttcctcatgctacatttgaagatggcctgggcatattaattagttttcactcagcttacttgctcttagtggagcaaacatgaggtagtattcaaatatctttcttcaagagatggcagcctgggactgaggcatacctgggccattaccataccccattaccacagaagcacataaggtggaaaaagaaatcatcaaaggaatgtcccaagggatatcttgtggcccagtatgtgtcctattctcatgtttgagctttatttctctagtgatctctgtagggacaagcgttacattacacgtcatgatcattaaaatcctatctaaaataaaaaattgtttttgaaggtttctaaggaacctgtccaacctttttgtttgcctgcttttgatttcatttttacctgttggcaaaaatttcatttttctcttggcaaaaatttcatttttctcttggcaaaaagtgcatttgtgttccttttactgcgagctgcatttggcccatgctggggccaagttggctgtctggggatgacaaggagaggctcctgatgagctgtgctgtgctgagccagctggggttgtgcttggccctctctgtgcacgggattttgctttcgtgctgttttattactggcactgggctatcttgggggtaagaggggaaactgaagtggtcagacaatgaagtcaatcagccattctcccagcctccagtcagtaattctgtccattagccagccaaccagccagccaggcagctcagcggtcagaatgtgaggctgttaggcattctgtctgtcctgagctggcttgtcaaccagggcatgagtgagtcagactgccctgcagccggccagctcattagtcagccagccattcagcctctactttggtcaaatggtctcacattatatttgtcagccaatgctattttctcaaagctgtctccagtgtctgaaaccaaattagtcacacacgcacacattcacacttacccacccacgtaccactccaggacattctacgtttgggtagctctctatacgtt

SEQ ID NO: 8787 - DNA, 826 bp, artificial
  synthetic oligonucleotide
gaagatggtcagattacagaaccggaacacatctcacagaaacagaagccaagagaagaatttccaaagaaggtgattgctgttagcaaatgtaataacttgagatgtgtgatgaatgaatacagttgtttctagctgtaaagaagtttcacttcagcgagcgctgtggctcatgcctgtaaatcccagcactttgggaggccaaggaggatcacttgtgcccaggagttcaagaccaacctgggcaacatagtgagaccctgtctctattgaaaaaaaaaaaaggcaaaaaagaagtttcacttctagatcaggtggctaactatggcccatgagccaaatctgactcactgcctgtttctgtaaataaagttctgttagaacacagtcatgcctatttgtttagtttacagattatctgtggctatttccacactatgtacaatggcagagttgttgtgacagagcccgtatggcccacagtgcctaaaatatttactcactagccctttatagaaaatgtgtgttgacccctggcctatatgaactacaaaatattcaactcaggctctgtgttggaatcctgggaaaaagaaaaccactgcaactttagctaacagctgagctggtttggaatcagaattgagcccaaggtaatggtgattcagccaaggaaggctaatctagttagtgatcaagttctgtcaggtcttcataatgtcccttccttttcactggaccagccaccaccctagtggaggccctaaccacctctctcctagactgttgcagtagcctcctcattggtcagagaagggcctcattt

SEQ ID NO: 8788 - DNA, 6951 bp, artificial
  synthetic oligonucleotide
tgctgttccctgttataaacacatgtatgtccatcttgtagacaaacacatgtcagacacatacccatagtcacacatatgtccctccatatacatacaccttaaaaaaagagaagagagctgggcgtggtggctcacacctgtaatcccagcacttttggaggccgaggtgggcagattacttgaggtcaggagttcgagatcagcctggccaacatggtgaaaacctgtctctactaaaaatacaaaaattaactgggtgggctggtgcacacctgtagtctcagctactcaggaggctgaggcaggagaatcgcttgaacctgagaggcagaggtcgcagtgagccgatactgcaccactgcactccagcctgggtgacagagtgagactctaaaaaaaaaaaagaagaaaaaagaaagagaagaggtaaatgacacagcaacagaaaaggaatagggaggaatagggaccacgagggattggggtcagagagagcctgccttttccatgtgtgaggacacccttgacattggacaacccccatgtatttggcccccagggctggcatttctctttgcttagagtctggagagagtgctagttgctcccaggcttgagtcccacgtggctgctggagagaggacaagctcagctaaatggcctcagctgcaatgactgtaggcgggcctggccagatgaggagggatagagagagacctctctttgccagcccctctttaggacaattaacaaaaatttcctagctgttgaatctaaaaatagttgtgattagcatgctgttttgcatgtgattcacatggtaatttgccataaaactgcccagatcctctcgccacctcttttgtttctgttttggattccggcctttcatccccttcttatagcttgcccctctttgtcccctcccctccactcttcccaccctcagccctgcattctcgccaggcctgtctgtttttctccagctggaaatactgctggctaaccttggcttctatgcacttcctatatagtcagccctctgtatctgagggttctgcatccactgattcaaccaaccgcagatcaaaaatatttgaaaaaaagaaatatgtctatactgaacatgtacagatttttcttgtcattattccctaaacaacacagtataacaactatttacatagcatttacattgtgtgaggtattataagtaatctagagaggctttaaagtacatggaaagatgtacataggttacatgcaaatactatgccatttcgtatcagggacttgagcatctgcaagttttggaatcttcaggagtcctagagccaatcgcccatgaataccgagggacaaccgtgtagagctggaaaagaacttgatttcagtaagcataacaagccctatccctgttcctccaggtctgattgtgctggccacaatcactcctgaatcatcgctggactcaggtcatgaaaccaactcttcagagctcacagacatgtcagagatgatgtcggccatgaagcagcaccagaacaccacctacttcctggcccagcacctcaacaaggacagcctccttgcccgcaaggacctgcccttccggatccagagctgtgcagcccaggccgttcttacggccccttactctcttgggcgcccggatcccaacccatctctccaacccattgccacaggccagagtcctggcccccctggcgctcggaggaagctgccccagtcagagggccaggtacagggagaacgaacatactccttggcagtgcacccagcactgtccccacagcttagtgaacagaagaatctgagtctgctgtccccagttcctgaggacaaagggcctggccacactagggcaggcctagaaatgtcactgagggcagccacatcatccctcagtgaagagcaggtctctgagctgagggacaacctgcccaaggaggtcaggttgagccccaagcttatcctcgacccaaagagcagtgtgacccctgccatcatctcggccgccctacagcaagtggttcacaataagagtctagtcactgctggtggggctttggggaacccccccagcaggggtgagagaaggctggaggccagcatggggaggccagaggttagcatgatgagcagcagtgccagtaagaatctgaagttcaaaattagccccagtgctccagagacctcatggaattctcaacatcagctgggtgcagaggtctcttccagccccagagcacccacaggcagccgggctgacagcctgcacctctcccaacaagaggacagtctgcctgttcaaaatttccctcccaaaagctatcttttgcgaacaagccgagagtcagtgggcaagcaagctacaggggaggtggcaggcaaaggcgggccagtgggtggtaagcccaccctgcagaagcagggcaccatctccagccaaggggagaaggcgcagctggagagcacacccaaaagaagcaagctcgaagagaccagcctggttccccgagctacctaccccatggctctgcagagccccagctgccagtcaagaagccacagccccagctgccagcctcatggccacagccccagcagccagtctcgaggtcagagccccagctgccaacctcgaggccagagcccactgaggtctcaggctgccagccggcaggtgagcaccatgccctctaggaagcttgaaacaactctcaatggagcccactcgacctctgaaggccctgccaaacccaagtcatcccgaggtcctttccggctacgcaatttattctctgccaccttcccaacccgccagaagaaggagacagatgagcggcaggcccaactgcagaaggtaaagcagtatgaactggagttccttgaggaacttctaaagccaccaagccagggggagctgccaggcaccgagtacctgcaacctccagcacctggccgctgcagctgccagctccgcagcagccctgtgcagcaggggcctggcatgtcccgtgagcagaggcgcagctgtgactgcaagcgcatctgccgggggggccggccacaagccacccagacaccagtgcccagcctccgggggagggaaagggacagagtcctccctagccagaggcagccagaggctggcccaggcgtgagcctcagcagccccatcaatgtccagcgcattcgttctaccagcctggagtcccgagagtgccgatcggaccctgagagtggtgtttcgtgcctgaccacgtgtgcctcggggggcgagtgtctgggagctcccaattacaggaaactgatgcgccgctacagtatcagtgagctggaccagggtgacagggcctcgctgacctcggatgtctacccacatcctcccctgggcatgctgcccagggaggccaaggaggtagaggcaagcctccccatagccttgggtcccaaaagcaggtctctggagtcaccgacgctgggagacccctcctacgtccaggttgccccagagaccaaaggccccagacagatggccgtgttctcactgcccgaggaggtgtaccggaagcctgccgagctagacgaggacagtgagagcagcaagtgctgctccatccgctactgcttctactaccgcaagtgtgacatggcagatgatgccagtgatggcaaggatgagctctcctactctatccccatgaagatcctgcctggcatgaagctggacgagcaggtggtgcctgtggtgagcaggaccctgcaggtgctggatgctgctacctgcagcagcagcagccctgaggcctcccgcactcaggagattgacctccgtgtgtccaccttcgaggggagcctggccaagatcaatgccctgcgggcccatgcctatggcctccctgatggcttcctggctgcccggctggacaccaacgagctgctgacagtcctgcggcagtgtgtggccagccccgaggcccgtgcccccaagccctatgtgtctcagatctccgagtataagcttgagctagctctcaagttcaaggagctccgggcctcctgccgccgtgtggccaatgtggacaagagcccaactcacatgctggcagccatcacgggcagcttccaggtgctgagcagcctcattgagaccttcgtgcggctggtgttcattgtgcgctccgaggcccagcgccaagagctgctggccaaggtagaagaggtggtgaggaactacaccttcctgctgcgtgcagctgaggagtccacagcccgtaaccttaaccagcagcagcagcaacaacaacagcagcagcagcaacaacaacagcagcagcaacaacaacagcagcagcagcagcagcaggtggcagcagctgcaggggcagccacagagcatccaccaggctccccaacttcggcgactgttatgagcacattcacccactccttaaaaacccttattaagtagggcatctgcccacacctgtcccccttccccaaccatggccccaggtttgagctttgtggtccttgcatcttgtggtgagtgtgtgtgtgtctgctgggccagtcagggtccaagagcccatcagtctccggggagtggaaactctcttgattgaggctctctcttaagggctgcaggcttagctgccgccctgggtgtcctcaccccttccctggcctctgggcctcactgtgagggcaaaggcccctcttcactctgctcacagcagagctgtattttatctcttctctggggctgagaggtgacatcaggctcacttcctgctcaatccgtgttgggcgctgggggagccagggcctgaagcaagcggaccctcaggctttgagctcctcgtggcatcggctcccctgctgggagcagtggcagtagcagcaggccacattgccgtgccgaggggagagggcgctcagtccagatgtccccatccaccttgggctcacactcacctggtagatgccaccctgagggcctgtgcctgggtgagatgtctgcagaaaacagccacactaggctgtttgcagcggcccaactggccggcagcctggtgagccctcacctccaggtccagtagctccacaccagccatccccaaagtgccctgcccctcactgatgggcagggcagctcagtccactagggagcaagcatctgggatcaccccactcattttgggtaaggtacctgatgaaaacgtctgcctggggagacccagtgcaggcctaggagcccgcctagcccggcccagcccagctcaggggctgttgctgcaggcatgaggcttctctctcaacatctctctaccagacagactgtccttgggagtttgacttagctgtggatcggggaggggggtggggggaggggggaaaggggtaggggtggggggtgttgatgactatatcttaaacttctggaagctagcgtgatatgttaatcctgagtatatgcttttggctgtgtattgaccctgtggatttgtctctctaagaaaagaagctgagcgccttacccggtgcagtcctgcacctttctccctctctggagccatctggaagggaattcacactgtttaacatccaccttgacacacacctcctattgccaccaccgctgccaccaccaccgccaccaccgctgccaaccctccccccacgccccccacccccgcaaccttcctgggagtgaagacacggagtccctaccaactgtcccactgtagggaacaaagaaagccaatgtttcttctgtatagattgcttctcgtccgcctctccatatctccccatttcccacacccttgtgccctgtgtctgcctctgtttcatcactgtgtcagaggcccatgtgaaatctttcattctgatgtgagttttataaagatgtacactgtgcttaatccctgcccatccttggtagcccctagtgcaataaagtctccctgagtggtgagttctcccggcaaggaggaggggagtttcttctgcagaatccagcccctcacttccttgcttctcctcccccaggaccaagttgttgaatgggccagagatgcagccagtggggaatccttttcccctcagccactgcaagctggagtgctgatatggtcttctttttctcccaacttcgccactcagcccctgcctgtgtcattccaccgccatccttcacctctccctcagcctcatggagaggaaacattttctaatgtctgtatatagtatatatactacataaaatatataaattatatatatactaatttatgtcttgtttttcaaacaagaatgattaaatctattcatcttactatcccaataagtctttgcggtgcctctttgtgggtgtccttgtgtccttgaattgttggttggtggtggccctttgtgtgctcatcctgggcccctgctcttatgtactgggcactggtgggtgatgagagctaaggaccctgttcctcccacctccccaacacacaggggatcccctttgctcctctttgaagcctactgtttctcatgggagttggaaattgtctacctctttctcttgaccacgaggcttctggctcacctggcccccatggctgtgacctcagagctgaagggctggaggtggtgtggggggttgtgtggagaaacacagtgtgctctgtgcctagtgtatcagatggcctgggaattaggattttaggccactcctcagactggggttgggaaatggggcctctccctctgaactgtgccttcttgctctcagagtgcagcctgactgcctcgcagtttaggctatggaatcccttgcaacagcctctggccatgtagtggggtgggaaggagggattgtttccatagtatggaagcattaggaccctaatcagagctaaccct

SEQ ID NO: 8789 - DNA, 1757 bp, artificial
  synthetic oligonucleotide
tcattctgatgactcattattatttatttattttgagacagagtttcactctcactgcccaggctggagtgcaatggcgtgatctcggctcactgcaacctccgcctcctgggttcaagcaattctcctgtctcagcctcctgagtagctgggattgcaggcatgcaccaccacgcccagctaattttgtattttcagtagagacggggcttctccatgttggtcaggctggtctcccgacctcaggtgatctgcccacctcggcctcccaaagtcctgggattaccgacgtgagccaccatgcccggcccacattaaatatttttatctaaaagcatcatgtgaggaatgcaaacatgaatgccttttaaagatacatatcatttcaaagacacttgagtcttatgtctgatacttttggtgacattcccatagccatctacccagcatccaagttcactctcttcgactaatagacatgcttggatggaagtattgacacacttggggcccatcagatgagccagctggttgcataagccttaaggggaggatagctgggacccgtctatttccgtggatctgggcacagggtgggggtcaagtgcttgttcagggatatgagacctggaatggccaggtagggtggctcatgcctgttttcccaacactttgggaggtaaggcaggaggatcgcttgagcctaggagttggagacctgagcaacatagcaagaccccatctctttaaagaaaattagccagacatggtagcacacgcctgttgtcctagctactcaagagactcaggtgggaggatcctttgagcccaggaagtcacactgccactgcactccagcctaggcgatagagcaagatcctgtatctaaaaaaaagagaaagacctgaagtgacagggtgtcagaaagggaccccaagaggagatggggcagcattatcaaaggctccctccccttccctgcccctgccccccaactgttgcctattacacactttagcagcaggtcagccccaagcccagactgaggggaaccagccggagatttctgcatctgcaatgagcaagcaaagcagggaagctgtgtgggctaggctgagcagctcaccctagaatcagggctcacttctatttttcagcccagccactgacttgccatatgatggggtatacgtcattttacctctttgggcctctcctctaaaacgaagatgactgagtcttcagcctccctctatggctgtgaggattaatgaggtggtgctgaaaacgcagctgtaaaaatcctgagtcttagctgtacaacttaacaagtacaaatagaactgccccatttgcagctggtccacagaaactaattaagcttgcaccaaaggcctggaactagaaacttggccagcagagctttgggggactgttttctccaaatatccattgctcccaggcaaagccattttcagttagtttccctcaaaaaggacctgcaagacctctttttccctgggcctttttttcgaaattgctaagccagctcacttcctcaatggagaatccctgtcctcagtggacacagtctggtgaacacgaagctcatcttggcctttggccaatacccctcacatgtttctctgacatcttcctgctcttcctccatcctcatcctccttgctaaaagcagctgtaataaagggagcttgaatttctaatttttcctcaacatttaggcttaataggaaagg

SEQ ID NO: 8790 - DNA, 369 bp, artificial
  synthetic oligonucleotide
ggcattgaattgggggttggctgacaaggccaaggagggaatatgaacaatgagagcaggtcacactagcttcgagagggaaaaactggagcagacataggagatagaaaagagaaaataccctgaaagaaatgctaatacccaggagtgggccaggttgcttgaagatgaaaaggaagcccagctagtcaaatcttccactgggctgcaagaagcccactgtgctagggatcaaagtggcaggctcagaaaaggatgatttggtcctgcagggaggagaggagggggcttctttctctctgtctgctgttaaagttagtgctcgacaagtctgtttgtaaagcttcttggaggtaagggccacatttt

SEQ ID NO: 8791 - DNA, 2957 bp, artificial
  synthetic oligonucleotide
ttgattccagaattgtatgatttttatcttctcctaacccatgcttaaaatatgcttaatggaaacatggtgcaagaataaaggctcacttaggtccaattaacaagtatcgctataaaaataataaaacatggtgtaaaaggccacattagcaacatgtagctgatgacattgaggcttacatgaggcagacaggactaaaacccaggttttttcaaatcccttcagggctctttatctgaagtcccatagaacactatactttctttcctttccgagggctataaaagttagatctttattgtccagatagtttggaaaatccatcttccttcacttgtttcaacatacttggttccagcactagaaacaaaacaactttctcttgcagtgtctcttggatgattcaggtggcatgccttcagtcacttcccccatgtaaactgtcttgcaggcaaaggcgacactgcaattacaatgggcaagcaaactccttgcatgcacgtctgtgatgtaaaagtgttttaattcagccccatccttataaagagataaaaaatgtgttcagaaacatgcaaactcgtggctgtcatcctgataaacagattttcttaaaggaaactgtaaaccagagccagacttactttcctgcgctgagggaggggaaataaaaaagcaggcatggttgatttcccgctagcgggaacgatctggcctcagacgtcaccagcatccctccacccccagtccaacgtctcctgtccccaacagcctagctacagggggccgggctatgggttagtctcgcccccgttcatgctcttcacccaatacctgagagaatcggaaggaggcagagctacaccgaggaccaaaccccgcccttcgctccctcttagctaatcgttgccagcggggtgtggacttcgccgctgaccccacctccgccgctttgggtaatttagagccgcgcgccgggcgggaatgtaagatggcggagtagcaacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctggtaaggaccaagttgggaccctgactagacctcacctgcccaggcggcagagtataggagggatggggtcgccgcttgagctcaaacagactgggggttggggggagagggtgcagctctgtgactagcctaccccacgggctgtttccgttattttacctctcgcgggagggtcacgttcattcttaccgtgcggtggggtggagtcaaaagatggagtgtgaggcgaagcttctgcgtttgagggcaagggctgggggacccaatagatagtggctgcatagagcgacgagaggggaccgacgcttagccagggcggtagggacacgtggcttggctttgctgttgagccacccaggctggactgggttgcttcagctcttagactagcttgcatttagagagcctacctgcgtactgagctctcctggtctttcttttcctagagtccaataagcagctttttgattcgaaatggtgttggtccgttcggcttggtgttgagggaaactgacattatatactgcaggcgccaaaattattacgacttcccttagatcagcaagcgttggcttttctcatcttatgaatcatctacctgagtaattggagccataaatctagttgatttgttaaagtgatgcgttgactctgcatccttgatagccagcatctcagcttgagccatccaaaaaatcttggaaatctcaattctggaatgtttgaccttccccagtgcagctagtggtacagataatgcaaaagcgtatttttcagtaaccgagtccatcctggacttggctccttctttaagctctgtgtagggaatttaggaaacaattttatacctgaatgttaaagataattgaggacaggcaatgtagtggaagactaggattggacagtgcattgcaacttgcgttttttccattgccttgccagtaaaacttgcttcctcgactccgacttacaccctctaccggcaccatgggactgttttagagatgacttggttacctgattatttcagtgccccttccacctaagtgtgggatctttagtttctgataggtgtaatttgtattttattgttaccctatcgattaaatcagagccctgcccacaatcttacagatttgttaaggggaaagttttcacctaataatcagataagaatatttcgaatattttttcctaaatgtttttgcttacttttttgctttctttggactgatttccaagtttaactcgccttatctcttttagacccagctgataaagtaatgtcaccgataatggacagcttcttcccgaattattgtgctactgattgtgatgcaaatgatagtgtaaacattgccatctgtaaccaggcaataccttagttaaaagaggcttacaaactgctgtctttagatttttccaaaccattatggctcatgggccttaataaagaatacaaaacaggactagactttgtgattggcaatatagttaggggacaagaatgtttttcatttagaggttttctttggcccctgtggatatttaatccttttcctatgcgtctaggaaaaatgtgaaggcatgaaagctttattttctccttgtgttaatccttctgccctctgcataatgcagcaccccagaacctgaggctatattgggagaggagagggggaggacaacttagttttctactgattgatttctattaagtccaacatggataa

SEQ ID NO: 8792 - DNA, 1548 bp, artificial
  synthetic oligonucleotide
gggctgcttcacacatgacggagatggcacagcggagcatggacagacgtgccactggggcagctcactgtcatttacactgaatagatttttgtttgaattatgtggtactttgtcaaaagacaaatttgtcttctatcctaccttctagtctggtttattttctcttgtaataagaaaaataagaattctctttgattggaagatactttggaccgaatggtgagatgcctagcttgtctgggtaattgatataactttctgtctagcaattgtgaaaaaaactcccaagcttggtgtccaggtacagttgacagtgacagttgatggatgttttgccaacagcactgagggaagtgatgaggacacaggcattggaacaggctggatgctgctcctctcctgccagtcaggttctcttctcaccacatccccattcacgggtcttccatgatgggaattgggacagtctgtgtactcctggcattagttaattctttcctcattccttctgctgccaatccattaaataaacttgcgtgtcttagcgttatactgcttcccagtactggtgagggtgtctgtcctctacccagaatgaatactcatctaagtttgatcagtacgttcataagcttctgttgagctatggaggcactggtttataaaacccagtttgtgatatttgcctttgagaagtcaatgatagttgctttcattcttccagccctgggaactattggtttcaaggagtattctcctccccaaaacaagcccattctttagtccatttctttttttcttttttttttgttttgagacagagtctcgctctgtcacccaggctggagtgcagtggcgcgatctcagctcactgcaagctccagctcctgggttcacgccattttcctgcctcagcctcccgagtagctgggactacaggcgcccgccaccatgcccagctaattttttgtatttttagtaaagatggggtttcactgtgttagccaggatggtctctatctcctgaccttgtgatccgcccacctcagcctcccaaagtgctgggattacaggcgtgagccaccgcccccggcctctttagtccatttcttttgtcttagaagccacacatacatatgaacacgctctgttttgcagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaagtaagtgtggattgatggggctggtagttagaaggaaaaagctagcaattgctgtctgaatgtcttcagcctgctgattccttttggaaccaaattgaggggataagtaactttgtgagatttttatcacccaaggcttaaattataatacatagaaattgttgagtactcttatttttttttcagattttcttattttttaaatttatattg

SEQ ID NO: 8793 - DNA, 2392 bp, artificial
  synthetic oligonucleotide
tttgggatcagctactctcataattgaatgtaatttatgaactcctgatccaccttgttcctctgcagagaaatttgctacagcctctagatttatgaaattgcccttctctctgcagacagcagagggcctcattagcacaaactcaatgtcactggcaaatatatgggaaggaaagtttgccaaggttctagaagcacagcaaaactttgattaacataaataggcaagaaaattggccagtcagcttaattccctaaaaaaaaccctggatttcctgagttaataggggttgagcagaagcttcttgctgttccaccctttgtggtcgaaaattcatccaaaattcccaaatcctctttgctccctcagctggtaatagggatcctggatagagttgccagatttagaaaataaaaatacaggccagacgcggtggctcacgcctgtaatcccaacactttgggaggctgaggtgggcggatcaattgaggtcaggagtttgagaccagcctggccaacatgacgaaaccccatctctattaaaaatacaaaaattagccaggcatggtggcacatgcctgtaatcccagctactcaggaggctgagccgggagaatcacttgaacttgggcagcagaagttgcagtgagctgagatcgcacgactgcactccagcctgggtgacagagcatgactccatctcaaaaaaacaaaaattaaaaaaaaggccgagtgcagtggctgacgcctgtaatcccagcactttgggaggctgaggcaggcagatcacttgaggtcaggagttcgagaccagcctggccaaccaacatagtgaagccccgtctctactaagaatacaaaaattagctgggcatgggcctggcgcggtggctcacgcctgtaatcccagcactttgggaggccaaggcgggcagatcacctaacatcgggagtttgagaccagcctgaccaacgtggagaaaccctgtctctactaaaaatacaaaaaagaaattagccgggcatggtggtgcatccctgtaatcccagctacttgggaggctgaggcaggagaatcgcttgaacctgggaggcagaggttgcagtgagccgagatcacgccattgcactccagcctgggcaacgagcgaaactctgtctcaaaaaaaaaaaattagctgggcatagtggcagacacctataatcccagctactcaggaggctgaggcaggagaatcacttgaacctgggaggcagaggttgcagtgagctgagatcacgccactgcacaccagcctgggcaacagagtgagactcagtctcaaaaaaaaattttttttttaaagaaaataaaaatataggatgtcagataacaggtctggacattatatattgaaccataagactccgaaagatggagagaaggcagatccagtagagacctcaggacctgaggcagtgagttccccgggttttctttttgcctcacatatcccagactgggttctagagagactggctacccagaaactccagtgggtacacacaaaaaaagccctaacaaaatctggctctctctagggaaaggaccaggcaagaggcagcctatcaagacataaaacctttagacaataaccaaacaccacaaagccaactggccccaccccacccatgtcagcaagggccaagtgggaagccaggttacaagaaggtatttccaatctcccaccaggtttcagaaaaggccagtacagagctgggattttcactgccaccagatggtcacaaagctatgcaacactggggacatataccaaaacgttctttttctgagattcaaattcacctgtgcatcctggttttgatcgggctgccctgactgtgggtgaatcttgattttctgactgaggtctggccaccataagattgtcagtctgaacaccattagcccagacaaggagatgggggaaaagtaagttgaagaggctgagctgagtgggtagttcatgggtagtccctcccattgacaactgctttctttaattccccatagctgcttgttttcttcctaattgctcatttcttttaaatgccaattgcaggaagaaaactaaacagtgtaattcatgtgtgtgctccaggcaaactgagctgattgtctacgaggcaccttattgtgtggattaaataagatcatgtcaatgaaagccccttagcatccaggagttgctcaataaatgttactttccttctttcctgaaacatcaaggataactttagacatcctcagcctggctgtggctcagagagaaaatccagctgaccttctgatccctgaatgccattattattttagtaaccaatgcttttattgaaaaaataagccatg

SEQ ID NO: 8794 - DNA, 1871 bp, artificial
  synthetic oligonucleotide
aaaagctccccaggtgattataatttgcagccaattttgagaaccaccctcttgtaccctggccactttcccctttccccttacctgcctaggcaggctctcaggcatttgacccctgctctcctctaaaccccaaagcttggcttccaaggctgtgccagggcggccagccctgcctgcctctccacctcctccctgcccacccctcatcccactgtagttctgggattctgaggccaaaccttcattgcctcccccactttttcccgcctccctagttagcggagcttgttttgttttcttgggcagctttgagtgaggacatgtgtcagaggcgtttggaaaatctaaagaactcacgtccttccctggtgcctcttgtccccactccagtcacccggaactcaccaggagccccaggcagggcgaagcgtcccggtcccgccctcgtctggcggccgcatggaggcccacatgccttacgctccccaagccggggccgcgtggggcgacatgtgctgccggtcacaggggagggtggccagaggcaagtgatgctgatcagcatgggcttggaagccgcctaagaaccaaccacagcgacttttccagtgggatgaggaggacggggaggagaaaaaagtgggcgggggcgggggaggagatcttacaccaaggcttactgggtaatttattattgcgtgagagcgtcttagagcagcagccctgatcaacgtccagacatagcaagtcattccaagtgaaaagaggttacaaccacaaaaagacagaacatttcgttctgagtgggagggagacagctgggcaaggccaatggaaaggccccccagccaggcttgcttttaaagtactgctaccatttcccagctattttaagcataacatcgccaatttttttcccccactgactacctgttttctctgtgaaggcggcttgaatgcagctgtgtgtgtcctctttttctcaggtgcttgcttttttcctagagattggaaaggagttaatgagattctacctagaaggtacggaagaagctgggaaataaagctgacaaatcaaggacttgattgccaaggcgatcctaattgatttagcaccagggacattttcacacttgctctccataactcatctgaggtggaggggaagtaagtgcctttggagagacctgtgggcactttggagagcaaaaaacgctgcctccggtggtgggtcaacctcaggaattccctctcttttcaagaatagctttcccggctgggcatgctggctcacgcctgtaatccctacactttgggaggccgaggcgggtagatcacttgaggtcaggagttcgagaccagcctggccaacgtgcttgaaactccgtctctactaaaaatacaaaaaattagtggggcatagtggtgcatgcctgtaatcccagctactcagaaggctgaggcaggagaatcacttgagcccaggaggcagagattgcagtgagccaagaccctgccactgtactccagcctgagcaacagagccagactccgtctcaaaaaacaaaacaaaacaaaaaagaaaagattagcttcccccttgggttttcagtggttggtgtgaactgtggcacgtggatgcctgcaagagagcaatcgaaggtggcagtgctgggctggactgagggggctgccaggagggctatgtaggaggtgatcttttgagctttttaagcttcttgttccttccttccacccaagagatcagaaactcagctggggtggaggctgtggccccggggaagcccagctttggacaggatgggagctggacattctcagaaagctcagtcccttggtggctgctt

SEQ ID NO: 8795 - DNA, 1908 bp, artificial
  synthetic oligonucleotide
aatggcccaggcaagagttagtgagctctggaactaaggtagtggcagaggggctggagaggagggttgagagtcagaggacatttaggaggttgaatcaatgagagtagataaatggattgaggggagagaataagttagacagatgaaagagtctaggatgccactctggtttctggctttgacaggtgggcagatggtggtactaccaaaccccacagggctcagtacagtgtctagccctcagcacaagtctgtggaatgaacacacgattgaatgattgaatgaagtgtattcatgtcctctcctccctctctgtggctccttatcacccatagggtagacctttgaacctcagcatacttgattccaccactgcccatttagaggcatggagcagcctggagattctgctgttcctgggttcagccccaggataccattatcttatttctttccttctggtccagaaaccgcctggtcactcaagagattcttggcctgggcggagggatgggagggaacttgggagtggatagccaccaaggttctgaggacccttgtcatgagctcaggaccctctcttatatcattagcctgcatcctcacccagactgccactcatccacaaacccacctcatcctacccagctatgcctcccatcaattagtgatgcgactggaatcctcattcctaggtttcccactgtgggcctacatttcctttgcagttcccgctggaatcagccacctgccaatccaccaggccagcagtgggcctctcagcattctctttggaccacctgcctcagaaccacatggatagggagatttattaaacacgcagatggccacactccatgtctgctccactaaatcagattctacagggctgggtagaaggaatgcatcagtcccgcatgtttcagaggttccctgggtggtcctgatacccagtaatatgggagctgctgtggtggagagtgtaagtgtggattaagggtgcatgtgctcctgccacactgcacacagcccctgggggccactcaatggacccttccttagaatgctctcccaacatgggcatgctccctcaatgctcatctttccaccaggaaacacactcctgctctgccactaatcagatcttgcacaatcttctgcccctcctccttcccccactaaatttccacaggacaatcagtactcaattgctttttcctctgtccttccaggcacttatcacagtctgactcgtgtgagaattggttgtttacatgtgagctcgtgaagagcctgggccaagtctgggaagactaatgcttttagactagcagcatctaggacagggccaggcatacagtaggtgcctgatagatacttagggaattgaatcactcatgagaggagcaagaggcctgaataacataaatcaaagtcttgtgcatttggctttaggagtgactgcattccgggtcttttccaagaacagatttgcctgacagtgaggttaataggtcatcaccactgctttataagccccagagaggtgggaacagagtgacctgccaaggccatagcaaggtcaagagctgtggggctggcactgtggacaggccaagctggcagggagcttcatgcattcattctttcaaccaacttttagtgagttcctcctatgtgctaggcactgcacaaggtaccaaagataaagccgtgaataaaacagacaaggttcctgcccttacagtgtttacagtttagaaggggagatagatgttattaatttcagaaagaattatagttatgataagtgctgtaaaggaaaagaacaatgtgcactgaatgtgcatataataggaggactcgatttagcctgacacgagggcagtggagctgttcaagga

SEQ ID NO: 8796 - DNA, 2585 bp, artificial
  synthetic oligonucleotide
agacaatgaggcaatatgctaaatacagtaggcagcaactaggaagaagtttgggtctgtggtgactttatagagctgccctatcaaccctggactgtgtaccttcagacttctctgatgggagagatgaataaactatctttttaaagcaactgttattatttttgctgttattacagccagggctaatcctaactcatactataccacccccaccccgagaatgagactatggcttgacaaacagatccagataatggtctagggttttatgggttaaaatatggatatagggaaaagtaagcatttggaatgtcttacgtatggagtgggggatccctagtcaagaggcacaggaatactagtagactgtaggcaatttcccttcatagtacaatttcccttcatagtaagccccatgaagaccagtacatgtctctcagatttaccacagtatccccagtgcttagcctggtgcctggcacataggataggttaaattaaaaattattaacagaggctgagtgtggtggctcacacctgtaatcccagcactttgggaggccgaggcaggcagatcacttgaggtcaggagtttgagaccagtctggccaacatggtgaaaccctgtctctactaaaaatagaaaaattagcccagcatggtggtgcacacctgtaatcccagctactcgggaggctgagacacgagaatcacttgaacccaggaggccgaggttgcagtgagccaagaccgcaccactgcactccagcctgggtgacagaacgagactctgtctaattgacagaataaacagttcaatgttttcataatggaaataatcaacaggccaccagtttacttaggtgatatgaaagaatttgggaaagctttcccaccccactgtccctacccaaaaatgtcttccccaatccatgactactatagcatgtgaacctcccagaaatttttctttttcttccttctttccctccttccttccttccttctttcgtgttttttttttttttttttttttgagacggagtcttgctctatcacccaggctggagcgcagtggcacgatcttggctcactgcaacctccaccttccaggatcaagcaattctcctgcctcagcctcccaattagctgggattacaggcgcgtgccaccacgccaggctaattttttgtatttttaatagagacagggtttcgccatgttagtcaagacggtctcgatctcctgacctcgtgattcgcctgccttggcctcctaaagtgctgggatcacatgcatgagccaccgcacccggcctatttctttatttctttttttttttttttttttgagacgaagtctcactctgtcgcccaagctggagtacagtggcacgatctcagctcactgcaagctccacctcctgggtttaagcgattcttctgctccagcctcctgagtagctgagattacaggcgcctgccaccacgcccggctaatttttgtatttttagtagagattgggtttcaccatcttggccaggctggtcttgaactcctgatctcgtgatccacctgccccggcctccaaaagtgctgggattacaagtgtgagccactgcgcctggccttatttatttatttatttggagacagagtctcactctgtcacccaggctggagtgcagtggtgggatctcaactcactgcaaccacctctcccgggttcaagccattctcctgtctcagcctcctgagtaggtgagaatgcaggtgtgtaccaccacgcccggctaatttttgtatttttagtagagatgcagtttcacaatgttggccaggctggtctcgaactcctgacctcaggtgatccacccacctcggcctcccaatatgctagtgttataagcatgagccaccacgcctggccccagaaatttattttttgatcagcaagtatcaggcactgtgttcagctctgaggatatagtgttgagcaaaattgatatgggtcctgcccacagggatattccagagtggcaaggcagaaacagcaaaaatttgtgaacaaatcattacaatctgggataaatgcaacaaaacaaaggtaatggagaaaacttatttagacagagtgacgggcaaagatgtctcagaggaaaggagagcccaaggattggaacaagcagcgaagcaaagtcaggggagggtgctggtggaaggttctgggctgactgaaccagacacacaaaggctctgaggagtatttgaggaatgaaagcagctcagtgggctggaacttggtaagagcaggggagtgacacgggaaaaggctggagaggtcagtggaggccagatcacgcaggcacttgtaggccatgggaaggagtttggactttactaagtacaatgataagccactgacaagcctaaagcaagggaatgccatgatctgattttgcattaagaaggaggtcactctagctgctatgtggaattggacagggtccagtgtggaggtagggagaccaacgaggcttttgcctttgtgtgaaagatgagggtgacttagatcagggagt

SEQ ID NO: 8797 - DNA, 3584 bp, artificial
  synthetic oligonucleotide
gaggtaagggaccagtcaatactcccaaggctggttaggcccttcaacatgtaggtggatgtgtatatgtatacatcgctacactaagatacagatctagccctatgggtatatatacgcatttatggctatatagaaaaactatgccaatactaaccaaacagaactttgtaagcggtcatcccaaagctgtaatcccacactgggctgtgcacaaagccatgcattataccatattaaccaacagaaggctgacttggctcaatctctcccatctgtgtcccctgccttcacgaaacagaggagaagagagaggttgcctctgcttaaaacacaagtggcttcttcataggaacagtcgttgtcaggtgaagctgttgaagatgtccatggagatgagaaacagaccccttaaactttctggagcaaactggtgtcacacctcaaactacccttctcctttgccagttgcagctaagttgcccaggccctgggagcccccagggcgcagtagcattagaggctcactggcttggtgttactaggccccatgcaactcagcctccagagacctgctcttgtcaggggtctgtcgctggagtggacccaggtggccatgtccttaggacatctcttggcaccagctgtgctaggtgtaaagttctcctcgtgagatgatgcttggggagccaaaaacaaactggaaagaactaggtaaaacaagtttagtggctctgcccaccctgaggacagagccacttacaccgcagaaccaccaggggcctcgggcacttgtggggattcgggagctggctcttcagggctcagacaggactggaacttctccagctgctctgggcttgccagggtcttcaacagggtgttctcacgctctagctgggagttcttctccaccagctctcggatctgctccttcaggatctccacctcctctctcacagcatacatcagatgattcttcaccagatcctgccaatgagggaatcataacaaagccattccttagccatcgtggcccctctgcagcacctttgctctgtcattggtgtgcctgtgctgtccttaatgccagggccctccagccttccctcagtgaactggtctggcaagtccaattcctcgttcacctttctctgaagcacttaaaccctcattcaggagagctacatgatttggcttatgctggagttgagagcccagctttgaactagataggttctcccctgcaagtttctaatgactttcaaagctggctgctgaggggcctttggggtgacacttctgctgtttgccagtggtttgctatgtccccctttttacataagcccctactgctgccgatccagatctgggggaagggtagacctgcaatgcatcccatactgtttgtctgctgtacaaatcttaaccaagagaataaaattggctattttagagtctcctcccctccatatgacccagcacattgaattgcagctgtcctgcagccggccagttagcacacaggacattggccttggggaaaggtacagaactgccgcatcctctctgaatttgatgactgcactgggggcagggaaggtgtccttaagctccagggcacaattaagtggctcccaaccgctgaagccctaaccctctgcagccattgtggctgctccttggagtatgacctctacctggtaaggagagggacaggggtggggtgcttcgcttcctgtttccacccaactcctgaccccagtccaggctctgcagaggcactgcagtgctgttgcatccaatgagctcagccccttgccagctgcacgatgcacacaaatgcaagagtctgagctccctgcccaacaacaggcccaggagagagtcagagcctgcggcaaagacctgagatggaggagggaggaagaaaggagggagcccaggaagggaagactggaaatgccctaaaaggtgccactctaatcagactccacctccagtgcggataggaggcaggctgtcggcttcctcagggttttggctaagggctttttcacccattccctcaatcctgcccagagttacataagcagcagctaagtcaggggatgagaatgacgcagtgatgccactcaccatggcctgttcgatcttgttgtctatggccaccacgctggctccggaggcactgccaagacaaaaagcaaagcgacccattacccactcggttctactcttgagtacatggcagttgtggccaaagtcctccatctgcctcggctcttcctctctctctccttctcgcctccctggcccagagttccggacagtttgtccccagatccttccttggcccctgcaggaagctgcatctcctcatccaggccggctcagcgctgctgccgccgccccgagttccaaccgatcggagctgcttgcgagtcctggggcgcgcaggccaccgtggcctgctcgggcaatatgcaaacaatggggctgtgcgacccggggagtcccccacagccggcctacaaggtcccaggcaaacctacccggctctgaagctagctaggaattccttctcggctggtaagcttccggccttctcccaagcggcgcacggcgctcggccagccccctgcccagccctgtctggtcctgcccgccgcccctctgcctccggctgcctctgcggctgcagcagctggttttcacggcgcagcggccgcagggacgcttcgatgacggatcccagagcggcggtgaccccccccttcctgcgtcccctcccccccgccccttcccaggatgctgcaccgcggggaacagggaccggcggcacacagctcgctcagagaccgggctcctagcccagctccggccggcgccccggctcgggaggcgccggagctggggccagcggttacctgttgtccagcttaacggaaaccacatcccctccaagcagagaagagaagaaggagatggagaaattgtgcagctggtagaccgccacctccatgggggtctgatacatttcggtgttcatggctcgggctgctaggaagctctggccgggtttcgtgcggggctgggcggctgggcggctgggtggctgctggcaggctgcgctgggctgggctctgcgctggagtccggccctgaggctaggagcggggcgaaggctgcagaacgaacccaaagccaagcaggcgctccagctggagttgaagggaagtgactcgaggggtgtcacctcgtatgtcacaaactccacggccgccagtccaacccagactcggagatattttggctcctgcttctttatataggaggagccggctgcgtcacatggcgtcaggggccatgcaaatgagtcctgtaccgggctttgtggcccagttaaaccacatcccctccctgaaccttaggctgggactgtaaacagttcagcactttcttgtaccaactggcatctccaaagaaggctctggagatcgataaaaaccaaactggagctgatttctagagaaataagaaatacaaatgccctaacaagaggcagagggcattcagtaaag

SEQ ID NO: 8798 - DNA, 1324 bp, artificial
  synthetic oligonucleotide
ccccatgaccccaaagggacagtaaggccacaagacatagcaagatagcaatgcaggacactctagcccatgccagaatgtcaaaagtcatggcctctgcgctctctgacatccagagctagctgtgtgctgtgcaagggtgacaggtgacagggtcttaggggaagcttgaggtggtattcagatggacacgggggaaccaatttgaagcctcatactgcatactgggaacgggaagtcctggcactgccagaagcacagttttcaaagatatcaatcatgcattataatgggctcttttaaatgaaggagaaataaaaacaagtaccatttgtgcacaatcaatcatatggacgcctaagaaatgattcccacaggctcctcttgaggacagttctaactagagccagtcctggcatagaggccctctgtgacttgagaagtgtgatctgaagggtggtgagaaaaaaaaaatccctctcagtcagagctgttttccagaccactactgtggtccttacaaatgccaccatgagaatcatgcctttggattccaatgatctctcctggagttcttcatttatactttgaggaatgagaacgccttcttttccaatgcaaaaagccctgggaaggtgccatattcaacactatcagttcaaatacttcagtatgaactaaattatagtattactttcaacagagtagtcagtggccaatcagtgtcagcagacaattggacacacagcaggtaaaccttgatggtgggctgcagtgggcctaagggagattgtggaaaatgcaggcgtcctgggctgcagccctagcatgtctagtggaataggcgtggggcgggagaagggtatttctcaggtgttttggacgcagctcttttgacaccagtccatggaattgcttttaggaactgctggcctaaaggtaagagccaagaaagggtctatctgaagagcccctatggtgccaggggcactgagacccatttcgtgtgacacattcggacgaggcttggcatattctaggcctgctgtctgttctgccctttctttccctctcactcctgaaggtttgaccagaatgtgagtgagatctactatgagagagatgatcctgaacatgctgtgatttatattcaaatctttggcaatttttgcctctctgttaagaggaacggatgccttttaagatacttcacagcggtcagtggaaactctcagcctggcaggtcagggacatgcggcgggggaggggtgggcatcgttgtgggaaagagagaacccagcatagagaaggggaagggactggt

SEQ ID NO: 8799 - DNA, 214 bp, artificial
  synthetic oligonucleotide
aagaaggaaatcataagcaaaaggtgaccttgctagatcttgccagggaactggtgacagggtggcaacgcatggtctcattttttggcccctgccacctgtctgtctccctccctctgtctgctgctggggtcccatgttggcaggcaagttgggaggagatggaactctctggagaggccatctggggaagctggtcctgtaatggaggtga

SEQ ID NO: 8800 - DNA, 3669 bp, artificial
  synthetic oligonucleotide
attagcatgactatctggttaatgcctgtctcccccactccgttgactgttctatgacagctttcgtgtgtttcccattatatccccagtacctgccaccaagtctggcacatgaaagtgtgcaatgaatatttgttattgactgaaggtattcatgaacttaaacatgaattctccagagtactggtgggaaaggatgtgggcacaggtgtgtccaagacactaacttggggagagggtcccagagagtgaggatggaacgttgaccatgaacaacacctttcttccccagtttacctgagactgctttctttttccaccctggttctgtctcccttcctgtcagcttgaggcttcttacctttctcaaccttaccctgaggctttcatttatagggtatctgggaaacaggtttgaccaaggtgcaaacaaggttaaaatgccaccctgcagggccatcagcaacttttttttccagagagacttgggtggattatctatatattctcgtggtagcaccttgacacacccctgcttctgttacccacctcagaagggacctcgtggagactgaagccagagatgcacagataggaagccacagcccccaggctcctctggtgcccaccctcgactgcaccccttggttctaccctgctcaactcttcttgttctgctgggctttctccaggataagagggaggtgcctccctactcccaggccccgaaggcctctgcctccccagggctagcctaggttcccaaggagagggtgctagggtccagtttgccctgtgtcagagaggggcaatgaggggagggccagagtgggcctttctctcttgttcctgaatcaatggtgactccgggttccagcccagaaggaatcaaaagtgtccccacaccaggccatccccttcctactcaagagccctgctggactagcgaggttctcctcccctctcccaatctgaaagccctgctgctttccatcgtgccaaagccaacccattctttcaggccctgctggaagcggccgccataaagagactctcccttcctagtttgctttggcaccatccaagctccagacctgcagaccccaggagcagtaagcttaaggcctttcccttaaggagcaggaggctggaccaggtttgcaaaggcctgaggtcacgccagtgctttgttccccactggccttgggtgcagctgctccactccttcctgctataccctcagctcctcagagccctggtcctagactctgacgtctcctgtgtcctctacagtgattagcaggataggcattcaataaatcctcagtcggtactcaatacatagcaggcccttggtcaataaatgatggattgattaattgaagtgcttggtcgctttggtacaaggccgaatgaggtgctgccatcattcatttctctgtgcacctgggcaggcagattatgttgccttaaaactgagcagttctttttcttattatttattatttctttgttttgttttctttgtttctttttcttttttactgctacagcctatgaaccaaaaaggcagaggggatagggagaagaaaggggctggaagcctgggaggagtcccacaaaggaaaattctgcatctccatctcaggtcccctaattttcactggattctgtgatctgggggactaagggtgccaagctcttctgagccctgagatggtagtcttgagcttgtccaagaacttatgagtcagctttggatacaaatcatgcctgctggtaattcccacaccacctttttgactttgtttccctgtttctcctctatttcttggagtggagagcagtgtccccacctactcacagcctgtgagccatttacttgatggcaacacacgtgagacaggctggggaaaagacaaaggaagagaagaagaggagctattggtttagttacaaaccttgagctagtggaatattagattgatgggggtattctgtgctgtagatagtcacatttgttattagagaaatctgtcatagaatctggcaatactgacttcactgggggctcagttccactaagccggtaatgtaattttctgaataggccaggcagagagctaagaatcactgtgaattcaggtcaacctggggactttgagacttcatggagcgtggactgggaattggctcttgaaaggccttcctttaaacagctcctccaccttccggtaaaccctttcacctggtgtcagtcagcctggagtttccgccccccccccaacaactccccccaccccaacccacccagtagtttctgaaccaacaagcagatacaaaaggaagagggacttctgcgacctgttctggggcctctccatgcaccacgcagtttctttagcagtgcattatcaggtgatagtaggttcctccctgccacctccaaaatgcctcaagccaaattaagtccactccagcttgcctgtctgcttacatttactgctgagtgtggaggctgagtgtgggaccgggtcaggctttgctgcctggcatttgcctctgagcagactgcttgcctgacactggggagagtaggcttttccttgggaagtatgatgagcttgacttggacccccagcaggcttccaaatgcctgtccccagggaagcctaccactgagcaagcagaagtgtgatgcctcagtaacctggctgttacataagatgtgctagttatgagtcagggccctcaggctggcctaggcccagcctagtctgggagtgaggctaaacggcagcgctgaaggaggggtgtcttgggagtggggtaagccaggaaggagctgctggagtcgcttcctttcctctcacttctcacccccttcttccttagggatagctctagccaatcaccagcctagatagcacggagcgggaatcctggccagacccctaagctgtgaacagctgctctccatctcccctgaagagaagattagaagaagtgggttgaatactcaagcctattctgtgagtaaagtcttccttcgaggaaggatggggaaggtccctgtgtgctctgtccataggcaggggcccgatttctggctggacctatttgaggaaagtggctcccaggagaggaaggccaatggtgagcctggatcatcagtgatccagcctgcttccagctcttgttttccctcgggctagtgtctgcacaatgggaagcttcccattcagtcttctgtgctggctgggatcttaatgcctcttatacagtttccagaagggccacagctactttggggcaggaattttcagctagaaggtacaagtgaacttgccttgcctactgatgaaattccctcctgcctggaatagaatcgagaaaagcttgctttctgctctcacagatcgcatcttagccccactccaactctagttaagctggatttcagcatggtagacagtggcctccaaaagacattttccctgacctgactcttcatcaaacctaggttgccctgaaactgggatctagccttctggccttcatggggctcctcctagcccatggggttctgtggagggccttttctgccaaagctgtggtgctacagcaatgccctaacccttgtcccattattgcagactttgggacagc

SEQ ID NO: 8801 - DNA, 5274 bp, artificial
  synthetic oligonucleotide
attttagacaatgagataatttgatgcctaaagtgaaataatagatgagaaagggcttcaatggtgtcgaaaatgcccgaggaatacgacttgttataataacactaacgaggttagcggccctgcttgtcttgcccagaatcactggggctgggctgagcgggaggcgatggtggatttgtcttggggcaagggaggcaaacctgctcttagcattaagtgagaatagcgcctgcctttctcgattgcttttaaaatttcctatttgagcctgcttgcattctaaatattttgtaggtgctcagaatttcttatcactttgtctgggcacatcgcctgcctacagcctagaatctcagagctaaaaggaaccttggagagactagagaggtcaggcgacttgctcaggctcatacaaacaggtgaagccataacttgtactacaacccaggtctcccacagtggcgatgtctttctcttacataacctgtgttgttgagcaagaataaatcctcgcttatacactcacacacacatgttggtgccctatcctgatggcgctaaggacactaaatccatggctgggtttcctgatgttgtctgccctgcctctaaattgcctcagttgttcccagagactggttcttgccagagtgtctcaaactgaaggacagcagctgccttgggtcttcccattgtgttttttccctcccttgtcctctccttgcctccccagcaggatttctagaaagcttgaccggtacaccaatacacgcctgcaacgacatggattcatccgccctcctgccacacatagttcttgaggcactcaagatgtcctagggtgctctctggggttgcgcttagcttacatttgaaatttaacgctgtgatccatggaggaggcgaatccctcccatccagaggctcaagaaattctcacaagtctctgatttttaaaaattttcccctccccatctccctctcctaccaccagcagtttaatttgtcttgacattttgcttgccctcactgtcagtcaggggcactcagtaattttaaagcccttgtagtttcaatctgattttgcacatttgagatgggcttttgagaagggtagaacttggaactcaagaagaccccatggcagaatctccaaaggggctatggaaatgtatgcatttgaggagcgggtactttcagctacctccaaaccatctggggtctgcccaccttctaggccccagcgtccccatcagaaagcctttgcaggcagctttcagaatagggcttgcacctgccagtcctcccctcagctccgcggtactccaggcaacctcaaggtccagtcactgtagcctgagtcagacctccccagtacccctcctgaacttcctagttgccccttttgccagagatgagggtgcagcagaggctggtgggagcaaggaccgagttgccgccgtgtgccgagccacccacctgtggaagaagagcaggatggagagcatggtctggtcgatgttgcggttgcagatgccctcgttgatcaggtagcaggggtcccgcagcaccggctctagcgaatcctgccgcattatgctgttgagcttgtcggtattgaggttctcaaagaccagcttttcctgcagctgccgaaagttgctcactgtagggctgcccgggttgttgttctccccgctgctgcctcgctggagcccactccgatgggccaggtccaggcagcagttgcagcagtcgaggccgacaggtgagcggcaatcgagcttggactgggccatcttctcaggctcggaggtcgcctggcctgcgaggtcaggggcggctggcaggtgcgcgcccaccgagctggcctgaggggactccagggtgcctggaaaagacaagctgtgaggaaaagagttggaaattagcgcctaaagccagccaccttcggctcggcccccttctggctgtactgctccgggtgcgaatagaaacagctggacaaacagctccgagcggatccttcgggctcacttcctcctcttcctccttctcctccccctcctcttgaggccgggggccgcccccctgaggtgccacacgcggccccagcgcagtcccaagtttcccaagtgtgagcggggattggggcggacctgtggaggcaggaagggcgggcagcagggcagagggagagccagggcgcgcccttgctccctccctcctttgctccctccctccccggtttgcaggctctcaggctctcgggctcccctgggctgtgacggctgagcggtggcaggagctgagagcgagtgagctagttagcggtctgcacgcccgggagtcagcactgggatatgacagcatgtaaattaccctagaggggacggcggagaacggtcctccgccacttctccggctggcgggcgggggccccgagcggctggatcctgtccctccacccctcgccccaccccgcccgcacccttgtgccctggcatccacgctgccgctcgcaccctcgcccgcgctcctgggagccggcccggctctcactctctcggcgagccggacgcttcggttcaggctctttcagcgctcatggcgcatcctccgccagaaatacgcacgcagcccacccgggctgccgtgccccctcagtggcccggtctcgcggggctcgagctcggcgtgagggcaaatgtctctagtctcacctcgaatgggtccccctacagaagagacgacgccctcgagagccccaagtgttgtagccttaaactgccgccctccaaagcccccctttttctggggggggggcgtgcaaggagagcggttgcctctgcagagagtcagagagtgccaggcacacattaggagtacccaataaatgccgtaagcaaaactcagagaagcacgctcaaactctcctcagtttctgtctctttctgcttacttaacgatatcgtcacctcctttccccagctcgctgtgtcctctcttccctgaacccctcagaggcagtctctgtcccggtttccctctgccccttcgccgtctctcctcagtcctccccttccttctctctgctcttctgcttccactcattccactatttcccttattttttctcttttctttacccatttcctctactttctcccccatttccattcttttacctttctttccttatttcttttctccttttctctatttcctcatttcccctttctcccctttcctcttttctctcatttttctctcccctacccccgccatttcccttattttcccctcatttcttacttcagcaccccctctttttcctcacttcacttaccttctcctatttctccaaatttgttgtccttctccttttctgaaccttacctgccaccttagttgatctccgtctgtcgttaccctttcaatagatgtagcgattgcatgttcacaggcctgaggggcgtgccccagctctgtaagatggagggatgttctgggtgggcaagtggtgggtttccagggtttctcaggactcagagacttggaatactttaaatgtgtaggattaaataacgattagtgtctgaaaaaactaaacttttcatgacgttcagttttcacgtaaaactgacttacatttcagtcagtactccccacccccgcatcggctccttcattcacaagtctggcctttgaaatagagcagcatatactgccatctagtgtccaagacgttgaacgttctctgcctgcgtcacagaagctcggagaggcaccagaggtacctcctggtggaatccacagtgcgttggttccaagagtagcagggaagaagtgtaggaggcggagctgctacactaagagagttctgtggccaagctaataggcaggaacacgctcctacactaagagagctccagctaataggcaggaacaccaattagggccagagccgcccttttttctagtggagcttcacttggcctgagtccctgcggattggacttccatagatttgaaacttcctccgggtaccacaagcatcaggcctgtgattaagagcaaagagcggccaactattgtaactcttattcccaaggccctgtgggtcctatatgtgccctgcaacttggggaaaatggaggtggggttgtggtctctatgctgtagcagccggaaagccaaaaacaagccgtacttctcgctcttgacaggatcccaaggtcagaggtgaaagaggtgctgggggtcactgaccatacctgcaaaactgagagtatggtcctttcgttctaacagactgctgaggagtctctatttctcctctcaaaagcaaaccctttagatgtattaatttccctttttcttcttcttcgctttttttttttttaaatgttcttgggtaaaagccagaggaggtagtagaatatgaaatttcatctgcattgtgtagacttatagtctactaaattgttttgtaattacagtgtttatgttttttcctcttgtttataattatttcatgttaaacgttatagcaaaatatattagacccataaatgtttatttaagttgtgttttgtgaactgctgggacttttgtttctatatttgcctgagtccttttatctttgtgcataaccttgggatgaggccctggtagaagtatttccttcttggcatttggcaccattaaactcaagattctgtccccttgacatttcccttgttgtagtccttgctctcaagcagtattgttaataattcagtacagctttccatactatatccaggttgatcaagagtaaatataattgagatataaaaaaactacatagttcagagatagagttcaggagctggtatgtatttgcatacaagtccagcttgtattgacatattgcacacctcctcaggagaaggctgactgggcagggccaccttggctcccttctgtgaagccttgctttgctgacatatattgcgttggatggagagactccaagcagcaaaacgttttgcataaactaagaaagcggaggggggcccccacttccagacagagctggtagctttctgggtggagcagaaagagggtataaggggcatctctttcttggatgaactcattcaacagtcactgtgtgcttgtcctgtgtcaggtatagtgtaagtggggattcagaggtaaacaaaacaggacaaactcccaaagacttcatggtctagctgcagaaacagagctgcagacagacaa

SEQ ID NO: 8802 - DNA, 416 bp, artificial
  synthetic oligonucleotide
atatatttaaggtgtacaccatgatgttttgacatacattgtgaaacgattaccacaatcaagctaattaacatatacatcaacctgtctttgtagaactgtttcatggaggccatatattattacatcctaatatctacagtgttttcttctggagctcacagtctggtgtgcgtatgtgtgtgtgtgtgtgtgtgtgtgtgtgtgtgtccagggtgggagcacaggcaagtaaagagacaatcacagtatatatgataaggattgtcatggaatgaagcacagaatggtgatggaaggaacaaagagtgggcataccaaacacagattggaagggtaaaggaaggcttcctagaggagatgatggcttgaaggatgaattgagaaggacaaagtacttatccaagcccattttt

SEQ ID NO: 8803 - DNA, 984 bp, artificial
  synthetic oligonucleotide
tagtgctcattctctgtgcaaatttgatccatttaactgttttatgccatattttccaagaacatgctgttattaaaagtgctctttggtaatagatcaggcatataagatctaagtctcaaccaaagacagcacaacttccctttcaggaagacttgacaaattggattttatgaccatgttttggggattggagctgtctatttttagtgtgccttgacatgatccttatggtcaggagctgaagtgttcttgtatctgaacacaaatatgttaaatattcacaggtttatacttctgtttccctccttttgacttccctctttttttcaactcaacttaggttttcagtggtggtgtcactgctgccaagctggaccgaaaacggccatcggcatgctgcccaaccagcaccatgtccaaagacctgaaaattctatgtaaagaccctgctttggagctgagctgctaccgggaccatcagttcagtggccgtaaatttcagcaggaaaaattactgaaggaaagctccacattgaatatggggaatctttccttttatacaaccgaagagaaaatacatgaactctttagtagatctgatatcaggaatatctttatgggcctggataaaataaagaaaacagcatgtggtttttgctttgtagaatgccataacagagctgatgctgaaaatgccatgcggtttctaactgggacctgcctagatgaatggattatctgcactgattgggatgtcggttttagagagggtcaacagtatggtcgcggtaaatctgggggtcaggtaagggatgagtttcgtgaagattttcattctggtagaggaggctttggaagacagactcagatctagaacaatccatagagaaaaagttttaactctaaccccttgaaaagtgtgttatagaccaacctcaagtctgcaaatagccaattccaagtttaaattaccttacttgt

SEQ ID NO: 8804 - DNA, 3689 bp, artificial
  synthetic oligonucleotide
tagccaggatcatgacaagattcaagggatgttagaaggctagtgtttggattgtagtgagcaagggtgagagtggaataggatgagttcagagacgaaggcaaggaccagctaatgcctggtcttatagaccacattaaataatttgaattttactctaactgcagtgagaagagactgaagggtttcaaacaggggatgaggataaaatgttcagatttccatttgaaaagattactttggctgcattactgattggaagtggaagtggagagaccaaaataagactcgatgatggattggatgttggacactggggagagcaaggtgtcaaggacaacttcccagtatctggcttacacagttggatggtgccatttactgaaatggggaggaatagaaaccaagagttctgttttggttgcattaagttagtactgtctgtatgatagtcaggtggagatgtaaaataggtagatatgcaagtctggacccaaagggagaaatctgagctaaaaaggtaaaatttggatccataagcttatggattatacttaaaaccatgggactagaggaggtcacctaggaagtgagtgtagatggagaagagagtcaaggactaagccctgaggcacattaaccttcaggggtacaatagaagagcaggaggaggaatcaacagaaccagaggaataggcagtgagatgagaggaaaaccagcaggatgtagaatcatgaaagccagactctaagtgaccaggtgctgctggttaagaaggcatggccagcagtaaggtttaggttgatgacacattaaaactccagaataatgtttaccaatgtaatatagttatccaacatacatgtttattgtaacaaacataattcaggtacgttcaaaatagataaaggcaatagcaaaatatagatcaaagaagactaaaaaatagcagggtgatatggtttgaatttgtggccccaccaaatctcatgtcgaaatgtaatccgcagtgttggaggtggagcctggtgggaggtgattggataaagagggtggatccttcatgaatagtttagcaccatctcctccattgtactgtcctcacaatagtgagctctcgtgaaatctggtcctttaaaagtgtatggcacttccctgtttgctctctcttccttctgctcccaccatatgagatgtctgttttccccagtcttaggtatttctttatagcaatgcaacaatggcctaatacagaaagttggtaacaaagagtggggcatttcaacaaagacacctgaaaatatggaagagactttggaactgggtaacaggaagaggttggaagactgtggagggctgagtagaagacaggaagatgagggaaaatttggaacttcctagagacttgttgaatggttgtgacccaaatgctgatagtgatatggacagaagtggccagtctggtgaggtctcagatggagatgaagaacttattgggaactagagcaaagatcacttttgttatgcctcagcaaagcaattgactgtattgcgctcctgccctagggatctgtggaactttgaacttgaaagagatgatttagggtatctggcagaagaaatttctaaggagctaagtgttcaagatgtggcctggctgcctctaacaaccagcaaataaatgacctggaactggaacttatatttaaaagggaagcagagcataaaagtttggaaaatttgcagcctggccatgtggtagaaaagaaaaacccatttccaagagcagaattcaagcaagctgcagaaatttgcataactaaaaaaaaggcaactgcccctagccaagataaagggaagaaggccttgaagttatttcagagaacttaacagcagtcactcccatcacaggcccagaggcctaggaggactaaatggtttcctgggccagggccagggcccctgctgccctgcacagccttgggaccctgctccctgcatcttagctgctccatctccagctgtggctcagaggggcccaagtacagctcaggtcactccttcagagggtgcaagctgtaagccctggtggcttccacatggtgttaagcttgtggtgcacagaatgcaagagttgaggcttgggcacctctccctagatttcagaggctgtatgaaaaagcctagatgtccaggcagaagcatgatacagaggcagagccctcatggaaaacttctcctagggcagtgaaatgtggggttggatctccaacacagattccccactggggtactccctaatggagctgtgagaacagggccatgatcccccagcccccagaatcatagattcactgacagcttgcaccctgttcctggaaaagccgcaggcactcaatgccaacccttgagagaagtcacggggactgaaccctgcaaagccacaggggtggggctgcccaaggccttggaagcccaccccttgcatcagtgtgcactggatgtaagatgtagagtccaaggtgattattttggagcttcaagatttaatgagaaccctgctgggagcctgtagcccctttcttttgactaatttttcccttttggaatgggagcatttacccaatgcttgtaaccctattgtatcttggaagtaactagttttcgattttacaggctcataggtgaaagggactagccttatcccagatgagactttggactttggacttctgagtaaatgctggaatgagttaagactttggggggctgttgggaaggcataattgattgcattttgtaatgtgagaaggacatgagatttgggtagggccaggggcagaatgatacagtttgaatctgtgccccactcaaatcttgtatcaaattgtaatccccaatgttggcagtggggcctggtaaagggtgattggattatgggagtggatccttcatgaatactttatcaccatcccttgcattgtactgccctcacgataatgagttctcatgagacctggtgctttaaaagtgtgcagtacctccctcttcactctgtcttcctcctgcttccaaccatgtgagatgcctctcttcccttttgccttttgccatgattgtaagttttctgaggccaagcagatgtcagcatcatgcttcctgtacagcctgtggaactgtagccaattaaacctcttttctttataaattacccagtcttgggtatttctttgtagcaatgccaaaatagcctaatacacaggggcatgccatttcttcatactggggacatatttattttaaaccactctctcttaagcagcctgtagggcttgttcacaactagttttaggacaatgtcctattgatgagtccatggcaagagtgcttctcttctcaccatcctgttaaaagcccctggttagaaaagcctttggtcaacctctggatttcagacaactagcttcttcttttgagagcagtatgaaggtccccttctgcagaatctcttacacaacaaaaccatcctctgtggttttccttctggaacagtctgggctctgtgctgctctctgtagaaagtatctggagccattcctccaacaccctcccaacagtcttagcaggaaaaagcagcccatgagctgtccctttcatactgtaggtctgtggtccaattagcttgctt

SEQ ID NO: 8805 - DNA, 4653 bp, artificial
  synthetic oligonucleotide
ttgagtcgggtggtggtctctgagccaatgacaggtcagcaaacaggctgattccagaccaatgggaggatgctggattccaaatggaccaattagcttattagggacctggaatagctggatagctagcatctgcctcattgtccatgtggtaacgaccctcttgttttactggtcaacaatttgaaggtacaagaaaaatcctacttttttttttcttttgatggttttaatccacctccacaacttctgcccgaggccaataaaacacagccattctttttttgtaaaaagaaagagaggttcggtttccttcaattgtctgcccttttctatctcctccactatttttgttttactctgtagttaactttgcatagagcagcttcatagggaggatctctgcggtggacccggctctctcttcttattacccgttgcaaaggcctctttcttgttctaacctgggggtttgtggggttgggggacagggggattggggagtgggagaagagtttagccatagccttccttctgcatttcacacacatttagctatctctgtcgctctgtcacacacacacacacgcacatacacaccatacacacacacacgcacacccgtccgggtccctctcggtgtgtcttccttcaagatgacagggcgctggagaaaaggctgctggaatcagctggtaggtacagtagtaacccgagccccacccaccggctgcctttgcttgctcaggtttctccggtcactcctgccaggggagaagacatgtaaacgtgcctccagaggaagggctgggggagctgggagtggcgggggcggcggaaggtgagcctgggaaggtggccgagcaccccttcttcttgggcccttcccagtgctcccttggggtgtcagccccagccccgtttgcccccactccgcctcccttttggaagggattgccttttttttcctctgcggcggcggaaatgacagtgtggtgctgccgtggtgtcatggtgctgcccctggactgaggggcgaaaactcttaagtttagctcgggaggcccagctgcggtagcatcgcggccgccgtgctgtcccctgcggggcgcgcgggctggcggatcccggctgctgcgcggcgtcggcgacggtagcggcagcggcggcgaaggcgggcggcggcctacagtggtagcggcggcggcggcgaccggggcccgggagctcgcgccggagcccgagccaacccgctgcggaggcagacgagagcccagcgccctcgagcgagcggaggagatggctggcacctgggaacgctatgggtaaaacgcgccccctcgccgcggccctggaggtcgagcgtcgtagccctcgcagggctagtctccggctccggccgcttttcaggtgccgccggggcccggcgttggccgagggctctccggctcggcgaggcagggtgatggggcccgcgaggctcgaaacggcgacgggggccccagctcagctccggctctcagtcatgctgttggggcccgggttcctgccactgccctcctgggacggagtttgcactccggggtgcggggcgggggcggccgaggcctctgcgcagcctggccgggcccggcgcgggcagtcgagcgaatcccccggcgcctgggcgcgagtctgggaaagggcacggccgccttcccacgctcccgcagccggcagcctcctcggcccaggcgtcgccccttggccggccgtctgccgggcggtgctgtcgcagcagccggcgtggctgcggacgccctgccggcggggaggcccggtgaaacttaatcccttttctgccagggagcgatcctcgagtctccgtctggatggttccttatttctggcctagctgtgaaatcagctctgtgggggagagggaaaacttacatatgtccacaggacagactgcgacgcaaccagggagagtggggattttccattcctgccttgtaagaattaagtaaataacggcggagtagatttacagaaacattactggtgatgataaggtttaggttacttagcacttcgtgtgttgcacattatttttcagaggtgtttcttcttagagcaggaaattgaaatcctgcagtcgttgtactctttactttctctcttccacggtcccctacccgttttcaggatcactcaccttcctatgtcacaacgcttacttgcctacccaaatcccccagcagagccccttggaccccagcctttccccatcaacgtgtgcactcccagcctcccagccatgcagcatcttacttctcaaccactttgcctttttgaggatttctgagtgtggggcggatagatggtgatggttgtgtgtctctgaggatgagcccttataaaggaatatattggaaactaaatagagaagtactgtgtgtgggttgatccctctgattctcaagttgggccagaagggctgcctttaaccccattctgctccgtcccagtactctaatcagttctctggcaatattccaatagaagggagttgctgaatagggagttctcctcccctacttttcttctgtttggggagtggtttcattgtaccccagatggttagcttccccctgcccacccccgaccctcacatccccctgtctgtctcctctcatgactgtactgagggagaaactgtctttgctatttttatatattcttgcccaatcaatgaacttaacatggatatgtaatgtgaattagatttttcctggttgctcctcacaacttgatttatgtgtttgttatagtttggatatttatccctgcccaaatcttatgtacaaatgtaatccccagtgttggaggtggggcctgatgggaggtgactgcgtcatgggaacagatttctcatgaatggtttagcaccatcaccttggttgactgtgagtccttgtgatagtgagtaatctctcctgagatctggtcgtttaaaagtgtgtggcacttccccccagctctctttctcccttgcttctgctcacaccgtgtgagaatctcctgctccccattcgcctccctccatgattgtaagcttcctgagtcctccctagaagcagatgctggcatcacacttcctgtacagcctgcagaaccatgacccaattaaacctcttttcttttcttttctttctttcttttctttttttttttttttttttgagacagggtcttgctttgttacccaggctggagtgcagtgtcacattcacagctcactgcagcctccacctctcgggcttaagcaatccttctccctcagcatctcaagtagttgggaacacaggtgcatgccaccacacccagctaatttttgtattttttgtagagatggcgttttgccatgttgcccaggttggtctggaactcctgaggtcaagctgtctgagggcctcgccaagtgctgggattacaggcgagagcgacaatgcccagcctacctcttttatttataaattacccagtttcaggtatttctttaaggcaatgcaagaatagctaatgtagtggttaaaacacaggtccaggagtcaagaagatcagagttcatcccaaatatgatgatacattggcttatggctttaggacattcctatgacttttctttcatagttggtgcacttgtgtaaaagctataatattgtgtactgggtattgttagtcttgacttggtcctttgaagatgaaagggttctgtaaaccctcagcattatactttttttttcctttgagacgaagtctcgctctgtcacccaggctggagtgcagtggtgtgatcatggcttgctgcagtcttgacctctctggctcaagcaatcctcccatctcagcttccttagtagctgggactataggcacacaccatcacacccggctaatttttgaatattttgtagagacaggattcaccatgtttcccagtctggtctcaaactcctgagcttaagggatccacctgccaagtccaagtgttgggattacaggtgtgagccaccacacccagccaacattatacttttcaaagaaagcacttcctttaccttttactgagttagtggattgactgggtgtaagcaggaatcttagcttactgaaaacctttagcttcccacccccagagccaaatcgtatcattgtacgtaggtcctaaatctggtttttctccaatacatgttcaactgaatgaaaacatacatgcaactaggcatacagagtaataatgatcaatttaagttgaggcttgaatcatttctaatgcactctaacctaacaatctgagtcagactaatttgaagacataacctcacccattttttagcctatatgggggcagtttgttagcttctaatgaaaagtgtcataaataatttggggtatggctatataagcatgattagcacctagtagcagagtcaacaatattaagcacctataatgtgcagaggacctctgctgattgggctgaggccccagatttagcccagtattttggcctcctgcttgttccacgccaaactccatacttgcaactccaggattaggtcagggaggggctgtgcaggacatgggtagaggctagggacatgaaag

SEQ ID NO: 8806 - DNA, 1295 bp, artificial
  synthetic oligonucleotide
gccatcaacagatggtgttttcattagccaaagatttatttttcaaagcattttcatattaatgaagtaaggttgaaattagagtcatcttgtcagatctagctctgtgttgttaacatgtgctggcattctgcaaattgctaggggcaaactaaccatttgccataattttgtgatggtaactcaaggcgcatagtctaactagacctcaaattatgtgttcagccctaatttttgttttcagtggctttatagaagccatgagtctcagttctgggccacaaaagaggaacacatagcagagattttgctatgtcctgctctgtactgtgaattatttatgagatatcagttttgtgatcagtgttgcaacaggttgaggtacttgttaaaaacattattctcatggaatcccatgtttgaatggaaatgcattacagttggaaacacaaatttctaatattgtatttgcttggcgttcatcaatctacattatatttgcctaatatatcaatatattcgcctaatatatcaatatattcatttgtgatacatggaatttccattgataggaatttgggccactgctagagaaaattatcaactggattcactaccaattcccactgcctaactcaagctagaccctttcatcacactacagagttattatattcaccttatggccaaatttttgaagaggagtctagacttgcagcctctactttgtcactacaccatactctaacctcaggatttcacaaattcttccaaaaccctactgaaacaccttttcaaaaggtcatctgtgacctctaattaccaaatccagctgccttttatcaatcctcatatttcttgcattctccgcatatttgacagtgacaaatcctttcctgaaacacatttctttcaattatcctcagtttggcccagacttgcattaccctacggccttgaatagtgcagccttcttctaaccagtgtccttcccccatcccctgccctgggctttcctatttcagtctgccccacattttgctgctaggttaatctcctaaatgcagccctgattatgccattaccttgctcaacagcttttggtaagtcctcagtgcaaacaacaacaacaacaacaacaacaacaaaaacaaacaaacaaagaaactacaaactccttatctaggcacttaagacctttataacaggactttggtctccatttccagctgcgtcccccactactctctttctaccctctgttctagccaaaggaaactactagtccctgaata

SEQ ID NO: 8807 - DNA, 2556 bp, artificial
  synthetic oligonucleotide
ttcttgactcacaaggtagttgagacctctggaaatatgttctcaagacctctttgttgcccagtcacagagttcagcgttggttattattctgaggcttcccttccctctgatgcttacaaacagaattcctctggtccttgtctttcaggctctttcctggtacttcctatttctctactccctcagcttagaagcaacataggctcttcttcagctattttcactcttctacttgggcccttgcttcttctgttgggctggaatcagactgttttctgtctgcctggaatcagattttttcccttttgtcatccagagttccctgtctcagaaagaatgacctctttctcataacaatgcccttttcgaccttagctatgagagttcaaatttccctggccctcccagtagaaattccttgctctgtatatatacagggagtatcacgatggtgaatccatccctcagaaacaaatgtcttgggaggagtgcttatgtcagacttgagtacagagagtggctaaatgctccccacaatctgatctgagacttaagaaggcggaaacattcactggcttgctttgttctcctccctttccataattccttggttgtgaaggcagtgaaaaggatggccttggaaaaagccctagactagaaatcaggaaacctgggttctgctgctggctctgtcacccactagtcacatgaacttgggtggaacagcctgtgcaaacctctattagactgcttgctcttccatgaaggaatttcttggttacaggctgtttccttggttggactagaagcttcctgaaggtagcagccatggccatgccacaatcattttggaaactgcagtttctaactggtctctctggcccatcctgttcccctcctatccattttccacattgctgtggaaatgaacttgtaaaatgcaaaacctgtcatgtcactccctaccacaaaccctttaatggttcccccactgcctttaaaacccattatgatctggcccctacctacctctctagcatggtctcccagacctttttgctgtcttcgtcttctctgctgtgaatctccccttcctctagctaactctcattcattccttaaaaatatcacatccttaggaagccttccttgaccatctaagctccccacttgacaactgttggttaaatccccatcttataagcacccaaagattatcctttttacgtgataaacctcttttgtagcactcctcaaacaggtaactgctcagtatctgcttccctgctcattataagattcacgagatgatggcagaggccttatctatctcgtgtattgctaagtgcttactaaaatgcctagcacataataacagtaaaatttgttcaatggtaatatgaaatgacctgtaatgtatccacataaatgagtgttgactgcttcaagaattgggtgtatcctccatggtaagagtgatgtctgtctataatctttcatgttcttacggctttctgaaaaacagtgctattattgaaatatctcccataaacattataaaacagtaaaacagttaatgtccttttgatcctataatgtagtattacacagatcttctcacttcgggtaaaaaacacagtctttgtcagtgcttctttttactgctagactatgaaactatgaattttgcttattagctgaaatattactagaatgtttatattttgttaatatctcaggttaacagtctgctatttgattctttaacctgtcttgaaaaggcatgtatatgtctcattattacttaaagaaatcgggtagctgatttgagaatataccattatgttaactttttagttgattctatttttaacatgaaaataaacaagtcaatttaaaacttttaaaaaggaacgattaagtagatatattttatcttgtttttggaggaatgtcaatattgtgaagcacttttccaagtccttttaagcagaatatgagttgacttattaatagtaatatgctcactgggagacagtaagtggaaagaaaagtgatagacttgagtctgtctggctctgttttataagctgcgtacactgaacctcattttattcatctaaaaaataggatgatagtatgtactttgaagagttattctgaaagttgaaaataatataaagtactagcacatctaatgatgtccttttgccatctgtactttatatgctgttcattcattccaaaaatatttaagcgcatttctgcattgggccaggcactggcaacataatggtggacgtcgcacctgtcttcacagaacttacactccttcgattttccatctgtaggagtactgctcagctcagccttcacctcctttaagaagccatcacccatgctctaagcctcattccctgcctccctcatctggttcaggtgttcctcctctgtgtcttcagggtaacctgtgcatactttcatcatagcacttctatataccgatttgtctccccaccagactaagctctcaggccgagtatggtgtcctat

SEQ ID NO: 8808 - DNA, 1017 bp, artificial
  synthetic oligonucleotide
caggctgatctgctttaaccaagcacgttttctatttttctgcttatgcttttgctcatgctattcatgtaattcattctgcctaaacttgtctccccttaagctccatttctagctgcccaagtcttgctcatccttgaagaccagctcagctacatgaaactttatctaatcctctgattgtccttttccaaattttctctttcctatgatctcatacacctttaattgtattctattatattacttgttttgctggtctttaaattataattagttgtattcacactcatagtctctactagactgtaagtgccttgaaggcagaagctgagtcattttcatcgttatatcccactcagggaaacccagcactatgctggatacatgtgggatatactgtggtatgtgggagacactcaataaatgtttgttgaaataaaaacttccccaaatgaactttaatgccaaaatttcacaatattctggtgaaagggagatctatttgggcagaagatttcagagaataaactaggctggcatttactgtgtagagtggagagcactgagacggagaagccagtgaggaattccttgccatataattattattattattattgcatttcacttgagtctgggtatatgggatcatctactatttcatatatcttgttccatctgaacaggaaatctcagtgccttctgaactcctgtgcaatgatgcactataggactgatggatgtgactaagctgaggtgaaagtggaagtggggaagttatcgtgggagtgggttggagggaaggctgatgaactttaaacccaggaataaaataactatagaatgagcaatggaatatctcccctgccccctccccctccccccccccaaaaatcctaactatcaaataagctctctgaaagaagctaagggtaaaaaggtctagtccatttacatttcaatacagaagagaaacaattgccaaaataactttttgcagtttcttaaatcttt

SEQ ID NO: 8809 - DNA, 1692 bp, artificial
  synthetic oligonucleotide
caggtttctagcctgggaactgaagaatcatgatcataagcgtcaagtgtgagcctccatacagctatatggttttaggcttgttggcttgctcgtcagtgttagtggttataagttcatgctgtgtgtataatgtgagatgttttgagaggctagagtgatcactaataatttgtgccatgctgagtggttatagcttatccaggaaactaaagtttccaagaatacagatttgtgaacacacaggtatgcataaagacacttagagaaatatgtacatagaactgtagatactcataaagaaaaagatggtactttttagtaaacatatatgtgaaaatatattgacaacaaaatgtaaacaaacaaaaatgtaaacaattataatctctgggtggtagtgtttcttttatactttttattttctgaattttctataatgggcatgcattgatttataaccagaaaaattagtgttactaatacacagaggaggtagataaccgagagtatatgactgtgttgcagcctaagtatgcaagcagtagataagagaaggaggggttggcacaagagacacagtgggtagggtgagaaggtgagtggttagtacagggaccatggaatattaataaaccttatttttagaatcactgcagcatgcctccttcatgttgttttttattgtttttaattaagcactgcatgttttatcttatttttttcttttactaattccttaaaggttatgaaactgagaaagttggcacagcaggttgctaattgccgccagtgtcttgaacggtcaacagtcctcatcaaccaagctgagcatatcctgaaagaaaatgaccaggcacggtttctacagtctgcaaaaaatattgctgagaggtcagttccttatattctttggaaatgcctgctcttgtgaaaagaggccaatttaaagtcacttaaagttcaggcatgtatctaacagctgccacctgaagattttaccagttaagtagttattgagcctcagtggtaaattaccctttggatttctggacccttgtctctgtctctgcagcctatcagctcttttaaggcacagtcaagtaccagccgtagctattgccatagctccttgctgctcactcagcgcatgagttttctatgatggtgttggtataagggtagagaaacttttagctatattgataggtgcgtgctcttctcagtctgcatgcagtttctattgctttcatttagttattctgcacataaatcctttatggcagtaatttttaggcctttatttaatcactcacccctttctaaattagatgagagtcatgaaccttcttccagaggaaaaacaatgcatttaataaatatacacagataattttctatactatttcagaggacttgcagatccttagaagcccatccatagaccactggcaaaaaaaccagggtctaaagtgaaacattgttcagtatagtcaccaagacttcaaggggctgcagaggctcataaggccagatttgacctccatatatctccttctcattcattgaagaccttggctccaggctcgcagtgttcctcccattgcctctgccatcattttgggtgacttcagcaacaaccacatggctgactcatctaatgctttagccatctagcttctttaacatccc

SEQ ID NO: 8810 - DNA, 1015 bp, artificial
  synthetic oligonucleotide
agggaaaaggagctgagagttttaagactgcttttagtataatgtcaaagatcagcagaaagtaaaactcacatatcctgccagaatgagggaagggtagtctctggtttagtgtgcatggatctgtggatctagttgttcctcatgcaaactttcaactttctgtggcactaaatcaacttgatgttgttggcttcctgatctagctttctctggactgttattggttaccacacattcatccctttctagcttccaaacatttgttgacaatcttttacttgttggcatctcttttccattctctttgtctttgtgggtttatgacatttcattctttgactgttatttcagtgagatttcatgaaagcaaaaataaaacatatattcaaaccactgtatttaataatctctgctctccaaccctctgaaatgttttgtcccactaccacaccattgaaagtattcttttcaaggtcatcaaatgaataccttgttgctaaatataatagacacccctttgtttcatcttacttgatctctcagtagcatttgtcctcctgaacatttttacttgaaatttctctgcccttaccttccatgaacactcctggttttcttcctactttgttgtttttgttttgttttgcctttgtgagcaatgtttccttggcctattcctttaatgctattgttctttgtgattgtgtcttaggttattctcttctctcattacacgttctccttgttgcaaactcattggttcctagggcttcaattaccatctagatggttatgattcccaactctttatctgaatcttctttgcataggctcaggtataacctgaggtgtaggtggaatagatgactatctatgtagtatgacttgagaatcatctactcaccttcaatactggtctcccacagggtctgaaattttcccccaccattatgcattgtattgtgttaagccaccatgacttcagttaaaatgaaattttagctgggagaga

SEQ ID NO: 8811 - DNA, 2396 bp, artificial
  synthetic oligonucleotide
gaagataaaactatcatagcactatacaatctgaggataataaagtgaaatataaatattataaaagatcacataggtcaggtgcggtggctagctcatgtaattccagcactttgggaggccaaaacgggtggatcacttgaggtcaggagtttgagaccagcctggccaacttggcaaaatcccgtctctactaaaaatacaaaaattagctgggtgtggtggcgggccaccagctagggaggctgagacatgagaattgcttgaacctggaagggggtcggagaggcagagattgcagtgaactgagatggcgccactgcactgcaacctgcgtgacacagcaagactctgtctcaaaaaaaaaaaaatcacataaaggatatatttagggaaggtgttaacctagcatgctgacttgctgactagcataaacaaaaaagaaaaatctctcttaaactgtttttaccaaacctttaaaggtctagttttgatgctgtctgccagatggaaaatgatgcagaggggaaaaaatcctgtatttacttctcaaaattaagaccggatgggggagtgtgtttgaggggtgaacatatgtgaataaatatggtataactcttaattggttcctgatgattaaaatttaaatagtttccattggaaaggcagagatatgatattttcactaaataaatcaagccttacaagtcatttattttctccttgttaaaccagaaatcaaacactgggtgaaagttgcaacctattttgatgtatattgatgtacttttctctttttcagggtcgctatggcaactgcatcttctcaagttctgattccagacatcaattttaatgatgcctttgaaaactttgctttagatttttccagagaaaagaaactgctagaggggttagattatttaacaggtgtgaaaatactgtgctttcctttccatttaattttttttcttctggtatgcttttacttaaaaataatttgaaaaagacaatatttataatttacatattttataatctttaaaatgatgcatgtgtcttttcagacagaatatattttagttcatgtaacagaaaaaaagatgatttatgatttgttaactatttctagggtcaaaatgggtataccatctgtacttaagagtaaaacacaagaaattgctgatagatttgtccttatgaatctaacagtaatgtattgttgctagttatgagagtagaactcaggtgacaattagggaatattagagaatgccttatgtgggtgtaagtacaaccaaaatggttttaaggaaaattaggagttagtagatcaggaagaaaaatgtaagaaatatctggctctcagacaattttagaaaatgagggatgcaaccagcctgttaaaaatgctggctactttcaggattatttaatgatcatttcatgaaaaaaatatacacaaacaatttttgaactgttttgttactatattaaatagctgctccttattgaacatctactttattctagacactgtatattaattttgtatctttaaaccttacaacaaatctataagttaattatcacccctattttatagatgagggaactcattattttgcacttgactatacagctaaaaatatataatggggctgggcacagtggctcacgcccataatcccagcaccttgggaggccgaggtgggtggatcacctgaagtcaggagttcgagaccagcctggccaacatggcgaaaccctgtctctactaaaaatacaaaaattagccagatgtggtggtgggtgcctgtaatcccagcttctcaggaggctgatgcaggagaatcacttgaacccagaaggcagaggttgcagtgagccgagattgcgccactgcagtccagcctgggcaacaagagcaaaaatctgtctatatatatatatactcattttgaaatttaaaaaaataagttgaagaccgtatgttaagaaaaccatataatcactttaatgtctacataagtgtttatgcaggcagactagacagctggggcagtcatcacaaaaatttaggcttatatctttgctaaaatatttttattgatgtagcaaaagtggttttagggagcttgagatcccagcattttgcttcaggttgcatggttcatgcaatctaaagattctctattaagaaaatctcttcaagagatgttgggttacgcaggaagagtaacaattgtaaaattccagaagagaaagtatgctttccttactttcttttccacctttccttacagccccaaacccaccatctatccgagaagaactctgtactgcctcccatgacaccattacagtccactggatctcggatgatgagttcagca

SEQ ID NO: 8812 - DNA, 441 bp, artificial
  synthetic oligonucleotide
gatttttaactttcttcccacctcttctaagatttgaaatgatcacaaccaatgatgtttcagattatgctgtgaggtgaatgagaattccaacagatatttgagtgtgtttgtcttctgattactttattatctttcctccgtttgaattttgtgttttgcattacaaaagcattagccgtaaactctgcctagccaggcggaccataacatactaccagaaagacataacttctatttcccttccttttcattctcatgcaaatactctctaccacacatttacactcaggttcagggatttccatattgtaatttttcccttttgaacaagaggtatacttccactgacataattcaatcataagtcccatcttactaaatctcagtaatacctagaggatcatatatttacctttttaaatttagaaatgatttcaa

SEQ ID NO: 8813 - DNA, 1615 bp, artificial
  synthetic oligonucleotide
tcagattaattataagccctttgatcagatctcttgcaaaacattcatgacttattattttcaattttcaacctcactaaattttgtactagagttgcatagaaatgactgaattcactgcttatattcctcgcctttccctttctaccctctagtagaactgtggctaaaaagtggtaaactaactgaaaagcagataacagtagaaagaagtctaaataatctgcagactagaatgttggtttttcttttaccgaaagcttgccaaatacatgttttaattatttacatttcccctgtttaagttaatatttgcagtctaaaatatatcaaaagcagaagcctagttctctgatccctttccctacttggaagggaggaagattccagataacaatgtgctcctggaccactcaacccaaaatgaacatgggaatcacacaacagaatgtgttgtgtaatagtggggagatgatatcttgctttggttatcatgtcatctctttggcttccctacggtactgtggagaccggctagtttgggaagtaagggtaaggatggagtaggagagtggaattgtaagccctgagagcctcactaccttgcagagacaaaagaacattgttgttcaccccatgaactgtgatgtagtagagagaacactgggctaccattttaaaaataccagggttctattctcagcaccatcactgactatctgtggccttgggcaggtcacttttcttctctcaatcctagtttcccatttgtaaaataagggaaatacagtatctatgtgtccctttggctgagtttccatgtttccctgctctgcacaggattgctccatccatacaagaccaaactcagctctcagaggagtggacgtttggagtaaatatccagagactccataagagtgatgattccgtgactctgtatagtagccattcctgtgttatctgggaaagaaattgaaataacctaacttatgctagtagttccattcaattgccacaagcaaggagcctggcctaagcctagttctatgggagtaatgaaatagtggaatcataagccctggttcatctcattacatcttctaagactcaaaagaaaacaaaatgaattcacttttgagggggtggcttatgatgaattttcagtgtgtttttcattctgtctctcttacctgctggttaatgtccttgtctttccccatgttacaggcctgtataattcagtagacagctggatgattgttcccaacattaaacagaaccattacacagtgcatggactccagagcgggactcgctacatcttcatcgttaaagccataaaccaagccggcagccggaacagtgaacctacccgactaaaaacaaacagtacgttgtggtgatttcaaaaggaaagatcaattttcttctccatgccaggggagtacacagcctgagcaggcactcacagcagtgcatggggagcagtggtactgggtagaggagctatactgttgtagtttgtactttgggcaaggagtttgttggtgcccatgggagatttgtggactcagagatatgcacaaaaagactgttagcttgggaggatgtt

SEQ ID NO: 8814 - DNA, 3401 bp, artificial
  synthetic oligonucleotide
ataagtctgaatctcagaggagagggctagactaggataaacgattgggaatcataaagataactgaaataatgggcatggtgtagattgcccagaaagagagtgagaggccatacagccctccagctctgttgcccaagggcaggagcacttactacacagtaattgtagctggaggattgttcctattttggggagtgcaaaaaaatattcctagagattgggaagagtgtagggtgtgagactataacactgtgctgagaacattccatttcataagaatgaacgtgttatgtgaagattttaatggaatgtaacatctttctgtcaaagttacaataaatgccatcttattttttctgtaacatttatcatttatattgcaccagggcctgtgttgagtgttttatgagtatcatcttatttaatcctcacaacaaattaatgaggtaggtattattatcaaccacattttacagtttggttaccgaaatctcagagagtttaagtaatttactcaaggtcatgttgctaaaaagggtagaaatgggacttacgtaaggtctaccagaatttaaaaaaatttctactctatataagatgatacagcaacacaaacattagctatggtttaggattcttgagcccctactgtgtagcatgcaatgtgctgaatattttacattatctcatttaatcttaataaaaccttatacagaaagtaccgtcattatccctacctaactgataaaactaagacctggaaatattaatttcctggttgtcacacagtcagtaagtggtagagtcagtacttgaagacatttgcttgattctaaggcttatatgtttcaccaacacgcacttttctctaacaaagataaccaaatcttataagagtggctctcttctctggctttgtactagaatcacctgcgaagttttaaaaaaatgatgctgagcctcatcatcaaagattctgatataatttaacagtaatgtggacaagtcattgggtttttttttattttttattattatactttaagttttagggtacatgtgcacaatatacaggttagttacatatgtatacatgtgacatgctggtgtgctgcacccattaactcatcatttagcattaggtatacctcccaatgctatgcctcccccctcccccccaccccacaaccgtccccagagtgtgatgttccccttcctgtgtccatgtgttctcattgttcaattcccacctatgagtgagaatatgcggtgtttggttttttgttcttgcgagagtttactgagaatgatgattttaaatttcacccatgtccctacaaaggacatgaagtcatcattttttatggctgcatagtattccatggtgtatatgtgccacattttcttaatccagtctatcattgttggacatttgcgttgattccaagtctttgctattgtgaatagtgccgcaataaacatacgtgtgcatgtatctttatagcagcatgatttatattcctttggggaactcccattcacaattgcttcaaagagaataaaatacctaggaatccaccttacaagggacgtgaaggacctcttcaaggagaactacaaaccactgctcaatgaaataaaagaggatacaaacaaatggaagaacattccatgctcatgggtaggaagaatcaatatcgtgaaaatggccatactgcccaaggtaatttatagatccaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacagtaaccaaaacagcatggtactggtaccaaaacagagagatagatcaatggaacagaacagagccctcagaaataacgccacatatctacaactatctgacctttgacaaacctgagaaaaacaagcaatggggaaaggattccatatttaataaatggtgctgggaaaactggctagccatatgtagaaagctgaaactggatcccttccttacaccttgtacaaaaataaattcaagatggattaaagacttacatgttagacctaaaaccataaaaaccctagaagaaaacctaggaattaccattcaggacataggcacgggcaaagacttcatgtctaaaacaccaaaagcaatggcaacgaaagccaaaattgacaaatgggatctaattaaactaaagagcttctgcacagcaaaagaaactaccatcagagtgaacaggcaacccacaaaatgggagaaaatttttgcaatctactcatctgacaaagggctaatacccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtcattgggtttttttaaaaagctattcactcattcaatttatttgataaatatttagtgaatgtctactctgtgccaaacactttctaggcatttacattctagcaggatgtatcagttagctattgccacagtgatgtgtaacaataaccacgaaatttccgtggcatgaaaaattaatcacttattaagaatttatcttcacagatctggaggccagctgggactcagatgattaaagagggctctgttgggtaactttattcaggctggggtcactgtactttccttgccgcagtactgtgggtaagctatggtggctctgcttcatgtatttctcatcctccttagaccagtgaactagctgggtctcgtttctctgtggcttctttcatgaatcataagagatgacatgtccaactctggtttcactccattaaccaaagtctcatgaatgagctcaaagacaggaggtaggaaaataagctccagttttttgtgtgcggatttgcaaagttcatgacaaaggttgagaaaggggccagtaattcaatttaggtgggaaagactaacaaagaacaataagcctaatacataagtaaattatcaaatatattagaaggtgataagtaatatttcaagattctaatgtgtagctaagactg

SEQ ID NO: 8815 - DNA, 3665 bp, artificial
  synthetic oligonucleotide
cttggatctgccaccccaactttcttttcctcccagactgccactgctctcccccttagttttctttcagttgggtcttatcctactccatgcagcttgacgatccttttctctccttccattccccacctttaccccgtagttattccccaaagtacccaaagaggatcccacccctgccctgcctttccatcttcacttacttccaagcactttgtccacaacacaaacacacaagcaggtgcccccttgttttcacacccctttgccttatagatcaatgtctgctcttcttctttcctcctgttccagaggaaaaggcagcccttgcaagccacccaagccagtaaattcacttcattatttttgtatttttgtgaataattattttactttcataacacagaggtatataaagaaagaaaagccctccacccagctgtcccataccccatcccaccctatatccccataccctgctgcctcctatcccctgaccctgagcccacccccaccccaggtaccttgtttgctaaatatatttccagaccattttctatgcttacacaaacataaaactgtaacgtaagacaaacataaatacataaatttgtaacattcatatacacactcacagaactttggggagttttgttttacaaaaacaaaagcaaccttgtcatatgattttttcttcatttaacaatacaggggccatgcctccaatacagtatgcaaaatctaccacattctttcacaagtgttttgcattttcaagctttcttcagctatctccttctccatggctcagatttctcccatattcaaaagaaccggctgggcacggtggctcatgcctgtaatctcagcacttgggaggctgaggcaggtggattgcctgaggtcaggagtttgagaccagcctggctaacatggtttctactaaaattacaaaaattagccgggcgtggtggcacatgcctgtagtcccagctactcaggaagctgaggcaggagaatcacttgaacccgggaggcagaggttggagtgagccaagattgcaccactgcactccagcatgggcagcagagcgagactccgtctcaggaaaaaaaagaaaattaaagaaaaaaaatcctctctcaactgagtatctcacttcaatccttcccttcacaaccaagaatccttgaggaagagcctccctcactgactccacatcatcctcactcactcctcacttccgcagtttggcttctgcccttgccgctcccctagatctgctggaagatccaaagtaaatgccagacccagtggatacttttcagctcctgagagggcccctcagctttattgacctttttctcctaattcttgccgttctgactgctcctaagtacctcattttccaaccagggacaattttgccctctagtggacatgtgggagtatctggaggcatttttggttgttacaactgggactctgagggggtggatgctctggcaactagtgggtagaggctaggaattctgctaaacatcctacaatgtactggacagccccctgcaacaaagaattatccagctccaaatgtcaagagtactgagactaagaaaccctgccctagagatatagaaagaaacccaaagacatttctgaaactgcaggccaggaacctggccctcaatcctgattattgttcatccccaacaggagaaaacctaaaaatcaagtttagctgcagcagagatgccccagggccatgacagcttcttagtctctaggtccacagatcctgggcaatatccagggctccttcagttgtgtctcagtctggtccaggtgtagccccttctcatccttccacctgtgcgctaaaacatacatgtagcccccgtcaacaaaacttacaatcatcagagggagagaagcagactaacccgtcacctacccccttaccgtacccactcctatcctcctccacctcaccccttccctctggaagttgatttcccattgggatatgtttctgttctgttctacatttctgaattcactgagagctttgtagccagatttccctcccacatttatcatggtggtgggttgggggagagaatctctcaagatggcaccatgctttggctcatagtctagaccagcaaaccctctgagcactatcagttgctgactcacctccttggcagtggcagttctcttttcagatctgactgccctggttctactcactggggactggaaaggattctcctgtcatggggccatacagtcatagcagtctgcacctgcatggtgctggtgtcttctgtaggtaggcctaagggattcccttaggggtggcaaatctctgctgttgatttgagtcaggatgaacctggggttcatcctgggcctgttttgattgtttcttgtgatataactcactcagagcatgaatgaacttctatccagttcattcatggaaactcttgggattcaggaatctccactgctcaccacaccctgatgcaactccccagccagtcccaccattttctttaatggtcttttgttcaaaattgctcttctggtacaaacttctgactgggaaataatctggttgctcagaacagaaactcactcaaattagtttaaagtaaaggggatctgtgtaaagtacattttcctgtagcacaactacaggaagtgaaaagtgattgggccatcactaccctctccatctctctgtagtcacaggatgaactcctctatgcctgtctgctccctgaaacctcatactggcgtcctctaaaagacacttgactctgtaaagcatccagttctgttcccccacagccagggccaggcctcagctatggccttggtgtccatggctgtgaccctggccccaactccaagtgacccactgcttcattgcccaacactattctgactgtggaatctgcctgtctgttcagattttctaacgtaaaaattcatttggctcaggattggtcaaatatccactcctgctccaattatctaaagcctacatgaagggagagagtgtaggtgttacatactgcccaggtccgacagatacttaagatagggagctagagacacacacacaaataaaaactgcagtagttctggagtgttgactactaatactctgaaatacaaatggagtcattaaaacatgtctctccctgcctgtcatctacatcctcccacccacaaccccgcctccccgcccccctactgtccaatcttcccactcatcccctttcccccactccacccaatccccctcccacctctcccctctccccctgaagattgatttcccattgagatatatttctgttctattttacatttctgaatttactgaggcttttgcagccagattcgcctcccacagaggaagcaattttccctccatgaaaaattcacagctttacaccacgggcagtcccagttccctggcctgcgatatactggaggtcttctctgctgatggagttcggagtctctcctgtctcttgggggctcttgagggtctattccctgggcctccacatctgaccacaggctagcatcagaggccccccagttgaaaggcatctgagttggaacccgttctgtgacctttgct

SEQ ID NO: 8816 - DNA, 1209 bp, artificial
  synthetic oligonucleotide
gaattgtgtttagcaaggtagaagttttacaaaacaagttcaaggcaagggagcttagagtactgtcaagagtgttatcaaaatgatgaagcatgggatctaagttaagtaatgagggaaataaaaaaggagatccttgatagacttggaggaagtagaaggatcgataaactataggagctgagaaatgattgtagtgttagtagttgaaaatctgtgaatagggggttgtggctagaggattggatggtacaattcatgatttaaactaacttgtaattctggagtgaagtggtttcagataataacaggatctctggtatgactatcagtgtgtgtggctaaggtgaaagagaaaagccacctgagatatggatttcaaataactgagtagtcagatgttgcattgtttatccttggggatgttgaaatcactgaggatagtggcagatcttgaggtaggaagaaaggatgtgaacaggggccaaagtcattgataaatgaaggggagtggcccaaaggtaaatctaggaatgactagaagtgaaagaggggatataattgaatgaactcaaagcatcaggtttgggttttatagtttacacttttatttcagtagcataggaatttaatggtctgaaagcagaaatgggggcaaggaggacaccaaccctacccttcatcttgctctgaggacagaaaagaaaagccctactccaaagggctgcagtggtggcccaggtttcacttaaggtcagggatgaagggaactcttgatgacaaggctgaggatatagaagggtttgctggatacagtgagacaattctagagggcacagagaaaaatttctagggctgggagaggaatggagtgctggatgaggagtaaggatgtacatggcattataaggatgatagtggaatagaggctagatgtcagttgtaggagaagtgatgaccacttggatttagcctcaacagactcttgaggagtctgtggatttagcctcaacagactgttacagggaatggaaactagccctaatggccagagtttcctcagtgtagcatctatagtctctacctatttgaactaacatggtggtaaacccagaagttacggtttctgcactggtatgatctggaatggcactagtcccagatgaggtggcttcagtcttgatccttgtagcctctggtagtggtgtc

SEQ ID NO: 8817 - DNA, 1282 bp, artificial
  synthetic oligonucleotide
ctatgggtcttttagagacttggtggacttagaagtcaaggcagaaccaagcctgagaaaaggtggtatggatctccagagacccaccctacaagttgtcctcctttgcaaaatcttctccctcaaactatttctctttattgcattgcctaattctcctggtcagagatttatgtgaggaaagtaagcactgtatttttaatagcacaaacaggttggagaatgttcaatgaaacgtttttttttcccttcctaacatggagctgctgtctgcttatacaggggaaagggagggtttctgggaggaatagaggtgaaaaggaaaaagtaattttggagcatgagatattctggggaatgagactctcccttagggcaaactagggacccaggagccagggggccgtgaaggtgggaggcagaagagaaggtggatgtcagagacatgcaatagttatttgggggaaaatgttgatttgtgcacaagtcatatcttgggaaatgaaaggaacgttctttctctgtcacctgctgttcctcctcaccctccactgccttatacggcccagtacgcagaattcaagccagtgctagattatgtgctacatgcctgacagtgagactcatattataacattgcttctgcaggagttcttgcgtgcagtcaacgagtttaccattacatcttgggacacgctcattttaaagttgggaactgcctgtataagacatggtccctaccctggagggattcacagtgactagatttaaggtagaccagttaataaatgcgaaactactggagaataatcaatggtcagctgtaggatattggctttaagtaaaatggaaatttatgctagggtggtatgtcggttcattgaaattctcacataggacagtatgactgatctatgctaagaatatacttggctagtaagaggaggaagaagaaaactctagtgatggaaatcacctggagccaacgtttggcatcagacatgagcatggacaggataggctgcaaggaggaatcaggcatgatggaagcaaaatggctttctaagaagcagtgggagattggaatggctaaagtaagatggggtcaaacatttcctgtaaattaaagacaggaacataaaacatatcacttgaaatttgtacacatttcatgtgactgaacactttgaggcaataaatcttgacatactttttcaggggcatgagttaatgtggctaaagttcagatgaggtgaggatcagatattggaagaatgggaat

SEQ ID NO: 8818 - DNA, 1410 bp, artificial
  synthetic oligonucleotide
gtgaagggcactcttgatggacagcaggctgaactccaggtaagaaacaacaagacctcaaactgtcaattagaaagtaaataagccccatgctgcctagtgaaattgaaagcctgatagcgtgggtgccaactcaaatgaaagtaatcctctgatgtattgaacctccttctgtcccacttgaatacctggagttaatcctggctttctggtttggaagtcaaacaagaccattctggggcaagagtttgtgatttcagtaggtgtgaatgaatgaattataaatggctgcatttataatgcaagcaagaaaacacgttgatgttagaaaaaacgggagagaaacaaatagttttctctgtaaatgtactcttttcctgggatttttccctcaaaatccagctttctgccttagttttaaaatatattgactttctgcttaaaggagaatacatttgaattcatctagacaatatcttttggttttctaattgctttccctcttttattggcctgttaaggtaaagcccacagtacaaggaattaggaaaattggattccagatctgtctcaaccgtcaattttgccttttattttttaacctctctgggctttggtttcttctgtaaactgagggaagtgaattaaatgaactgtaaggccttccagtagattttatgaaaaattagtctcaccagactaagacaatacagtttattgaacaataacaatcacttgaataatatacatttacatgaaaccaacaaaacatgtacatagaaggtgtgtattatgaagggacctcaggaattacctaatccagtgatttcccagcttcagtcattcatgtaccatctacatgatttttgtcatatttgtgtatcaccagcactatttgttatttaatgttattttctgtattgacttgttttcttaaaatcttaaaaaatatctaccttaatctaccctatgcaacaatattcaggaagtcatagatttaatgtgctagatttttctgtttctaatacacattgaaatttgtaagttttcatttatatactacctaaaatcaacttaaatgcctatacttggtaaatacatatcatactttggaaaacattactctcttttctcattcagatgtggaaagtaaaggttggagagattaaataactttgtttcttatctaaaaccaggctgccatggaggcatgactagaggccacctcccctaactatatcacagtgaggggcagagctgtgactaactcaagccacctgacccctagaccaggaccctttccaccacatcatgctgctcccacagttgccattatgatctaagtatctatgctctttaatagaaatgggactagaatccagatcttaagtttaataagttataataata

SEQ ID NO: 8819 - DNA, 1521 bp, artificial
  synthetic oligonucleotide
ccaacatacattttaataattttttttgtgtgtgtggagacccagtctcactttgttgctcaggatggagtgcagtggcgtgatcttggcttactgcaacctctgcctcccaggttcaagtgattctactgcctcaccctcccaagtagctgggattacaggcgcccaccaccacgcccagctaatttttgtatttttagtagagatggtgtttcatcacattggccaggctggtctcgaactcctgacctcaggtgatccacctacctcggccttccaaattgctgggattacaggcatgagccactgcgcctggccaagaattttttttaaaaataaataaacacacatattattcaaaatgaaagtgaggaagtgactgcaattgtcacagaatgccattcatcctaaagaatttttattctttgtcattgccttacagtgaaaccttctaagcccctttgtagcgttcaaggaagaccagaaactggccacactatttccctttcctgtctctctgcgcttggaacaccttcccctgtgtactactggcataaacttgagggaagagacatcgtgccagtgaaagaaaacttcagtaagtgtaacctgcagtagaccctggaaaggcctggtgtctgtggttggatgacagcaggagtgtgtggttggctgcttgaccttacagttcaatcttcttgttttctcagtggtggcgggtggaggggggcggctggtaatgtaaaaagaatgcctgtctcccaacacgatgattgtgttctggtctactccccaaattctaaaagccagctcagagatggtgaatatgtagggaacaggcatggtcccaggtgagttagcactggaacagtcctgaggggcctagttgaatcctgaacatctcaagaaagagaggccaatatgggggagtgggtggacattgagtgatctgttacactgatgttatctgtatgcacagaagagatctcaaaagtctattccctggtttcaacagacccaaccaccgggattttggtcattggaaatctgacaaattttgaacaaggttattaccagtgtactgccatcaacagacttggcaatagttcctgcgaaatcgatctcacttcttcacgtgagttgaccatacaactttaacggtttctccttaaatcaagtagtctgggcctgtcagacaaataaattagttaggatccccagttagtgcttcctgcttctctggagatttgtgtgctttatatacaggctgatatgatgaatgaccatcctaatatctaatgctcacataataatatatgccatatgctgccctaaatcctttacaaaaagcaatttgtttgcttcacaaaatcgctagaaggtaggtattactattcaatactaaaaaagaagcctttctgataacagcaggctgaatttctctttgtgatgctgttggtaaatccaggtgacactgtagctctgacaaacatataccttgcaaagatctgccactaataa

SEQ ID NO: 8820 - DNA, 564 bp, artificial
  synthetic oligonucleotide
aaggctcagctctgatgccaccttttctaggttgtagaaagcctattcacccccagttggaattaattactgtatttatttccttttctttccctgtcttccacatcactttcctttcacttattgcacttctgttagttgtttccagacctagcctctccactaaaaagcttttggaaggtggagactgtatctcactgatgttttaccctctatacttaacacatagtaggtatactctataaagtttatggaatgaaatatgaatgaatattcagctgttaccctacctatcccctgtggatgttgtcccaagttctttaagatgtgatttgatgtatgcattgctgagaaggctgttttagcaccagcagtgtcctggcatgctgttagaattgaaagacctataaggaggttatcctatatctcagacccctcctggccctgagattctatggccttttaatttcactttagagagtttgtggtgcttctttctttagcacaagctccacagaatctaagatgaattgactgaaattcatgtcatgaggtataagtgtt

SEQ ID NO: 8821 - DNA, 908 bp, artificial
  synthetic oligonucleotide
gctgcaggattttcccccagaagtatggctggtgtctacacacactgaaggggcatctgcctgtgaagtagctggtggttctgaggcctgtctgcatcctctcctctagtttaatccaattgtcagtataccagtgaccaggagctgcaagtcctcctcttgtgaaccattctttcactactctgggatggatttgaggttgagaaagcacagactgatggttctctctattctgatagataatttcctgaaggtcaatgccatcttcttaagtattgcctctagctaaaagtaccatttggcttttgtttgttggcttaattgaatgttctttggagatgtgtgtatttgtacactgaaagtaatggaattaaccctacactttgaagatgatcttcaagttaaaatatctcgcagcatgaggaaagagggaaagggacagagagcaagggtgagaatgagagcaagactgagagagtgatatgtatgtctgagtaaggcaatgagttaggagagagagaagcccaggcagtcttccttctttattgctgagaagtcacatccacagagactggcccacatcctaattctgggccaacagctccattgtgcaataccaaaggtaattctaagttgtgttcttttgctttcccccaagggatttttctgcaaagaagaaaaagactttgataactggtgtagccttgttcagaaggtaaagctatatgtttttcttagtctgaaaaatgaagttacccaattttattccttttcaagattgtttttcatagtaaaaaaaaatcctactctgatacgactttactgcaagagaaagaaactaaggcaacaaagaaactatcaggtgtggggaattgtgcataacttcggggaaactgaacaaaaatttt

SEQ ID NO: 8822 - DNA, 1380 bp, artificial
  synthetic oligonucleotide
ggtcagcaaactttttctgtaaagggccagacgggaaatattttgggctttgcaggccatgcggcctctgtcacatctactcaactctgctgttgacatgcaaaagcagcaatagacaatatgcgtgtaaatgagtgtggctgtaatccaagaaaactttatttacaaaagcaggtggagggctgggtttggcctgcaggctgtagcttgccaatcagtgacttaaattgttgatttttgtttgataaattaaaaataaattgtgtttgaagtataccctacttggttgacagccatatttagaattattcatgtggtgaattacacattttatctgtgcatcatatacaattccaaaccatttgaggctagcaacataataggttttaaagcatgtattcatcaaattagctttgctaaccactttcctgtgaggatgaacctcaagccccagcagtaccttctcattttccttttcttgcttccttaacttgcctgcatttcacccccatccttaatcaagtcccgaggaaggccagcaactggaagctagcaccaaaccaatctgcttgtttccttagattccatgtttttctttttccccccgtatattccaatggttcaaaattcaaaagatgtaaaatgatattcagtgacttgtctctctctccgataggtcagttccctcccttggaaattcccaatggtattaatttcttgtttatcctctcagaggatatattttatacatatataaatatatgcacacacacacacacatatacacacacacactcatacacacacagcttggatttgattttaatgactttaacattctctacttttgttttatctacaaatgatcctaaggccacagaagtatgaaaatgcctttcttgaactctttttttattcaaaaaatttatttatttttatcaacctacatcatgctttgatatgttgaactctagcgtgtgacagggataaaagcaggcataggcttatcttgaagcagcttatgggtttgttgactgtttgttagaggactgtttcagctctttgactttgatcatcttctaattttttcctgcctcagtgttttgttacagagttcgacttggcagtagcagaaacctctcaggctctgagagggactcataaattgcagtgagatggacattagaaaagttttcataaaggaacatcaaaagagtcacatgttcagatttcatttattttatttgctatgtacaaaactgacaccatgcttattactcaggaggtaaagataacaataattcagattatattgattatgctttgtctgtattggcacagtttatataatacttaaggaaacagaatcacctggaagga

SEQ ID NO: 8823 - DNA, 2418 bp, artificial
  synthetic oligonucleotide
gagccccaggtgggcctgggagcccactggggccatctttaccggggatgccaggtaaacctttggagcctgcaggagagaaagcccaaaggagggtactcaatgtagagggtccccaggcaccttccccaggaaaggggacttatgtgtcatgcccaagactcactaggagacgatgcacttggctgtcgacttggtgtgcacactgcacatcaaggctgcagccgcctgggctagttcttagttcatgggggcatctctgccctggggcagtgccctcaacttagcctttctgagccccttcatgcccacttcctcctcccttcttctcatcctcctagcaacaatggaaattatgcagggcaacggcgagcatcccatatcagaaatgaggacaccgaggctgggcgcagtggctcatgcctgtaatcccagcactttgggaggccaaagcaggcagatcaccttaagtcaggagttcgagaccagcctggccaacatggggaaaccttgtctctatttaaaatacaaaaattagctgggtgtggtggtatgcacctgtagtccccgctactccggaggctgaggcgggagaatcacttgaattcgagaggtggaggttgcagtgaggtgagatggcaccaatgcactctcagcctcggtgacagagcaagactccatctcaaaaataaaaaaaaataaaaagaagaagaaggaggaggaggaagaagaaaagaagaagaagaagaggaagaagaagaggaggaggaagaggaagacgaagaagaaaagaagaagaagaagaagaagaggaagaagaagaggaagaaaatgaggacactgagacccagagagacttctaacttactccaattagaggccaggttttctgtcccccagccttggacttttttcattgtcttgtgtggccctttattcaccaccacactccctccatctctctgcagcacattagagaggggcgagtggtctggagtagcaaccttgctctgccctcacatcctctaaagccaagtaccaagtacaaccaccctgctggtcctgctggcccttcttctccccaacaggaagcttgggagctttgtgaaggaagagaggcaacgcttgatgaagacacacccttggaggtggacatccaagccagcctctcagccaaactgtctcaactccccaacaaatctcctttttctggcaccctcctcaccttgtaggcctacagggccttgagccccagggtccccagtgaggccagggatgccatcgatccctggtagacccaagggtccaggaggaacctggacagcttctgcagttggtgtttgtccaggatcaccttggaggccagaagagcctgtgggcaggtgggggaaataagaacatcaggctgaggcagagggaggtgacgggggccccagaagccttctttactaacttgcaatcaacagctttctatcctgtttgtccccacaggatacccgggtatctccaggatggcactgtgtgatattatacaatctttatccatctctctccccagtggttgggtagctccaagagggcaggaactgggtcatattcatcctgtctcctcagggcccagcattgtgcccagtgggtgacaggcagtccagaagcatttgctgctaatatggtgagctgagccttctctcagggctggggtggctggtttactcactggttagagcacagtgccaaggaggctgaggggacgcttctaaccccagaggttcagttggcatcccagcctaggaacccggcgccagccagctgcctttctaatagcataatttgcttagtaagtcattgaacaaatatttccccagtgcttattatatgccagggtcctggtagctctggggatagagcaatgaatatgacagacatttatggagattatggtctggtgatgaagatgaataatgcctaactcgacaaatactgttaatctgagtgtaagttgggagaagtgttgtggaggaaaggactaacacagggacactgggagggagcagagggtggtatggggtggaggcatctgttttagagaatgatcagtggccttttgcaagcaatgacatttaaactgagaccactaaaacattagaaggactttgctatttaaagagtagaggggcaagtgcactctgggaagtagaagtagcatgtgcaaaggccctgtggtaggccaggacttggtgtttttggataactgaaagaggccagtatggcaggagcacagtgagcagcaaaggggaagggctggccatgaggatgaagagggaggcatcacacagggctttgcgtgccacggtgagttcattcctacgccatgggaagccactggatgatttatgtttttataagctctttttggcc

SEQ ID NO: 8824 - DNA, 1983 bp, artificial
  synthetic oligonucleotide
atacatagatggtaatcttgatgggaaaacacaaatgtaggtgttgatattatacatgtagcatggaagatatatatttattactttgggatattctagaagatattcaaatgaagataaatggattcaaactggttgataaactgttctggtggttgagattcttaatttttgtttgcgacaagaaaatccaaaaatgttaatatcgaattttatcttttgtgacaagaaaaatgcaaaaatatgctgaatttctcttattaaggtaaatccatgaaaatttataaaagtgatggtagatttgggtgtttttaaatagctcattaattaattgaatcttgaaatttagacaaagaaaaaataaattttgagaaaagtctctctaggtttcttaggtccggaaaaaagaaaaaacacaaaaagaaaactagtagctaagccacgtggtggtactcatagcattgttacttctggtttggtgaacctttgaaatatttttctttatccccagggtaaaaatctgaaaagaaagacatattgtatactttttttctgaaaatacagctctacacatatattatgtatatatacatataaagcatatatatgtatagcttatatatataaactgaaattatgcaaaactaataaacaagacaccacatgtgtaatagagtaggcagtggtgggcagtacacaaattataaaagttcccatggcagtttttggagactttttctccctttacctgtttcttaattttataattacacttacgtgttattaaacctgaaataaaggcactactgacttcaagtattgcaaaaagctcatgcatttctttaacaataaaacactttaaatgagcagatgaaaatgcaaaacagcccatttttccaactcagtccagtgtcaaagccttgaaaaaacaaaatacataaatgcagcctctacgtatttagtgcaaatatgaaaacaaatagtatcattgaaagttatttagataacagtactgtaatgagagggattgctctatgaagtttttttattggttagtttgtttgagatagggtcttgctctgttgcccaggctggtgtgcagtgatgtggtcaggactcactgcagcctcaacctcccaggctcaagcaatcctcccacctcagcccccgagtagctgggattacaggcgcacaccactatgccctgctaatttttgtattttttgtagaaacagggttttaccatgttacctaggctggtctccaactcctgggctcaagcaatctgcctgccatggcctcccaaagtgctaagattacaggcatgagtcactgcacccaaccactctgtgatgttttcttaggagtaaatcatcatattgcactgactcccgttgtcaaatcaaagataggttcctgtgggggtggggtggggcgtggtatgatatttcttgtattctttttaaagaaattgttttaattagatattgagaagatatgacataatatttataatatgcaaagaataattcagatacaatgaacacttgtgtttcaaccactcaacttaagaagatgtcacttgttttgaatttccttgtgtgccctccaccctcttccttcccttcctctcagaggcaatcactcctgaattttgttcatcatcctcttcctttttcttcagtttgaccatgtatatctctaaacaatgtattggttggtttcgcttatttttgaacatttattgatggaatcataccaaatgtattcctctgtgacatgtttgttttttgtttagtgctatgttgctgaaatgtatccttcttgacctgtgctgtttactacatgcataattgtgattttattatctcagatagctaaagaaaatgaataatctaatgaccatcaagatttgaaaacaaaagaaaatgtccctgtgtttttatccagtccccttttccctatatcccatgaaagaagaca

SEQ ID NO: 8825 - DNA, 3128 bp, artificial
  synthetic oligonucleotide
caccttgccttgtatgagcccagataagctggacttgattctttgctagtcgttgcaccttgtggagcttcaaagacctttctagcaaaacgtcaagaagtttttacgaattcttacaatgtgccaggctcaacatgaaatgctggcagtggggtgcagagaaaaaagcatgtaaggtagttcttgttctcaagctgtaacaatctcattgaggaagtcagacccacacagaagcaactagaattgatgtcagcagtgataagtatagagtggcagctgggtgggagctcagggactcctggaggagatggtgcctgggctggggactgaagggcaggcagatattggataattgtaaaggcaagagaaggctctgccatttcagggagatgtgaacaaaagaacagaggaggagatgttcaggaaagggtgggaagacctgtcagactcaaggagagaactctttctgaggatgtcctgggagaaggggctgagaagtaagctgggatcagagaggtgggcagtgggggtatatccccgtgagatggggggccttttctggtataaagacaaagatctggtcacacttacactttctcctggcattcctgggaaacctgtgatcccagaggaccccttcaggccaggtaagccccggattcccatgaagccagggggccctggctttccactaactcctttgataatgcctgggaggccaggagctccaggtaggcctggtggtccaggtcgaccagcctctcctttgtcacctgtaaaagaaataaaaagacttggaaaaagacactgggcaagaaaaacccagcttgccaagatgcaggtgccccaggtcgcaggccaagtgcaggctcagggagcagttagcttaaaggtaaaggtgaagtggggagagatgctttcagtcttatggggcatcgacagagttgcttctgctataccactgggaaagcagcacagtgctcagggtcctccaggggtaccactgcctgtggttgaaaacctcagttctacagtggcaataacaaatggcagtctcaaagtccaggcagccttcaggcccaggggaggcagccttcttggattccttgctgccagccacactgctgctctgaggttggcgatggggggctgtacttgagggcctttgctcaagaaggaagccaagtttggttatgaagcctctcttgagcatttctcctatccatcccctgccccagcacctcttggcccaggaaatccattggatccggctgagccttgagagcctttgtctcctttgagccaaaggtttgacattggacgtcttggactaggtattccgactggccccggattgcctctgtctcctgcagggatggagatcagcatgagaaagagagcttagacgcagggtcaggcaaaggctgacctttcacatcatttcttcccataccaccacagccctcttttggggcctttccatcttattccccacccctattcccccaacttcacatttctgtgtatgtcctcttctacaaatcccaagtctatcagcaactttagactctcctcaaatccttcctccactggtcttccgggaatgggcacacatggcctttaacatgcagtgttaactaagaggggattaagtcttttggtttaaaaggacttaattcagaagcccaaatttttattatctaacatagatttggtacaaaccacaggaataaccaagtcaacaaacaaaatatatatattgaaaagcatgggcagcagttccagaattcaattccccagctcacccttttcaccaggagtaccagcacgtccagatggtcccatttttccagttgatcctggaattccttttaatcctcttgttccaggaataccaggcagacctggtattcctggaaaacctacgaatccaacagaccccttctctcctgttgaaaaacaagaacttttattatcactcccattttacataccaggaaatggaggctcagggaggttgagtaacttgcccaaagtcatacagcaaggaagttgcagagaaggaattcaaacccaggtttctctaattccaaagtcttagtcattaccaaactcttatttattacatattatactaccttcctgaatagggacatggcactacacaatacaaaggaaagaagtgggctcctctcggccgggcacagtgggtcacactgtaatcctagcactttgggaaggtgaggcgggtggatcacctgtggtcaggagttcgagaccagcctggccaacatggcaaaaccccatctctactaaaaatacaaaaattagctgggcgtggtagcgggtgcctataatcccagctactcgggaggctgaggcaggagaattgcttgaacctggggggcagaggttgcagtgagctgagatcgtgccacttcactcgaaagagcaaaactctgtcaaaaaaaaaaaaaaattgggcccctctcttatgattcaccgagttatagctcatgtgtgatacaggaaaaaaaaaaaaagcctagggccaggaggcaaggagatgagctttagcctcgttctgctgctaaccagttgtgtgaccttaaaccactcactttccctttttttaaatggagataccacctgcccaactaccaatggctatcaaggcaatcataggaagtgagtgctatcagcctccatggtaggactatgcaaatgagtaaacccagtgtggctggtactgcccagggttttgctgaccatgatactcagcctagtgttccacccagcaggcagtgagggtgactcaccttgaccagaggtccccctttagcactagccttgtccaactatcttgacacaaaaagccctgtccaagtccctccccatttcccattcctaggcagagaggaaggagcaagctgcgcagctgaaatgctcctttttggcaaccactggtcacttcactgatcacttcacttacccttgggtccagagagggctggcaacccagcgacccctggagagcctgggcttcctttcagtcctactaggcctggatttccaggaaggccttttagccctggcagccctttctttacaattgatccaggaggacc

SEQ ID NO: 8826 - DNA, 1709 bp, artificial
  synthetic oligonucleotide
ctcacttctaaacaaaaatccattacccagaaccctctattcttccagtattgtctggttattagagttaagttcttgtattataattataggaaaagttttattaattttttcctattcttaaatgttcactaccttggatcctttcttccctttggggaatcccatgaattccagctctccagtagatggtggaggtcctgctgggccagggaggccaacatccccctgtaagatcaaatggaacattaagcaaagtgacaatcacaccgaccgtttttccagagtgggggtttgtcctctggatgtaactcacaaataaactgtctcttactttggcctcttcaccctcatgccaatgaggaaacaaaactctcactgccaaagggtgagaagaattataagcccgaccagtgaattttgtaccagcactgcagagggaagagcaagatggatagaaggaaactttaagttcatggttgctatgaaaggatgtttagaagagattaaaaaaggaatcagaacgaggtgaatggctacctcttggcaacaatgatccaactctaagtggtctaatccttgcaaagagcacaatcagaggcaatgatgttcatgttagaacattggaggcaagagttgttccttcagaaggcagtgcaattgtaacagaagggtgggaatggcaagttctcagcctcgcttgaggctctgaaatcacaatgcaatttgtaaagagagaaatgagagaaggagggaaataaaagagaatggtgaaagagaggttaaagaagagagatagaggagagagagagagatacagagagagaggaggacaaaaaggaaaaggaggaggaagtggaggagggggaggaggagaaagggtagagagaagaggggaagcagagacaaggaaagagaaggcaacagaatacacaaaacaccaaggaaagacccagatggaaggaagagaaagaatctatttcaagggaatatgtttgtaagacatacacctttcacaggtaggaagcagggaaataacaatattttgaagggaaaagaaccacaatagcccatgtgtggcatgtacacatgtagccctcaagagatcccaccagaggatctatgtgggttgggaaatattcatttcccaaggcgaaaaaacaaatcctcttacacaagcaggcacatgtgtgtaatcagacacatttcttgcagcatatggaaggcagactgtattttttaaaagctgtttaccttgactcctttctctccttgaaaacctagccccatattcccctagggaatagggatatagggaggaaaaacaaaatcgattactaaataagctctgggaacttaaattggaatgcaatcttttttaccagaaagtagggttaaccaaaccagtatctctctgggaaatccagagtacttaggagtaggaagcaaaatgccctaagacaaagtatacttacatcaggaccaagaggaccaggaggccctggaggaccctagattttttttaaaaataagaaagagttagcacttgttagtttcagtcaaaaagaacacggcatgttgagagtcactccccagtaactcagccatctttcctgctttggcatagtagattctagctgtctttcctatggttcccttttatctcctttgaaatcccccaaattgacctggtaatcacattaatgcta

SEQ ID NO: 8827 - DNA, 1103 bp, artificial
  synthetic oligonucleotide
ggaggaaagcaaagctaccttcctgtgtgccttcatccccaaagattctgtgcccatatgtatacgatgcaaatcggtcatttcaagggaaaatcaacagagcatacactctctgattatgttttaattactttgctgcatgtttagttactgcatgaatcagtaatataaccatcttgtgaaaattgttgtgttccactggatccagggtctctttgatatttggcaaagccatttaatcaatgttttctaagacaatgaccaaattttgacacctgctagtcttactccacttggcttacagtaaaaaatcagctctctgtagcatggaaagagcactgcctgagttttagctctttagtgaactggctttgagcaagtcacatagcctcagtacacctcagtttttctatctgtaaaatgagcaatacgagtccaagaatcatgaggtcctttccaactcaaacattctatcttctactatggcatctatagttagaagcccataccctaaatcttgtccggctctccagccacccacccccatcactgccttccaaagtgatttccaatgttccaggctctatgcactaatggaagacagaaaagtgccatcaattagctgagtgaacttggtgcatcttctcctcagatgttgggcacatacattctcatttgctaccagggaaatgatggactcctgccccactctgcaagggaatagggccaatcatttggagccagggtttacttaggccccgcaggatatcaggcaacacagtcacaagaacacagaaggttcttgtcaattctggaaagagatgaaagattccagccagcctcagggctgatgggcaatttttgcagacatccaggggcccagctagggtgatgggttggtgtgtagtgacagagaagggcagaaccaggatctttggctaaaggccatgttgagatgggcagagacatacatggcttcaaaccaaggaatacagacaacaaggattctggagtagataaaaggtatctgcctccgggaaatgtcttggtttgtgaaagaaaatgatacccatgcaaactgtttgtttgctgatctgtctcct

SEQ ID NO: 8828 - DNA, 2981 bp, artificial
  synthetic oligonucleotide
cctagtgggtgcaacacaggcaggctggtctatcatttagaacaaatcccagtagggactgaattttcttggcagaaaaatgaaaaccattagtaatatgcattacctctcagagagcacaacaccgtatcaggtagaaagtccattttcataaatgcttcccatctccacctcttggcccctttactgactgtccatcatttcctacaaatctgtgaaaaactttgaaaagaagcccattaagcatgccctttactgttcaccttcaaggcttactttttaaaaggctgaaaatgggacagatgccttatgctgtggctacagttaagtactggagatgcaagtggccaccagctgtgatgatcctttggagtataattttgagtgtcaatcaggcccacgaagacctacgacccttgcaaggaagtaaaagatgctctgtccaaggaaatgcagttctcttgggcaccacctaccacttaaccttttccaatacccaacatgtggcctacaaaaaatgataggttgcaaactgtttaacaggcttcattctgggaatgatgggggtggagtaaactttcaatttttaggctcctacctcccattgttggaactttgtttacagtggttctgttatttattattattgggattttcacaaaatcaataaatatgtgtgtatatatgtatatgtgtgtataatgcatattaataatataaaaagagcagtacttaaaaaatagtgctggggtgctgttgacaatgagtaggaggtcgaaagcatgggcctacatcaatgatagactggataaagaaaatgtggcacatatacaccatggaatactatgcagctataagaaaaatgagttcacatcctttgcagggacatggatgaagctggaaaccatcattctcagaaaactaacacaggaacagaaaaccaaacgctgcatgttctcactcatacgtgggagttgaacaatgacaacatatgggcacagggaggggaacatcacacatgcgggcctgttgaggggtggtgggcaaggggagggatagcactgggagaaatacctaatgtaaatgacgggttaatgggtgcagcaaaccaccatggcatatgtatacctgtgtaacaaacctgcacgttctgcacatgtatcctagaacttgaagtataatttttttaaaaaaagaaagaaaatgtgggcctaggtttcaagactaatgcatacaaaatcacagcaaacagtacaaatttggaacagagcctaagtgctgtgggaacatgaaaaaagagttggcaatggagggtttgtggaaggcttacattttgcccatggctgggggaagtcatgggccgcactggaaaggttgattggaaaggttccagctgaagcgggcctggaaagcaccgcagaaaagtcgaagtcgtgatgtggcaggacacagggaaccctcagaggtttgggaacaggggagagttgggagaagagcggtctttcagggctgaaagtcatcaagaagcattcaggataacatgtgtatgtcagaatgaggccagggctgcctgcctgaggctgggacaagggaggcagataagaagcagctgttgaggaggagggagctgcttgatgggagaatggagggcaggatgggcttgcagaggccatgttattactagcagagaggatccagtcagggcactgaatgcttgacccaaatccaagccctgacaaaagttttcccacatcaagggaaggaaggggaagaggacagtaaatcactgaacagctactgagagagcaggttgtgatgtggcccagtcccatcctgctcacaccattagagagaagagtcccagcagcacccagcataggcacagggactggcaccctctacctctggtctcttacctttgcaagcacatgcttatcagcaagggtaagcaaggagacttaggaggtaggcaactcgagggctgggcctaactggaactctgattccatgtagaaaagacagggtcccacagcctgcttcctttctcctggcttggtgggcatgcagaatttcttgacccctgtgttccaacaagagagctgaaaggaactctcctaaagaactcacatatattttttaaattctaattctttttccaaatagaagtttgaaaaggcaccccctagaggaacatgcacttctggactggccccaggttccagcttgggttggcgggcgtgccagcagctcagtttgaaacctctcacattgaatcaagggccagaagcagggcctgtgggaagtttctaggcttctgctcatccagaactgtcccctcagcatggtgtgaggctcttatggagcctgcagtcataggatatgagacaaaaagccttcccatccatggatgtcctttcatacactggcacagaacaccgggaacaaatgaaggtgactgagaaaaaaaagaggcagacccatttcttctgcgggttgttttgtcatccagatacgcttactttgtgcttatagctgtatgatcttttttcctcatctctaatgcacaggatttctgcctcattacccatacagctaaagcttaatattaactaaatcagtggtgaattcctttcctttcccaccccgacactatcagcgacatttttcataatggccagcagaggtcagtgtgagaacatagagactacagataagcaggtgggtaggtgggcctctccctctacagagaaaaagaaatcaaaccagtgtcagagaagtcacagaatgttcgagcaggaaaggcccttagagaccattcaatccgggctttattttatacatggggcggggggcggggggaagggggaaggccgagagaagaggaaggacttgtttaggtcacgtagctagtaggaacggcatggaactaaacagaccacctgctgccagtatgtggctgtttccctgtttgccagtggcag

SEQ ID NO: 8829 - DNA, 1804 bp, artificial
  synthetic oligonucleotide
gaggaattcacctttggacaggtggaatttaagatgcctgggcaaacatctagggagatgtttagcacatttttcccacaaaacaggaagatttgaggaaacagagtgaggtttgttcaccaccatatccccggagatgcagtatttggtgtgcagtagacacacaaaacataattgtggggaaaatgcataattatgaaatgaatgaaaatagagaattaaatatgcactggggaatctttgagaaggccacttccaagtctcatttgctaggagcaaaatggaattaaaagaatgtcactatcctaaaaaactccttgtggccttttgagaagggggagcagagatccttgacctccagcctagaaacaaggtggcttgatttttacaatttgtctttgctttacaactgaaattctcatttcagctgatggttggggggaaatgcaagaacttaacaaactttacctcagtagccagggatctttctcctagcaatgaaatgtggtaagaaagatactaataataacacccccatgagtagaatacttaaacttcacagcagttttcttttcaccattcctttggatcatcacaatacatctgcaaggcaggcgaagggcaccaagctgcaaagcagttagccaataggctggctaatgtcacacagctgcacagtggaagagttacatcagagcctcccagtcaactctgtgctctctctgttgaaacaaatggagatgagtatccatagagccatacacttcactctcctagtaacagcactaatgaactagcattgcctgcagaagtaaataaaaaagaaagaatgctggtggtgaagaatgtgtctagcatatggcaggtaaagactcatatcatgcagatatagagacctattttgtggcccaagaagttttggatcagcttgataatgttaacatcacctacaatttaccaacaagagcagtgaccctttccatctacatacatacatacatacatacatacatacatacatacatacatagtgactgatgtcttgcaaaggcaattttcaggtctgccacagctaataaatagtatcagagtctccccctcaacactcaaatggaatcacatttcttttctagttcttcatctataatcagcgtttgaagcagccagcccaggcatgaagacatgcatctacacgttttgttttcaaagatacatacacccattccactggttattgtcagcatgttgaaattttttggaagacatatcccgactgataaagttaactcttgctaggcaagactttgcatccatttcttctacctgtttactgatatttctcttctaaaacataataataactttcttttaccaagagtttataaagtgctattccttaaattcacctcctctattcttttaacagccccaacaggtgggtattaatctcattttacagatgaggaaactcaaatacagagagattaaggaacttgcctgagatcacacagcaagcaactggtgaagccaatttgctgatatcaaagcctctgtttcttccaccaagctacactgtctctgcattgaatgatgctctgaacgcagagacacaaacccatgaacaggagcagtaagagctacactgcggagaaaatattgttattttcattgataccaaagcaatttatctcaatttacccacacttttcattggaataggtactctttaatagaaatgtactaatataattaataaattaagaaataagatgcacttcaaggaatggcactccctagaacttaa

SEQ ID NO: 8830 - DNA, 2735 bp, artificial
  synthetic oligonucleotide
cccccagtattagttttgctgattgctcaagccactctgagtcccacagggggcaaaaaaaaaaaaaaaaaaaaaaaaaaggaaaggcatcctcaaatggaagtgggggggctacttcctgaagagagctttctccaaagttctgctctgatagcctgctgtttgaattggaccaaggagagaggctacattatctagaagagtctgtgttagtgctccacactttagtaactttaaaacgtaaagcagcatttctcaaagggaaggtcaggatgaccttgggggctgaaggaacttgtgtgtatgagagaaagatagttcaataaagggactcagtggcaaaatatacttttcccttgcctgcccaaggtctgccacaaaaaatgcagcattcagaggctcatttttcctcctcattcttctcttttctttcccctaattttgtttagagccaagttctgtacgtaccctgaatctgtttttcagtcctctcttgtcactggttctgccaacctcaccctgttaacaaactctgactctttgcttgcccatgttcatttttcacacttccacctaatgatctagcagccagcacatttggactctctttcaactccaagctcttatgacaataatcaaccacagccaaaacatctgtgctataacaacatataccttcacagaacatacaaaattaagttgaatgatcaaggcttcatagaaaattaagtatcttcagcattagagatacagctgccatggagtcatcataaggcaggaggagggaggagtggggcatttcttcaagaggtggtacgtaaagtatactagccagggagacaggagacctagtctcagctctaccaccaactttctgtgatcataagcaagtcccttttctgtatctcagtttccttatttgaaaaaagaagaattatatagtgaaatcagagtttttgcaaagaggaatacacaaaccacacgggtaaatcttttgtattctaattgtattgtatgtattttattttacattagcaaaacactggttttccattcccagtttcattctgaaataaatttattcaggtaaacctgagaaccaacctaaagaaaagcatttattaaaataataaatactacatatagcaagagttatgcacattttgacttggatttggtgaatgatgggcttaaatgtttcttactggctctagcatcctgagtcaatgaaataataactaacactttacagcatttattatgtgtcaggcaagtgccagtgttctaagcacttcatgtatattaaatcatgcaatcttcacaaccttatgaggtagggatcattgttatctctattttatagatgaggcaactgagatatagaggggctaggaacttgcctaaggtcacacatcttaagagtcagagccaggatttgaacttgggctaattgaatctagaggacacactctttaacagccataccagtacttttcaaagtgtggttcctggaccaggagcatcagcatcatttgggagcttgttaaaaatgtaaattatcaggtactcaccccgagacctactgaatcacaaactctggaggtggagtctaataatctttgttttccaagcccagcaggtgattcagatttgagtttcttattcaaatttgagtgtatactagactatactgcactgtactacactatactgaaccaatggcagcaagtgtggaatgagaggaaaataatttggatgtcaaattgaggtagagtgaaggtttatgcaagattgaagaagcatggatacatctaatagcagaaaggaggaaggcagtttaagattatggaaacacaagaggggaagaaagtagtttggaggtcccaaaggaaaatgaggatggttatctctcaaagaactggaaaaggcaaagaaagacgaaccaaggcaagaagttgagggttttaattttttgcctgtatgacaaaacatgagtaatagcttttagtgatggtagaggttttaaggaaagaggaactgaccgggttttgaggaaagagatggttgattcaaacaaactttgctgtgagccacaacattgacatgggtgaaataatatttacttgtaatacttaagttagagtagcagctggagattatgatgttccagtgaaccaagcccagtgattattagggttttgtagcagtcatgcttggatctcctgctttagggagcatatttgatccatgcacttagttgctgaccccttgagtccatcactgcacttgagccaaggccacgtgtccagtgggcatttctcagctaatgactgtgcatggtaagaatactaaggtagacccattactgtgagacagaaaactcctctgatcactgattctggcttcagaactctattggcctggctgaaactttcttagaactgtgctccaatctgagactctgcttgtccaaacctctttccttccttctctcctccacagaggttggacctgccctgtggtcggataagtcacacctcctctggctcccttcctttttttctctcaaagtcaccttcccccggaagatctcttgcatatttaatacgatcttggaagctgctctacagaggtaccaaactaataaaaggttcttccccaatcatgctttgctgtatgagtgaagatgtttactctggaaatatttcatggttgaatgatttgaggttaagagt

SEQ ID NO: 8831 - DNA, 960 bp, artificial
  synthetic oligonucleotide
taaattctaagcagtttatttctaaagaaaacagataacagctcccatgccactatttgtctttcaacaatgaaataagcaacttactctcgctcctttctcaggaaaacactgacagctcccactgcagtcctggcccccacatggctttccataagacttctctccctattaaaaaaaggaaaaagttaataaaccatgtgaaccaagaagcaatgttgtcccagcagacctaactcttagcttctttaccaagtaaatctattgcggcttaatgatcttatctgatgttgtcagtagtcaaatgaaataaaaactaaacttaagctagcatccttttagttcaggtctataccttatcaaataaatagccggtttgggaactttgctttagacacctcctcactggtagaaattccaggcacaatatacaacagaatatctttacttgggggctggaaatagactctagacatattcctgtgaaaacaggtgtccagtgacttatggatttgcactcattggtaaagaagtagctgtagcagataacttgagtgaaattcaagtgctagatatgtagtgacaaatgaaaatggctaccttgtactctgctctcggaattgttctcctcaaactccatttcagcacacaattcacaccttacagtggcactcccatgcccagttagtcagatccaaattcctcagttggtattttacagtaccccccaagctctctaacttcatttttgcctctcctctgattgatcgtgatgattgctagctgaatttctgcaaggcccccacatgacctgccatgtgctgatcctcaccaacctcatctcctttctctctggctcactctgcttcagtcacacaggagggcgttcattctgttcattaaaaacatcaagcctgttcctgcctcagggcctctgccctcgctgttacttttttctgc

SEQ ID NO: 8832 - DNA, 486 bp, artificial
  synthetic oligonucleotide
ggtctatagtagatgaaaaatttccagacccctcaagcatggagcaaagaggctggaagcaagggaactggataagacagggaaaaaaaaaacaatagcaggagctgaacaaaaccataagaatcagaagctaaggtttcttaggaactcgccagaacaaggaggcaaagacactcagctaacaggaaatcatcactgtcctttgtcactgaggaaagtaaccagagaagccctgttggccacaaggcaatttcctgtaatgccagccctggcagtttccccaggagtcttcaattacagtgaggtgggaggagtgaaggcaggcttccagggaacatgaccagactagacctgagaagcctctgccttatcctggcttgtctggggacactccaccccctgcttgaccaggccatgtggctggtgtcatttccaccttggaatgctctcccttttctctcaagatcaagcccatcttatacccaa

SEQ ID NO: 8833 - DNA, 657 bp, artificial
  synthetic oligonucleotide
ctacaaagtacaaaacccagcaaatacaccaggacctctgtcttcatttgcaaagaacaacatattacttttacctattttttggctgcaatattaagctgtaaatcctttcagaagttaattttcattttgcttgcagcatgaacaagacagaccaacttgtcacgtatgcctacatttctaaaattaggagaaacagccctaatcccttctcataggcagaaaatagaaacaagtcaagtagtctacttggttggtgggaatggactttaaaaagcatcatgctagaaaaaaagcactgcatgtcataagcaaagttcaaactccagtttaaactttttgggcttaatcaaagccataggcgaaggagcggtccagtatttttgtctctaattccatatttcatgacttcaaaactcatctacttttctttttgtttctaaccacagtgagatgcaaaactaatttttaaaagcccttctgtggcaagactttatctttggtgattcccgtgcaagacataaactaccaaatctcactgaagaagaagtagaaaatcccagtagtcccttatctattaaagaaattgaatttgcagttaaaaaccttccaataaaggaaactcctgggctagatggcctcactggtgatttctac

SEQ ID NO: 8834 - DNA, 1141 bp, artificial
  synthetic oligonucleotide
tacttgtttttaatccatactaactaaaacttcaagtactatgttccctcctcaatctttcccatcccataagacttcattaaccaaacaaatctgttttcagatgacttttagtatgtaaaaatgaagagtggatcttaccactcatcatccataaatgaaacaaaattaccaaaacagttgaaagctgaaataatttcagtttatctaaataaaacacatgtagtcatcttctggaactgacagaagggcatgagttatagcatcatctggaattgtggacaaggcagatacatgttcaagcctaaattaataaaagctgagtaatagctaacaacccaagcataggagatcagcattaatgagattaactcttagactactgtacattttcttaacctgattacaaaaccaggtgtgagctttttatccctgccccttatgcaaattacgcgcatttaatggagtgtggtacagtatggctgatggtgacatttgataaatacaggtggggctaatgcaaattttgtgggttggtgattattgccctgggtcaagagatttggaaggaatccatgatcaaggctgtagtggcacgctgcctcctatagcatgatgttaattttcatcatctttgtcacagatgtggagcatctgcctaaaatcaagtgattctcaactctgactgcacattagaatcacttgggggagctttgaaaaatccctttgcccaggtaccactgcagataaattaaatcagactctctgaaggtgggactcaggcatccatactttttaaagctccccacataattgcaatgtgcagccaaggttgagaaacacaagtctaaatgttgtgattcaccaggatttgaagcaacacaagaggggaaaccagaaacacccccgcaccccccacacaccgtggcaccaacatttaactggagggtcaactggttcccctgcatggggaacactaccttgccacctggagccatgtggatactgccttccccttggagaatatagccatcatttaatgaacatagaatttattatgtgccaggcagtgtgtgtgaagcgcttcaagtgctactctttttcatttaatctttacaacatcaccatagagaatatatta

SEQ ID NO: 8835 - DNA, 2192 bp, artificial
  synthetic oligonucleotide
gaggacttttgggagagtaactctagcagttacgtatatgttgtcctagaatagggatggcttgggactgggaacccagataggaaggcattttatagtcttgtaacccttataacacatcatcggcctgttaaaatcagttgtaagctatatccaaataatttgttacaaataattgctaaagtaccaaagtttgccaagagttgaaagcagattcaaggttattcttgtataatatcattagccctcaggcttcccaagaagtcttgcctgacaccttccccaaaacgtagggtgccccagatgcacacagcacccctggtgctgcacagcacttagaactcagcataggaactgtaattttcctcttctgtctcccctatcagactacaaattatttgacagcatggacagtatattatccatttctgtatttccaataccaggcacagctgtaggcattttactgaatggaagcatgaacactgacaggtaaagtaactaagaaaatagtaagaattcttttgaggactagtatggctctaccttgctttagctataacgtctaagaagacctaagttcaaggataatgactttttttttttttttttgagacagagtctcactactctgttgcccaggctggagtgtagtggcacaatctgggctcactacaacttctgcctcctgggttcaagcaattctcctgcctcagcctcccgagtagctgggaccacaggcgtgagccactgcacctggctaatttttgtatttttattagagatggggtttcttcacgttggccaggctggtctcgaactcctgaactcaggtgatctgccctcctcagcctcccagagtgctgggattataggcgtgagccaccgtgcctggctgataatgacttttaaaaatttttctcttcccattctattggttatgatataactgaattttttttaacttcagaagactgcagacataataaagcaaaggctttcttcagcagtcttttcttttgaattctgtctataagctggcaacataacataaggtaaggtatgggtacaataaggtggctgaaatggaaagctaggagtcctgatcctttctagagggtggtgcttctggagcaggcatgagggagagggagtacatcgaaaagagcttcagagtcctagggaccggatctgcactagagataagtagtttgaatatggttcaagacagagctgaattccaaaccattctgaaagcagatctgtccatagtgttcaaaagatattatctccaagtccttgccaatcagttattctctccctttcttgtatcatcaaccttttattctccactggctccttctccacctcgtaaaaaatgtgaaagtctcctacatcattttattttatcctcaagccaatcccatgtggtaggccatatcattatcctcattttataaattagacaattgagggccaaagaataagtaaattaccgaaggccacacagctaatcagtgacgggagctaagactctaatccagatctgtctgacaccaaagtccttgtttttaatcattctgctaatattgccttcttatctaattcaggcaagctgcaattgcaggtatttttcctattatcctgtcttgcaaggtaatgaaggataactgtctacactattcctgtaatactctttcctgtaccaggagattcatgattatgtctatctctggtcatttcttcttaaaattaaatacaggtggtttggtgtttagactctatttagcagatctttaattaaatcagccaaaacttattaagtgcctactaggtgcctactttgtgtttcaggactcaatacaaacaagttcttggcttgaagtgggaacaatgtatcaatgcagaattcaagacagtgggggacaggtgtgagtgagcaaatatatggtattcattttaaatgcttatatgttcaggaaagttaaagtataggggctgccataatttgcctttaggaagtataagtttcagggtaataccgcctacataacatatttgcagttaaagaaataaagaagttccgtgtacatttcttacttgtgtagagtcaacagatgtgatccagaatggctatattctgagtagctgctagaagactggacacagctggacaaaagtcattaaccttg

SEQ ID NO: 8836 - DNA, 1237 bp, artificial
  synthetic oligonucleotide
aagccaaagtatttactacttggccctttacagaaaagtttgctgactcctgccttaggccatggcagaaagttcatggaaagagcttgggtttctgaatgactgcatgggacacagtcacctatttcctccatggacccacattggatctttattatattaaactcccaatattttggattttaaaaaattactgcaattggcctaacatattgttaaaggatgtgttaggtattatgtttgcccgtttgatctcaatgctccaccttttttcaccctgttttatgtccagggagaatgcccacacttttgtgaatagtcacttcgttaaattcctttatttttatttttgagacaggacctcgctctgttgcccacactggagtgcagtggcgcaatcatagctcactgcagccgcaacctcctgggatcaagctatcctcccacctcagtctcttgagtagctgggactacatgggactacagttgtacaccaccactctcaactaattaaaaaactttttttttttttttttttttttgtagagaaggggcttgctatgttgccagggctagtcccaagctcctggacttcaaacagtcttccttcctttgcctgccaaagtgctgggattacaggtgtgaactaccttacctaaactcttctaaattagtctttttagtgtactatccacttcctgctgagactctgactgatttaagggataatcttgactctgctttatttatatcaaaaaatccacaaatgttactattttattattaatatgttaattgcagtatacttcacagctgatggagacatactagtagtattatgacaaatacaggtgaaacatactagatttgtctcaatctcacatttaaaataagttaatatttttaaaaagctctcaaggctggatggtacagagagaagaatatccctccagcagttggagaccccaagtcttctctttgccctgcccctgaccctgtttgtgtcttctctcttcattattgccaatgatcaggctggacctggtggtctgtcctacaaatctctctgccgccaatatttgataataattccaagaatctgctaaataatccaacatgctaaagagtcagcatagaagctcctgggtttatgcatttactgagattcttcagcaggagagtttttgctttatactcattcaaccaggtaatgctgtcaatctactattttaaaaac

SEQ ID NO: 8837 - DNA, 2052 bp, artificial
  synthetic oligonucleotide
ggattgtctggcttacagagttaatcataacactggcgtctagtgtcattccagtccatgtgagctgattcagcatgttctttaggatccaaaaggaaaagataacctgacaggtcatcagaagcatttcttttttcttttcttttctttattattattattttttctgacagagtctcgctctgtcgcccaggctggagtgcagtggcgcgatctcggctcactgcaagctctgcctcccaggttcacgccattctcctgcctcagcctcctgagtagctgggactacagacacctgccaccacagccggctaattctttgtatttttagtagagacggggtttcaccgtgttagcagtattcagtcagtttccactgctttgatggaaacaggatgtgctggccttacctggcttctagacagtccagttagaactggtttcccagccttggtccctggtactctggagagtcacaaagactgaaggcaatgtaggagttaaacatctattactactggttttcagacacagtgtggataatatctggtggttctcatcggtgcagagcttttcagaaccataacatcctcaagagacactaattaaaggtttcattctctcctcatgtcatttgttacaaaatgcaggttgagggttaagtctatggccactgcacagagcaaagcgaaattcatagagacatggaaaatgcagtgtatgatgatttttaatggaactctctaatcaaacctctgagttatgctcagtagtcagtgactaataggttgaagaggaaaagattatattcaatctgcctgttaactaaaagactttaatcaatttcagaggaaaatgctctgaggcagaaagaaacataatagggcagtgatctaatctctcagaaagcttgatgccattttgtactttctgtctccagttaggaagatgcgaatgctgagaccattcctaagtgtattctacataagtgttgaggaagaagagggtcattttgctcaatggaccacacatgtccttggctatgaactgttgaaacctaaatctcccaatatggttgtatttcaccataccaaaacatctggagagccttgttgagaggttatggcaagtctgtgggttcaaaatcctgctcttctctccaagaaaataaataaaatcctacccctggctggacacagtggctcatgcctgtaatctcagcactttgggaggtcaaggtgggaggattgcttgagtccaggagtttaagaccagccctggcaacatagcgagaccctgcctctctctcaaaaaaaaaaaaaaaaagaagaagaagctgagcatgggggtgcacacctgtagacctagccactcaggaggctgaggtggaaggatcacttgagcctgggaagttgaggctgcagtgaaccatggttgtgccactgcactccagcctgggcaacagagtgagatcctgtctcaaaaacaaaaagaataaaagaaaaaataatccaacccctagcctacagcagcactggtgaaaacaaaacatgtctttgaaccatattaggatcatggatcaccagtttgtaacagctagtctacactatagttattagaggatttcagataaatgtaagattaatggaggccagagcagtcatagtacaatttgtggaggtagtgcaatttgaaggtaccttggcagaaaagtaggatttctcttctctccaactaattcctttaatgtaaacatacttttaaaaggtctacaaatatcatcctctccatacccaccattctctattagcaaatatctacacatagctgaattaatttggaatcaggaaagcatatctctttcctacctacaggatttatgaaagaatgagggagatcagtaagccattgtttcatgtggcaactcaaatttcacttcctccgaaaaaactttcctgtttaccctggtcccaaatgggctctcccttcaatcaccccaactgactactgtaaaatgtaatgcctatattatttatttggttcacacaggaa

SEQ ID NO: 8838 - DNA, 1860 bp, artificial
  synthetic oligonucleotide
tctaaatactagtaagaaacaaacctgcaataatacaatatatacaatgccttattttagattgaggtgcagcaggggtggtgaaagttcttatttatttgagtcttatagataggattatattattgatccattcagggccagttacttgtttgcttcaggcaagaatacacacttgttggcataggaatcccaggaatctgattttactacatggaattcatcaaaatattcaaaaggaggcatttaaatgggaaattccttctattcaagattaaagaccagattcttttgttaccaattgtctctggaagtaaattacactgctgtcagttatacaaccttttaaataataggacgtggcataataaatataaaacagtctataagtcagaaaacctgagttctagttcaggctcctttaatactaccttgttacatacccttaagcaaatcatttaatctcattgttatggtcaaagggtcacagaattatagctattctattaccataacactaaatagcacaagatggcaggaaaagtcaaaaatagataattttattgaaacaaaattgttctaagctaatatctttgtccatcgctacagcatacaactgcgagaacaccaaaggggtagaaaaaattcaaactgagcaaaaaaagaccatggtcttgcattaaacaatacagactgcaatatgcacaaaaattaacaaattgacaagttccttggtttctgcaggagcaatggaacaagaatgagtgaaatcgaagggacatgacttagtaagatgtttgagggaaagggacagggctagagagaccagagatgtctttctacagggtgcattaagtgtgcaagggggtcattagggctgctcactgaacattttcagctctccaccttcagggcacatggtaggataatacttgatgtcccttaactagccccaatcaaagctgaccaatggtgtatgagaaaaaagtgtcatatcctttccaggaatcatatttaattggtgatgcagtgtgagacctccagaactctctttccttctgccatgataataagcagtgttccagatggtggctggtccatctaggtcctagagggaggactctgtaatgtcccccaggtgactcattatggacacgtagcataaacaagaagaaacttaggttattttaagctactgagatttggggagttgtttgctatgacagcataacctaccctatcctgaaagaatggatggcagttaggagttcaagcactctacccaacagaggcaaagatagcttggctgttttcctccaggcagttgagcctcagtaggggccttagtgcttctcagaggattgtgccttaaaatactgtaggattctattatgaatatgaacaaaagtatgtcactgttactggcatctaatagtggacatgaaaagataaaggcacaattcaggacagggcagcctcaggggactggtataaatgcttcttctcattctgctccaagtaaatagtgattaaaagtcatatggctcttcaatggtccatccagaataactggccccagcccagcttgagacaagcaggtgtccttcataatagtgttgacgctttcatttgtcagtctatttagtagcagaatgagcaaaaagctgaataaacaagcaggggagaactacatttttactttctgaggtccttaaaagtgaccgggccaacaatagtgttacaagctttaggagatgaaattaaatttatatctctatataatttaacgctaactagtctttacctaaatgattttctcctgaagactctacagattactgatactgtctaaccggaact

SEQ ID NO: 8839 - DNA, 2332 bp, artificial
  synthetic oligonucleotide
atcaactctatttaaatatttccaattaagtgtttatattaattctaagaaacactgcactaaatttatttaattccctgccctaaatctttctgaaacacaactacaatgagagtcaataccttttacattagctcaatataggaggcattaattataggattcaatgcagctaaacagagatatagctgtattataataacataataccatagaataattaccaatacctgctgaatgctcccagatcttatacgtatataacacacataaagtattcacgcacatatacttattttcttacttgtttataagcatatactttatttattcccaatattttcacatcttctgcttgtatgtagaaactctctgttctgtgagcagctggaaggtaaagaagaccagcagcccagggagcaccgaccaaaatttgtttctaatgagtaacaataaaaagcacggcccctctgagatccatccgctaaaaaaatagtcccagtttagatctatttgtaattggctttggtacgcacaccaatgagattggaactgagcctagaaaagtagtatcaacggaaggtgcaaatgaacgaatagaaaagcttcccggttggactcatggtgctcagtcaactagtctggaagtttccctcccccaaataactgagcgtcactccctcgcaggttgccggtgcagtctaaaactgtggcggagtgatactcaaattcccttgtgctggtgaggaggggggccttgcacggggaagagagggaggaaagtagatctgtaggaattgagtgaagaaaaagtttgcaagtctggacagaagggaaaagttctcctgagagaccggctttggggaggggaggggggaaggaagagtagctccttcttcttcttcttttttttttcttccactcttaaaaagcttctttctcttcacccaagcctcactgtccctctccggctctagctctctccatataaaccctcaagattatgtcaattggttagagccagccgggaatttcgtgcgggtgctgaaggagctgcgggagccggagaagaatgaaactgcgtggagtcagcctggctgccggcttgttcttactggccctgagtctttgggggcagcctgcagaggctgcggtaagtccttcctcccctcccccgcgcccatcaccgctctttcacgctgaaattaccttttttttggggggggggtccctttatcttccttttggcgttgactagggaattcaaatttgctttctcatgtttaggaagaaacgttatttgcaacaccggtaactcaagccttctgaagtccaacggagaggtttaagtgcttaaaaatagggctgcttgcttccctgcagctagctcctccgggggcaagagcaaagtcagaagtgggggacgctaattaaaggctcactaggctgtggtgggtatttaaaacttttcctcccctccctccaccgtcgggtgtttccctgcctggcgactaaccttttcactacttgtacccagcccactctttgaattttgtctgtagtttaatattttggctcttcgaaaatccagcttccatcaaagtgtttttagcgcctcagtgaagttcgtcccctttgctctttccttaagcaacaggaacctacccccacctcaggtcattcaagccactgacctccttttcccttttgacatccttgttacaaatgaaatgctaaggcaacataccaagaagagtgaggtaaagtctcaggcttcaggtcttttgcgtctttttgttgttgttgttttttctaaattatgggtttttttgtttgtttacttttttttaaacctaccaaggcatctgaacaaattgagaatttgcccatcacctattcaaaggaaaatactcctttttcaaaggagaatcagtgttccagtttaaaggaaagtgggggaggaggtacatgtgaaatagcagcaaaaagctccattcagttttaggaatgtagaattcaaacctcagtatatctcttagaagggtatctgggtagtcccacccactgtcctattggggatgagggccagatgttaaaaaaatgaatggctttgtgagagaaaatgttctccagcctgaagcccatcatctttaatttcatataacctctgaagaataagtgtgtgacaaattatttaaatttatttgagtgatcattatggatagttttaaaaactgtttaatatgagatcatggcttaggccttcacatggttgagtgaccgtcaattctttgtaagcagctgctatgttacagctcatctgggtccactt

SEQ ID NO: 8840 - DNA, 2722 bp, artificial
  synthetic oligonucleotide
tgagactctttacatccctgaaagcttggttaagatggtgtctgctaggtttattcactataaagtcactattttttcttttgtaattacaaagtgagactatgcagggcaatattgtgagacaatgtaaatatcctgtttctcatcatatatttgcccactaattttagcatatgttgatgattctggcttgaataaattattgttgtgacatttgccagacattgatttcaattttcaacatttttacatttattaattgattgaattatactgtaataaaaaactttctctttacgcttaatgtatatatttattcagctgtttatagcagtatggacttaatgaatatttgttttattctataggttataatgaattatgctcttactactttttgtttttgctgaaacccagatttggccaacaggagccccttcaaattggctcctgtgtcctttcaacatgtctccatcattttttaagcaccctcttactttctggcaccacagatgttccagactcttttttttttctttttttttttgagatggagtcttgctctgtcacccaggctagagtgcagtggcgcgatgatctcggctcactgcaagctctgcctcccgggttcacaccattctcctgcctcagcctcccaagtagctgggactacaggtgccagccaccatgccgggctaattttttgcatttttagtagagacggggtttcaccatgttagccaggatggtctcgaactcctgacctcgtgatccacccgccttggcctcccaaagtgctgggattacaggcgtgagccaccgcacctggcctccagactcattttttaatttccttgccccaactctggaatcagaatcttttctccaaggagctctgattctttttattggagaatggtatgtagaagccaagatctgggtgcttggcatgcttattgctactgaggtgtcattgcctctaggccctctcagcaggcagaactaggaaatatatgtatatatgcacacatacctgtttctatatcgatttcttgaagtccctctttatatatgtcaaaatcatggattcataatgatacatctgattccagtccaagaccctagaataaatatacatgatctcattctcttctggtatttctcttcacacgttttgtggactttgtagaggtcttatacagagtcttcaagaggttggcctctgaagtcagacatggaatctgactggtagatgtgtaactttcagcaaaatagtaatctttgagacttaatttcctcattggcaaaaggaaggccgtagcacctatctcacatatttttttttttaggatgaaatgagaaaagttatgtaaaacatatagtatttgacaccatagtaaatgttaaatcaattttagatttcattattgtcattatatttattgacttaccatttcttactacatcaactctcaaatctcctgtctgattttcaaggcctatcatgatcttttcccttatccaaccttatttttcattacagtttataatatactccctccagtctagcctaggtaagctttcctacaatcccgtgagcactgcatacacattttggccctccatcttgattagaattttgtggattcaagtctttgctcaattccagcaaatgtttacatttattcagcagatatttattcagcaacttctaagtactcaaaaattctatttatgctgttctatttctattcatggaggtgtactgcctacaaaatcattttgtgctagacactatggctaaaaccaaataaagacaaggttcttcccttcatggtgtttacatactggtgagaatagctaaatagtcctgtgaaactttcccttattatagtatcaaatactgattgtacctttctttgaacatttgtaatatttagcctctcccagtttcgtatctgcatgtatttggtcttataggcattttgttttatgacattttatctgttctttttatttgattaaagtcccttttgaagcaataactatatatttgttcattcaaccaattcatatgttgattttatatggtaacaaaagtaacagctgctcaatgttggaaacttgaaaaacataaagaaaataaaaatatgtccacagttctaccagcaggccagaactgtgctggctgagcacagaataatggtgtgtgttttgattattgttgtttttactattttctttcctatatatataatatgtttttaaaaataaatttggcatagaacaatgacttgtaagagtacaatttttgaattgtaaatgatatgttaaggtttggatgtgaatcacgaaactctaagcacaattcatgtttcaattgctatggtaaagttttcatttcatgaagatactgaatttttaaaatactaaaaaacctgattaaataaacactagctaataactaaaaaaaaagttggttaaaataaaaaagtaagttgggcttattctacatatagttttatttcttactgtttgatcacttatcaagcagtttcccatgttaacattcttagttttaaaacgttattttaaaatgattacatacaacttgtatttatacacactccaatttatttacctgttcacttttgtagagtatattttaaaatgtcaagatttgttagccatcgtaagaagtgctgccatgaacatttcttat

SEQ ID NO: 8841 - DNA, 318 bp, artificial
  synthetic oligonucleotide
tttttgtcagatgtatgtattgtgaatatcttctttcagtctctggcttgcttattcatattaataattgtatattttgatgagttatttatccactttttgtggtttttcctgtctttgccctgtccaaaaaatcctgcttaatctcaagtcatgttttgttttttatatgtttgtttataaaggttttttcctctgtgttcctgtaaaagttttgtaggtttttatgttttatgtttctaatccatgaccttttatgttttaatcgatgatctttctcaaataatttttgcacttagtaatgaagtagggattcag

SEQ ID NO: 8842 - DNA, 319 bp, artificial
  synthetic oligonucleotide
aagttaagagggtatacaatgaaagatctccttctcacctgtgtccattagtccctgagttacccacacacactttaaccacctttgtttgtaaaatagtagcacattaaacacactgtttgacctttgtttttaatttaatatacattgtagacatcctattatcaatatatacagaacctcctcattttgtataactgcattgtatttcattgtatatatgaaccataacttagcattgtatgtataaaccataaattattaagccagtcccctattgatgattatttaggtaggtttcaattttttgctattaaaa

SEQ ID NO: 8843 - DNA, 1622 bp, artificial
  synthetic oligonucleotide
aataaattacaccaaacaattcttaatttagtaggcaaatcatcacacttttcatgctaatagggaaggatattctccccaagtaatgcctagttttgcaagatttcctgtataaaaatggcaagcagcgttatccacctaaaatttcagaaatacctaactagaaatccccatggtgattttgttatacaataaaatcttagagctcaatactgagttttatattattccctttgaaaacacacagtatagtggaacatttctaatttggccacaaattgagtactgcccttatctagaatgtttatttgaatgttctctgaaatagggtaataatagtgatttccgtaagatttctagatgcatgtggtacagtgcctggcacacatacatattcaataaattattattccttttccttcaaaaatacgtggctaatgaaatactaaaatgatgagatgagtgatattcagtgatctttcccaagagaaagaaaataaatataggttccattatgctctaaatgcaaacttcagattcctaaatgtgaacttcagattcctaacctcaagatagtgaattaaatacagactgtatctggaaaattgaaataaagaattatctcaggatgcagtaaaagagataaggagttgggaagtatgaatgaaaagttaagaggtatgaaagataaacctagaagctccaaaattatctcatgagggaggtcaaggaggagagaatgggacaagaggcagcatttgaaaaaaaataatggctgagaacttccatctattaaaaaacacatgcatcactatgaaaaagctcatgaagcactaagcaatagtaaaataatagtaatgcaaaggtccataactagacacattgtagggacatttcagaattcagggataaaaagaagctcttaaaaactatttgagaacaaaaggccaatcacctacaaagcagtgagtcagaggatgataatggagcacattttcaaagtgataaggacaaattactatgaattagggattctgtattacattaaactatcatcctaatgtgaagatgagatacataggaagtttaacaccttcagactgtctctgaaatagttactggaggttttactccaaaaagaaaaaagggaattctggataaaatgagaatagcggtaggatgcaagaaccaaagcttagaaaatatattagtaaagcatattaagtctaaatcagtactggttattttttaaaaaggtgttttaagtaacaacttggagctataattgtaaacattattaacgtgatgtgtagatgcagagagaataaggataagagtttttgtcttgttagggaaagataatataaatcttgttaactgtataaatttttagaaatgtatacatgtttaagtacataggttaaaatgttaatagtagccactagagaagaatagaaataaaatgtataacatacacaccaattgaagaaagaaaatgactaaaagtctcatatatagtataagttaagatgggggcaaaataaagacaaatctgggtaaatagaaaataaaatataaggtgacaagaagaaattaaaaataagtcagtaactccaacaaat

SEQ ID NO: 8844 - DNA, 1309 bp, artificial
  synthetic oligonucleotide
gggttgaaggggtaaactggagagaagaaaatgttagaaaaaaagaaactgattttctttttctctttcttctttttccactcttttttctttttttccttactcatttcagggcattccaggagctccaggtgctccaggctttcctggatctaaaggtgaacctggtgatatcctcacttttccaggaatgaagggtgacaaaggagagttgggttcccctggagctccagggcttcctggtttacctggcactcctggacaggatggattgccagggcttcctggcccgaaaggagagcctgtgagttggtttgatatttttggttttgtgatgttaaattttcacttagaaatgttttctaagttaattcaaaggatgggactgatgctgagataaacacccaatcaatgcttaaaacaatgtgaccatacagtaatggcacattgttactgactacgtagggtttctgcactactcttttctttcacttgttttgtaaacttatttttcttaacccattaatattgaatactattttctatgaataggtgggcaggaggttaagatgtttatgagacagtataaggttccccatctcttaacccccacatatctttccttgggtttacttaaacctcatgactgggcatggtggctcacacctgtaatcccagcactttgcgaggctgaggtgggcggatcacctgaggtcaggagttcgagaccagcctggccaacatggtgaaaccctgtctctactaaaaacacaaaaattagccgggcatggtggtgggcgcctgtaatcccagctactcgggaggctgaggcaggagaatcacttgaacccgggaggcggaggttgcagtgagccgagattgcaccactgcactccaccctgggcaacaagagcaaaactccatcacaataaattaaataaataaataaataaataaacctcataaccagcagtttaacttgtttctatatatatagtaagcttagagaatagtacaagtagatagccatgttcaatgtgccacagaactgaaagatttaacataaatgaacaatcttattttgtacataacacacagcccaggatatttaggtaggaagtgatattttataatgttatctagactataacctttctgacttacactaaaatgtaagctgcataaagtcagagatttttgtgtatttttgttttctgttgtatcaccagcacttgacacatagtaggagcccaaaaatatttgttggaggaatgagtaagtggaatgatcacacataccatctcataat

SEQ ID NO: 8845 - DNA, 2091 bp, artificial
  synthetic oligonucleotide
tttatagaaattgacacctttgggaaagtttatgggtgataagcccaattaactggaaaccctatgctgccattctgttactgctacacatttttttcaatccttcattgattatttttgtcttttatttcattgaatagataataaaatcatggcccggcacggtggctcactcctgtaatcccagcactttgggaggccaaggtgggcggatcacctgaggtctggaattcaagaccatcctggccaacatggcgaaaccccgtctctaccaaaaatagaaaaattagccgggcatggtggcacatgtttgtaatcccagctacttgggaggctgaggcaggagaatcacttgaacttgggaggtgaaggttgcagtaagccactccagcctgggtgacagagtgagactttgtctcaaaaaaaaaaaaaaaaacaatcatatatgttataaaagtaacactgagaagtcttccttccaacccatcttcatccactttgttcctctccatcctcctgcttaactattttttattctcctttcttccccccaccctccccccataccccaagacagagtcttgctctgtctcccaggctggagtgcaatggcgtgatcttggctcactgcaacctccacctcccaggttcaagcaactctcctgcctcagcctcctcagtagctaggattacagatgcatgccaccaggcccagctaatttttgtatttttagtagagacagggtttcaccatgttggccaggctggtctcgaactcctaacttcgtgatccgcccgcctcggcctctcaaagtgttgggatccttctggtgtttcttatataaataccagccaagaatttgttttattttctctgttcttaaaggagaaggtattttcttttgactttatttgcactttatttttttactgaaatttgtatcctgaagatcactccatatcagtagatggagatcttaactttttgaaaataggtgcctagtgttaaattgcgtggatataccatagttcatcccagttgctagttgctagattggatttttgccaatcatttattacaaataatgccatagtgaataatctttcatgcatattatttcagatgtgttcaggtataatagtaaaataaagtgatgaaaaaggattttctgaattaaagggtaaatgcatctctggatattgtcagattcctctcaatttgcaccatttacactccacccacaatgtatgagtgtgtttccccacagccttgataagtgagtatgctgacaaactcttggatttttgctaacctgatgaagtaagtaggtttctaagtatatttttaaacattttattgttaaaaaattttaagtactgtgaaaaataatagtacagttaacagctgtatatctaccacccagattctacaatgaaccttttatctccctgccaacgttttgttttttaaaattttaaatataacaaagtagacagaactttattgggactactatatacccatcactgatattttactgtcaacattttactatatgttgacaaatactatatactatttgtcacatatctatccatccctgtctccatccattcatctatttttgatgcatatcaaaataaattacaacaacaatatacttctctctaaatacttcagcatgcataccataactaaaattccatagctgtatattacttttcttctgatatgtaattcacattaaatgagatacataaatcttaagggtacatttactggattttgacaaatgcatacacttgtataacacaaaatctttatcaagatattgttttagaaattttccttatgcccctttccagtcagtccctatcccatcatccacagtggcaactatactgttgattttttcatcataagttatttcgcctgttaactccttataaatggaactccttataaatggaaacatacggtatgtactttctttctgaggcttctttcactcaacataatgttttggagatccatccatgttgttgtgtttatcaatagttcttttctttcagtgaaatcattgagtattt

SEQ ID NO: 8846 - DNA, 1437 bp, artificial
  synthetic oligonucleotide
acaaatccagatggcatcactggtaaattctaacaaacatttaaagaagcagtaacaccaattctacacaatctcttcccaaaaacagaagtagagggatcactttccaaccattacatgaggccagcattattttgatatcaaagccaagcaaagacatatgagaaaagaaagctgtagaccaatatctctcatgaacatagacataaaaatcctcaagaaaatattggcaagtcaaatctagcaatatatgaaaaggataatacactacaatcaagtgaggcttatccttagaatacgggctggtttgacattttaaaatcaatgtaatttgccatatcaacagagtaaagaagaaaaactgtattataatctcagtaaatcctgaaaattatttgataagtttcaatattcattcctggaaaaatagtctcagaaaattaggaataaaagggaacttccttagcatgataaagacatttacaaaatcttgatccattatgtttagtggtgaaagactgaatacttttccccaaagttatgtaacacaaagatgttatttgttaccatatttgatggtatgaaaaggttcaatattgtattggaagtcctagccaatgttataagacaagcaaaataaatgaagggcatacagattggaaaggaagaaataaaactccctatattcatagatgacatggttttatacttagaaaaccctaataaatctacaaaaatttactagaactaaaaggtgaatttcgtaggatcataggacaaagcaaatatctaaaaataaattatgtttttatatactatcaatgaacaactagaaataaaaattaaacaaaaacagtataatttacaatagcatcaaatgacatgaagtgcttaggtatgcataggtccaacaaaaatgtgcaggctttgtatgtggaaaattacaaaacactgttgacagaaatcagatacctaaataaatggaatggtatattgtgttcatggatattgttaagatatcagttttctccaaatcaatccatagattgaaaatattctcaaggagaacacacaatttttcttctaaaatttatatggaaaaacaaatggcctagaatagccaaaacaattttgagaaagaagtacaaagttggacaattcatagtacttgatgttaagacttaaaataaagctacaatagttaaaatagtgtggtatgtgtgaaatacagactaatagatcattgtaacataatagagagtctagaaatacacccacatatttaatttttgacaaagttgctaaggcaatctcaacagaaaggtaagtcttttcaacaaatgttgctaaaatataaagcaattggacatccatatgcaaaaaaaaatataaacaaaccaacataacaaacctctacctgcacttcctaccttgcac

SEQ ID NO: 8847 - DNA, 1676 bp, artificial
  synthetic oligonucleotide
ggaacaattggaatttccacacattgttctgagtgtgaaatggtttggcagtttttaaataaaacacaacatatacctactttttgacccagcaattccacttcttgttatatacctaagataaattaaggcagtggtctacaaaaagacctgtgcagaaatactcatagcagctttatttataatagataaaagctggaaataaaacaggtttttataaataggaaagtggatatttgtaataactaaaacctgtcaataaaccaaaagtccagcaagaggaatggattttttaagttatggtatattcatataatggagtcctacaaatcctaccagtataatatggtggtagttatttttatgtttatgaatatataataatgccaacttcaggataaatggttaaaaacataaaattattattaaaaatagccaacaaacaccagcatcttttgggtttctttttgttcttcactgtttctatgctagcactataaattgtaagtttgaattgtagctcttaaagcaatgcagtttttctttcatttttaaattgagctctttactctaggaaccccaggccctcctggaccaaaaggtattagtggccctcctgggaaccccggccttccaggagaacctggtcctgtaggtaagcatgaaaaataacagtttgctgttttataaaactaatgtttatcatattaagtttgggaaagtcaaatcatgttcagctgtgaacattttcaacacaaggaaatatagtgttcattcacttaacactgcatgtgaggtacagaatgaataacttttaataaaaagtgcttaaaattggctgggcacagtggctcacgcctgtaatcccaacattttgggaggccgaggtgggaggatcacttgaggtcaggagctcgagactagcttggtcaacatggtgatacgccatttctattaaaaatacaaaatattagctgagcatggggatgggctcctgtaatcccagctacttcggaggttaaggcacgagaagtgcttgaacccaaggggtggaggttgcagtgagccaagatcgtgccactgcactccagcctgggtgacaaagcaagaccctcgaaaaaaaaaaaaggacttaaaatgatcatatgtgaccttattttctaggcccactttttccagggagagttaattcaagtgtcctagaatagaagctttgatttttttagaatggcaggctgtagtaagtaagtttgtttattgatttctaaagtaaataacttctcttggccccatatgaggcctataattctccccaccacccttcgcaccttactctcttagatattctgaaactatattaaaatgaagaactgaaaggttttagatgctgaatgactattccttattttcattatcctccttcatatttttataacattttgtgatccaaaggagtgtctcaaaagcaccttgtttcttttggataaagaagggagcatatggaagtaaaagggagttggaaattggaaaactgggtgtaacctgctgtactcaattttttaggtggtggaggtcatcctgggcaaccagggcctccaggcgaaaaaggcaaacccggtcaagatggtattcctggaccagctggacagaagggtgaaccaggtgctgtagttttt

SEQ ID NO: 8848 - DNA, 4628 bp, artificial
  synthetic oligonucleotide
agttttcctaaacagatttctgttagatatggcagcaattcaaaaactggtttctctcacaccaatttttgtcctgaacttaggtcactttggcttccatttcttgtaacctttctctttcccttcaaatttgtgtgttttgtctcataggtcctcctggattacctggtccttcaggacagagtatcataattaaaggagatgctggtcctccaggaatccctggccagcctgggctaaagggtctaccaggaccccaaggacctcaaggcttaccaggtaccaatgcagatcatctttattatcattattatacttttaatttctgggatacatgtgcagaatgtacaggtttgttacataggtatacacttgccatggtggtttgctgcacctatcaacccatcatctacgttagatatttctcctaatgctatccctcctctagcccccctaccccttgacaggccctggtgtgtgatgggcccctccctgtgtccatgtgttctcattgttcaactcccacttatgagtgaaaacatgtggtgtttggttttctgttcctgtattagtttgctgagaatgatggttttgtccatgcaaaggacatgaactcatcaattttcatggctgcatagtattccatggtgtatatgtgccacattttctttatccagcctatcattaataggcatttggattggttccaagtctttgctattgtgaacagtgctgcaataaacatacgtgggcatgtgtctttatagtagaataatttataatcctttgggtatataccaaaatgggatggttgggtcaaatggtatttctagttctagatccttgaggaatcgccacactgtcttccacaatggttgaactaatttacactcccacaaacagtggaaaagcattcctatttctccacatcctctccagcatctgttgtttcctgactttttaatgatcaccattctaactggtgtgagataatatctcactgtggctttgatttgcatttctctagtgaccacagatgatgagcttttttcatatgtttgttggcctcataaatgtctttttttgagaagtgtctgttcatatcctttgcccactttttgatgggattgtggttgtttttttcttgtaaatttgtttaagttccttgtagattctggatattagccctttgtcagatggatagattgccaaaattttctcccattctgtaggttgcctgttcaaactgatgatagtttcttttgctgtgcagaagctccttagtttaattagatcccatttgtcaattttggcttttgttgccattgcttttggtgttttagtcatgaagtatttgtccatgcctatgtcctgaatggtattgcctaggttttcttctaggatttttatggttttaggtcttacatttaagtctttaacttatcttgagttaatttttgtataaggtgtaaggaaggggtccagtttcagttttccatgtatggctagccagttttcccaacaccatttgaatatgaaatcctttccccattgcttgtttttgtcaggtttgccaaatatcagatggttgtagatgggtggcattatttctgaggcctctgttctgttccattggtctatatatctgtttcggtaccagtaccatgctgttttggttactgtagccttgtagtatagtttgaagtcaggtagcgtgatgcctccagctttattctttttgcttatgattgtcttgtttatatgggctctttttttaattccatatgaaatttaaagtagtttttttctaattctgtaaagaaagtcaatagtagcttgatggggatagcattgaatctataaattactttgggaagtatggccattttcatgatattgattcttcctaaccatgagcatggaatatttttccatttgtttgtgccctctcttacttccttgagcagtggtttatagttttgcctgaagaggtcctccacatcccttgtaaattgtattcctaggtattttattctctttgtagcaattgtgaatgggagttcactcatgatttggctctctgtttgtctattattggtgtataggaatgcttgtgatttttgcacattgattttgtatcctgagactttgctgaagtcacttatcagcttgagattttgggctgagacaatgaggttttctaaatatagaatcatgtaatctgcaaacagagacaacttggcttactcttttcctaattgaatacccattatttcttcattttgcctgattgccctggccagaacttccaatactatgttgaataggagtgaactcaggattaagaaactcactcaaaaccgcacaactacatggaaactgtaccacatgctcctgaatgactactgggtaaataacgaaattaaggcagaagtaaataagttctttgaaaccaatgagaacaaagacacaatgtaccagaatctctgggacacagctaaagcggtgtttagagggaaacttatagcactaaatgcccacaggagaaagcaggaaagatctaaaatcaatacccttatatcaaaattaaaagaactagagaagcaagaacaaacaaattaaaaaactagcagaaggcaagaaataactaagatcatagcagaagtgaaggagatagagacacaaaaacccttcaaaaaatcaatgaatccaggagctggttttttgaaaagatcaacaaaattgatagcaagactaataaagaaaaaaagagagactcaaatagacacaataaaaaatgataaaggggatatcaccaccgatcccacagaaatacaaactaccatcagagaatactataaacacctctacccaaataaactagaaaatctagaagaaatggataaattcctggacacgtaccccctctcaagactaaaccaggaagaagtcgaatccttgaataggccaataaaaagttctgaaattgaggcagtaattaatagcctaccacccaaaaaaagtccaggaccagacggcttcacagccaaattctgccagaggtacaaagtagagctgataccattccttctgaaactattccaaatgatagaaaaagagggactcctccctaactaatttcatgaggtcagcgtcatcctgataccaaaacctggcagagacacaacaaaaaaagaaaatttcagtccaacgtccctgatgaacatcaatgcgaaaatcctcaaggaaatactggcaaaccaaatccagcagcacatcaaaaagcttatccaccacgattaagtcggcttcattgctgggatgcaaagctggttcaacatacacaaattaatagacgtaacccatcacatgaacataaccaataacaaaaaacacatgattatctcaatagatgcagaaaaggccttcaacaaaattcaacagcccttcatgctaaaaactctcaataaagtaggtattgatggaacatatctcaaaataataagagctatttatgacaaacccacagccaatatcatactgaatgggcaaaagctggaagcattccctttgaaaacggcacaagacaaggatgccctctctcaccactcctatgcagatcattcttttaaggcttattcattggagaacatttccctagttctccttttacatgtcagaggttgtctctgacaataggagtctaagcaactagtagaataccagaccaccacaagttccattttcttttttcttgaaagtgttaatttcccatggttgaatttctcttagactatgtcaggttactgttagcccctctggctgttccaatttgaacaactaattaatgttagaaaaatttataatgaaatgaaaatgcatttaagatctggtgctttctgtacatcatccagcagaaagattgaaggctgatttggtgggctatcagtttcccactgtgaagccccttgtcttttaaactaactggtgtctagctggccatttgactctacgtttatagccaactttcattaatcattataaaagaaaactagaactaacttcagtcttttgctcttattaagtgatcaagtgacagtcttatcaaaaacaaagtatacctggcagtaacttatggtggaatagaaaacgaaagttgggacttacattcttgtctgattctgaagacaaagagagcacaactccattaaaagcatcccagaagcaaatggattgtttaaaactaaagctaaatccttgttggcttctttggtcctggacttgagttatctcttcttttttctggatttaagacaaaaccaaattgtgaattcagtgtctcgagaaccttatgtctcctagatctgtccagatgtgaaaatattctactcatatttgaatgcctcattcttttcctgtaggtccaactggccctccaggagatcctggacgcaatggactccctggctttgatggtgcaggagggcgcaaaggagacccaggtctgccaggacagccaggtaagacaagtaaaacatgctgttggtggagggaaagtctttgagtctgagagacctctggacatagggcctccacttagagctgtgagatcttctcttgatgttagc

SEQ ID NO: 8849 - DNA, 903 bp, artificial
  synthetic oligonucleotide
ttgtctgggccattcattctgtggaaatgtttctgcagcagcagagaccccggaggtcagctttactccctatttttccaaggcatatggccacaccagttctggcccaccagggtaaggatattcacttacatgtaagtcagtggtcataggccattttatgaaaccaaataatgtaagggtttgcccaatagctttcttttccatcttctttttttcttccgtttatatttcctttttctccttttcaactttcctctgctacttttctttctccttttcacttggttacatctttttaaattttataattgaccaatcttcattaaattagtaattaaattatctttccataatttaatcgaataataaatatctaaataattaatttaatttaatatcttcaggtaattttctctagtctttctcctataaatttcttttttgttcattctctctacactgtcagacttataatcaaactttaaacttcaaatccctaacctaccaggtcaacagaggaaccattataagttttgagcactacgaattcaaaaatgtaatgcagttagaagatggaatctgctatcagcatgtaattataacttttcagaatccatgtattttctctaataagaacaatcagatttggaatctataaactggccctgactctggtacagtttaggcctcagacacaggaaggccatgacggagcccaagatcctaggaatggtcctggattgcagaggctctgctggggctcacacaaggatcacattggaagtatcttgatgactaagcaaagatacaggcagctgtcactttgatgttaaagaaacaattacctcctgatcgaataaatgcagtctgtgttgaattagtggaaggattataggatgt

SEQ ID NO: 8850 - DNA, 3270 bp, artificial
  synthetic oligonucleotide
ctttctttttttggtttgtttgttttcccctcacatctttccttcctgtcttatttttttcctttttacgtattcttcaaacctgactgtggtggctgtgcacactggccagcattactattgtccctaggcctaagaagattgcagattcacacaagatacatactgaggaagtcttagaagaagagagggcagcctggagcacgaaatattgataagatatcgtaaggactcagtatgtgtccttcacttgtacacaatgaattactaaatatcctccataagacaccattgtttataagatgcatcactagtttaaaaacagcattagggaatatataatgagctaccacaataaatattaacatactttattaaacacatcctaattttataaatgttaaaatatgagtaaatcttagacttaagaaatatagtatatttattacctatgaaaggctggcaagtttccttgaaaggctgtttgctattgttttagaagaaaccaaagtatcattatcacgcagtcctttactgttttctctccaaatctttctagggacggctggcagctgccttcgtcgctttagtaccatgcctttcatgttctgcaacatcaataatgtttgcaactttgcttcaagaaatgactattcttactggctctctaccccagagcccatgccaatgagcatgcaacccctaaagggccagagcatccagccattcattagtcggtaaggcattgatttagctgtgacttttaccaatccccagttagttagctagtcagatttgagtccaaagctaacaatctgatgatattcctcctaggttaggtagaacagaggtacctcttaatattcaattaagtatttagtttgactcatatttattgggggtctgcttttgaccaggcccccatgatagacatagtgtaatagccagataatgcacagtgtagtaattatttattacataaatttgtctaatatatatcagatttgggctaagttctataatagatataataaaaatgttatgaaaacatagggaaagagatgtttagtttcaactggagaaatgtgggatggccatatggaaaaaatatgtcttgaactggtcagtccttgaatgactagaaggacttgaggcacaggcagttataaaggggaaatatacactaggcagataaatgacaatgggtaataaaacaatgtgtctaggatgtagtatgtaaaggttatgttgggagaaaagattgtaaagttagcttgggcccagatggtagaaggccttctgtaccaaattgtagtttaaagtttatttgatatgtaacaaggagccctgaaatattttagagctacacttcaggttagattatagtgccatcaatgtgtaacatggattacaaaagggatagtctcgaggtagagagaccagttggattgaagggtattgctatagccctgatgtgagtaaattggaactcacagtggggtacatgtatcacattattaggctagataggatttgacagttgattagctatgggaagaaggtggtagctgagatttggagcatgagtaactaagaggagggtgataccattaatagaaatctcttagagttttgccattttgaaacctagtttaactcaatctcttaggaatgttggttattgccgtttttattctgatcatgacccaggatttcaataaccataaaggatgaattgctggaaattctcgttcctttgatagtaaatataaagattaaagctggttcagccttagtagcaaattcatggtgccctttttaatacattttcctgaatcctttgggaatttgggtgtatgtgtgtgtgtgtgtgtgtgtgtgtgtgtacaattttgtcagtcccaactcttgggagtaaaagcttgtctaaatgtattaactattttgttaggtaaactgcaaaactggcctcagtaatatgtcaagaggtccactcatgttttttattaaagatatggaagtctcagctatattcattctgttgctatcttacttgattttatagatttcagccacatctccaagtgcctgggtacctgcccagcattctggatatggtgtacttctccagatatagtcaaatgtttataaatgtcctttggaccaagaataatgagtagagattgagaaagcgtccgtttcttatattttccagtctttctgacattgttcttaccacagtttcagcattactaaatgtctcccctccaattgagtactttgacaacaagtagtatgtgcaatacaccaaaccaaactcttacggcaattgaggcattgactatagcaagtatgaatagacatttagggcataatggaatattaaaaggccattgcactggttctgcagttttttgaaaaaagtttacagtttattatgtatactgggagacaatacttagcaaatgcaatcctcaaagtgcattttttcaccttttgtgatcattgaaagagacattaatcggcttccatactaagaaggcttccaatgaagcaggatggctacttctcacatgctcactctgtagattatgttccttctccttttcctttaccagatgtgcagtatgtgaagctccagctgtggtgatcgcagttcacagtcagacgatccagattccccattgtcctcagggatgggattctctgtggattggttattccttcatgatggtattttacactcttccttgcatttgtcatcatagctgactgtccattccatctacatttcttcccaatatgaggaatccctgtcatttgcataataagaagcttaaacttcaaacagcttctatccaagcactgtgttccccctcacacattttttgtaacatattttcataatctgcctattacttttttttgactacccttggtgtggatactattgtcttacctctgggcctgttccttcactagatttgaatttggccaagctcagcacacatctttggatattcactaagctattatggcacatgggtattgcggcacatttttccttgtcttttatagcatacaagtgcaggggcagaaggctcaggtcaagccctagcctcccctggttcctgcttggaagagtttcgttcagctcccttcatcgaatgtcatgggaggggtacctgtaactactatgccaactcctacagcttttggctggcaactgtagatgtgtcagacatgttcaggtaaagtgcttatagcttt

SEQ ID NO: 8851 - DNA, 895 bp, artificial
  synthetic oligonucleotide
atgtgcagctagtctatgtgtttcttaaatctcctaactattcctagccctgctttgttgtttgaagtacacaaattcattccaggacattaatattgttaaccctctcttgccatgaattattcaaagattaatctagctgctctactagttacctatggtgagttttttgtgttttgttttgttttgtttttgtttttgtttttttttgcttttttatcatctgtgaaatttccagaagtactatggtaagttttacagtcatacacaattaatagctttctcacattggcaggaaatgaatgaactattctgcttaatcagatagtttgactaccaaatatttatgtgtaccaaatgtggttttaccagttaatgaatctttcgtgattcagatgttacttaaggaccaaatcctagtattttatagctgtgtatgtgtgtgtgtgtgtgtgtgtgtgtgtgtgtgtgtgtgtgtgtacccacacacacgtgcacatgtatcttcagaaaaattgaggtctacatgaataacttccattatatatatattacgtaatatatatatacacacacacacatatggataagtgtatacacacacatgtgttgtgtaagaaagtagacattccaattatttttatagcttattggcctgatctttgctatgttggtgtcacactcattgcttccaaaggaggttgtattggacaccttgtgattgtatgatgttttttcccacccatccaaatttgaacaacactttttcattcttgtagtggcaataaggttctttgcctcaatgtcatgccaagccatcaaatgcttattcagaagttaatcacaagagggcactattgcctataaaaatgaatcagcatgtgtaatgatttga

SEQ ID NO: 8852 - DNA, 1279 bp, artificial
  synthetic oligonucleotide
tcattgtcacacatccacaaaaagacatggtagtctttcaaaaaagtttttttcaagtatctatatcacacatgagttttatctactgtaattaaagtaatatatttagctataattctaagcactaagcaccaccaccaatatctcctgtgttcctggaatgagcataaccttaatataaagagggggaaaacagaatgaaaaacaaggttagaaagatagtccctagcttcttgtgagaaagttaaaacaactataacaaaagtctgagcatggatatattttaaatggcctacatacttttaattccttgaaaataatgcagaaaatccaaaaatgttgaaaacgttcttggggattacaagtatggaaatacagaatgaattgcaaacttcacatttttttttctgtagatatttaagaatctgttttccaattcaatatttccttgctccttttgttattgaaatgctaattcagatttttgccagtgaaatagaagatcctataatggatattctgagattgaaaagtgaaggagggtattgcttctagttcagttctatggacccaaatatttaatattaagtaaaatcaatggtctcttcctaaattctcaggactttattctaaataagctttccccatttacatagaatggcactgatgttgctgagaaattccaatgtagcatgcaacagtggttcctaattgctttagcatttatcatgcacaagagacaggagggaagttgtctcattttgtatagctcagttgcatttcttatctctgaagtacatttaagcagcaaactgggacttaaggtagctgcctgaaaaccagcgtccattaacatgcatatcttgcggggttggcgggggatgaattgggttttctaaagcagaatacagttccatctcattctgtgcattaattttacataatttctcttttacacattttataaattaaggaccatgatctgacttacccatacaaattctcatgctcacattttccaggttgtgcctcttgtctgctttgttttcaaaacatttattttatttttccttttcgtcccacactatgctgatgtaagttttcaaaacattatgaaaaagcatcttggtgcatttccaagatgctctttgggctcaattagtacctggtaatattcttccaagtagtcatgggaggtgtttaactactgtgcacttacgcatcttttacctgacaagtcttatgaacaggttttatgttataaagaaacagtactact

SEQ ID NO: 8853 - DNA, 2768 bp, artificial
  synthetic oligonucleotide
gttttgctaatgagcaaaacttgaaataatctgccctttagtcctgcctttaaaatactggtaatgccccatcaagatatcagttcagttgacatttaattcattgatcaagaaatgttttgtgtgtgtaatactcggaaaaaagattccagatcataccttccttccaattatgacagctgttttttctttatgtgccctggtttaaagtttttcaacttcaaaattgaatctaaatattttacattattaaaattggcattgaccaaatttatatgtattctaagttacttttttttaaagagggaaagagttatgagatgctcacttgtatagtatctgtttcctttcaaagggacagactggggaggaaaaccagaaaacaaaaaacaaagcacagtgtaaatattgttaattagaaatcactggatccataagcagcagtatgaatgatctgcatgaataggatcattcaattgccagagtccacttgtaggcttgtagaaatttgggttgctttctactcagaagcctctgagttttctttcctttaggcagatctggagtagacgaagataaaattccataagcatcacttttcttctaaaatgtgtttttgtggcaatataatcactctaggaaaaagataataaaacaaaagttacttgcagaattaatgtggagagctgtcacccccaccctgttttaaaacaaaacaacacaaaacaaaacaaaatctaactagaagtttttgagagatatacagaggagactgcctgggcatggacatggttaatcaactctgctggctgcctgtgaggaatatcagctgggcaaagacacaagggcagttattcttcttgcccccaggctgtcactgacatttctggtggacagcatctttgcacgtgcgtgcactgttctactttcttccagtggagcccaagagtgagccaggcattgtgcagagaaacagatttttttcttcttcttctacatgtttgactctgccttcaccaggttatgtggcacaagtcataggatttaagtacagcattggtgatggtctctagactcaatcattgaatttcttctaatagaacaaagtcatacctgcaaaggagacttgaaattcccatctgtttaataaaagaaaaaagttccagcattattctcttggctttctgcttttgagtgggtgcataatggggagtgtggcagggggtgatcagatacatagaagaaggtgctggaccagagaagggataggaataaatgatcagcaaattgattatgggatgccagtgttaccttaagatcaggtcaccacaaagtaccaagtattctattttatttgagacatcttaaaagaatccatggaaaacatcccccagagtgggcttcaagtacaagattgtctattaaactggaaatatacattttaagtattcattttctcatcaaaggttttacaatttttttaaagagatgaggtctcactatgctgcccagggtgaagagcagtggcatcattatggctcactgcagccccacccagactcctgggctcaaggatttttaaaatgtaacaaatttgcagctggatgaagcactgagtgggaacagtacatttccctcttactagttgtgtctcttcattaagattcaatgtataggtttgttcttgtagattagaagtttaaaaaaatgctagccatggtggctcatgcctataatcccagcactttgggaggccaaggcaggtggatcccttgaggccaggatttcaagaacagcctgggcaacatggtgaaaccctgtcgcgcaactacactctagcctgggtgacagagtgagaccctgtctcaaaaaaatgccatagattagtaaaggtattaagctttcctgtcagcagtgggtttaggaaattttacattttatgtatctagttctacacaggaagaaaggagtctgtgataaccacagttaactgtgagactgcatattagtaactgttaattcgctgcaaaattaggctagaccagtaccagtattacagtgttatcagatatcagctacattttaaaatagatatttaaggttaggaaggtatttcacctagtttagtttactattttgttttaataccaaaaatattttcatatgtccatatatagcacattgcatgtgctttaaaagggacttcttgctgtcttatatgatacactggatttcatatatattttcccagaaacctgcaaattaagctccatataactaccctattggcattatactaagattaggaacatttgcttttattggagttgtttttctttctctttcctttttttaaatgacagagcctctactaaaatttgattcatattgccattgctttcctataacacctacaccagcattaagtgaatgtttggtaacttaataaaaagtgacaaataattgtgtaatttcatgtttacttcacaaaatacatttgtcaattcttgattaactatgctagtagaaaggaataatgttatcccaaacaggataatcccaaaataatttaacttgcttttgaaatgcattatgggaacttgagccacagatttgcctttataatcctattttacttaggccaatattaaaatgagtttacattcccggggcacattccaaagaacagcgtaaggaagcaactcagaagcttgctgggtggcaaaggaaagcaattcgagattaaaacttggttgtgaacagtctgc

SEQ ID NO: 8854 - DNA, 10764 bp, artificial
  synthetic oligonucleotide
ctatatcagatttaaaacattcaattccagcacaagtcaaattcttttattctaagagccagggcaaacagttcaatgtaataaaattacccaggtcctggaagatagtccacagttataatgctctgaatgaattacttacaacaaaatttgctactatcaagtgaaagcaaacttgtaattttttcctaatcattaaccatgtaataatctgtcaccagtgggaaaataacagactaaacacctgattaaagggaggtgtcatgtgttgggtggagtgctggacttgaaatcagatgtatgagttagattttcagctctgccacttacctttttgatcttgggaaaattctcaacatgggcttcatttccagtacttaccatccatcagtaaaataatgaatgtgaatgtgctttgcaaactataaggcaatctgcaactggaaagcatttcctcaatcaacaatttgacaatttaacaatagacccttttaaatcacataaactattccttagttctccctacactcgtcagccacatctattcccacaggaattatttttttgtcactctgagaagcctaagtttgttcccaaaacaggggattagggagagaaaaagaaagtaagagatctcgttcgaatttttatacatgtgtgacattctggtgtgcttaattaaagttctggtccttgtttaaggtaagtattttgctagtagttgaaatttttaccctgaaaacatcactcttaaaatagaatgaatgcaaatgaataatgattgtgaacaactttagttaactttaattaagtgaagtcctctttaattgttagaggacaaatacctcattagtccaaacactgtccaattttgaggtgttgaatattacctaaaataaatgatccgtcaatggtagctgggaaatttctgctatatggaaatttttataataattaacttcaatggaataaaaacaatgtgctcttagtgcctataactgatagcaacaagtttggcagtagtacactcaaaagaagcatgattccttcatggtgataacagtgtctaacactgaaaaattaattactaaagttttttttttttgctttttaataccaagtgccatcataacattactaatttggctgaccgattctctcacccctcctagagctgcccttttatatcctcccatctcttgaataaaaaaaccaggaaaatgttcacctcaagtcattttgaactatgaattgtacatcaggtaaggtagaaaaagaagcaaatagtcatacataggttaacagtcaaactaaactgcataagaaacaacattcttctcctaaatgctaatgcctataacctatgtgtttaaaatgtgaagacttcatctttaataaatgattaaaaattatttcatttattaatacagtcatgtctaaggttatacttctgggtgtttctttctaatcgacttgagtaaattcctttactgtacttacttatacgcaatgtgactgtaggtaaatggaattacatattaattttgtgttacatgagaacagctgtctcacagatttataatctcacttcacttaaatggtaatctataaacatgccaactgaacaataatgtaaagtattttaaatgcaagtaaagactaactgaaaagtgagattttcagatggagaatcttaatttaggtttgtttttctaaatgtaataataacagtagcaacaataacaatggcaataactgtaaaataattcatgtatagtacttactatatgccaggcactgttctaagcacctgccatcaattaaaatgactttttgaaatacataacttctaataaagatggtatttgttcctctgtcaaagcattatgtttttgtttcctaacgtgattgtttttgttttaatgttagataggaaaatagagatcagaaatgagtgaaaattattctacagctttacaataaaaaaggatcagaatcattcagcttgttcttaacacttcacagacaacattctaccatacaatttacattaaaatgctaaccaaagtcatttcctacaatgggttgtttcaccaccatcaacaccaccaccaccaccaccaccacccccacccccgcacccccccgccggcaatccccaccattcctttcatgtatttcagcaaattatgtgcaggaatcaccctcaagatcaattattttgcaagaaactgaatcagtttaaactgccgaaatttcacttcagtattaatccaatgacactaaaaatatcttacatttgtaaagtgctttaacattccaaagtgcttccacgttgattctcttatttcaacctaagcgcctgcctccctgtgagatagagcttccttgctaaagtcactcaataaagctaggaatttcctcaataaacaatgcatttacagaatgttaaatctccaaaatagctacaaagtcataaatcaggaatttatgctaaaataatgatcattgtgtctaggtattccttgggaagtcagaatttattcaaggaacagtaagatttcactatttaaatcttaaacttcttaaaataaacctctatgaaaactggtccttttgaaagtactacagggacacaggcaactgtgtatcatctacatcaaaattataaatggtgtcttcaatagttagactcaaacaatagattgagatcaattttcaggtatattctacagaataaagtagatctactcttgaaaatcttattatggattaaagacttggaaatgaaattatatattttaaacgtatgattatggtagcagtggtgatcatgtgtgtttgtgtgtgtgtgtatgtgtgtgtgttggggagggaactcacagtttaaaagaggtctgaattgaatcctttggcaagccaaagcatccttttgttgttttaatgatcactctttaatgtgtccacgctgcaaatgtgagtttgtgtatggcaagttttctatagcagggagaaaaaggggatgtgggggggctacacctgcattaaatagggagcttgttaggtgactgttgtgatcagtgcccgacttgttctgcctgatcaagcacagtgggcagagatccaatcacaaaagcattccacaaagcaagcaaagcaaaaatcttcactaaactgactactggaatgaaaactgctggggtccatcccttcccttcactgggaaagaagcatattctacttaagaggcaaggtagttgagactatggagacatcatcctctgcaatcatctcttgaaaatgtttcaagacacactgatgacaacattccacaatgttgtacacagtagaattactctaagtcttgtttccaagtctgacagctcctactcttccttacttcttcctttggaaaagtagccctttaaaaacttccaccattccagggtaagctgcccctggagtcaggtcttcctccagccttatcttgctttccttgatttcccataagatatatgaattaaatgttttaactgctttttaaacctttgaaataatattcatatccattctcaagttgtcaccacaccctcttttagaagggtggggggttaaaagaagaaaatgaggcacagcaaatgtgacttgcctgtcattactagtgacagagaaaaggaacactcaaggtttctggaatttatcctgtgtaaaaacaaaaagaaaatcaacacacaaacacattccagagccaaatactgtcttcttttaatcacctcctgttttggattatttatgttttgttccccccagacattcacgttaacaattgagatttaactttcttggtaaatcacagcaaactagcacaacaacgactgctctttaaaaagtaactttcagaggagaaaattatcctccctaaacataaatagttgattattactgcttaatagtctgtgctcttattaaattcctacacttaaatatgggcatttgcagaaaagcagcttttaattgttgatttgaaaattagttggtggaacccaatttacgatatcctgctttacattatcattaaatgatggggaaggatgtttaaaagtatccttatgctttttatgtctgcgttttaactactcctaaaaaagtagaaccagtgtttaaatgataatcagttctgtccagataaagaaattgattagataaaaacaaatttttgcaaagatcaaaaaggcatttgtgaataattaaaactgaattctatactccatgtcgaatagcaccagttaatgaaatagtatccctaacactgtagactgtagcgcatcgaatcattagacaatgaccattcactttagggaaattaattctaaaattaccgacctcttttgggagagtcgaactgattatcacgtctggcaaaatccattctcacgtgagtgtcgtcgtcgttgtcagaatcttctctctccgggggtcttggcacccggcgactgcgaggtggtggttccggagcggcagctgcagcggcagccccgccagcctggttatcacctctggcaaggtttgcagatgggttgtgggctccagggttcgagccaccggcaacgtcttgggctccccttactgcttcggcatcagcagcattagcaacaggttgaaaccagcgggcagaggcggagtcaaatccagcagctgcggctgctgcgccgatgcccggggctgcggcgagcgcggaggccgcagctacaacttggctgagggctaaagtcggctctgcagccgaagcgacagccggggctgaggatggggaaaggtctctctcgaggctgtctgttggaaaagcagagacagcggctctggctgctgcaaagaaactttgagaacggctttgtgggcgtcttctctcctgctcttcttcctgcagcagcctagctacaggtggtggttcagaacatcggctgggggagagagaaatatccatacagcactcagaaaatgggtcgaccacatagattcgacctgtttcagcatcatagcgaatggcactgtcagcaagagccatggctggtgtcattgctgagttgaaaattacttcaatgtagtcaccctcttcctcaatagcattgctacctgtagcactgaggggaaggggaggaagtggccacctagcactgtccagagataaggggttggcacgtggtatagctcttaaaagatctgagaggtcgtttgctggatttggaaatggcactccaaactcaacattcacataattagaaaaggctgactgtctgggttcagcaattatgccccacgaatctggtagtccttgagtagagggagctggtgtattgctctctcttttagtgaagtccatgttgacgtagtcactagagctgtcagcttctctctgctcatgtgtgggcttttgtggttttggcttgattttatatccttttgtaataaaagaaagtcggttaggtctcttagctttattctttgggggctcatgatctgaaggctttgaaggtgatcccccatctccaggctttgagaatgatccctcacctgaaggctttgaagctgcatctttggggtcccagttataggagacttctttgtctaggcccctccccaggaactttccaggtaacattggcacatactcactgttgtcattctgtcccaaaggtgagctccgaaaagggtttggtagagagaagtaggagctccaacttttggaggaagagccaccctgaggatttctggggttttttggaattgcaccggctccaggagccataaacatgtagtcactctcactgtcattgtcctttgagtcatcctctttattagtatcaggtgcttttggaggactcggagcaggtggtgggctcactctgggaaacatcatcatgtaccctcttgaatcttcaaaaggggatcgagagtggcgcttttttgaagcagagacattttgaggagccattggcatataatcactggagcttacaagaggggtggccacccctggcctcattggcacgtatgggtcatcctcatcttcatcaaaagctctggctctgtggggacctcgagctgcaccttctgggatctctgcatctttcacttctttggcttctttgcattctttcgtggctcctctgtcaacacaaaaataaagtctgaatcttcccccagacttcccttttccaccagttcctccagctggtgggggtggaggaggaggtggtggaggtggtggcatttgctgttgcttgctttgagttaatttgccaaaataggatcttttcttcagagattttccacgttcaccatcaccatcggatcctttcccacttcctgagcctttgccccccccagagttcttgccaccacctgagccatggccatctccaggtccctggccaccacctgagccatgcccacctccaggtctctggccaccacctgaaccgtgcccacctgcggtgccctggccatctctagagcactggtttcctcctgagccctggccatttgagccctgaccacctcgggatccctgtccctcgcctgaacactggtttcctcccgagctatggctactggagccttggccatttgagccctggccacctcctgagccccggccatttcctgagccccaattgttcataggcatgtagtcacctccgcttccttcctgatcttctttgccctggggattgccttcctccccaaagttgccagagccagaaccagacacttcagaagacaggcgagctccattgttcggggcttctgcagggtgccggggacgtgctgggctgggtgctaagcggcgaaaaaagctggccggcactgaaaccgctctccttgacctgcgccctctgggcaggtgcagtcttcctcgcctggagtgggccacaggctcgctgggtgttacgaagcgcctggtgaaaagcatctcgtcttccccgtcgccgatggccctgaggtggcaaaactgctcaaagcgggaccttctgagccagcctcccggctcgagcggcaccaagcccaggtgcctcctagcggacagcagggttaacaggtgggcgccgatgctgatgctgtagctgcggcagcgggctctgtattcgtctgcacacaaggctctcatcttctccaaaaacagctcatgcatgttttgggcaaccacacagtcatcgacctgcatccagagctctcccggaccgatgacagtggacctgcctacttccaagaagaaatactgctccgagtgtccacagcgacggatgctcaggagctggacgaccacgctggccacttcggtgttcagcctcacaaacacgacctcctcgtcggttagacacagccggaacacgccgctcagctcttttctgtgccccagccccctgggtttgactattacctgccacacatctttatagaagggtggctccgccgccgctgccgccgccagcgcggccggctctccgtccggctgcgcgccgagcgtgccgcagcggcggcgcttgctctcgaggatgaggcggctgagcagcaagtaccagctttcctgctccgactcgttctcggccaccatcgcgaagtattcgtcttgggtgaaaagagcaatgaggtgtcggtaccttgcatctgctcgctggctcacggaaaagcactggtatagggtgatcacgcgccgcggtggaatgagcggggggatcgcggcgccagaggcggccgccgctgctgcagccgccgcggcgcggacactgtgccggaacttcctggcattttcgtagtattccagccgagctggggcgtcagcagtctcgagtttgagcacgaagtagcgcctgtgcccatgcttctgtttccgcaggtagccgcgtttgcagacttcctccccgacgggcaggtcctcctcttcggactcggagtctgaccgggagccagtggccgtggagagccacatggctcccggacaagacgacccggtcccaatgagtgcggtcggggttcccgaggaaagaagcggggtggtcaccactgctgctagagctgccgctgccgccgctgctgcacctcttagtcttcttgtcgcttggtcgcgagtgaaggagcaactcgccatggtgatgcacgatggttttaaggtgagcgaggaggagggggaattcaggaaagggagggttgggggaagaggctgtctaccctcgtctgcccgccccagccccctcctgccttggcccgcgcccccgcccactccactctgagcgcacgacagcgggcaaaacaacacgtgaccacagcctcacgcggcggccgctgcggatcctgctaccggcgcaatggaggggcgcgagcggccaccagtagaggtgagcaagggaggagacggcgggctcgggaggcggagccacctccggctgtgccaaatcctcccggtcaatctccaggcctgtgggccaagggaggaccgagaggaggaggcgggctctctggccaagctgattctaacagggagtccaggaaggcatgagggggcgggagaaggcctggaggggcggaggagaaagcggccggctatcagggtcgggagagggcgccacagtcggggccccattggtgggaggtggtgggagggggcgtagcgcaagcagtgcctgcctgcggcgccagggtgcagagcgggcacagtcgcgggacagtttgtttgtttatttgggaagcgggagccaggtgaaactgttgcaaggctctgattggttgggataggagccaatgggagggtccggcaagaaggcagccccgaaatcattagtttggcgggagggaggggtgagaggggagaggggagagggggcgtggctggggtcccaaagtggcttcgctgtcggcttgtggcgctctcaggcggtaaacaaccttacgcaaatagctgttaatggtggtggtaaactcgtgcaaatcccagagccgtggtgacccgggatggagtcgggtgccctggtactccctgtcaatcacataaattctctgttcctgtcacagtctggttcattctttccagccgcacaaggcggcggatcgagcttcttgggagaaagtgtcggcaccccctgaaaacgggttgacgaccagggcgctcagaactgcttcccaccgctctgcaggcactcccgagcccgctgcacccctgacagaagcccgcgactctgaggcacacgaataacagcgatgcattcaaaatgaacatgatctttattaatcagaatgcacttctagcccacgaaacacaggttccctaaatacagtgtttctgcctatttgattaacgatgactatgaaagcacaaatttgggggcctgcaatgtatacagccatattggaaaaaattggactcgattcttactgaaataaccagtgttgggctgtgaaggtatttttctgtgggaaatgctttggaaggtgcctttaaaagaatctcaaaatattgctttcctttccttgagcgagaccgaaaaactttagaaaaagaaaagctcatacctagaacaaaggaccacgctgaatgcatattctagagcacatttcacatccctcgcgtcaacaagaagaagaagaggagctttgatgcatttcagtctacaagttgacatcacaaaagtaagaactactgcctccctcatttctggaaaaactgccggagtgtaagtgcaacctcctcaagtctctctctctctctccctctccttctccctttccctctccctctccctctctcccccaccaccccagttattacttgactaggattttagactcttaatggtggagatgggtcgtgaattatcaaaggagtgaccaggtttgcaaagaggaatggagggagaggaggagagaaatacagcatttctctctgaaagaatggaatgtcagttcacccttgctctagggttgatatggcaaagggtactatttataaaatccaacagtaaactaggcaatatgtatatcataaaaataaaccatatttctgccctcttaagaatttgctctgttagaaacagaacacacgtatttgaataaatggctcctttttgatgctataatttaagagaaaaagaaattggtttgggttgtcccccagatattacaaatattcaataacattccctctgctgccaatggtttataagtgcaatatattcacaggtgctggaagcagccgtggtttcggaagggagctagaggcagaacgagtgtggatgctgagagatccctgactgtgactgctacatatttcagctgcgtagtcacatatatacaagattccctgcacttacaaccaaaatgataacaaatgctctcatttgggattttgtttgatagtcattaggatattttataagtctttccaagcacaaggtttttttctttttttttttaaagagaaatgtgacaaataaggcaacatatttgaaagtgctttgagtaataacatgacattgaaaatatcaaaatgaatattaaatgaaatgggaaaatactggagatttttaaatcctcatgtcctttttcctgtacatatagtttttacatagagcagtaggcttacaatttatataattttgcatcctgttcttttcactgaacattatacaatatttccccatattattatgcatcagcataaatatcatttaaaatacaacatattatccaacacaatcgatgaatattaat

SEQ ID NO: 8855 - DNA, 1832 bp, artificial
  synthetic oligonucleotide
ggcttaagcgaagacagctggattctcatatctacttctgcattcagcccattgtgatacaccactcgactgtaaacttgtaagaggatgagggtaaaaaaggaaaatattattttagtattattataaaaattgttttgattttatgaacaccctgagaagggattagagacctgcaagggttcccggactacatagttagaatagttgttctacactattagtgtagggaaaatgatgcaatatttataaaatacttactataagttaggcactgtgcttaatactttgtatacattacatattattttcctcattttatagatgagaaaacagaggttttgggccattaagtggttcagatcccactggtagtaaatggtaaagttaggattgaaacctaggcctgtccgcctgtaaagcaaggcctttcttcaccataccccaactccaattttaccaataattgatgtgtggccatggaacctgtttctatcctgtagttgaaagaaataggactttacattgctggaacaactaaggattttgcataattagctttattccatgcatttggaatttattcctcataaaattgaaagggattaatgactgacagaaggcaggccttcgtgctagtagaagttatttccaaatttccctttcaaaatccttcctttccctgcattttcaaatccagagcacaatcatcctccaactacctttttattcctcagtatctcttgcaggaagggatcgataaaaccaattctcacttaggtgttagggatttaatgatactcctctgaagagtatttttactacctgagggtggggaatggctcttattcatctttgtaaccctagcaacctgcacactggaactgtcagtgtccaataaatattggttgcctttaatgggaagtaaaaggccaaagagggagtttttgaaaccaaagaaagaatgaaatttcagttatcagtgggggaaatatatttattggacccaataaatcacaacatacataaaactacatatctaactgcatggaaggacaacgaaaatatttgctttaatgtaaatgtcctttatgttcagttttgatttgactgttctagaaactctggaaagtagatattgttgatttgacagtagttaaccttctaaaatgttaaaatgttaaatatcattattaaaactaatatttttggctacattatttttatgctgttggttttctcacatgcattggagagatccagagagtgtaacttcaactgacagtgatgttgttaattacttctctcatcaatggtttgtctctattgtagcttgtgcagcaattaaaagaaagttcctagttatctttttcattcattgcatttggaagtttgcactaatctaagaaggaagagacctaatcattgcgtagaggatcaaaactggggcatggtacatgataggtatgctcaaactgtaaactagtctttccctgatatcaatatcatttctgtctctaaccaaattgtgtttacattgaatgcagttttttaaatctgcagaggaataatgcaaatgataattgtgtgtggtagtttttaaaaatgtgtttttaattttaaatttgaaaataaccatgttaaatgtaatagcttccagtcagaattcattttaaaaatgctgatgtatattggctcagaattaactctttgtaattctaagcccaataccgagtttgcccatgtataaataatgattgatagacaaggttattaagttttgccttgttggtatggctgccttctagaaaaataaaaaatattaacttgcc

SEQ ID NO: 8856 - DNA, 377 bp, artificial
  synthetic oligonucleotide
atctgaaaattcaaatacagcaaatatttattttgttcttaacatgtgcatgactttactaaatgtagtgaagaatatgaagatgctacctacctcgggcagtgtattcagtcacatagtcctcatatggtatgacaactatcccagagttcagagtatacaccagggatgccaaaaatgccagatatccacaacatatgtggagggctcctagggcttaagactttagctctgggtcatatagcatagggtatatgctctgagggttagtttttaagtatgaagtcttagagttggaaaaaactttagagattacctagactagcctccaactcaacataggaatctccactacactcttacaagtggtcatacag

SEQ ID NO: 8857 - DNA, 798 bp, artificial
  synthetic oligonucleotide
ccactttcttgcctgtattttcaaaccctctctttcaactggctcctttccttctggatacaagtatacatggtttcggtctcttaaataaaacaccataccataaaatactttccattaaccctaccacatactcaagctacagcttcatctctcttccttttcaaatttcttaaaagagttatgttgcttttcctgtctcaatcaatgtgcaatttgacttccactttaatttctgtacagaagctgaactctggatggtaactaatgtcctctttctcatcaaattcaaaaacatatttttagttttccttttcttaatccctttgtagtgtgctttgatgaaaagagcatagacttcagctcaaaactgatgtggatttgaattcaaattctggccctacctttatgtcactttttgagccataggtttttttttttaatctttgaaaaggggttgattatgtctactttgccaggagttgtcaagattagagaaaaggatgtaaaacacccagtatatagttggtacaaattaagttatttctacccacgttttgtaattgctttttaaaatctcttaagcgggacttcctcctcctgtctccttagaaagatttccataccttgagattttgcccttggacccatcctttcatcatattgtacctccccagtgtcttatgtactaccacctcttcaactaatatgtatgtctagatgtctttcacacctagttcgagatatctagaaatctcttctaaatgcctgatgtgaatttccagcttaaagttccat

SEQ ID NO: 8858 - DNA, 12409 bp, artificial
  synthetic oligonucleotide
aataatagtaactttaatcaaggaccctaggaaaattttaagttattttatataagagaattgatatacaggagggaggcaaagcaagatggctgagtgtgttgcgggaagtcacggaccccaaacagagagaccggctgaaaccatggcagaagaacgtggatcgtgaagattttatggacatttattagttccccaaattaatacttttgtaatttcttatgcctgtctttactgcaatctctaaacataaattgtaaagatttcatggacacttatcacttccccagtcaatatccttgtgatttcctatgcctgtctttgctttaatctcttaatcctgtcagctgagaaggatgtacatcgtctcaggaccctgtaataattgtgttaactacacaaattgtatagcatgtgtgtttgagcaatatgaaatgtgggcaccctgaaaaaagaacaagataacagcaattgttcacagaatacgagagataaccttaagctctgaccgcaggtgagccgggcagaacagagccatatttctcttctttcaaaagcaaatgggagaaatatcgctgaattctttttctcagtatggaacatccctgagaaagagaatgtgcacctaggggtaggtctctgaactggcccccccagggcgtacctgtctcttatggttgagattgcagaggtgaaataaactccagtctcccatagcgctcccaggcttattaggaagaggaaattcccacctaataaactttggtcagaccggttgatctcaaaaccctgtctcctgataagatgttatcaatgacagtggtgcccgaaacttcattagcaattttaatttcgcttaggtcctgtggtcctgcgatctcgctctgcctccacttgccttgtgatattctattaccctgttaagtacttgatgtctgtcacccacacctattcgtatactcccttcccttttgaaactccctaataaaaacttgctggtttttgtggcttgtggggcatcacggatcctaccaatgtgtgatgtctcccccggacgcccagctttaaaatttctctcttttgtactctgtccctttatttctcaagccagccgacgcttaggaaaatagaaaagaacctacgtgattattggggaattctccaccaatcatcctcctcacaggaacaccaaatttaacaactatctatgcaaaaaaaaaaaaaaaagaaaccaccttcctaagaactaaaaatcaggtgtgtgatcacagttcttggttttaacttcatatcactgaaaggggcatggaagagggtaggaaagacagtcttgaatggctgacaccactcctccctcatctcctggcaatggctgcataacagagagagaatctgtgcacttgaaggagagaaagtgcagcaattgtggggctttggattggaactcagttctgccaacactggggagaactcagccaatgcccatggagggagcatttagaccagacctagccagagaggaatcatacctcccagcaatgggaacttgagtttgggcaagccctgccacactgggctaaagtgttctagggtgctaaatgaacctgaaaggcaatctaggtcacaaggactgcaactcctaagcaagtcctagttctgtactggacttggagctagtggacttgggggggcacatgacctagtgaacaccagcaggggtggctaaaggagtgtttgcctcaccccttccccaaacccaagcagcacagctcacggctccaaaagagacccctaccttctgcttgaggagaggagagggaggactaaagaggattcgtcttgcaacttggatatcagttcagccacagcagaatagggcactgggcagacttgtgaggcccctattccaggccatagctcccagatgacatttcaaattctgggccagaagagaacccactgccttgaaggaaaagacccagtcctggcaggattcatcacctgctgagtaaagagcccttgggccctgaatagtcagcagtggtaactaggtagtacacactgtgggccttgggtaaaactctaagacatgctggctttaggtgtgacccaacatattcacagctgttgtggctacaaggagagcctgcttctgcttgagaaaatgagagggaaaagtaaaagggattttgtcttgaagtttaagttctggctcaaccacagtgaggtaaagcatcaagtgggctctgggggtccccaattccaggccttggctcttggacagcatttatggacctaccctgagccagagggagccaactgccctgaagggtaaataaaaagcctgatagcattcaccacaatctgactgaagagcccttgggccttaagtgaacatcagtgttaccctggcagtattccccataaacctgtagtggtcgtggacatagggagagactcctctgcatgaggaaaggggagggaagggtgggaaaaattttgtcttgtatttctggttccagcttagctgcagtagaatagggtaccaggtagatttctgactccaggccccgactctgagacagcatctctggatgtgcccagggtccagggggcctcaccaccatgaagggaagttcacaagactgactggcttcaccacctcctgattttagattactagagccttgagcaaacatagatggtagccaggtagtggttacagagggccatgggtaagactcagtgtgtgccagcttcaggaatgacctagcacagttccagtggtgagggctaatcaccagaaagaatcagtgagttttaagatagaatatttgaaaatatatagtcaagagagacaaaagaaaaaaagaataagaaagaatgaagatcaatcaatgaatggataaagaaattgtgatatacatatatgatggaacactactcagtcataaaaggaatgaattaacagcatttgcagcaacctggatgagactggagactattattctaagtgaagtaacccaggaatggaaaaccaaacatcatatgtcctcactgatatgtgggagctaagctatgaggacacaaaggcataagaatgatagaatagactttggggacttgggggaaagagcatgagcggggtgagggataaaagactacacatatggtgcagtgtatactgctcaggtgatggatgcaccaaaatcttataaatcaccactaaagaacttatgtaaccaaatactacctgtaccccaataacttatggaaacattaaaaaacaaataaaatgaagaggaaagaaagaagcttgctacaagatctagaaaacagcctccaaaggacaaatttaagtgttattggcctaaaagaggaggtggaaagagagataggagtagagagtttaccagagggttgatatcagagaactctccaaacctagagtaagacatcaacattcaaatacaagaaagttatagatcataaagcagatttaacccaaagaaaactacctcaatacattgaataatcatactctcaaagtccaaggatgaataaaatatcctaaaatgggtaagagaaaaaaacaaacaaataacatacaatggagctccaatatggctggcagcaaacttctcagtggaaggcttacaggccaggagagagtggtatgacatatttaaagtgctgaaggcaaaaaaaaaccattgtatcccagactagtatatttggcaaaaatgtccttcaaacatgaatgagaaacagatttttccagtcaaacaaaagctgaggaatttcttcaacaccagatctgtcctacaagaaatgctgaagggagttcctcagtctgaaagaaaataatgttaataagcaataagaaatcatctgcagaaaaccaaacaccacatgttctcactcataagtgggagctgaacaataagaacacaaggacactgggtggggaacaacacaaaccgggccctgttgtcagggtgggaagaggaagagaattaggacaaatagctaatgcttaatacctaggtgatgggttgataggtgcagcaaaccaccatggcacacgtttacctatgtaacaaaccttcatgttctgcacatgaatcctggaacctaaaataaaataaattttttaaaaaaagaaattatctgaaggtacaaaattcactggtaatagtaagtacacagaatcacacagaacggtacaacactaattgtggtgtgtaaacaactcatatcttaggtagaaacatgaaaagatgatatcaaacaaatatgataactacaacaactttttaagacagagatagtctttataccatattgtatggtataaatacatacaatatggtataaatagaaacaacaaaacgtttaaaagtggggcaatgaagtcaaagtacagaggtttttagttttctttttgcttgtttgtttatgtaattaatgatacattgtcacagtttaaaataatgtcttataatacataatttgcaagcctcatggaaatgtggggttcatgtccccacacagagtccctactggggcattgcctagtggagctgtgagaaaagggccactttcccccagaccccagaatggtagatccactgacagcttgcaccatgcacctggaaaatccacagacactcaatgtcagcccatgaaagcaaccaggagggaggctgtaccctgcaaagccacaggggcggcgctgcccaagaccatgggaacccacctcttgcattagcgtgacctgtatgtgagacctggagtcaaaggagatcattttgcaactttaaaattttactgcccttctggattttggacttgcatgggccctgtagcccctttgttttggccaatgtctcccatttggaacagctgtatttacccaatacctgtacccccattgtatctaggaagtaactagctttcttttgattttacaggctcataggcagaagggacttgccttgtctcagatgagactttggactgtggacttctgggttaatactgaaatgagttaagactttgggggactgttaggaaggcatgattgttttaaaatgtgaggacatgaaatttggaggggccagggatggaatgatatggtttgtctctctgtccccacccaaatatcatcttgaattttacctcccagaattcccacatgttgtgggagggacccagggggagataattgaatcgtggggtccagtctttcccatgatattctcatgatagtgaataagtctcacaagatctgatgggtttatcaggggtttccacttttgtttcttcctcatttttctcttgccaccaccatgtaagaagttccttttgcctcctgccatgattctgaggcctccccagccatgtgaaactgtaaatccaatttaacctctttttgttcctactttctggtatgtgtttatcagtcgcatgaaaatgaactaatacagcatataaacaaaaaccaggaaagagcaggatagtagctaaatttatatcagataaagtagatttcaagacaaaaactaaaagaagagacaaataatatagttataaatccatcaatttggcatgaggaaataacaattgtaaatatgcatgcatccaacactacagcaccaaaatatataaagccagtattattagagctaaagagagagactccaatacaataatagctggagaccttagcaccacactttcagcattggactttacatgtacagtacatctacatatacatatacatgtacagtaggtacatataaaataatatacctaggaataaacttaaccaaagaagtaaaatacctctacaatggaacctatataacattaatgcaagaaattgaataggacacacaaaaaaatggaaagatattccacgttcatgaattggaagaatcaatattgttaaaatgtttgtactacccaaagtaatctatagattaaatgcacccctcctctaacaaaatgcaatgacataaatgctttcagacagaaaatcaatgaaaaaacatcaaacttaatctgtactatagaccaagtggacctaatagatatttatagaacattttatccaacagctccagagtacacatttttctcctcagcacatggattattctcaaagatagatcataggttaggccacaaaaagagtatgaaaacattcaaaaattgaaatatcagccatctctgaccacaatgaaataaaactagaaatcaacaacaggaggaattttggaaactatagaaacacatggaaactatataatatactcttgcattgggtcaataaagagattaagaaagaaattgagaagtttcttgaaactttcaaactcattctatgagatcagtattaccctgacaccaaaaccagacaaagttgcatcaaaaaagcacaaatataggccagtatctgataaacattcaggaaaaattctcaacaaagtgctagtaatccaaattcaacaccacattaaaatattcatttgtcatgaccaagtgggcttcatcccacggatgcaaggatgattcaacatatgcaaatcaatcaatgtgatacatcataacagaatgaaagacaaaaaccatacgatcatttcaaattgatgctggaaaaacatttgataaaatccaatatctcttcatgatagaaaccttcaaaaatctgggtacaaaaggaacatacctcaagataataaaagccatatgtgacaggcacacagctggtatcacactgagtgggaaaaagactgaaaatcttccctttaatatctggaacatgacaaagatgccctcttgcaccactgttattcaacatagtactggaattcctagctagagcaatgggacaggacaaagaaataacaggcatccaaattagaatgcaaaaagtcaaattatccctgttgcaagattatatcttgatataatcttatatcaagaaaaacctaaagaatacacaaaaaaactattagaactgataaacaaattcattatagttgcaggatacaaaatcaacatacataaatcagtagtacttctatatgccaacagtgaacaatctgaaaaagaaattaagaaaataatcccatttacagtaggtacatataaaataatatacctaggaataaacttaaccaaagaagtaaaatccctctacaatggaatctataaaacatgaatgcaagaaattgaatagaacaaccccccaaaaatggaaagatactccatgttcatgaattggaaaaatcaatattgttaaaatgtttgtaatacccaaagaaatctagatttaatgcacccctcctctatcaaaatgcaatgatattgttcatagaaacagataaaacaatcctaaaatttgtatggaacctaaaaaaaaacaaaatagccatagctatactgagcaaaaaagaataaatatggaggaatcacattacctgactttaaattacactacaggggtatagtaaacaaagcagcatagaattggcataaaaggagacacatagaccaatgaaacagaatagagaacctaggaacaatccatacatctacagtgaattcatttacaacaaaggtgccaagaacatacatcagggaactaacagcctcttcattaaatgatgctgggaaaactagatatccatgtgcagaggaatgaaactagacccttgtcttttaccatatacaaaaatcaaattaaaatggattaatgacttaaatctataacctcaaactacggaactgctaaaagaaatatttggagaaactctccaggacattgcactgggcaaatatttcttgactgataccccacaggcccaggaaaacagagcaaaaatagaaaaatggaatcaaatgaagtaaaaaagcttctgcacagcaaaggaaaaaatcaaccaactgaagagacaacccacagaatgggagaaaatatttgcaaactactcatctgacaagggattaataatcagaatacataaggagctcaaacatctctataggaaaaaaatctagttatacgatttaacaataaaatggacaaaaagtccgaatagatatttctcaagatttacaaagccaaatacgtatatgaaaagatgctccacatcatagatcatcagagaaatgcaaataaaaatgacaatgagatatcttcttaccccagttaaaatggcttgttttgttttgtttttgagatggattctcactctgttgcccaggctggagtgcagtggcacgatcttggctcactgcaacatctgcctcccaggttcaagtgattctcctgccatagccctctgagtagctggaattacaggcgtgcgccaccccactcagctaattttttatatttttgttagggacggggtttcaccatgttggccaggttggtctcgaacttctgacctcaagtgatccacctgccttggcctcccaaagttctgggattacaggcatgagacaccacacccggactaaaatggcttttgtccaaaagataggcaataacaaataatggcgataatgtgaaggaaacagaacacttaggcactgttggtgggaatgtaaattaatacgaccactatggagaaaagtttagaggttcctcaaaaaactgaaaatagagttactatatgatacagaaatctcactgctaggtatccacccaaaagaaagaaaattagtatatcatagagatatttccactcccatatttattttatttcatttttaaacttttattttaggtttgaggacatatgtgaaggtttgttacataggtaaacacatgtcacaggggtttgttgtacaaattattttatgacccaggtattaagcccactatccaatagttatcttttctgctcctctcctgcctcccactctcccccataaagtagaccctggtgtctgttttttccttctttgtgctcataaattcttatcgtttagctcccccttataagtgagaacatgtggtattcaattttctgtttctgaaagtttgctaaggataataccctccagctccatccatgttcctgaaaaagacatgattccattcttttttatggctgcttagtattccatgatgtacatgtaacacattttctttatccaacctgccactgatgcactcccatgtttattgcagcattattcacataagcgttcatcaacagacgaatggacaaactgtggtacttatacacaatgaaatactcttcagccataataaagaataagatcctgtcattcgcaacaatgtggttagaaatggagatcattatgtcaagtgaaatacaccaggcacagaaagacaaacttcatatattctggtttatctgtgggaactaaaaattaaaacaattgaattcctgaagatagagtagaaggatggctaccagaggctgggaatagtgcggttggggagaagtggggatggtaaatgtgtaaaacaaataattagaaataattaataagattagtatttaatagcaaaacaggttggctgtagtcaacaacaatttaattgtacatttaaaaataactaaaaggtacagttggattgtttgtaagacaaaggaaaaatgcttgagatgatgaatactccatttgcccttatgtgattatgacacactgtattcctgtatcaaaataccccatattcccataactatatacacttcctatgtacaaaaaagtgcaaaacaaaacattttaaaaatgggataaaaataataaaatattggatatactaaatgtactaattaacaattattcctctttttttttttttttttggaagacagggtctctctctgtcacccaggctggagtgcagtggcacaatcatggctcaatacagccttcaccttgtgggctcaagcaatgctcctacctcagcctctcaagtagctgggactaccggcatgtgccaccatgcaagagtagttttttaattttttgtagagaccgggtctcattatgttgcccaggctggtctcaaactcctaggctcgagcaatcctcctgcctcggcctcccaaagtgctgagattacaggcctgaggcactgcacctggcctattcttattcatttttaattttttaaatatgtacaacatttatttgaaaacgaagaaaacattacgttaaatactgaaagtcaagggaagctccaccaatgaggacatggttgagctaagtcattatcagcactacagcttcaactggagaaaaaataaaacaaaatttttattagtctcaaaggtaatgcatttagcccaaatatattttttaaatttttttatttcagtagtttttggggtacatgtggtttttggttacataaatagttctttagtagtgatttctgagattttagtgtacctatcacccaagccgtgtatactgtacccagtatgccgtctttcacgccttaccccactcccaaccttccccacaaagtcccccaaatccattatgtcattcttatgcctttgcctttacatagtttagttcccacttgtaagtgagaacatacaatacttggttttccattccagagttacttcacttagaataatggctaacagctccttccaagttgctgcaaaagacattatttcattcttttttatggctgagtagtattccatggcatatgtatataccacatatgctttatccactcattggttgatggacacttaggttgtttctatattttttcaattgctaattgtgcttctataaacatacacgtgcatgtatctttttcatataatgacttcttttccttagggtagatacccagtggtgagattgctggattgaattggagctctacttttagttattgaaggaacctccatactgttttccatagcagttgtactaatttacattcccaccagcagtatcaaagtgttccattttcaccacatccatgccaacatctattgttttttgagtttttaattatggccattcttgcaggagtaaggtggtatctcattgtgattttaatttgcatttccctgataattagtgatgttgagcatttttcatgtgtgttggctgtttgtataaggatagtctatttgtgtgctttgcctactttttgatggggttatttgttttttttttttcttgctaatttgagttccttgtagattcggtatattagcctattgttggatgcatagcttgtgaatagtttctcccactctgtgggttgtctgtttactctgctgattatttcttttgctgtgcagaagctttctagtttacttaggtcccatttatttatttttgttcttgtatttgcttttgggttcttagtcatgaattctttgcctaagccaacgtctagaagagtttttttgatgtcatcttctataatttttatggcttcaggtcttagatataagttgatccatcttgagctgatttttgtataaagtgagaagtgaggatttatttctttattctacatgtggcttgtcaattttctaagcagattaaattaaggactacttttagcatatggttttttgttagccaacattcttgtcagtaaagacacatagtggggaataaactcaaggtgggaaaagagtgtctaattgaatttggaccacagctcatccagcagggagatagtcctagaacaaattacgtgtaggaaaaaatatctaatgaaatccctttctttagtttaagctgcaatatctttaaagcctccagaacaaatatattattttctttttcacacacacacacacacacacacacacacacacacacacacatttctcttcatccaaatcttttctcaggaaagtatttgaaagaatttgagagcatttctttttctatggctccacatcttcaaatttaattttaatagatatcaaaaccttgaagtacaaaataaagttttgggtgtgttttcaaccagatgaaaaggaaacaactgggtccgagggagaagaaagcttatttagatctgtgaaatcactccattgtaactgttgtcttccaacacaactctgacttttaccagcttactgtaggctaaaggcagagacatcaggatatcagattcacctttttgtgatggtatacactttttcctactctgacaaaaattcagttgaagttataaatcttattcttcattatgaagttggtaaatatgtcctcctggagacaaagaaaacctttctttttttctaccttaaatgaatactgagtgagcatctgaaagcatttttttttttccagaagtaggtcttttgagtaccttagtcttttgccttagctaacctcggctaaccttaaaatt

SEQ ID NO: 8859 - DNA, 566 bp, artificial
  synthetic oligonucleotide
ctcattcttgagccttctcaatgatactgaagccacctagaatccctttaaaaatgtgtttattgcttttaatagctagagtgggtttcgttgcttgcaactatgaacactaacggatatactccttattaatcattttatattcttacaaatttctcttgtgtatgccctcagatcagataagattatttactcatggctccatgcttccctctttttaccgtgcactttattctctctacactctgaagcctagataattcctactactcttggatattgaaacactttgagcatatgtcctaggacccttgtccacctttttaatttacttcagcatagagttcacagccttctttagcatcccaaagtaggctgtcttccagtgaagttcatattccagagggtgtcctcgaaggtatagcacctggtacatagaatttcccaaaatgttcctccccttaaaacagcctgacttcaatgttttgccaggaggttttcctttcattaagttcaatatttgaattttaaaaaatagtttattacaaaagtagtacataaataca

SEQ ID NO: 8860 - DNA, 380 bp, artificial
  synthetic oligonucleotide
caaccagtttgcaaacttcctgaaaattccataatcatctcttgcatgccagttcatgtcagctccaacacgtctctgtgtagtccccttgtgaagccctcacagagtaaaagaatagaattcaggctcaaaaaaaaatttataagaaaaattacatgttcatttttataatttctaagtaaaatttaggatatcctttgattataaatgtattttgaaattataggtagatccactgctggatctttcatttaaaatcttaataaaaagtgtatatattgccatatgaattttttaattttgataactaaatttcagttcaatgtatttacgttgtattcttttgtattttacacattttaaaagggctttagaggctt

SEQ ID NO: 8861 - DNA, 6086 bp, artificial
  synthetic oligonucleotide
aattcttagttttaaagtgtccataaagaaatatccagacctaaatggttttacagcagaattctaccaagcacttgaagaattaacacgttttttacaatatcttgcagaaaatagaggctagtattctgaagctactattaccctgatacccaaaccagacaaaggcagtaaaaaataaaaactacagaaaatatcccttatgaaaacagaggtggagggtattccaagatggccaaataggaacagttccaggccgcagctcccaacgggatcaatgtagaggatgggtaatttctgcatttccaactgaggtaccaggttcatctcattgggactggttggacactgggtgcagcccatggagggcaagccaaagcagcacgaggtatcacctcacccagggagtgcaagtgttgggggatttccctttcctagccaagggaagccatgacagacttcctggaaaaatgggacactcccactcaaatacggtgctgttcccaaggtcttagcaactggcacacaaggtgattctctcccttgcctaactcggcagctcccaggccaacagagtcttactactgttagcacagcagtctgagatccatctgtgagacagcagcctgtctgggggaggggtgtccacaattcctaaggcttcagtaggtaaacaaagcagccaggaagctcgaactgggcagagcccacctctgctcaacaaggcctacagactctagactccacctctgtgggcagggcatagctgaacaaaagccagcagacaacttctgaagacttaaatgtccctgtctgacagcactgaagagagcagtggttctcccagcatggtgtttgagctctgagaatggacagactgcctcctcaagtaggtccctgaccccgtgtagcctaactgggagtcacctcccagtaggggctgacagacacctcatataggtagctgcccctctgggaagaagcttccagaagaaggattgggcagcaatatttgctgttctgcaatatttgctgttctgcagcctccactggtgataccaaggcaaacagggtctggagtgaaactccagcaaactccaacagacctgcagctgagggacctgactgttagaaggaaaactaacaaacagaaagggatagcatcaacatcaacaaaaaggtcacttatagcaaaaccccatctgtgagtcaccaacatcaaagaccaaaggtagataaaactacaaagatgaggagaaaccatagcacaaaacctgaaaattctagaaatcaaagcacctcttctccttcaaaggatggcagctcctcaccagcaatggaacaaagcttgacagagaatgactttgatgacttgacagaagtaggcttcagaaggtcagtaataataaacttctctgagctaaatgagcatgttctaacccattgcagggaagctaaaaaccttgaaaaaagattagacaaatggctaactagaataaacagtgtagagaagaccttaaatgacctgatggagctgaaaaccatggcaggagaacttcatgatgcatgcacaagcttcaatagccaattcgatcaagtggaagaaagggtatcagtgattgaacatcaaactaatgaaataaagcaagaaaacaagattagagaaaaaagagtaaaaagaaatgaacaaagactccaagaaatatgggactatgtgaaaagaccaaatctacatttgattgttgtacctgaaagtgacagggagaatggaaacaagttggaaaacactcttcaggatattatccaggagaacttccccaacatagcaatgcaggccaacattcaaattcaggaaatacagagaacaccacaaagatactcctcaaaaagagcaaccccaagacacaaaattgtcagattcaccaaggttgaaatgaaggaaaaagtgttaagggcagccagagagaaaggtcgagttacccacaaagggaagcccatcacactaacagcgaatctctcgtcagaaaccctacaagccagaagagagtgggggccaatattcaacattcttaaagaaaagaattttcaacccagaatttcatatccagccaaaaaaagcttcataagtgaaggagaaataaaatcctttacaggcaagcaaatgctgagagattttgtcaccaccaggcctgacttacaagagctcctgaaggaagcactaaacatggaaagaaacaacaggtaccagccattgcaaaaacaggccaaattgtaaagaccattgatgctatgaagaaactgcatcaatttacaggcaaaataaccagctaacatcataatgacaggatcaaattcacacataacaatattaaccttaaatgtaaatgggctaaatgccccaattaaaagacacagactggcaaattggataaagaatcaagacccatcactgtgctgtattcaggagacccatctcatgtgcaaaggcaaacataggctcaaaataaagggatggaggaagatctaccaagcaaatggaaagcaaaaaaaaaatgcaggggttgcaatcctagtctctgataaaacaggctttaagccaacaaagattgaaagagacaaagaaggccattaaataatggtaaagggatcaattcaacaagaagagctaactatcctaaatatatatgcatccaatacaggagcacccagattcaaaaagcaagtccttacagacctacatagaaacttagactcccatacaataataataggagacattaacaccccactgtcaatattagacagatcaatgagacagaaggttaacaaggatatccagaaactgaactcagctctgcaacaagcagacctaatagacatctacagaactctccaacccaaatcaacagaatatacattattcccagcaccacatcacacttattctaaaattgaccacataattggaagtaaagcactcctcagcaaatgtaaaagaatagaaatgacaacaaactgtctcgcagacaacagtgcaatcaaattagacctcaggattaagaaactcactcaaaatcattcaactacatggaaactgaacaacttgctcctgaatgactactgggtaaataacaaaatgaaggcagaaataaagatgttctttgaaaccaatgagaacaaagacacaacctaccaggatctctgggacacatttaaagcagtgtgttgagagaaatttatagcactaaaagcccacaagagaatgcagggaagatcaaaaatcgacaccctaacatcacagttaaaggaactagagaagcaagagcaaacaaattcaaaagctagcagaaggcaagaaataactaagatcagagcagaactgcaagggatagagacataaatcaccattcaaaaatcaatgactctaggagctcgtttcttgaaaagatgaacaaaattgatagaccactagcaagattaataaagaagaaaagggagaaaaatcaaataaatgcaataaaaaatgataaaggggatatcaccaccaatcccacagaaatacaaactaccatcagagaatattataaacacttctacacaaataaactagaaatctagaagaattgcataaattgctggaaacatacaccctcccaagaataaaccaggaagaagctgaacctctgaatagaccaataacaggctctgaaattgaggcagtaattaatagcctaccacccaaaaaaagtccaggaccagacagattcacagatgaattctaccagaggtacaaacaggagctggtaccattcattctgaaactattccaatcaatagaaaaagagagaattcttccgaactcattttatgaggtcaatatcatcctgataccaaagcctggcagagacacacacaaaaaagggaattcctgaccaatatccctgatgaacatcgatgcaaaaatcctcaataaaatactggcaaactgaatccagcagcacatcaaaaagcttatccaccacaatcaagtcagcttcatccatgggatgcaaggctggttcagcaaatgcaaatcaataaacatattccatcacataaacagaaccaatgacaaaaaccacatgattatctcaaaatgtgcagaaaaggccttagatgaaattcaacagctcttcatgctaaaaactctcaataaactaggtactgatggaacgtttctcaaaataataagagctatttatgaaaaagccacagccaatatcatactgaatgggcaaaacccggaagcattccctttgaaaactggcacaaggcaaggatgccctctctcaccactcctattcaacatagtgttggaaattctggccagggcaatcaggcaagagaaagaaataaagggtattcagttaggaaattaggaagtcaaattgtccctatttgcagatgacatgattttatacctagaaaaccccatcgtctcagccaaaaatctccttaagctgattagcaacttcagcaaagtctcaggatacaaaatcaatgtgcaaaaatcacaagcattcctatataccattaacaaacagagagccaaatcatgagtgaactcccattcacaattgctacaaagagaataaaatacctgggaatccaaatttagaagaataaatcaaacaaccccatcaaaaagtgggcataggatatgaacagacacttctcaaaagaagacatctatgcagccaacagacatgtgaaaaaatgctcatcatcactggtcatcagagaaatgcaaatcaaaaccataatgagataccgtctcactccagttagaatggcaatcactaaaaagtcaggaaacaacagatgctggagaggatgtggagaaataggaatgcttttacactgttggtgggagtgtaaattagttccaccattgtggaagacagtgtggcaactcctcaaggatctagaactggaattaccatttgacccagtaatcccattactgggtatatacccaaaggattataaatcatactactataaagacacatgcacaggtatgtttgttgcggcactattcacaataacaaagacttggaaccaacccaaatgtccatcaatgatacactggattaagaaaatgtggcacacatacaccatggaatactatgcaaccataaaaaaagatgagttcatgtcctttgtaaggacatgaatgaagctggaaaccatcattctcagcaaactatcacaaggacagaaaaccaaacaccacatgttctcactcataggtgggaattgaacaatgaggtcacttggacaaagggcagggaacatcacacactggggcctgtcggggggtggggagctgggggagggatagcattaggagaaatacctaatgtaaatgatgggttgatgggtgcagcaaacaaacatggcacatgtatacctatgtatcaaacctgcacattgtgcacatgtaccctaggacttaaagtattaaaaaaaagaaaaaggaaaacagacacacaaattattaaccgaatattaagaacagaattcagcaatacataatgaaaattatacaccataacccaatggagtttattccagggatgcaagtctgattcacatttgaaaatcaatcagtgtaatctaccatattaacagcctaaataagagaattcactagatcatattaatgtatgcagtaaaagaatttgactaaattcaacatccatttatgatgtctctcaggaaaataggaatataaaagaacttcctcaacatgaagagcatctacaaaatactggagcaaataacactgaatgatagagaatggctgctctcaccctaagatcaaggccaggaggttcttgattctcaccattctttttaacgtatttctgggagttctatccagtgaagtaaagcaaggaaattatgcagaaagcatatggatgggaagaaataaaactttctctttttgaagatggcatgattggctacatagaaatgcctgacaaatctacaaaaaaaaaattcctgtaactaataagtaaatttagcaaggttacaagaca

SEQ ID NO: 8862 - DNA, 1282 bp, artificial
  synthetic oligonucleotide
cattgaccacatgattgaactcaatctgtaacctccttgaatatctccttcgttcagtcccaattttctaataataaagctgattttttggcaaccaaccatcatcctgaagctacccagttctactccctatgagtcacctcattattgtaacaaagacagtcctatcacttgggaaattccattcccaaatatattttttattttaccacaccctctatgctagtgacaccaaaagattttattttctctggaagtcactaagatagcttcacataagacatccaatcaatttccaaacccagtgtcaccagaatcaggtggaatgtctgtcccaagttctttctttatttccctgcactgtagtaagtattcaagaaatatttggtgaaaagaaagaaagaaagaagagaagaaaagaaagaaagaaagaaagaaagaaagaaagaaagaaagaaagaaagaaagaaagaaagaaagaaaggaagaaagaaaggaagaaagaaaggaagaaagaaagaaagaaagagaaattacccttaagaaactctaaatattgtagacaaaatagatacatgaacaagtcactttcatacaatctgggagaccagggaaactttcacagaaaatggagtaagtttagaaggatgagtgttagtcaagtgaaggaatgtaagaagtgggttctagacagaggacttatcttgaataaagatgtaactgaataagcagttttccatggtgtcaaccacttattttcttatccattctttccagttcttttcctgtggcttccatccccttaccaactagttccgtttagattgggctatcgcatagcctctcagagacctttctatcttcaaatctccttgaactgctgtctcagatcactgtagtgcagtgtgcataggtcagccagaatctttctggagtatttggatgtcattccactgttcagatactcaaggtagttagtgctcaaattgaactgaatcataggacacccagttgatgtcagagaataggtgcaggaatagaagatccaaacttatgtgtcaaagtcctctctagctaacccctccttactgaacttccttcagttcctgctagtgtcttccctcagcttttgctactgtctgacctgaactttttgttccagccactttgtttcctgagtgagaaaatatgacttccttattcccatttctgaaccatcccacaggccaggaatcccctctcttctcttacctctcctccttgaacacagctctggcaagag

SEQ ID NO: 8863 - DNA, 1660 bp, artificial
  synthetic oligonucleotide
taatgaaaaagaatctaaaaatggatggactcattttacaaagggcctcatgataaaatcaagcaaaggatgatgtgatcataaacaagacagaattagtaggcttgacaagataaacttggttgacatgctggactagagaaatactaaggagggaaataggggataggatcagatacagagttaggaatcactctcagtgggttttgttgcttaataaaagattttggctgagcactgttcattttgcaggcccaccctggagctataggtcctagggctaaataactgaactgtgtttgggagaatacaaattcatggaggctctggagctgcagccccactcccactcccttgccctcaattatccttccatatgtattctgcaggacagtgctaccatctctggaagaagtgaagcttttttattgcctcaccaagaaaagattcaaatcttggagccctttgccctagagcgagagaaagagaaaacagtaagcatgccttacatatcctaggcctttcacaggatttcaatacgaataattccaagcccccgcgccactactatattccataaacagcttgcaaattcctcaactttcctggattgttaaacaaataaacattatcacatttgtcacccaaacttctagttaggtcttaaaagctcagcttttgactgagaccttgttaaaaatagaggatgatattttatgtgtccttctctggcatgtctggaaaaaggagttagaaactctgctcaaggaagttgaaaggcaacttaagccttttctgcatcctcttaaacagctttggcatagcaagtagaccacctgaggctggcagaagttggattctgttaagagataagtagtccaagggcctttgactgaaggttgaaggaaaactgctgggaagaacttttcactctaagctcagattcagggtgagttgatagtggaaaaattaaataatagtgagaaaggtatcaaattataccttaggcatttatttctttaaaaggggttgtactaaaaagaattaactgctttactagctgatatgtttgggttcagctgttttaataaagagatttttttaaatataataaacgagaggaaaagcttgcttaactattttaaacatgcctgagacttaagccttattgctttggtccacgtgactgtggcaagccactgccaataaccccttgaaagtggaatctggaaaactaaaagcataaagtaaaaacaaatgttcaaagggatttattttaggagaaggggtagagggttgaaaggcagggtgggcaggaaaagggagggaaaatacaaaactttaagggaatcgctcagttcaatctatgatttttatatcttttaccctgacaatatatcttacatttattctgtcatgtttagaatactaccctgagtcccagttaaatactcatctagcaaggacaatccaattatgttgcctaacttaggaaaagagacagtgacagttttggaaagattttgaaaaatgagcaataagaaaacaaagaaacttcttagccttcagttatccaaacaacacaattaaccagactcttctccctctttcttccttatgcattccagccaattgaggtcacaatagactgggattcaga

SEQ ID NO: 8864 - DNA, 3852 bp, artificial
  synthetic oligonucleotide
agggactcttacaggtagggtaagactccaggttggcctccatctataggtcagttacttggttgtcaagaaccacaagtctcagaagagaaaaggagtgtaaactcaagctagtcaccccagggcctgagtgatgacctcagaggagtcaaattttctgcctctgttctgcctttctctctttccagtaaactttcctctcaatgtgcttctctctcctcctttcaattctctttcatctgttctctcatttcctctaatccataagaaaaaaatgtgtttaccaagactgagaaaagtaatgggatgtgtttccaactcattaatctgaaatatggtctcactcacagcagctctcatttggagcagttctgaattgtttaacttagaaattccaattagatttacccctttaaatatcaagtccactgttccctattttatatcacatatatttatcccttaacaataatgacaaaaaccataataattagcacatttaattggagaatctcaaagcattttgcaaatatttgattcaaggcttgaacaagccttctatgaggcaagtagaaagagcataccactatagtccaacctccattaactggcatcagactctccctaagcctcaaatagttcaaataattggactatttgagcccactctgttttcagaagaggtaagcaacttgaaaatatattccatcactcattctttcatttattccactcctcctgtactagggctgggaatacagagatggttccatccttaaggaactcacagtacagttaaacacaaccattaggccatgttataggttctaaacacatgaagcccaactcctctgattccaaagctttttctttttacacagtacctagtgtagtgtcttatacagacagttgcccagtaaataatcagactgtttcattaattgaaactctcagcccttgtgcacttggaatactcaagacaccactggatcttattttggaaaaacatgctattaaagttcaaactcaagggccccccaccctcagccatatttgactgtttgtcttgagatctagaggctaacagaacagcatgccaatccccaagggagctttgtagagggattgtccaaagatttgggtgggtcttaggacacactgggatgccaaaactaatggttgcaaaagaggatagaagtgttatggactcaggcaagcttccaaatcaaagagtatgcaggggagctccaggggctctctgaggttttggagtccatccaaaagaattcttagaatcccagttctctgtttacctacctgacttccacaattttgctaaagggagaaaaagagagaaaacaagtatggcaacaactaaagcctgaaccaaactctttgacccaatatcaatccccaagcagtcctagagatcccccatataagagcatcttactttggcatgatgcttatgagacattttggtatctcctatcttatttaatcctcacaaaaatctggaatgtaggttaattattaatctcattctgcgaatggggacactgagattcctggagattaaatgacttgtcaataaataggcacagctgggacttgaaaccagctctactagacaccaaattttaaatgctcttccttccataccacaaagcttctccaacacactggagtcaaaaggcagatctagaggccaaaaagcaactattgggaaatttgaagcttgtgagattaatgagcttcctgataaccacaagtcagatgaggcctctatgtggacaaacgaaagcacagagagagggtgaaattacttgtctgatgtcagacattaagtcagtgatggggcaagaatttgaggcaaaactttctgaccttcatggatctgtcagtacaatctcactatttcttaattgcctgtctgtgtgcatgtgtgtgctcatagacatgctcatacacacactgcttgtgtgtgtatgctggggttgggatatgagtgggaaagactggggaaaataaaacaaatactaatacttaggaacctgagaaccaaatactgtttaaccccagaattcaaagacaagttcagaaagtgcccacttctagaatgtaaattagtacagccattatggaaaacagcatgaagattcctccaaaaagttaaagtagaattaccatatgatctagcaattccacttctgggtatttactcaaaatattggaatcagtctgtcaaaaagatatctgcactcccatgttcattgcagcactaggcacattagccaagttatggaattaacctgtttatcaacagatgaatggataaaaaaaatttagtgtatacatacaatggaatactattcatcctttaaaaagaaagaaattctatcacttgtgacaacatgaatggaattgaagaatatttgctaagtgaaataagccaggcacagaaaggcaaatactgcatgttttcacttatatttggaatctaaaacaattgaattaatagaagcagagagtagaatggtggttacagaagccaaaggtgggtgaaatgaacagatgatggtgtaagaacacaaaatctgttcagtgaggaagaatatgtgtgattttttcagctctattgcatatcatggtgaatatagttaataatgctgtacatttcaaaatcactaaacgaatgcatttcaaatgttctcaccacaaaaaaaaaatgttaagtatttgaggtgatggctatgttaactagtttgattgaattattccacattgtattaataaatcataacatcactttgtaccccataaagtacacaattattaattgtcagtttacaataaaaaattacaaaatatttttaaagtgtccacctctggcaacaacataaactggctgaagagcagtcatttgagaaagtctccccagaatgtaaatctacctaaaagtttctggtaaatacagctgataagcctagatatatacaaaaatctcagcaaggagccccacacttgtcagaaaaatagtgactgaaacaggactcatgtacgagaaaaggtaatacagtgatttatcactagcccacaaggcgagaaatattgaaaaagtagaactggccagttaggcattgataatttgttgcctgtatagtacaagaggggcttgaagtgggcaatgggcagtgggcccaagaggctgagcttctcatctctaaatgagtcctcccccaagctacttcagcttcctcactttggtctctttctttgtaacctcaacccagccaattactcaactgccctatgttctcctctctcacccaattaatccatgtttttgattccactaagggaaataacgtaaagtgtcatcaacctagtggaggagatggcgtggagggaagaaggttcttactggatataaaccttgagcccaagagaaaaggctttaatggaggaatttcaaacatcagtcagctggaaggaaaagacatttctagccatcaactttgaaatcacaccgggctcaccatcaaatgtgatatttctgccccatgtactagagcaactcttgcttccagtagcacagagtggatgaggagtgaaaatattgaatcagaatttctgaagtgtgctggcgacatggtcttattgggggtatattgcatgtccctggtggaccagaaaccccatgtgccccagcccttatgatgcaaagtacaacacctgtttctggtggggaggtagagggtacagacacagaaaggatctctcctcctctcctgacctttccttgggccttacttcctctcctcttccttgttcccttgccccttcctttcc

SEQ ID NO: 8865 - DNA, 1892 bp, artificial
  synthetic oligonucleotide
gctccacttcatagccctcactcagattttgaagaattgtaacagtgctgagactgacatgaatgcgataagctgcaaaagaaggagagacatgatttgggctcctttctcactggcaaaattaatgagaaaatgtcaatgtaataaatgtcttcacttgtaaatgaactagaccattagcaacgtcctgagagaggtttacttagggtttcacaagaggaggagacggagtgatggccttcttcaccaggccgaaataaggcattagttgtagcacctatcagcctcctagacactatcttaaatgaaaggccatgcaatagaaaggtgttaatttaactcaaaggttgagatggagaaaccagcatctactgtgctctcagctgaaacgtgacgtcatttgaagaaagcttgacttcagcagcttctttcacaggctgctactatggctgaactctcatgctttacatatcttaggcaaaatgatgtcttttccatatgcattcttacaactctctctcaacattgctacacttaaaaataaaacatcaatgagaaatatcccaagaactctttcaacaaatattttatgaagactgtacatttatagctgacgtttgggtgggggcacctagctgtgtttacacatgaatgtactattttctaaccaatgatctcaatctgggataagagatttacatagggaactgccacgttaaaattttatttagaacctaagggtaattatttgattaagaataatcacttgttcactcaggtaagatccttgacatttctaaaaactgtcaccctatgaagtgagaccttgttgaggttgagtcttaaataaaagtccaaggctagttttcacacatgcttgagaaaatcattttttttaaaaaaaaagctgattacaacctgagtaggaaggcatggcgggagagaactgcaaggagtttctgctgtgtatactcacagtgactttctttctcttgatagctcagtactgttgtttgtttgtgccttcctcattaactcatgatcatccaaagcccttactcaaaaaaggttgacctattcctaaaatacacatgcccagccagtatattcctagccagtcctatgtgtgcatcccacaagcatctggtcttcagggagcctttcagtagagtaatcttgatggtagggaacacacagcttaaaagagagatagctcataccaaccaccatccacttgtatggtagggagaatcactccaggactgggtcacgagtcacttccattccagaatctcagtggtttcaactgagcacaaaggagatattgatgaaataatttttttattaatagatatgtgacatgtcctgatttcatatccaatgtgaggagaggctacctctctacagatctccattcagttgtggagcttaatgtcatatttgggtcatagtcattagcttttagaaaagcacattaaccagctcctttagcacagagagcacacgcgtatacttctttgtatgcttcacaataacttccttgcacagtcagtgcttaataaacacctgctgtgggtgattcactccattttcttcgttctagctgatcactgggcaaggtgctgtctacatctcaaaattcaatttctggtctcaactttgtatttccaatgtgaaatgtgtggagttttccctggttcagaccagaatatgacttcagccttctacaagcttacatcagtccagaatactgtgccaaatctgcattgcagttccatgataaatttcacttcatcttgggttgcacttcaagagtaaagtcatatgcaaagttatattaatgcagcagttcctggatgactacttccatggcctctgccatatctaaggag

SEQ ID NO: 8866 - DNA, 2050 bp, artificial
  synthetic oligonucleotide
tcacatggctcacgagaaactggagacaaggttggattaagtgggttgtacaagatggaggatcttgaaccactagagaattttgagcaaggaattgcatgatcttttttctcagatcagtgtataaaatgcattgaaaggggaaaatgtaaaaccaggaaaaccctccagatggctgctgcagtaatccaagcacaaagtacttaaaaggaggcaatgataagaagtggatggccatgaagaagtaataagagagacgtaaaagaatcaacagatttattggctgtctgattgacaaccatgagaaaattgccatgagcttgtgagtttatgctgatttgtgggaaaagatgacttgaagttttaaatatgttaaatttgaaataatggtgaaccctacaagaagaggtatgctgaggggggttggaaatgtgaaactgaagcacaaatgacagatgagggcttttctctaaaagaaaaaatcaaacgcctgctatgtgctaagaactctggatacaaacatgagtaagatatgcttcctgccaccaaggagcttaaagcctaatggaaggacagacaaggaaacacagattatgctgatgactatgagaaggatggatggtaagaggcaagagtgaaagcaagaagatgctattgcagtgatccaggcaagagatcttggtgtcccaggcttgggttgtgagagtgaataagagacaagagagatcaataaatatttaaaaggtaaagagtgttcaagacttagtagttagttgaacgttaaaggtcagagtaagggaggagtcaaagagaatgactctcaagactaactggagtaactaggtcaatggtggtaccaccaactgaaatagagaataaatataagaagagcaggaagtttgtatgggtaaaaaaataattgttttagatgtgtcgagtctaaggtccatgtggaacattcaggtgggcatatcagcaggaattttgatatagaaggctgaagcttaagggagaagactgcactaaagctgtggagttggaagtcatcagcgtacaagtggtagttaaaccacagatatgaatgagatcacccatgagagtatgtaggaggagaaaaacagtggatcctgacagaacactggagaagaccaatataagggacaattagagacaaaaggaattatcagacagtggtaggaaatgaaagtcaggttgctgtgggttgagtaataaattagaggtgagacatgcagacagcaaaaagatcacaagactgagagctttgcagaaaatgttagagaacaggaagagtcaagagaaccagtaaataaagtgaaaagcagcattcacagagtgaggagcatgtcataaaagccaattgaggagcattttagggaggcttgtcatgaattccagatgctgcagaggtaaaggcagacaaggaccggggaaagtggtgagaactgaagtcagattgcaaaggggctaaggagggagtggacagtgaagaaatggcacagtggatgtcattcatttttttaaagaagtttggtaggaaaggggtgaaaaggatgggggaaggaaaggagcctagaagagcagagcagagagaaaaaggtggggagtggatacagaagcaagaggagctagtaggtaatgaatgtgggaggaaaataattcagaagtagggattttaattaattaaatgaattatcctaactacaacatatacctgttgatcttgtagcatagtcaaacatggaaatattgcctctaaccaaaatggtagattaaaagagtttagtacctggaacaaggagctgctgcccactgtgttagtgcaggtactgggaggagagtaaatttgggtaggcataaaggaattatgcagcccggacacctggataatccggtggccaggaatcaggggagagctatctttttccctttcttttttagtcttcctagaggcgcattagaatgtttcctcttactttaactggttattacctgagtgaaggccaattcgaattcggaccggcacttctgg

SEQ ID NO: 8867 - DNA, 6291 bp, artificial
  synthetic oligonucleotide
gaataaataaatgaggaagaagagaagattctttcttataataaaatgtcaaccagtaaatgcagaaacaatgatggaatacgacatttatcaatggatgtcaaaattattgggtaaaactttgatgaagaacaggatatttacatagattaaagtatctcccccaatgttatgtattaattacaatgagataaatacagttactctccagtggaggaacttggcagacaccacctaaattaagtaatcaggttaacatcaccagtaatgggatgatcaacatcatcctgataaagtgcctcctgataaagtgcactgaaaaagacacataacttctgtagtattccggctgaagatgcatagtctaaatcgatcttgaggaacacaggcaaactaaaattgagggacagtccatgaaataattgatctgaattcatcaaaaatatcaaaatgaagaaaaacaaagaaaatctgagaaaccgttacagattaaaagcaactaaaaagatatgacagcaaactgaatgtgtgagactggattggaaactgacctgtgggaatattagctgtattgtataagaccattagtaaaattagaatatgggaagtagtttagataataatattgtagcaatgttaaattttctgattttgatcattatactgtagtgtttttaggaagtacacactgaagtatttagaggtaaaagggcatagggtctacaacttactctcaaatggctcagaaaaataatgtgcataaatatataaatagataataaaaagcaactaggcaaaatgtacacaattgctgaatctttgaattattattgaagctttttgtaggtttgaaattatgtcaaaattaaaagctaccccaaaaaagatgtcatggacacactctaccttgggtcaatacttctagtgtatcagctgtctcaggtttggcctgttttggcaccataatttggattacgaaaccagtgtagaattgtctattttagttctgaccttgatcccccttctggactcatgtctcattatcttgccttcatctccaagcattacaatcacgtgtaagaaaaataccaaattggctgggcgcggtggctcacgcctgtaatcccagcactttgggaggctgaggcgggcagatcacctgagatcaggagttcgagaccagcctgaccaacatggtgaaaccctgtctctactaaaaatacaaaatattagccaggcatggtggtgggcacctgtaatcccatccactcaggagtctgaggcaggagaatcgccttgaacccaggaggcggaggttgcagtgagctgagatcgcaccattgtactccagcctgggcaacaagagcgaaattccagctcaaaaaaaaaaaaaaagaaaagaaagaaagaaaaataccaaatcataacatctcttcctaacctatagggcatgtcctatcttccacaggccacatgtcttccatttcctttgttttctcacttgttcagtgctctggaagtagcagttgcctcattcagatttgttggaatgatttgaaattgctcacttcataaatgtagagcaatctgtgattgccttttaaaattgcactttcaagaacctgaagggacccaagatagtattcacaagtcttgtatggactcagtctaaggaggagccaagattttaaaatggcttaggaaggatcatcagtatccctgccttatctacaggctgctttcttaagcaagccatccaaggactccttgaacataattagtgggattagggaaataaccacttttcaaatagaaattaccaggtgactggaaaatgaagatttggaatggtgatgggatatttacttgataataatcataatagctaccacttgataaagaagctatgtgccaggaaatgcgcaagatgctttacgtgtattgtctcttaaaatcctcatccaacctaaagggtagacattaatataacccttttgtaaataaggaaactaagacttagggagtttagatgacttgcccaagttattacagctcttacatggtagagccgagatttgagtgcttcatgtctctttgactccagagcacatacctttgccattgcatgatatgatcataccaacccattagcaaccctgcagtttccctgcactgatttgttaaggggtcttcctaaacagctctgatgttagttactttggagaacagatttattttagtgggaatttacataaacgaagatttctcataccatttcgaacacatcacttgctcttgatttgatggacttaaggtctccaaaatctccaagggagaactttttcagccacacccaatcaccctagaaagaaaaggaggagaatgaatagtgatgaaacttagttgccagcagttttagaaaaatgtcccttccacataaagggtttatacctataccagcaatccaaatagacattttccttctctcccaccctccacctcacagacattctgcattctgagctgaaatgaggtcatgcacagaagttaaacttaaaaattacagttactcaagacagggaaacaattgcaagtatgtagactccagaaacggaatgataccactctttgcaaagcctttcttaactaactgcaggaagtgctaggtcatttcactttttcatagctaaatgatgtagcaccaggttccctgcgattaatggtgatagttagtggttgcaattcccactgccttgaggcgtctgtagagggaaatgtagggtgggagatgtagtgcagcaaatgtttcctgcatttaccttgatccatttttctctcgtgggacaggccattcgtgtgtgtgtatggagggggggctgtcttatgctttagtcacaatccaattgtctttaatctagattaaatattttttatttgagtgctcaatgtactaccatagtaatgtgagtaatctagagtcttccaaaagtctatttctgacttattaagtaaaaaactgctattttaaggcttctgtcaagttaaaaacaacaactattttattgttttcacttcaacaccagcgcctgatagataacctttttctacgtgcatagcctcaaggattcatcagtcataaagccctatttagtttccgtccaacccaaattgttttaaaaaaaatatcaatatagattcttttttctccataatagtaataatgccttacatttgcacaatgctctctacttttcaaagtgctttcacatccattacctacagcctggagattccatttcgggctgcaccaacttgtcatcaagtagagataataaagcagagggcactgtgcagtcaaattccaaaaataagagtgtaaccgggccgggcgcggtggctcacgcctgtaatcctagcactttgggaggctgaggcgggcggatcgcgaggtcaggagatcgagaccatcctggctaacatggtgaaacctcgtctctactaaaaatacaaaaaaatcagccgggcgtggtggcgggcgcctgtagtctcagctactcaggaggctgaggcaggagaatggcgtgaacctgggaggcggagcttgcagtgagcggagatggcgccactgcactccagcctgagcgacagagctagactctgtctggaaaaaaaaaaaaaaaagagtgtaaccactctcttattaaggaatatatccagctatggcactgcatctggaaacctgccagaggcaaaggctaatggaagctgcaggcttccgagttacctgccagcactttgtattagcatttactagccaaggagctcaaagtcctttaactaagaaatggccctcagagaccttcagcagctggaaaaaaaaaaaaaaaagaaaaaaaactgcactggccaggctcagtgcccagagagttcagaagggtagtaccggatcagtgcctgcctgcagcagaatggtcaaagcatttgatccagtaaatctccaagtgtggtccctggaccagctgcatcagcatcacctggaaaccggttagaaaggccaattctcaagccccacccaacacttaacgaaatcagaaatcgtagtagggtgaggtccagcaaactgtgttttaacaagccctccacgtgactctaatacaggtgaaaatttgtgacccaccatcccagcctttgccttttcctcgtatttatggaactctcctcactcacactctcttcatttacctcttactacgtttccttcatcaaaatctgctctcagtcagggatcgaaaagtcattcacagaagtcaggagggcctgacacaagcttgaagttttacccttcagagaactttgtcctttagcgggatcaaaggctacctattaagctgaaagaataaaactctaaccgaaaatttatggaatcagcctatgtgtgggaaagactggtgaacaaaaaagccttcccggcacctttgcagctatgttactgagcccatggtcactgctagccactatggcacctttgtgctagttagaaagggtattttctctcaaatttaaaaaatcttaactttgtgagtatatcatcatacagcctgtggcagccctgtgatgttaggcagcacaccctggctgtatacatacaagtaccatactctcatttatggatacatcccccagacaccagggagcacattccactagcagcatggatgctctgcacatcaccaaattctatctgcccagtgaagcctccttgtcacctttggagtcaggctttaggagagggggtgagaagtcgaaattggttctctgagaatattaggcaggagagaaaagcaacctcaagaaacttctggaacatagtcaagatagtacatacccagctacacatgagtttaccagtgatgatgtatgtgcatagctgggagtgccagtatagatgtagatgtgagaaggctcttctaccacctcattccagaactaggctgggaagccagaatctctgtgcccactttggtaccactcacgcataaattggcatatgttacaatgtgaatattaccctcttagatgtagttcccttttgcagtacacaacctgaacatcagtactcgcagtcctgactctgcctcaaacctggtacctgataccttcttcctagagccagccctattgcaaacatgggctagccttctgtctggcttattaagtgccacgagcagctaagcagagctttttcatgccaaatcaacaactgtgagagctggaaagggtcataggtatccataacacaatcccttcatattttgataaagaaactgaaaacttaagagattaagtgactgtcccaaggtcagaaaactaggtagtaaaagagccgcaaattgacccaaggtcttccatctcctactttgttgctctttcctctcgttaggctttctttggtttgggagatttgtgtgtgtttgttttaagatttaaataattctcacaaactttgtaagcaaatttttattgagtctgtgtgagttctacttcatgaataatgaggaaaagggaggaaatgggcaagttttatcttcaccacacatgcactatttgttttgtttttttcttttaagagagaatgataaaatacttcactcatcactcactttttaattaagagcaagaaacatcaaactctattcactaaactttttagaagtaatttaaagtccatcagttttgaactaaagccacggtgtattaataaggggaaagagcactagatcctagacctggccctgcttcaaactcaagggtggccttagaacagccactcaatctgcctgagcctcagtttcctcactgataaagctagacttactagatgattctttaggacttactaggtgatttctggacttactagatgattttttagctctgatgatctgcgattctgtgataagaaagaaaagatggttgacggaagggaggcggcagggagagagctacaagggatatagaatgtgagaagacagaaaaaatgatctgagaaagagagatgaatggagagagagaaagatgagacaaagaggaaaacacagggagaagcaaagaggaaagagtagtcagaaaatgaagagggaagatgaattcagtgggttctctctgaatgtgtcagggttacactgctgcccaccacaccccatctcacccagactgtaactattagagcagatcctgacatgtccccactgcatctgccattcacagctctttctgcctggcagtccgctc

SEQ ID NO: 8868 - DNA, 1515 bp, artificial
  synthetic oligonucleotide
agcatttctcaactctggctgcacgttacaagcgcccgggaagctatttaaaatacctttgctgggacccaccacagaccaattctagtagaatttctggaggtggcgctgtggcaccagtattcttgaaaagatgtccaggtaattctagcatgcagccacactgagaacccttgacgtaaaggaatctctaatggtagggcaataatatgtgcatttgctccctccctgcctcaaaggggttgtgggtggttagcactcaatcctaattcttctcagtctggcagcccaaagagcttcagggcctggatttatttaacattttatggtagaggccaaaatgtcatttcaaagtatacaaatgggtgggatgtgaaacattcatggaatataaacttgcaggagacattgggcttcaagaagatttgtaacctattataaagttatgatactaaatatattagcctgtttctggcatggctcctcctgcaaatgattttatgtctttcaaaataattctatgctctgctttgaaagtatcaagctctattatgaagtaatcagagccatactgattgctaaacatcacggaatcttgtcaactggagctggaggcagattactgtagttctggaactaaaaactcctcttgccctcatcctcttgtgatcatcataattaaggtccaatactgaagccacttgaaacttaaaacaggcttctgattataggccaggcctaagctggaccattctctaacaaacatttccttaacaatggttaaggaaatgactgggaccaggactaatccttgaaggaatcagtttgtcaaatagtttctgagatatccatcctaaagtggtggagtggctgcagtgggggaatgagcagcgttcccatgaatcatagccatctccagaggaaggtaaaatggaggttaaaaaattggaatagaaaaaatcaaaactaggtgtcacaagggcttgccataagtgtgagtaaaagagatctgattcaagaggaccagaaagggcccccttttgccaaaatgcacccaactaactttgagaatgatagctttagtgggtcaagtcctttgcttcacattttgtctatcgtctctgcaagaatcgtctttgaacattaagcttccattggaaggggaaacttaaaatttagacagtcttttcattttaatatgctttcattcatcagctaggtgccccccatatcaactaactgtgtgctgcaaaaagaaaagccctgctttgagaaaaggcagaaggtatggacatttcggagtccacagaagacagattctaagtaagtgtcccacaaggacactgggtaccgttgaaggaaagtatccagaagggagtcaaaagtaaatctctcctcagtgactagaacaaacaaaaatgaagccataagaagacccgcgcctccccataccattttggcactttcgaagctaccaaggtcctaagggcagaaagaaaggatgtatggctacag

SEQ ID NO: 8869 - DNA, 939 bp, artificial
  synthetic oligonucleotide
aataagaatatataagtaaatgcatgaatagccaagtgtctaaaagcagactttgggatttgaaagtttgggactgaaatcccaggtccactagctgtatcatcttaaccaatttacttaacttctttaaacttaagtttaaatttttaaaaatctagataataatgtctgcctttctgggggttgtgaggattgaatgaaatcatataaaacacaatctctcaatcaagaaaaacaatcaccaatgaagtagtaaacatcagtcattcttggcaaacagtagtagttaactttgccagtgttggtgaatttgggagaatagcctgggaaaataaattcagatcagaccaaggtaggtatttaaagattatgagaatttggaagaaaatagacaatagagttatcaaagtttgtgtgggaggagagaatgagagggggaatgagagggggaaagagagagaagtgggggtgagagagggaggagagaatgagatggggaaagtgagagaagtgtgggggagaaagggagggagagagccaagaagagcgagggagaaaaacgaagagggttagccggacgtggtggctggcgcctgcagtcccagctactctcctcgggaggctgaggcaagggaattacttgaacccgggcggcggaggttggcagcgagccaacatcatgccactgcactccagcctgggccacagagtgagactctgtctctaaaaaaaagaagaagaggaggaggaggaggaggaggggaggggaggggaagagggagaagggttgctatagggaatggtcagaactaagcaagttacttagtatttctttgtaactcaatgttatgtttattgtctagcactctcattacactttgagcctcacaaggattcgaaacatgcctattttattcaccactctatatacagagcctt

SEQ ID NO: 8870 - DNA, 445 bp, artificial
  synthetic oligonucleotide
aaagcacagtaatagctcttaaaattaaatatcatattttatctcttcaaagatgcatgtatttttcacattttaacatctctggaattggtacagatcttaaattgatgccatattatagttgtgtctcatttcccctttctcagtggtaaagtaatggtgagtcttataaacaatggcatcttaggagttttgcctagataaaaatggctaggaatctacttaggtctaaatttgtaggcgttagtggaagtaaaaggctgtaagcttacaagactaataattcatgactcaaacaaattctgtcaccatgccatttgtatttcttgagtagcccatatggctgtaagagccacagattcctcagtgaatttgagtcatggtaacattttcatactttttggaaatcacctagtaatgtatagtgtatctataaagatagccc

SEQ ID NO: 8871 - DNA, 1419 bp, artificial
  synthetic oligonucleotide
tcttactctgctttagccacactgggcttactgctctttttttaatatactgagcccagttgctcctcagggtctttgcatttgctccaacctctgcctaaacgttttgaccagctccttgaatggctgacttctcgactttgagagcttagctaaaatttctatgtcctcagagaaaccttctctgaccactctggctaaagtaacctatcaagtattcatggttacagcaccctgtttctttcttcagaagaagtatcacaattcataattacatatttgtttattagtgtaacccagcagttgcatgcacatcagactccttccagattatgtaggctcagttcacaactttgaaaattttgctcttactcagagccttgaatactctcatatttagaggatgatgggaaattttgcttggctgtttccattaaggagtcttttagccagcaccatgtccatagcacatgcactcctagaagtccccctttttacctccctcttgtcttcctttttaacccctttcccctcatttcatcatgcaattatatcctgtgcttgaaatagtcccatttttactccctcttcaacttctgtgaaaagataacagttttgagataggaagttatagttttattttttcctcatttcccctatttcccttctctgtttatttaagcaagtagtcaaccttatgcccctatgtttcagggaaaaaatgggtcagagtgcttttcctgactcccattattatgtcaggctgccagggaaatcttcaacttagaattcgcctttcaatttagccaactgcagctgaggctgtcatcccacattgagctgcttccaacacaaggcagtttaggcttccctctgaatgtcaagaaataatgagtaaagctagtggcatcctcttgccagtgtgaggtgacagaattccaccagtgtattacataggatccttgggatctcttccaaaaagtcttcttcatggaaaatattttccagtgaatgcatccagtccatttgaaaatttttttcttgaatatccttgattatttagagccaaacagcaaccagttaactagttctagcatttgctctattccccaaagcactgcccttagcactctggaactttatttcttaggctataatatctgctgctatactatatctaagggacaccatagtatcctacaaatggactgttcattagtgatagtttttgccattcccatgagaactttcttatgccagtagagtaagttcacatattctttaccaccaacaaggctacttctttccttcccactactgaatacaactcaaatattatccactgagctttgcactaattctctatcctcatttggtgaaatagtggtcagtttaggattaaagatttcatggctgaaa

SEQ ID NO: 8872 - DNA, 1970 bp, artificial
  synthetic oligonucleotide
cttaaaggttttttaaagtgcatcctgaaagactgcattgtgatctttgaaagtgcttcagaaataagaaaaaaggagggataagtaataaagtaggtataacttttgaaacacttgaaaaaacaacccatttagccatataaacattttcttcacccataatcacacatatcaaattggaactggttacatagatataaatatcacaaccacccaacccccaaatccaaacatcatttccaaaagcaaaagaaaaaggattccttctccatatggtactgggtcttaaggctggaatctctgagagaagagtcttgcgttattgtttaaacaacctttattacctgcctctgacattccccagggttacagagcagggggcatctgagcctcaagttccacggatgaagcagacactgcaataacaactgaatcaatagaggagaggcatttggaagtactggggtgatacacccagtaatggtaatcctcagcagaagatggcatagctaccaaaaatcaggcgttaccactgggatgaaaactggggaggcaagaaaatcatacggttggagtcatagatcatttccctccccgttgagcactcctcccccttccgtcccccattaagttcattctatcccacagactggtcctagtgtcctgctagctccctgctgaaagagagagggagggaaaagatgtctgaggtctcttcatttcctttgtctctgtccctaaggcaactggaagctggagctgctgcagtcggcctggcaagcccgttggctctgcagagtgagcagtccctggcagcccctggagcagctgccagttagacggcccagagttctgatagaatgcattgcttcagttcagtgccaagtgttggacgtgttggattcagttcccagagggctggagcgtgctgtcagggctgtctgaagacaagagagcagaggcagtttagtgcagttggatgtgcggggtaggggtggaggcgcaggggtgaagagggagaaactggcccgaatgggtaaggtggtgcttctccttccagggccttccagacaaggtctcctggcctctcaccattatctgggcctcagatgaggcgaaccctggaagggagttgggggtggaaggtgggaggcgcgcccagggatgagcgagatgaggagggcgcgaaccagcaatctggggctgtggttttagacccgctcagcgccctgggcgagggcaggcagcccctcggaggcaagctggcggcggccctcggcctgggagcccgcggcagcctcggcgtcggcggtcagggcgcctcccggggcccattcgtgctcggcgcaagcctgggacggctcgtccttggcctcgacgagcttacgggagcgggtgtaggccaggatgaggcctccggccaagcaggcgtagaagatcatgatgagcaggatgtagagataggcgtcgtcgcccttggcgctggtcacctcgcggcccacgaaagggtcaggcacgacccccatgcccatgctgggacgagggccagcgcccaagccgctggcattaccccggtggtgcagctcgagcaacaggcggctcagaagggttcgcagccgctggctctcgctgcagttcatggctttcggggagtgacacggcggctccaggacgctgctgacctttccccctgggcgaggggaagcgagctagcgagcgggccggccggcgggcagggctcagcagcggaaacagcggtagcacccagctctccggcgagcgcgcagtggctgggggcgccgacggcggggcctccttattccctcactcccgcccctcctccccttccccaccacgccccctccggcccgcggccgcctcttcccaggctctggctgtctcgctgctccagggaaaggggacagctggtggggggaggagaaggggacaagagtgggggcgaggctggg

SEQ ID NO: 8873 - DNA, 2368 bp, artificial
  synthetic oligonucleotide
ctatgtcttaaaaaagacctgactgggatcttgctgaggggttctcatcagcaagttttaacttttgcctcatccaagtgaatagcacaagggcccattttggagtcattttttgaacataaaggtccacttcagtagactcaatgaggacaatgccaaagtaactgacattctcagaactgactagtgctaaggattgatattaattttctaaggttcaggcctcgttagacacatataaatagccaacagtaaaaaaaaatatatgtgcccatgctgccccttgggtggagaggtgaagagtgaggaaggcctagcatagagtatgttataggaaacagttatataaaatcacatgtggttgaccaagaaagacgtcctctgagctctttttgttttctcattacctgtttgctatttccctgcccattctctctacactcaatgctgctgttgctagtgctgctagtacttacgctaaggttcaggctctgtttagaatattttacatatatcaactcatttaatcttaacgacagccctatgaggttggtattgtccttgttttgctgatggagaagctcatacataagttaaataacttgtccaaagtttgaactaatggaaccatcaactttattaatgactgatcaatattacctttcatatatactgaagttataaaaactaaagaaaaccataaaaagaaaacattctgacctataatctgtaaacatccatcgggatggaattctccaatatcaccagtgcaaaaccacctttgtccattttcatccacagaataatcttctgctgttttctcttcatttttaaaatatcccatggagatgttctgtccaccaattacgatttcacctctggggtttggcttgtcattaattgtataaccgcctggaaatcataaaagtaaattagttattgttctacaacaaatttcattaattcttaaagcttatacgtatgttagtatttttctgctgatcagattttatatcactttatgagagaacattagtttatatttactaaaatttacatgaggatactgggtgactgtgattttaagaacaccaagaaaggctcaatgataatcaccaccaacaatcacccatctcaaaccttcccataccataacatttcacacttagaacaccattagagcttagtgttcacagagttctgttaagataaaatcacccccaggaagagtaacacttgaagctgttataagtaaattactgacatactgatatcaatgcatttcaaattttttctaaggaggttttaaccaaaaagaacatgcagtaagtacccaaaaatggtagcatcataaagtgagagggaaaggggggactatgggaaacaggaagaaaattgtattaattttgcctgtggccagtcatgactttagaagttcaaacactaaactaattgataataaatactaatatatttcatcactactcattacctctgtattactgaaggaagcttactttaaggaaaatatacaaaaatctaaatttgcaaaataagatatagactagattttgtgtcataaaaggattaaaatcagggttcctttcagctgttagctgctctgataaacttaaaactattcaatatttcaacatgataaaacccattgtatgttaaaaaaaaactgagatcattcatacagtataaagccaaagagtcttcacagcaaggaaaactccaaatacatgttcaacaagggacctactccccaaaactgacattaaggcccagtaccaggaaatcagaaaataaaaattatagtaaaacttggtaaggagatttttgcctttaaacatttctctgattccactgcctaacaattaaaaacttacctaataaaataattctgatgttgatgtccaaaacacatacacacaaactattttcttcagattttcatggtaaaattggaatgccattaccatggaaaaagggaagactaagtcccaaggtgtaaaactcttgggaatgcaactggctttttaaaatgtgtttttaaaaaagaaatagtcatttgctcataaagcactgacaataacacacataataaaaaatgctttagaaacttaaagtttatgttagataaaaacgtattcattttctcagggtttggacaacctaagggttgcatcctacacggtaacttgtactttaaatttttagtccgtgttccatcctaaggtaaatattctcttttaaaatcttaagcattttaattactcttcctttatctgacatggctaggctgttaattatttgttttatttaacaatctactttattgtagttactgtgtatatttagtatc

SEQ ID NO: 8874 - DNA, 1248 bp, artificial
  synthetic oligonucleotide
atagtagcttagagacttaaacaatgaatgtaaaatgaagtagttaggaaagacattattgaaaagtgggcattaaaagatggttgtgatcaataagcaaaaaggacattccaagagaagggaaaagaaaatacatagaggtgagaccaagaatgccttcataagaaacagtaagaagactggtgggtctggagagaagagccaggcattgtgtatatgtggggaataatggaaaatgatgttggataagtacactagcatcagattaaagatgtcaaagctaggtaaagaggtgtttagatttgatacatcaggtatcaagcagtggatgaggtggatgcatctaatagaaggatacaggataaatcagaagtgatgtaatgtaggcagacacagctgttacaaggctgttaggtcagggcaggcgcagtggctcccgcctgtaatcctaatactctgggaagctgaggtgggtggatcacctgaggtcaggagttcgagaccagcctggccaacatggtaaaaccccgcttctactaaaaatacaaaaattagtcaggtgtggtggcacacgcctgtagtcccagctactcaggaggctaagggaagagaattgcttgaacccgggaggcggaggttgcagtgagctgagattgtgccactgcactccagcctgggcaacagagcaagactctgtctcaaaaataaaaaggctgttaggtcggagcagaatggagcaataaaaagttggacgacagaggtgatatggagggaaaggagaaacctaatgaaggaatgatctgatgacatttaaagatattttaaaataaacagatgacttcaaagctgatacctggaatgactttaaggatggtatcaccattgacacaaacaaataatttgtcaatagagagacagtttagaataatggcattgattttggacacaatgagtttaaagcgaaaataagattatccaaaaaaacaattcctataccccagtgtttctcaacctaaagtgattttgccccccaggggatatctggcaatgtttggggatatgtttcattgtcacagctggggtgagcccataaacatctgctttggcaactaaatattctgcaatgcatacaacagccctcaacaacaaagaattatcggattcaaaatttgaacagtgtcagggttgggaaacctcgcttcaggctgttgaaaataacaaaagggaaaccaaagaagaagttaggac

SEQ ID NO: 8875 - DNA, 531 bp, artificial
  synthetic oligonucleotide
tgtttaagatatatgaagtgaaattggtttaagatgaaacttcatactcaagatcaacttcctcaaatttatgtaggctataaaccaaaatgttaatctctaggttgcagaattacaggtgatttttttttttattgagacaaggtcttgctcggttacccaggcaggaatccagtggtgcaatcttggctcactgcagcctcgacctcttgggctcaagccatccttccacctcagcctcctgagtagctgggactacaggcatgcgccaccacatcaggctaattttttgtatttttggtagagacagggtttcaccacattgcccaggctggtctccaactcctgggctcaagcgatccatctgcctcagcctcccaaagtaatgggattacaggcatgagccactgcacccacgtagaggttatttttagttttatccttataatttccctacattttctaaaacttctacagtgaatgttacttttatcatttaataataaagtagaaaatatagcaccagccttt

SEQ ID NO: 8876 - DNA, 1693 bp, artificial
  synthetic oligonucleotide
tacaaccaacatatacaggtttagtagtaaaaaaatttactgtactggtaggtaaacaagcacgctggagtactggagatcaaccaactaataccaagtattcagtgtacactgtattttacaaaggaaataaaaattattcaatgtggtgagtcaattaagtggaggtcaattaaagcttctaatgcatatgtagaagctttttcatttttatttattttatttatttattttttgagacagggtctcgctctatcacccaggccagagtgcagtggtgcaatcatagctctctgcagcctcgacctcccaggctcaagggatcctcccacttcagcctctggagtagcaaagactacaggcacatgccaccatgcctggctttttttgttgttttttgttgttgttgttgttgttttgttttttttgttttttttttagagacagggtctcactatgttgtccaggctggtctcaaactcctgggctcaagcaatcttcccaccttggcctcccaaagtgctgggattataggcgtgagctgcagtgcccggccatcacttgtctttttaactgggttatgatgtcttacactttccagaagattttttaaaatatatacttagatttttaaaatatattcttaagttatttttgtgtatgatgagagatggagacttattactttctaaatacacagccacctgtctttactcaatttccattttcaacattacacttagaacacttaaaagaactaaagtgtcaactgcttcgttataaaaaaggaagttgtacaaacaaaataataaaccaacagtctaagctcagtttgataggctcttactactatgtacttaaagatcacatagcagtttcaggagcaaaaacactaccatgcctggctctcttattaccgctacagctcacaacagggtctccaaaagacatcatagactgcatagaagtctatctgcagcttactgattgccacacatgtaaattcacattcacatttaaataacccacacttaacaacaaaatcaaccgtctcaactctctatgcattccttattgctgctcctagaccacagtgctttggagacttagtaaagaaaatgaatgcactctcctgaatcacaatatcacctggaaatgtaaccagaaggtataaaaagtcagggtagtttgttaaattgtgtgtgtgtgtgtgtgtgtgtgtgtgtgtgtgtgtgtgtgtgtgtgtgtgtaatcaacaatttataaggttaccttatctctggggtcagcactttttctgtaaaggtccagagagaaaattggcttcacgggacataagggctctgtttcagctctgatgttgtattgtgaatgcggccagaaaacacataaattaatggatgtggctatattccaagagaagtttatttacaaaaaccggtggtgggcaggatttggccacaggcagtattttgccagcccctgccttataccaatgttttatctttttcaaataacaatctacttccctcactgcacacatatttgagtaaatatagtaacactgaagggacaaataatttcagtactgccttacagaaatgaatattctcaaaattaatcactaaccttttcctataattccttctcatatgagcacatacatttttcaaaatataaaactgtaaacatc

SEQ ID NO: 8877 - DNA, 993 bp, artificial
  synthetic oligonucleotide
caaacaaaaaccctggaaacatcagatgcccttcaagaggtgactggttaaacaaactgcagtaaatccatattatggaatactactcagcaatggaaaggaacaagccattgataaaaggtatattccttgcactaatctccaaggaattatgctgagtgaagtaaagtcagtctccaaaggttatatactgtgtgattcatttatataagcatttttgaaatgacaaaattatagacatgaaaaacagatcagtggttgccaggagtcagggatgaagggagatggctacatctataaaaagacaacaaaaaggatccttgtggtgatgcaattgttctgtatcttgactgtggtagtgcttatataaatctacacgtgataacattatgtagaactaaatacatacatgcaaatgactgcattaaaggtgacgaaatctgagtaaggttgatggattgcatcgatttcaattttgtagttgtgatgttacactatacttatgcatgaggctattattgggggaaattagataaagcgtattatttcttacaactatatgtgaatctacaactatctcaaaataaaaagttaaaagggaaagaaagagtatataagaccagccaatggtagaagtggaaaaacaaagcttttatttttgctaaaggctcagcaattgaaaggatggagaaaaaggtaatgtcaaagagtctacaggctacaattaatagaatcatctcttcctcccctatggaaacttaacttctccagaattttgtttgtccttgatttgactgttgttgtttttaacaaaaataaactggatgtacatctgtctctccacatgccccccaaccatctccatcagcccaaagtataaactcatagagtagggtttgtcttaaccatcatgtcctgagggcctgacatacgtgacagatgaaggaagaagatagttgaatgaattaataaatgaatgagatgcccacatat

SEQ ID NO: 8878 - DNA, 1840 bp, artificial
  synthetic oligonucleotide
ggcatccctcaaattcgagagggcggatgcctctagggctagagaggctccctagccctcagttacagagcgactgggaggggacaaaatggagttgaggtttaggggcaccctaaaggtcgtttggaggtctagcaagcacttcatggtctcctccggaaagggccgtggcaaagcctagtaccccgatcaggaagatgacttctggccctcgggatgcggtgagcggcaggaagaggcaggctggggttccgaggaccccagagtccatcacaggagcagatacagtgacctcgggaatcttcccggccccagcggaggcgagcggatagatagccctggctcaaggaaaaaagcgagccgactccaggagctggaatgcccacccaacctcctcccggctcaggtgaggtacgccagtccccctctggaaatggggccctggtaccgacagggcaggggtgccggggccgcaacctccccatccagggatactcaccggaggggcggcccaccgcgtcttcgcagccggccggcgcctggcactcggaaagctcgcaaaaaggaaccgcgtgcccgctagcgctgggacgaggaggagcgcgcggcggaggccagagaaaaagccgcagcggcgcgcgcgcacccggacagccggcggaggcgggactcagcgcgagcccggaaaagacgcgcccggaggggcgggcggagcgggggcgcgcggtggtgtggcagagccagccgaatcgctggctgcagacggctcggcccacccacgcgcccgcccccgctcgcccgggacgtcagtcgaaaaggcggagccgaacgggcttcccggggcgcgggaggggcgctgcgaggaaggcgaggcggctaacggctcgcctcaagttgttgctcccgctggcgatccgcttctgtcagtctcgctgctggtgtcgttgagtgtgtttcgggatgtccttgcgcctaacagcagtgaggcgcagaattggcccacgccctcacctgcggcttgcttcgcaggactccaccccaggataaaagttcccctcgggtcatcttccagctgccctcaaaagacactcatttttgggtttcactgctcctctttaagagagctatcttgaacactttgactaaaagcatcttgctcctgtaagcctgaactaatgcctctcatccgtttatcttgcctcttactgcgttaagatccccgctcactcccactgatgaaatatcacaaggacgcaggattttcacgttgtctttcatttccacgatggtatcatggcaaaaaaacccccaactgataaggaaaagtcaccgcagctttgtgacatcttactagccctgatcattgcttataagccggtcatacgaatgctgttccaacagatgcaagaaattgctattaaaattaaaatgccagcgaactatctgagggcttcaaaagggacagaccataattgcaaatgaggcctgataaactgccaagaatatatcacccaaaaaaataaatctcaagaattcttccagttccctgatgcgtaatggtgaactagcttcctgttcctgatggtaattgacatttcacttcacttgctgatttccattttcccatagaattaccatttgtgcttgtgtgtgtgtatatatatatgtatatataaaatgccttaccacctgagattacaagctagagtagttcttcagtgtgcatcacaattatctggggtgcttgttgaaatgtaggtacctggagctacaacccccaggtattttgattctgatctgggtagggataagaaatttgaatttttaataagcagcccag

SEQ ID NO: 8879 - DNA, 916 bp, artificial
  synthetic oligonucleotide
actgttctgatgaagtctgttaaatcacatcagaaaactgaataaaataggtcagattttgcagtcacatttcatttcatgaaatgtattattctttttaaactctatggagtataacttattgatttatttttatagttaattaattactgcctgcttctatcttcttttgtttacaaggaataaatagttaaaatattcagatatttctactacttcttccaggctcagagggagccagatccctaagtactataaccaatacctggaactatgtcctcattcattggcaatgacctaggatgagacaaaactcctagtagagatgtctttgtcttcatcctcttcctccttgacatcatcacacttttaacaacaaaaaagacatttgttgattgattttttgtgtgtgtatctggcactctggcaagcattgagattttaataacctttctatatcttacccccaaccgcaaaactttaagtggtctcacttggaaacaatggcacataaactgtctttgtatttagaaatcagaaataagatggcacttttgaagtaaaggcttcatgcaaacaggatagtggaatggttaagagcataggtcttgtctggagtcagaggtcagagcgctcaaatcaaattcctgctcaggaacttccacaagctgtgtgacactggcatgctgtacaacctctctgttccttactgtcttcatgtgtaaagcaataataataaatgtataccacagaggagttttgaggaataaacgaggtaattcatgtaaggtgcttagaactgaacctggtaaattgaaaatgctcaataagtattagctattattgcacaagggactcaaagtttgcagagtctaaaaaaggcaactctggctgcaaatcaaagaacatcttctta

SEQ ID NO: 8880 - DNA, 4534 bp, artificial
  synthetic oligonucleotide
ttatatcctgaaaatgccaactacataaatagaggaagaccaggtttgatgattacatgaattattacaatttagaggaagatcatagaacttgcaagatccaaaggaaccttttttttttaagtggtcttccacagcactcatgtttgcctctagagttcatcaaatttcatttattatcaactggcatggttacttaggtcattcctgccgcttagaatagaattggtagagcaggtccctgatctctaccataaaccctatcaatcattttgggttgaaaaacaacaacaacaacaagtacaacaaaaacagtgtggtcttcctttaatatcccaactgagccttttgtgagcaggggccaactcaattcaaaagtaggtatactcctaatggtggttgcccagggctgggggaaggggaaaaggggagttacagtttaacgggtatagggtttcagttttgtttgttttttttttttttttttttttgagacggagtttcactcttgttgcccaggctggagtgcaatggcgcactcttggctcaccacaacctctgcctccgggttcaagcgactctcctgcctcagcctcccaagtagccgggattacaggcatgtgccacgacgcccagctaattttgtatttttagtagagacggggtttctccatgttggtcaggctggtcgcgaactcccaacctcaggtgatccacctgactcggcctcccaaagtgctaggattataggcgtgagccaccacatgtggccagagtttcagttttgcaagatgaaaaagttctggagatctgtggtacaacaacgtgaatatacataacactactgaactgtacccttaaaatggttaaggtgctaaaatttgttatgtattcttttaccacaatacatttttttttttaagatggagtttcactcttgtccaggctacagtgcagtggcgtgatctcagctcactgcaacctctgcctcccggtttcaagcgattctcctgcctcagcctcccgagtagctgggattacaagtgtgcaccaccacacccagctaatttttgtattttagtagagacaggctttcaccatgttggccaggctggtctcgaactcctgacctcaagtgattctcccacctcagcctcccaaagtgctgggattacaggcgtgagccaccacgctcagcctaaaaatgtttaaattaattttttagaaagtagatatgctagtatgattaaataggggccccaaagcctcagccatctgctgagcctcatctcagcctctccacaactacctactttagtacctaacaatccccctacatccaattaaagttcctctttcaagtaaaagcattttccacatcaggtccccatatagactacatacagatttgcagggagaaaagggatagtcaggtaactattaatatgaactaattgaataaaaatgtataggtgagaaattaggacatgaagctacacaatatttttttgaaggaaacaatctagaaaagttggaaacaagggataccctaagagtagagacacaggaggaccagcgaggtatgagtgaggtgagactccctggaacgggaggaaaggtcttcaatatgaatcctgaaagggcttagtagtgtaccaaacatgcaatgtacctatggcacaaccaaatccaggttggccctgtgtcaaaactaagaacataaatgctgacaatatcaaggaccaggatgagtgtctgggactggaaaacaaaagccaaggctacaaagtccaggacagctggatacacaaggaggttcacatacgatgaagatcacagaaatagatggctatgacaaaattggaagtctggaatcaggacaagataaccaaggttggcagagcaagatggtggccagaataagatattcagacaagagtgaaggtttaggaatgtataaggttagaacagagagcagttctggaacaccaccagacagaatgaacttggaactatgacaaagagtgtgttacgagaattagaaaccagattagaagtcatgggatcaaagattagaacagaggcaagaggtcctggcaacaggtaaaaggtacaaatgacagcttgatgctgatccagtttgtctgcgatttggagcttaacattccttttaaggcatgaatcaatctcagaaaatttcactgaggtcccgtaggtgagagttgctgtttgggactccctagttgagatatgggtgtgtgggcaagataaagcatagcttcttgaatcaagattctggctggcactttggtgctgagggaacatgacaaggaaggcgaatttaaaagcacaggcttttaattatttacctttcactgattcactgattcttagactttagctttgttcatttggtgttcctaataaacactcatccctcaatttttgttatccttcttcattcatccaacatttactaccagcatttggacataccaagatgaaagaccatatgcagtcttatgtctgtcttgggcattctatgagaaacgttttgtaacactgcattaataatctgataattgaccgggcatgttggctcatgcctgtaatcccagcactttgagaggccaaggccggtggagcacctgaggtcaggagttcgagaccagcctggccaacatggcaaaaccccacctctactaaaaatacaaaaattagctgggcctagtggtgggtgcctgtaatcccagatactagggaggctgaggcaggagaatcatttgaacctgagcagcagaggttgcagtgagccgagattgtgccatttcactccagcctgggcgacaagagcaaaactccatctctagtcgtcgtcgtcatcatcatcatcatcatcaccatcatctggtaatcgtcatatatagtttttctatgaagtatagaatcctgtcagaaatgtttaagagtgattcaacaataattattatttccacagatgtttatttaaatttgatattgagctttaaatataggcggtaagtgaaatgacctgcctgactgggtcatttagaccctacctgcagacaaccccatctcagtcccagtgaccaaaggtattccttgtcaaggagacaaggaatcctaggctagtagctcctagagtctcaacattaagccagctgtggtgttagtgtgtactggatccctctcccctatcagacggggactggacaaagtgtaggaccaagtggatgactctaatggaaccataacagagtacaatttctctgtggctatagtgcgaaaagccagagagcatatccaggcttttgaggtgtcctagaggatcccatgaacaaaaggacagtatgtacagttacaggggcaacattctaataaattatatgagtgcaagagctaaagtctggaatcagaattgggtaaaacaaaacaaagtaaatacaaacaaagaacagccagaaagtaataaacaaaggacaattgggtgaatggaatgaaacatgaagaaattccagagataaagtgagtgcagaagccttccacattttttcttaacccagccacagcacaggtttaagtgggtttgtatacaaaaatcatataaaacagcttgagtagagggaagagtctgtttttttcttgttttgttttgtttgtactcatattttgattactggacccttgccttgtttcttttaacttggtgctccctttgctcccttattcttgcataccagacttggtaatgtcagaatcctgattcatctgggcctggggccctgccatacctgtcctaatgttgtctctgcttgaacttcaatctcctctacttattccctaatactcattatctattccagtgctttggatatagccaaatgcctctatcaatgagctcttccaggctactgaggacccacctacaatttctagttagatgttgctaatgccaattatttatttacctattgcctgttgttagactttaccaatgtgctatctactggtccagatgtcttatctttgcacaataaatgtgtattgaatttaacttcctggaaccttcccagattgcctgcgctgctccagtgggtctggctctccctggtgaggttccagggttgccagctgtctggttttgacaaagacagtctaacatttgaacttgctgcccagtaaaaaataccagacatatgactgtccctttttttccaattaaataaatggtatcattttcttatagcaaaactagtatacacataagcagtgcaatctgatgaaagctagaaattgttttcagtgcactttttatactatctcttttcaaaattagagcttcaggtacgtatccaatgtgtctagtattttgcagataccatttagcaacatgagctggactattgtttctccaaccacatcttacagcatgagagaatatagagcaaaaatactagtcagtttgtaccttagtaattaaatttagtgataagcacatcattatcatcaaaat

SEQ ID NO: 8881 - DNA, 421 bp, artificial
  synthetic oligonucleotide
ttattctttaaaatctgcatctgcctaaaatttttggcaaaaagttttacaaggttgttatgccaactacctggtcagctgccctacctgtccagtcttgtgcaccagaggttcttaacctggggctttggcggatccttgaggttacatgcagaactctgtgggggtttctttgtgttgatgaatgtgtgcacatttttctatagagagaaattgttcacctttttgatattagctgggttatcatgatactacttcttatttttgcctttagctataacatattttccgtcagtgcaattaagatatatgtttctggccagaatagtgcctataaaaacaattgaaaaaaaacatagaagatgtaaacttaacactctctagaatattaggctgatacctggatcctgtggctcagtaa

SEQ ID NO: 8882 - DNA, 1004 bp, artificial
  synthetic oligonucleotide
ctgtaagtaactcagttacctagagcataagaaatatctatgttccctatgttgaaggtgatgttggaaaagtgagcaaagtacaaatattggaaggctgtgtgtgctgtgctaagggtttggatgttatccaacaagctatagggagccattgaaagcttttaggcaggagattaaaaatcagatttgcatttagaaaagtcactgtgacagcagcaggaagaatggcttggggaggaagatgactaatagaagagggggcttgtcaggacactattgcaatattccaggtaaaagagaggcctgagccagagcagtggcattggagatgaatggaaatggacagctgggcacacgagtgggacatttaggaggtaggtgaaaagacttagcaactgatcaaatgtgcgagatgagggggaggtttctgactcagttgattggttggatgggagtgctgtttattagaacagaaggcacaggggaaatcaggcttgagggaaaagtaatgaaacacatttcagacacattgagtgcaaaagggtctctttcaagacttagataaacagtgcccgaaagaaaggtgagcaccttctaagtagcttaatgagaaactgcatgattctgtacaactaataaaatcaaagattaagttaatgctactgacttgatttcttcacaagaagtctgttgtatttagaaatattcattaatttaaaaagcaatttagaaaccgacgctttataaaactgaaatgcatacaagagaaaaaatacattatcgtgaccttattaagtgactggtgtacagccttttagctgaattgtatgaaataagttgaccagattttccttcttcattataaaacctttttaccagagacttggagccaacttaattagctatgctgatggaaagaggaatagcaaaagtaattgaaaaccacagatgaaagccatgggcaactcccaggaaaaatggcctgatgtagctccttggaaccc

SEQ ID NO: 8883 - DNA, 3047 bp, artificial
  synthetic oligonucleotide
cctaggtttcaagactggctctatgtcttatatactatgtgatcttcagcaagttgctgaaactctctgaacctttatttccttctgcaaagaagggatagtaatatctctttataggcctagggtaaggattgaatgagttactccacagaaagaattgagtcctatgcctggcacactgctacagtttgaatgttcccccaaaaactcatgttgaaatttttttcacataagttattggggtacaggtggtgtttggttacatgagtaagttcttcagtgttgattttgagattttggtgcacccatcacccgagcagtatacattgcaccatatttgtagtcttttatccctcaccccctcctactcttccccacaagtctccaaagtccattgtatcattcttatgcctttgtgtcatcatagcttagctcccacatatcagtcagaacatacgatgtttgtttttccattcctgagttacttcacttagaataatagtctccaatctcatccaggtcgctgcaaatgctaattcattccgttttatggctgagtagtattctatcgtgtgtatatataccacagtttctttatccactcattgattgatgggcatttgggttggttccataattttgcaattgtgaattgtgctgctataaacatgcatgtgcaagtatctttttcgaataatgacttcttttcctctgcgtagatacccagtagtggaattgctggatcaaagggtagttctacttttacttctttaaggaatctccacactgttttccatagtggctgtactagtttacattcccaccagcagtgtagaagtgttccctgttcactgcatccacgccaacatcaatgattttttgattttttgattacggccattcttgcaggagtaaggttgtatcacattgtggttttgatttgcatttcccttatcattagtgatgttaagcactttttcatatgtttgttggccatttgtatatcttcttttgagaattgtctattcatgtccttagcccactttttgatgggattgtttgtttttttctgatttgtgttccttgtagattctggatattagtcctttgtcagatgtatagtttgtgaagattttctcccactctttgggttgtctgtttactctgctgattgttccttttgctgtgcaaaagctctttagtttaattaggtcccagttatttatctttttttaattgcatttgcttttgggttcttggtcatgaaatccttgcctaagccaatgtctagaagggtttttccaatgttatcttctagaatttatatagtttcacgtcttaggtttaagtccttcatccatcttcagttgatttttgtataaggtgagagagaaggatccagtttcattctcctacatgtggctagccaattatcccagcaccatttgttgaaaagggtgtccttttcccactttatgtttttgtttgctttgtcaaagatcagttgactgtaagaatttgggtttatttctgggttctctattctgttccattggtctatgtgcctatgtttataccagtaccacactgttttggtgactttggccttagaatatagtttgaaattaggtagtgtgatgcctccagatttgttatttttgcttacccttgctttggctatggtctcttttttggttccatatgaattttggaattttttttctagttctgtgaagaatgatggtgatatttttatggggacagcattgaatatgtatattgcttttggcagtatggtcattttcacaatattgattctacccatccatgagcatgggatgtgtttctatttgtttgtgtcatctatgatttctttcagcagtgttttgtagttttccttgcagagatctttcgactccttggttaggtatattcctaaatattttattattttgcagctattgtaaaaggtgttgaattcttaatttgattctctggtcactgttggtgtataggagagctactgatttgtgtacattaatcttgtattcatgttgaaatttaactgctaatgtaacggtattgggaggtaagacctttaagaggtaattgagtcatgaaggctctgccctcatgaacggatcaatgctgttatcatgagaatgggttagtcatcatgtgagcagactcctgataaaaagataagttttgtctcaattttcttgctcaccatatgatgtattctgccatgggataacccttgccaaatgctggtgcagtgctcttggactccccagtctccagagctgtgagccaaatgcactgttctttataaattacccagtctgtggtattctgtttaaagcacagaaaatagactaagacatacattgtaagtgcctagtaaatgtgaactaatgttcttatcccttgtctgacattggccttgaataatgcaagccccttctcatcagttccctaatttgtgagaatgaaaacaggagccttcatggttgtttataagttataaattctcattctagggaaagcgctcattaatattcttaccactatttcttatagacagcaccagaggctgagatttatttaatatgaacaatttaaaataatttctgtaagcgcacacacagctagctttcaattactcactctaatggagaagatcagagtcataggtaatctaaaactgtgccaaatccaaagtcatctctgtttggcttggaaatgaactggatacacttttttttttttttttttttttgcagcatatttaccttttggatttttttgtgcttggccaataataaaataaatttacattatctaagcacactagctgacagcacgtgaaagtgcacagaaatactcctggggaaaaagagaagctaagatcatgatactaagtttgctgcaatgaagaagggatttaccatacatttttattagtgattctcagagtttagaagagattttttaaaattgtatggggaacttgttaaaaatgcacattcgcagctccaaccatt

SEQ ID NO: 8884 - DNA, 2996 bp, artificial
  synthetic oligonucleotide
ttgtgttttctcaggctggaaaaattgtcatcctccattcgccactagatggcccatcattcaaaaaaattccttgttttctaaaaaaaaatttagggaacaaggttcccataatgatttgagtattcccatcatgatttttcagccatatcatagcaaatcaccatatattctttcagtatttactttaaattggctactttctaacttaaatatgcctattttagaagtaaactggaaggtgaacaggaaaaaagagagaaagttatacatagatgaaaaattcaatggccctggagagaaagagctgcctcaaggatgaataggaaggggaactgggcctggagttggtgattcaggactcaaggggccaagatcaatagtaggcagaaagataaagggggcgggtgagaaagaaggactctcaaaactgacacggaaaagctgggccagaggtaggaagagggaggcatggaacctgggggatagagagcggagctgaaacaaatatagaaatgttggcacaaaatgtttgtgtaagagaaggctacaactgagtcgggcataccagaagctgaaagaaaggtgaagcctagcagtatagtttgaagtcaggtagcgtgatgcctccagctttgttcttttggcttaggaatgacttggcaatgcaggctctttcttggttccatatgaactttaaagaagttttttccaattctgtgaagaaactcattggtagcttgatggggatggcattgaatctataaattaccttggggagtatggccattttcacaatattgattcttcttatccatgagcatggaatgttcttccatttgtttgtatcctcttttatttccttgagcagtggtttgtagttctccttgaagaggtccttcacatcccttgtaagctggattcctaggtattttattctctttgaagcaattgtgaatgggagttcactcatgatttggctctctgtttgtctgttattggtgtataagaaagcttgtaatttttgcacattgtttttgtatcctgagactttgctgaagttgcttatcagcttatggagattttgggttgagatgatggggttttctagatatacaatcatgtcatctgcaaacagggacaatttgacttcctcttttcctaattgaatgccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcataaacagctcttattattttgagatacgtcccatcaatacctaatttattgagagtttttagcatgaagggctgttgaattttgtcaaaggcccaaaacagcatggtactggtaccaaaacagagatacagatcaatggaacagaacagagccctcagaaataacaccacacatctaaaactatctgatttttgacaaacctggcaaaaacaagaaatggggaaatgattccctatttaataaatggtgctgggaaaactggctagccatatgaagaaagctgaaactggatcccttccttacaccttatacaaaaattaattcaagatggattaaggacttaaatgttagacctaaaaccataaaaaccctagaagaaaacctaggcaataccattcaggacataggcatgggcaaggacttcatgtctacaacaccaaaagcaatggcaacaaaagccaaaattgacaaatgggatctaattaaactaaagagcttctgcacagcaaaagaaactaccatcacagtgaacaggcaacctacagaatgggagaaaatttttacaatctacccatctgacaaagggctaatatccagaatctacaaagaactcaaacaaatttacaagaaaaaaaaaacaaccccattaacaagtgggcgaaggacatgaacagacacttctcaaaagaagacatttatgcagccaacagacacatgaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactagttcaaccattgtggaagacagtgtggcgattcctcagggatctagaactagaagtaccatttgacccagccatcccattactgggtatatatccaaaggactataaatcatgctgctataaagacacatgcacacgtatgtttattgtggcactattcacaatagcaaagacttggaaccaagccaaatgtcaaacaatgatagactggattaagaaaatgtggcacatatacaccatggaatactatgcagccataaaaaatgatgagttaatgtcctttgcagggacatggatgaagctggaaaccatcattctcagcaaactatcgcaaggaccaaaaaccaaacaccgcatgttctcactcataggtgggaattgaacaatgagaacacttggacacaggaaggggaacatcacacaccagggactgttgtggggtgtgaagaggggggagggatagcattaggagatatacctaaagtaaatgacgagttaatgggtgcagcacaccaacatggcacatgtatacatacgtaacaaacctgcacgttgtgcatatgtaccctagaacttaaagtataataaaaaatatatatgtatatatatgtatgtgtgtatatatatatatatatacacatatatatatataaaaggtgaagcctaaggaagagatgtggggttggggcctgaggagatgaagaggataaagaggtatatcagacgctcttcgttgcaatgtttccatttcccctccacttctttcctttggggaacat

SEQ ID NO: 8885 - DNA, 3543 bp, artificial
  synthetic oligonucleotide
tggagggggaactatatcttactgatctacgtgttcccagtgtgtgcttcagggtatgtggaatgaatgaaccaatggatgagagaatgtaagctcttgggatggcagtgatctttgtcttcttgtttagtgatgtatcccaaatgcctgacacagtgcctggtacatagtcagtgttcaataagtatcttttgcatgtttttgaagatttaatgaagaaacaaataaatgagtacaaagcaagtcacctcatgttgtcttcccactatctcacccaagcctatctttctttaggcaatgcccagtgttctagtagtattcatctcatccttcctgtcttttaaaaatgcattctttacaaaggactaatcttcttttgttctatttttatttatttatttacattgtattttgtttgtaattgatatcttaattgtacatatttatggggtacagtgtggggtttcaatacattgtgtatatattacataatgatcaaatcagagtaattagcatatttctcacttcaaacacttgtcatttctttgtagtaagagcattcaaaattttcttttctagctattttgaaatatataatatgttattgttaactgtagtcaccccactgtgctgtagaacaccagaacttattcctcctaactgtaactttgtacccactgaccaacctctccccattcccctctccgcaatctcattactcacaatttttctcactacttctgtgagataaacttttttatattccatatatgagtgacatcatggaagtatttggccttccatgcttggcttatttcacttaacataatgaaaagactaatattcttaatttgtaattattaagcatctcatgcctgtaccaaaacatttcatgtaccccataaatatacacagctatatatccaaagaaattaaatttaaaaattaaaaaaataaaaatttaaagggttaaaaaaatatataaagagctcctggaaactaagtaggaaaagattgacaatacaatggaaaaatgagcaaaggacatgaacagagtgtccatagaaaatgaaattaaaacagcccttgaacatctgaaaaggcactcaaccacactcacaagtataaactaaaaccaaatatacacagcatttccctcctgttaggtttgccagaatccgaaagtttggcaacactcagttgtaaagtagtgggggaaatgagcactctcatacattgctgttgggaatgcaaaagtgtataatacaaccaccacagagggcaatttgtcaatatttgttaatatttctaaaagtatttacctttctggttttttatcttacaggctgactttcacacttcaggaagcacctcatgtgcaggattattccttgcagtattgtttataatagtgaaaggttggaaacaacccaagtgtccatctatagggaactgaataaataaacaatggtacattcatgcaatgtaatgttacgcagttgtttaaaaaaatggttgaggaaactgtgtctgtactgatattgaaatatctccatgatatatactacattgaaggaggaaaatatggaagactcgtgtacatatctgtacaaataataaaaagttatacaagaagttaatgaaagtggttacctactagaggcaaggggattgaacaaaaaaaacaggtaaattaagacagaggaggagaaagacttcttaatgtattccttttacatagtttcgaattttgaatcacttaaatgtactgcttatttgaaaacattacattgtgagacaaacatcccttctttttatacatttgaagagacaaacttattccctgaaacaaagtaatgtgcttctccagggacacttgcatccaaacagggaattaaaacgaaagccaaagaaatcaaacatgaatgatgaattttttttttttgagacagggtctcgctctgttgcccaggctggagtgcagtggcatgaccttggcttactgcaacctccacctctcaagttccagtgattctcctgcctcagcttcccgagtagctggggttacaggcatgcgccaccatgaccggctaatttttgtacttttagtagagacgggatttcaccttgttggccaggctggtctcgaactcctgacctcagatgatccacctgtctcggcctcccaaagtgctgggattacaggcgtgagccaccgtgcccagccaaatgaaatttcaagtagcagcagtaagtattccagtgagggagagggaagggagcctcctcagtacttctgaaactttattcccattgtaacttgactcaggccttccatttcctgagcgtggcctctgctctgatcccgtttgccaccctgtccgtacattcagcaaacagaactgagaagctaggttcctctaacccagagctaacaccaggcccccagttgtcccaatattcacaaatgctaactgtagctggtcaaataaatttcttttataaatggagaatcgaggccttttgaagaaatatatgtggaattgaaatgtagaaaggtgcgctctgccttccagaaacagaaaataaaaagataggaaaagaaaaaagctatagctattgacaccaaagcctgagcaatttatttgctgcaaatcccataatcacaaacatttcagagctgtaattctgcctgattaccctgtgctgtcaggggggtggaaaaacccagaagattaatgttttgtatggcaataaggcggcaggcctgcaactctgagcttatcgcccatgaatcaggagccgggctgagaagcttcaggagacagcagcattttataatgatttttttatggaaagaatgctgtcaagcccagattcattagtttctaccaacactggtttcttcagcagacagtcaggccaaatctccctgtgcacaaccccccttctccagtttattctgtggcatcagagtatctggggcgggtggtatatgtacataaggggcagggttggttgaaaagggagaaaccacttcgagtgtgagctttagcttctaaccttctgttaaaaggctggtgcttcaggaactgctgtaaagctactaaaatgggaagccagcttcagatagttgtttctagttctttcataaggcacattaggaaagggtggcccatttaagacaaggactactgttcggttgacctatctgttgacccaaagcatttccactctagcacccagaatttaagtacaacctttatacatcttcctatttaaatagtaatactatccaaaatttcaatgtagagctatactacatataagctgtgtgactctggaaaagttacttaacctctctgaggctcaaattatctataaaatggggataataatatttatctaagaagactgtcgtgaggataaaatgagatgaagttatgcatgaagaatgcctgacactcattaaatagccttcattattcaagatatcatggttcagaaattaacttcaccatttactaaacaagttaccttggg

SEQ ID NO: 8886 - DNA, 559 bp, artificial
  synthetic oligonucleotide
agggtaaggaaaaggaacaaaaatccaggggaaggacaagattcacctagaaaaatgcctgccaaaagattcttccaatgctagagacgtagaccacaaatatatttctaagctttccggcagccaatgcaaagatagaaatctgattagttacaggattcacagcatccataagtttaaaaaataccctccccactttaagagctcagggtttttttttcctgatatttgagagaaatatcttcagaagattcccagaaaagagggtaccataagatgtagtagatggcaatctttacaacagtcttacaatgaatttgatagcaaattgctttttaaaatatctttcattgcaggctagagtgagctgtgatcatgccaccgcactccatcctgggcaatgggagtgagaccccatctgaaaaacaaaaacaaaaacaaaaaaaaatgaaaaaaaaaaacaaaggccctcaatagggcccttctttgttcccgtaatgccttatccttccttctatcaggctctgcattgtagttcttatatatctgtattctgtca

SEQ ID NO: 8887 - DNA, 911 bp, artificial
  synthetic oligonucleotide
cattgctttcatggaacttgcaattcaatggaggaagcagtagataagtatgaaaactgagagagagaggaaattattgcaggaaatagtatgtagtgaaagtaattaactctgtttttatgtatgtgtgttacctactttatataggtggtcaggtaaggtaggctgcagacccttgacccatagaacaaaaagctaacacttccactctcttctcttctccgttttttcccttttcctcttttcttatcatctcccgccatcaagtctctctatctcaccatttcctttcccttcctctccattattccttctccagattctagctttcttttcttccagctctctgcatttgtgtatatatgtaaatgtgcacatatgtgtacattgacatgcacttgcacacatgtacacacacacacagaggtagtgcttctatgactgaacttgataaccacaaccctgggagccctgcttatcctaccagaattgctgcactgttttaattacagccattattcacaacacctcgcacattttctgtcttgttgacagtatttgggaagcagcagctgctcccttactttcacatttattgccactgttttgccttggaaaagaatattaaatatcacagttaaatacaaatcttcttaaagatcaagacagcttctgctcttagccattcagatttcacttctctcactcagctgagctccactgaacactttcagattggctcctctgcttgagttattacaaaatgtctggctttgatttgattccaatccccttcaaactctcaacatctctgctgcttctgctgctgccttcctcccttgtttccttctgtccgtctcaagacagcttacatttcccaggccaaccctctatgactccattcatgcatt

SEQ ID NO: 8888 - DNA, 1045 bp, artificial
  synthetic oligonucleotide
aggcaaatcccttaacctttctgagtctcagtttcctcatctgtaatatagggatgggtgtatctcctcattaggttgtcgtgcaacttaaatgaaataatgtagcttaagtgttcagttcggttcgtggcatctggtaatcaatcaatttgtactagccatgatggttattctctgaaaataaccacttttatgtataaaagtggacatcctcagtagccatgcctacactaagtgactctgctctccaatcatagctgaataagtctgggatagctccttggctcagattgggcaattgaattctctcttcaggaaacatgaactttggatgaatcaaggcagagagaacaagctgttagagttgagtcattttcatggcaacactctggaacagaagctgcagacatgttttgtttggtcttttccgtgttttgttttttggtttttaaaaatttgaattcatagtcattatttaaaacctcagggaatgtcatataataatctacaattctggccttactggatctgttaacactgggccaaattcctgtatggcaacaattggctagaggaaagtaggctcagcatagcctgcttcacccctgctggatccccagagtttaggatccctgctcctcaaggctgtgctggtttctgctattccctggccttgactgtttcactcttcctttggttctaggagataacccaggatcccgcaaagcaatcctctcaacactttttacttctctcagctacctaaagtgtctacaatttccatgactcacagccaaaagatataaaggatacggaatgactggactcccatggtagatccgccacattagctctcagtgtgactggctcaaaagagccagtaaattccatgaagcatccttcagaaatgctgttttacttctctgatcgtcaaggattataataataaaatttctatatatggagtttatatatacaaatatctaagaggacatgtgttcttacctaatgttcttagacagatccaaattcaaacacttcattc

SEQ ID NO: 8889 - DNA, 1373 bp, artificial
  synthetic oligonucleotide
gttttgttttggtttggttttttgtttgttttgttttgttttgttttgttttttgttttttggtgtgctaatgaaagaactgctgagtggcttcataaggggaaggatgtggtcaaagaagcaaaaggagataaagtggcctaactccacatagcctttagaacttagttgatgccaaggagatgctaaaacaaatacaaattagcaaagcatcattaggatctcaccatagctaatggaaccaaggaagttttctccaaaaatgagctgaagtttttattatctccctacctgtgactggttaacactctcattaaagctttcaattcactctgaggctagataagtttgttttactctcttacatggccaaacgctatacttctcccctgccacaactaattgtcttccaatgcatcccacggtggaacaaggcacttggaatagtgtctgtttggtgccagttcatccccctccaaaaaaaataaaaagcccataactatagttgttgtattagacaattcttcttcctgtccctgcactgcctgcgctgtattccagctgccaatcaggaggatcagcaaatgccatccaaagtagcatcttgagctataatgagtccttgctgctgactgggctcctttgtagtatgctggaagtagtcaacttgtttgtaaggcttgggagaccttgtacatgagtgtgaagggtcaacagaatcaagatagctgagacctaaaggtctgagagagaccaagagagtctattctcttcttggtaagataagtaggatcccaggatactacatccatactgggggcctgggctaggaatctgggttgagcttggggttagatctgcctgtggtgctccagagcttgaactcaaaggtgatctgacagccagcgatcaggggagaagttgctaatgaaattcaatagacaatccaactgaagggtcaattccaatgggcacactaaagggagagaatctgggctctgcaaagctagtaagaaaacgtggcacagcagaagagagcaagaggagtcaggacagtgagtcagaggtagagccaatggagattccctgagctcttgggatagagttgcagaaactttttattgggtgacttggccttgcctttgagtagggatgacctagcaacaggctgccagaatttaaattccaactgccatcctgggccaccaaggagtcctgcttattaactatgggatctgtggctagccactcaccctacttatgcttcagttgccacatctgtaaaagggagatagcagtgtagtacttaccctgttgggttgacaaaataagataacattgtaagtacttagtgcacataagcagtgtatatt

SEQ ID NO: 8890 - DNA, 615 bp, artificial
  synthetic oligonucleotide
tcatctgtgaggtctgattaagtagctggattgggtcaccgatatatttgaatgaattttatttttctactgaactcaaactataggcataatttctgggatattggtaagaactgattgctgttttcctttattgtccatccatttgtatcaacatgcatgttatttatcagtatggagtattataaagaacatgtgtgtgggaatcagatcaatgtgactttgagcaaattttaaccactctgagttttagtttcttcatttgttaaaaggcagtaaaatcatctaattcactaattcatgtgtcagaatctttgaacacactcagaatattgcacatagtaggcattcaatgaatattctttttattaataccaacaataacatggatactttatttataagtgtctattatgtatgtactaggcattgtgctggcttctacataaatttctgggttggcacatacattttttagtgtctaggagttatggaaaactcctttacaaatagctgcttaattagggctttgtgaacgaatgtgggttattgctttcacttagtagagagcagaaacttgctctgtgtctaggacaggacttggacaggtaaggg

SEQ ID NO: 8891 - DNA, 781 bp, artificial
  synthetic oligonucleotide
atagctctgttctgattctggccttttgttcctgggcatctgtttgggccctgatagtctcctataactaagagtctcccttattctttctagtgctttttctacctctccccagatattagattttttccagtgtgtgtggccatgcagccttgtggctaacttccctgatcctgcctgccctgctgaatctctgaacaccagctgcttctagaatttccaacaccttgtttaacacacctgtcaggatatcccaagtcttggtcccctgaaatttgcttgacttgctgtaatttacctttctgtctagactgtgttatatgaaaggattggggccaaggagatgtttctgtttccttgatagtatattttgcactagcaccttgtccaaagtgtggtccctgaaccagcagaactagcaatgcctgggagctttttagaaatgcataaaattgggccctaccccagacctattggatcaggagctgcctttaaaaggtatctgttctagggctatccgctgatccattaccaagtcaatgaaactacacttaagtgtcttgcttataagatcatttactccattgcaatttaagttccctgaaggacagacaattcatgcatcttgttcactgctgtatttgcagtacccagaactgttcatggcagatgataagtgcttaataaatatttgttgaagggtggtcttggaaatttcttaaaatctctgtgcctcatcactttccttacctgtaaaataaggatttatatcccgacttcc

SEQ ID NO: 8892 - DNA, 209 bp, artificial
  synthetic oligonucleotide
tatctacaagccagccagatttagatgtgttactctaggacacctggaaaaacttatgggccctttgggggtggctgggatgtctaaccccagagatgtgagcggacccagagagctgagccaatgatgggagattgacaaaaatacctgcaaagtttctcagtcaggtaggagtattcgaaaacattgttaagctgtgtttgaaagta

SEQ ID NO: 8893 - DNA, 1573 bp, artificial
  synthetic oligonucleotide
ggaaatatgaattttaactcacccacctccaggtgatatttatgtgctctcaactttgagaaaggctactctgtaaaatggcctgaggggatttggagggtagctctgggaaattatcaacccttctctttcactcactatttgtagagcaagtgagtgggtggggagaggaaagtggggcattccaggtgtcagaaggtatttttcaaagtgcagatagttaaaggctgtctactgaaaggaaagtgaagaaaaatagagatgccagcatgctaaattagatgacacttaacactcaaacatttgttgaattaatgcctgaataattaagagttgattgggcagagacacaggaagattgtgtttaagttacagacttggcttgcatccgtgtttccttctaaagagaccaccttctccatttctgcattgtctttctttagagtgaaaatagctagtcatccccaacatatttggggttttgtggtaatttaaatatctaataggcactgcataatgccattcaatggttgtacctaaatataaccctactaatcaaaatgaggatattgtgtttaagagtctggctatatagtctctggtctgattatagtgttgagtcttttttcaaaaactgtctctatggagtaaagcagggtcctgtgtttcattgctttccagacattccccaacaagtgctgaatggattttgttgcaaaagtttctttggaagtctatttagaattcagattgcattttcccaaggacacaatattcttcttgtggttcaggttcccagaccagctggcaaaagcctatttaatgtgaagtagagtagaagtccaaccccaccagccccttaccagaatgcctaaaaatatttttgatggggaaaagcctcagggttcagacctgtgatcctaggcatacatcccagcttcattctctgagcagcatcatagggatttattgttggagggaacaattcaaactccttttctaggtctcctaggctttgtgtgagctgacctttctgctcatctctccagtatcatttcttaccatgtttcctctggcactctatactatccaggcaaaaggaactactttaagttccctgaacgcatctttgtaacctctatactatccaggcaaaaggaactactttaagttccctgaacgcatctttgtaacctctgggtcatttaagcctttagctatgctcttccctctgcctggagccttctcctcttgcctatcccttctcactggtgttttgtgttacagctctcaaagctctgatcatcgtttttattatagagtgatttgtatgctttatgtcatttatcttcccttctgccagactgaatactccacagaaacaaagaccatgtctgtgttactcactgtagtatgcccagcacttagcatagtgcctggcaagtagtaggttcttaataatgatatggccggtaaatgaatgatgttgtccaggggttcccgccctcttttacagatgtggaccctgagatttagaggggccaagtttttttttttttccaagtccatagca

SEQ ID NO: 8894 - DNA, 643 bp, artificial
  synthetic oligonucleotide
tttagaacattttcatcatccaaaaaataactccatacgatttagctcacccccctccctacctttcccccactcaccagccctaagcaattgttaatctactttctgtttctatagattttatctattctggacatttcatagaaattgagtaattataatatgtgacctttttccactggcttctttcacttagtatgttttcgagattcatctgtgtttagcatgtatcagtacttcacttatttttatggccaattaatattccattttaaggatatgccacattttatgtatccatttgtctgttggtgagcatttgggttgtttctgccttttggctattacagataatacttctgtgaacatctgtaagttttcaggtgcacataggtttttatttcccttggacataggttttcatttcccccaggtataggagtggaattgctgagtcatatgataactctatgtttaacctctcaaggagctgccagactgtttctctaaaatggcagcatcattttacatccctaccgacagtataaaagggttccaatttctccacatcctcatgcacacttgtgtttgccttttatattttggccatgctagtgggtatgaagtgtcatctcattgtgga

SEQ ID NO: 8895 - DNA, 1005 bp, artificial
  synthetic oligonucleotide
gaagggaggggaggggagggaaaaatagaataaaacaaatcattgagcagtaacaactattaacattgtttgttacatattctggaagtctttttgtctctttatagatgttaagagtttatagtgtagtggtcaaaagtaccaatccttgaaccagctggtccatggttttatggctggctcttctacctgcagctgtgtgaccttgggtaagatacctaaccttgctgacctaattttcttatctgtaaaatggtgcttggttgaacggagatgatgtgtggtaagcacttagcccagggcctggcgcataggagataaccaataaatgtcagatgctgttgtttttactactattactactattatcctaaacactgaggaggtgcatgcccttgttgatgttagtctttagagctttgaccccaactccctgagcttttcagtggcggtaatgtgaagggggctttgtttctgcattagccttgctgagtgagattaaaattcccaggcaggctttcctatccacattgaccaacactgcctttgtttttcacatttgtttcagtgacagcctgtttgattagggaactggccaatctgcttttctccctcctgacaggtgaattgggcccactcctttttgggttttcaaataaaatgtccagaccttttaggtttgtcagtaggcccaagcccttcagcccatttagggagtggcagcagtgagtgccaggcagcagcctgtttgcctccagagcttactagtttgccttggcccttgtttgccttggccctgtcttcctaaaatcacattagaaggaacagcgtctggcagtcttacccaatgtcttctgtctccaccttgagccactacttcaagcagtgtttctttatgcaatagaagccttatctagtgagtgcttccactccttagtctgtggatcagtggttctcaacgctggctgcacaattagtatccccagagccactttcaatacacac

SEQ ID NO: 8896 - DNA, 1275 bp, artificial
  synthetic oligonucleotide
gttttacattgtaaaatgaggacggtcataacaattcctgaatctttaataaggtaatgcatgtaaagtgcttaccacaatgcctgatacaaagtagtaaatgctcaataaaggttagctaagattatttattaataataataggaaatatttgagttgctattaaggtgcttttgagaatggctttgacttagaatcaagaggcagatttggagcccagcgaaatgattgttgcggggaggaataacgacaaaaacaaaacaaaaaaactttcaaagtggctgaaaagagagcaccggtatgaactgggaagtggagctgcagatgatggcgtcctggtaattttcctccactgtatgtagttttttccccctgcagttcccctggaggagagaggagaactggctcgggtgggggttgcaaatactagaaagtattctgggcaagaaggggcactgcaatcaaagggctgggggcccccagagtcctggctcaggagatgaagtctcaggttccctgggctcatgggcctaaagccccaccttgtggggaatggtctgagtgactctgtttctgtgcacggagtttggaggcatgaggcaggctcactacatcgtgttagaaacattcccattgttcaggaatggtcttgctctctgctgccagttccaggcatcagctgaaagctttttaataaaaatggaactcaaaggagacgtgataaggtacctgattttaacctgaagtgagagaacaccagatgtttcattctgtctgagggtttgagaggcaaagcaattagcagctgctactgatttagcaacagacacctgctaaatgaaaatctgtaaaaccggccaggcttggcagcagaagcgcatacactgcttctcaggcatttctgggaattgtaaattatgttggctcaaatggcagggcggggggcttccagtgaagctgaacatgctcatctagaccaggagtgtgtttttctaagatggcaataacttagaaatggctatttggttggtggatggagaggacgagatgagaacgaatcttccagaagctgcctggttcgtctctgctgctggcccagctcacaggtgccctctgggagtcatcctatagctgccctctggggacagatagggctgacagaaggacgagggaatcctgccacccctctcctcctgatccagagcacatctctccctgccaccaaaggcagtaagtctcaaagcaggaggaacacccacctctggactcacagca

SEQ ID NO: 8897 - DNA, 880 bp, artificial
  synthetic oligonucleotide
ctccaacttaaagcagaggtcatggggattgttagggggagatgttagaagtaacaggccagggaagcctgcctcacaaatgactgccaggcccactggttgcctttaagcaatgacccccagggagtagattaaccagattcccttcttggcagatggtggggtggggggttaggctgagtgcccttgagctgttttgactggcctgaaagccaaatccagatgctttcctgcttgcctttgctctagtgctagtggagggttggcatttatatcagtcatgccatctgatgctcaggtcttttaaagacattacaatatgggtggagggtaacacagactacctgtgcggatgaagaactgggagtttagtacctttcctctcatacctactgctctacatggcctaaattttctgggtggaatctgtaacccagggtagaggaaaatgatgtgttggtcctgtcattggtggaaaggggcctcgttgatccccttgttccactacctaagcaggaatgttaggcctgggcaagtcagtctgcaggcacagtttggcctccacatacaagccaattttcttttgacttgcagctgccctggttcctcggtaggcttttgaaccatctctttgattaattagactttcctctgagttctttggagagatctgtacaaatactaactttcccttattgagtaaaaagtcaaataatgtgttcaggactggacttcgaagtcctgaaacaccatcttgtatactcaaaacatctttcttttttgtgtatgaaattcaacctttgtctcagtttgaagaagtgataaataaatttgcattttgtgaatttggagctccctgagtccattttgatggctaggt

SEQ ID NO: 8898 - DNA, 1738 bp, artificial
  synthetic oligonucleotide
cttgggtcggaaacaatgagctgcaactggaaagtggtttgttgtggaccccatggggaggcaggaccctaaccctgccccttggcctgggggagtcttctgaccttgggtccatcctgggcccattcataggccctgaaggctgcactcttccctgagcttcatggccagtgaagtgtggtgttggggaaatcctgtggcattctggggtgtttagaacttcctggagtcatgaagaatggttggatggttggactcagtagctgagttatccagagcccaaaattgctgagtgtaagagtgtatatcagtggcaaaatgagtaggaagagctcaggactggggctgggggtcaggagacccaagttcaagtcctggctctgccactgctctgaatgagtcacctcacccttgagggcagagagttctccacctctctttgacatggtataaaagccccaacttccctgagaggtggtgaggacttgtctttaatgtgaacaggcttgaagggctttggaaggcaggtgccgcgaccgtccccggggcaggtgtcgcatgtctggttttgtgtgcaagtggcagtaatgtagcattagccatgtggagcctcgcgtgacctagcatgactagggcgtgtaactgatgtccccaacacctttgtagaagcagtcactttctcttcctcattctggtgtatggctctgctctggtttgctgggggcttagtctgagctccttgccaacagtgtgaatgcttcctgcgctctcaggaggaagccgtacaaagttcacacccttaccacttgctgctctccactgggacccagattccagaggcatcagtgtgctcatgtcaccctacataccatgctcaggcaacgcctcctacaaggagggcaaccctcaccccattcctcaccataaacccccatccatctttcatgagtccattcaggtaccacttctgtcatgaaatcttctctgaggactcagcccccatattgtatgctcctcagacctcctcatagtgtataaagctgggtgagccctgtctggtttggggtcagatgtagtaaacctttgaccacccccacttgattgattgcagttacgtggaggcagggcccacgctgtgggctgtacttttagcctgtaacacctctccggggtctaggcacatagtagatgctcaggaatggcaacaagttctgggcccaaacagaaggcaagaccgtgagcaaaactgaatagcttttccactagacggccctccgccatcacctccagaggcctctagcttgactcactcagaaaaccgaggggagagaagaaatccctttataaacaggtggggattggtcaatccctccttgtctagtcccccattaggtagagatggctgaactggcagaagccagagaaagcctaaggatggtgaacgctcactctacctcccttgtccctgcaggtcaccgaagtgaatttgaacaacatgctgtgtccggccatctcagacccattctacggcccctggtatcgcatctgggcctcgggacaccagactctcatgaccatgacccacgggaagctggtcatcctgttctcatacatggctgggcccttgtgtaaatatctgctggatttgctccggcttccagccaagaaaatagactgaaggtgcttattttttttttttttcctccctgaggaagcaagtcgtgacttgacttggaga

SEQ ID NO: 8899 - DNA, 1135 bp, artificial
  synthetic oligonucleotide
ccacccagagagggaactcttttctaattcacataaaagcaatgtaaatgccagcagtggccccgaatacacagactttattttctcctatctttccctataccagcaatactacaattttaatgcccagcaataaaggactggttaaataaaacacccatagaatggaatgtcttgtaggcattaaaaagaaacaggtactgctgtctagttgattacattgtgacaatcaattttttagtattgataatacactataattatatatcaccagtgggaagctgagtgatgggtacacaggattttgctgcactatttttgtaacttcttgtgagcctgtaattatttcaaaataaatagtttttaaaaagaaaagaaccaggaagttgcaggtgtgctgatacagaagtatctccaaggatgtgcagcaatagcagctcttgtttattgctggtgggaatgcaaaatggtacaaccactttggaagacagtttgagagtttcttacaaaactaaacatacttttaccatacactccagcaatcatgctccttcgtatttacccaaaggagctgaaaccttatgtccacacaaaacccacagaaaaatggtgtttataacaactttacttgtgattgctaaaacctggaaacaaccaacatatccttcagtaggtgaatgaataaacaaactatagtacatctagacaatggaatattactcagcactaaaaagaaatgaaatatcaagccatgaaaagatggagaagaaacttaaatgcatattgccaagtaaaagaagtcaatctaaaaagtctacacactgtatgattccaacgatgtgacactctgaaaaaggcaaaattgtggagacagtaaaaaggtaagtgttagggagggagaaatgaataggtagagcacagaggatttttaggacagtgaaaattctatgatactatactggtgggtacatataattatacatttgtccaaacccttagaatgtacaataccaaaagtgaaccttaaactatgaagtttgggtgataatgatgtgttaatgtagggacatcagttataacaaatgtaccactcaggtgtggggtgttgttaatgggggaggctatatatatgtgc

SEQ ID NO: 8900 - DNA, 3797 bp, artificial
  synthetic oligonucleotide
tccaggacactttattgtaatttccactttacatattaatttaatattttagtctaggcagaaatgtttatacttatacaacagtagtccaatcctctaatctcacaaaatgaaaaggagcagttttaaaagaacatcaattcaggtatttatgatatgggggacaaggggcacttgtcttagctggaaaaggggctgatgcctttcagtacgagtttcactgaaattttttctgtattatttttcttgttgatgctaagtactcaaataaaagcaattgcactttttctcattctgccctctcttggtctttacattctgtctagcatttaacgcaaaaagtcagtttacattcagtttacacattaaaaaaaaaaaaccatatgccccacctcccacacatccaaatggacagggattagaattaacctggcttttagctgtaacagtgctattttaaaatttttcaaccacacacttgaagggtaaaataatttaagatacaaaaccaaaggaaaccataacaattcctacacatttactatttaactgttctcaaatcatcaagtataacatggatttcttaaaaagtgaaatcgacacaaaagcgaatgcacgcttaatgtacaaactgaccgtggctctgtggggacagttctctttgaatgagctattatccagacggtggaatggaaaaaaaaaaaaaaaaggtcgcactcttcaaatgtgaggaagccggcagtgcgctcgctacacgagaaacacattttaatgggtgtatttggataaaaataagtagtaagggaaaaatgtgttttaagaaacctccccccttcccagggcacaagaaaacccagaggagaagatgggtaacctcacaagctccagagctaagttccatcactaacagaagttggatagttgctatttttcatcctgcaatgggatagtagttctccatgtgcaagatacgcggggcgggaatactggcggggctttcacttggggtaatggaaaccaaagtgaggagaggtcaacaccttgagtaacccagatctccaaaaccggggcagggtgaggggtggtgggggtggtgaaggagacaagtaaaggagtcaaaactcctcgaagtcatcgcaaagagaaagctaacacctctaggagccacggggccattccttgcagcagcaccctgctccaagtgtggggtgcctgcctcggagggcaaaaagcgcagggtgcccttagttcagttgagtagctccggggacccgggcagcgagagggcaggggcatccgccggccgggaggcggactcgcactttgcctcaactctgagccccatcccgagcgcaagggagagggcggcggagggcacggtactcactagggctcgttggtgaatcggggggtccggggctgctggtatccatacaggtgacagtagagcacatcgaagcaaaagcagcacatctctgctgacaccaccatcttccgggagcccggcgatgaggacgaggcggcggacgatgaggagggtgaggaagaggtggcggcggccggggtagaaagtagggtccccactccgcagctcggaggtggcgacagggcgatccccccgccgccgccgccgcagccctgggggggagagagggtacagccgctgccgctacctcctccggttagacctcccagcccgttgagccgcgtaccggcgcctcctagtcccagctccccagctcggcactggctctctccgctgcagtgggaggaggaggaggcgccaccaccgccacccgagccagaggggggcgaactggacagtttctgcttcttcaccccgcagcaacccgccgccatcttggaacagtctcccccacgcagcgtttccgacccataagtgaggcgagctggcggcgggggcgagcacgctgcggctcaggccgccgggggcgcgccagaggctggcggggcgcgcgcgcgccgctcccggccccgtctgcctagccacgcggctgccccgcgcgcgcccccgcctcggtgcgcgctcctcgctttcgcggctgggcgcctcgcgcctgtcccgcccgactcgtgcctcttctgagccgcagccccagccccagccccaatctcaatctctccggccggcagaggttggaagacaggaagccgattagaaaggaaggtgaaggaaacaagagtcagacagcggaaagtgggagcaaagggagaaggtgggcacgcccgggaaggaaggagggaaagggaaactagtgggggtaggggggaagaaaggagaaagtccgaagtaagcatccaggtcccaaagcacagctcagtaaccccccgccgcaagcagtattaatgacacttaagcccagttacgtggaacctgagccacccggcctcaaatacacgggtttctgaactgttggagtgtgagcgagcaggtgcccagagctccatacctgagaccgcccctgtaaagtgtgtacaaagcaatccaggaaatggccacgctgctgtctttttaattccagcctaagcacacaccagggtactctttcctttccttatggagaaatattcaagtccgactgaatctatgtatcttgtacttgttcccccaacttaccctccttgccccgtttaaacatttaaaagccaaaaataaagtcctaactaatacttcactggttcaaagatactaattgtgctttgggacttgcagtggtggacttttctggttttggtttttatttcttggcttgggtacaaagcaattaggaatattatctgtagtgctcagatcttagagataaatagggaaggtaatgtacttagtcacaaattgaaagattttgttcaagtatataattagctcttaatattcatttttaaaatttctcaattaaatgcttggatggatgaggagacatatgagtcagtccctttctgggtgcctaagtgcagcttaataataaaaataatgacaataatcaaatgttaaaattcgtagaaatgaacgtgatagaaatagaaagcgtaagttatttgcattgtatctacaccatgctaaaacatctagataaagtcaggtatctgcatatttaaaaactgcagattgatttttgtcaccttttttctacatgcgtgggatcttgcagatagctgggggctgttcattccactcagggaataaaaacaaaacaatttattcattcagtaatattgagcctctgcaccatactatgtgcacaacactatacttctgttgaaatccagggcgtactcaggaagtatgcctcccgctctaaaagagtttatgaattaagtcagatacatgcacataatcagataaatagctattatagtatgtattgaacactttttaggtctccaataccatacctcgtcctaccccataatccttcagaataagatactatctcgttttatcttcacaacaatgctctgaggttactcattaacagatgaggctattaaacctcagaagtaatttgcccaacatcacacacctagaaagtaacagagctaggattggaatgctggcatgtctgattccaaaaaccatgccattatactacattgcctctcactaacaatatatgataacaaggctaaggatggacaaaagatagtgacattacactccagcaggtggaaccgaggttaaacagaaataagaacttagtttttatggaaagattgagagacactgaaatatgttaccaaggaaagatgaaaaatctccttccaaaaagattttatga

SEQ ID NO: 8901 - DNA, 1493 bp, artificial
  synthetic oligonucleotide
ccttgggcaagtagtttaaacctgtctacaccttagtttcctcatctgcagagatgggtactctaggacccatttcttaaaagagttattgaaaggattaaatgagataatatatgtgggaagtacttttcctagtgtctgtcacatagtaggtgctcaaaatacattatagctttaattattcaagttttctggggcagtttccatttcaaatattctgttgtgtttttagactatttgttctcatttgaaattctaaaatgtcatcactgtatttttcttcagcatttgaaggaggagggtttgttttttcaggtataaagacacaaaactgcctccactttctacacttgatttgaaaatctcaatcctagtcagagacatcttattaagacccaaagcataggatggctactataaataaacagaaaataaagagtattggtgaggatgtagagaaaattgaactcttgtatacagttggtgggaatgtaaaacggttcaaccactgtgggaaacagtatggcagttcccaaaaaaataaaaaatagaattatatgatccttcaattttgctcatgggtatatacccaaatgacttgaaaacagtgtcttgaagagatatttgtacacttattttcatagcagcattattcataatagctaaaacaggaagcaactcaagtgtctatcaacagatgaatggataagcaaaatgtggtatatacatacaatgaaacattattcagccttaacaaagaaggaaactctgcaatatgctacagcatgggtgaaccttgaggacattatgctaagtgaaataagccagtcacaaaaagacaaatactgtatgattctacctatatgaggtacttagaatagtcaaaatcatagagacagaaaacagaacagtgattgccagggactgagggaaggcaagaatggggagtcattgtttaatggctacagagtttcagttgtacaagatgaaaagggttatggagatggatggtggtgatggttgtttaacatgatgatgtgtttaataccactgaactatacatttaaaaagttaagatggtacattttatgtttcatgtattctaacacaataagacatttgagaaaaaagaagacctaaaacagacttgtacccacaaagaatggagaagggaagaagagtgatctttaaacacagaagtaccaggcagtgaaattttgagttttcctcagaagtacaaacaatgagtggacagacaagaagccagggtgggagagacctttcattgggtgtgacccttcatttccagttctacttgaagattttgctttaattaacacaaaggtgaagctcagattgtagatggcctgacattgcttatgatcagccgtttttctaaattatctaaacctcattataattatacatatgaaatgcctggtaataaaattgcatagtaattacacagcccgtaacatcagtattcaacctgc

SEQ ID NO: 8902 - DNA, 1572 bp, artificial
  synthetic oligonucleotide
ggcaaaatatgcatagcactgttttagaaagattccactggttttcatatgggagattaactagagggaagaagagtagtcaagaggctattaccattgtccaggtgggaggtgatgttatcttgaactagattgatagtaatagagacagagaatggtggacagaattgagttatattttggaggtaaaaatgtcagggtttggtaatagaattgcataatggagagtagaagaaagggaggtgacaaggaggatttcaaattttcaagtttaagcaaatgcttatgaatagtgatgccattctttaagatagagagcccaggagaagtagaaagatttttttggaggggaaggacaaatgagatgatgagtttcaagttgacatttggaggcaaggaaaccagttaggaggctattgtaaaagccaagtaagacaaggtgagatcctggactacaatggtagcagtgggaatggaaggaaaatggtgaattgagagacattatacaggaagaattgataggattttgtcacggactgacttctggagttgaaaggtagaggaaggcttgaagcctaagatatcttctgtcctttatcttcttagtgatgctccgatcttcgtggcttaatatactatctatttgctgatgagtcacaaatttgtatctccatacttttatgcccaattgcctgctggacatatcaacttgcatgcctaataggtatctccaacttaccatgttcaaaactgcccctgcccacaacccccaacaaaacctgctgcactcacaaaacctgctcctcacagtcttccccgtctccctaaataccaatttcattcttccggttgctcaggcggaagacctaggaatcaatcttgatttttccctctttcatatcctacatttatttgatcagcaaatcttattggttctaccttcagaatatatctagaatctgaccactttttcattgctactatcctggtttatgtcacaatgatctgcttcctggattatattgcactagcctctcaactgttctccttgcttctgttcttgccaccatcactcaagcctattattctctcactgttttttggaaccaggataattttattatgtgaatgtcagatcatgtcactcctctgctcaaaactcctccaatggcttcccatctgacactcagtaacaacaaaaccccttataatggcccataatgctgtatgcaacccagatattgacatactcctgtccttcaggtgatggatcaaatatcccacttggtaaaatcttctctgattaccatatttagtattgcaagcgccttctcgccattctctatctgccttccatgttttatttctttatactttgaatactagcagatgttatatgtttatctatttatttgtttatcatctatctccttctgctagaacaggagctggaaaactttttctgtaaaggtccagataataaatattttaggctttgtgagccacgtaatctttaacacaactacctacctctatcattgttatacaaaagctgccatagatgagcatggc

SEQ ID NO: 8903 - DNA, 5974 bp, artificial
  synthetic oligonucleotide
tcaaagtgactattttccttatacctgcttctcccacagccttctttatccattcttctggttatttaggccaaagccttggagtctgacttgactccctttttctctcacactccagatcctatctatcagcaatactttcagctgaatagttaaaaatttatttgtttagaaacagcatctcacactgtcacccaggctggaatggagtggcacaatcatagctcactataacttcagactcctgggctcaagggatcctcccacctcagatttcccagtagttggaactacaggtactcaccacagtgctggctaattattattattattattattattattattattattattattattttgtagaaacagatgtcttgctttgttgcccaggctggtcttgaacttctggcctaaagttattttcccaccatggcctctcaaattgttgggattacaggtgtgagccactgcacctggcctaaaagtatatttagaatctgaacacttctctactgctataaccttaatccaagccagcatcatttcttacttggatcattacataatccattaaacatgtaaatcagatcatgtcatgctcctgctcaaaaccgtccgtggccttttatattgttcacaataaaagccaaagtctttagagtgacctacaagattctacatgatctaccttcattcccattacctctctgacctcatgccctgtcactctcctctttgattactgagatcagccatatggcttacttgctgtttctcagacataccaagaaaactcccagaggtccattgcttttctctctaactaggatgtttcttcctcatagagtgtcatgcttattcacttgcttctgtcaaatctctgtgcaaatgacactttatcagtgatactttctttatcatcttatttaaaaattgccactctctgcatgcttcctacaactttactctgcttaatttttttccatagtacttgtcattttctgatatattaatattgatttgtttgtttactgtctatcttcaccactagaatataagcttcaggaaggcagggattttattttgttgctgctgtatccctagtgtgtaatgtggtagctggcacataataggtgctcaataaatttcaaattattataataaagaatgattccaagtgcaataggaattccaagattcctgccatcttcagatggacccagatatccttcatcatctgcagcaatcccccacccagtgccaaactctgtgacactgcatgtctggtagtgagtttagtctttacatgaggacttccaggaagttccatagattcttaagcaaagtgctccattattgaagctatttaactcctagaaagatctttgtggctgtgtgcggtggctcacgcctgtaatcccagcactttgggaggctgaggtgggcagatcaggaagtcagggaattgagaccatcctggctaacacagtgaaaccccgtctctactaaaaatagaaaaaattaaccgggtgtggtggcacgctcctgtggtcccagctactcggtaggctgagacaggagaattgcttgaacccggggggtggaggttgcagtgagcagagatggcaccactgcactacagcctgggcgacagagcaagattctgtctcagtaaaagaaaaaaagaaaaaaagaaaaagaaagatttttgccaagggtccttttctgatacataacattttttgaataggtattaggtgtacacgatacaaagtgccaaatgttcaaagagcaagtagtgaaaagtatattctaccactcccactgctaccaacttattccaagccacccacatttctaaactggaattatagcacaatttttttagaaacagaagttagatgatgtcgctcctctgctaacatcagcctggggcatgtcatcacactcaaggtaaaagctagagtctccctctgcccccagccaccaagatcccttcctggaggcaaacactcttactagtttattgtgaattttttagagatagcatgtatattatacacacatatctccatgtgtataattcatttttaaactgtacacactattttttatatttctttttttctcactttattctacctcattctttttaatagctacagttgtatcagtatggctactgtattctccagagattcttagtctggagtccatatatgggtttcaatgggtctatgaatctcctgaaagtgcatgttgacacttgtgtgcgtgtgtacatgtatatcttttagcagagcaggcccatatctttgatcagattgaaaggaatctgagacccaaaatgagtaagaaaccactatattgagtctgaatctgccttcctgaaacacctaccctttagtcctaattccactgtttggagcagttctgtcaggacctggtacatagaggacatacaacaggtaacttgtgaaatggatgaagggacaacataaaatgaatctattctgtctctctctttttaaaatttttaaatttttatttattattattttttaaagacagagtatcactcttgtcacccaggctggagtgcaatggcacaatattggttcactgaaaacttccactcccaggttcaagcaattgtcctgcctcagcctccccagtagctaggattacaggcacctgccaccatgcccagctaatttttgtatttttagtagagacatggtttcaccatgttggccaggctggtcacaaactcctgacctcatgtgatccacccgcctaggcctcccaaagtgctgggattacaagcgtgagccactgcgcccggcctattctctcttctttatgttagcttttggttagcctgaggaaactatcatattctaagtcatcccttttctaaagttaattacttaattttcttaacttttcctaatttgacatggtttccaaacctgtaggctttccctacatgctgtaatgtgggtttcttcctcaaatgccatcggggcaagctggtaatttaaaaaagtgaagtggatcagatgtgagacaacggcaagtggtgggacctgtggagtccacatggctaagatgttcacattcaaactcacatataacacatccataaccaaacaaaaaatattttcaggccagttttggactatgggcaggcagcttgcaaatataaaaatttggacctcgtacagtttgttgatactcttttcacatcttctgcactctatcaattcacttttgtcctccccataggcctgacaatttaatcaaactaaggtagtgcctgcatctcaaataccccttaagattccttgctattattcctttgccaatatggctctgtctgtataaaatgcctttgtggaatattctctacttgcccctcaagatccacttttaaaaatagactattttttagagcagttttaggttaacagcaaaattgagaggaacatacagagagttcccgttagcccctaaagatccagttttcacccttcttcatcctctttgtgtaccccccgagactgacctttatagactgcatttaaaaacatatttttagttattgtgggtacatagtaggtgtatatatttttggggtacatgagatgttctgatacaggcatgcaatgtgaaataaacacatcatgaagaatggggtatccataccctcaagcatttactcactgagtcgcaaacaatccaattacagtccttaaattatttttaaatgtacagttatcactggctatagtcaccctgttgtgctatcaaatagcagatcttattcattctattttttgtacccattgaccatccccaactccccccagccccccactaccttcccagcctctggtaaccatatgaattggcttccttgtcctctgaattcttcttggatatggccaatgtaaggcactaacaggggactggagatcagagacaggttaaagtctgcgtatttattctcctggctccctctttatggagtgggtgcagcttggctgaatcctgttagaaggatctgctgtgagccacagacttttttttggcagtcatcttctaaagctatggctactctgtctaggttctggttaactgctttctccccttggcttttcaggtctcagggtggtaagtgctccctggggtgcttcaccatcctttttgctttcccttaacaatgctcacactgttataaacagtccgttcattaaactccactcacttccctgttgaatatgctctcaatatcctactagatcctttactgttaccaatgccttcaactcccttgtgtacttggtgtactccccattgttaaggtcccagctcctaggacaatgtggtgcattcctagatatcactccctttgagaaagttagctattcccccacctctttgagaacatttcttgcaacactctgtgtttagatcttgggcttcttatgattgggaatgaagcctattcgttattgtttcctggccaagtagatgtttggtgagtattggttatcttttttgctttgtgaggaggatataaaatcaaggaaggaggatatttgctttttatttctttcaaattatttgattttaaaagaaatgcctacacattattttttaaaaattaaaatgaaaagaaaaaagtagtaaaagtggcaccgttcttcacatccgtgctggaagtaacagtggtaatggtttttgttgtgcatccttccagtatctttttatgcacataaaggcttaagtttgtgtacataaaatgtagactcacatatttctctgctccttgctttttttttaacttaacaacacacctgtctttctatatcagccaatgtaagtatacagccctacttcattatgttttatggctgcattgtatttcatttgatgaatttaccataatttatttaacaagcctctattattagctagtttatctaatattttcactgttaaaagcaacacaacttaaaacacagagacatactggatcaaatttaagcccaaaaatatatggctgagctccagaagcaagaaaggaaaactgtcagattccagagacaagagaaaactcacagtcacagcaatgagcataaattgacatttcaccactcacaggaaaaatgggaccaggtatattccttaaaggatgagattataagtcctctgtagggcttagaattgagttagaattgtgcttccctcataaaacaaagagtagaaggatgctgccccatttattatttaaaagcagatttcccaaatagtcaggggtacaataataacaaatcttatttagtacttactatgtgccaagcattgttctacatgatttacatgtatttatttatttaaccatcacagaaaccctatgatattaggtactattataaaccccattttataagtagggagtaaaacgtttaagtaacttgcgcagctaggaggtggcagctctaaaattcagactcaggcatcctgactccaggaccatgcctgtaagtaaatgtgctatattgcttctctacaaacaggatgtaggtcatcttccttaggatgaggtggaaataaactcacccataagaagtttaaaactttaaacctgagctgcacactagtatgaaaccaaaattcacagtacccacataatgcagaaaccctggggtgagaacttaacataaaacctggctcagagcaggaacacaatgaaactctagcagaggcaaatgaaaaaccgcctgtagacccacctccataactcagagtccaattcttacggaagggttctaacagaaaacagttcctgcagaagataagctcacatgcaaaaaaatgataaagcacatgaggaaattgactggaatgagttagttggtatatacaagaaatgggagaattatgtcccaagaaactacag

SEQ ID NO: 8904 - DNA, 306 bp, artificial
  synthetic oligonucleotide
tggtaaggggaaggggttgtctgggggcctctatcaagatacaccatggaggcttctcctacaaccaaagggtgtttggcccctttctcagatggctgagggccctggagtcagatcaataagcatttgaatcttggctctgccattcactgattgcatgatttcccacagttaatctcagtgagccttcgtttcctcccctgtaaaatggatctaataatagttctcatctcctagacgtgttgtgaggatgacatgagataacacacttacggtgtccagtacaaaataagcatgtaaaaatgt

SEQ ID NO: 8905 - DNA, 1684 bp, artificial
  synthetic oligonucleotide
taatgaatgaatagagtgaatgagagaagaaaaagctctcacttggaaagtttagtgacatgagctgtatggtatctgattcttggctgaagctgctgcagtttttccctatgactacagtgctataaaaatatgtctgcacatggataaagactggaagagaactttccacacaaaactaagagttgtgttagagtggtgagtgatggatgcttttttccccattttcaaaatgttctttagtgctgcttttggattgttttggcaatgtagcagacattgtagaaatggaatttggggctcccatggaggaatcgacaaccaatatgtattgatgcccagtgtactctgctgggttctgggtgctgtggggagatgggtgggtaaaggcgactcattctgactcaggtttgcatggtcaggaatcttgccaattacgttggatttgctggaataaaaagataactttcaagaattttccaagctcctgggttgaggtatttcttttctcccaaagctgggccgcaaacaaagatggcttttgtttgcagtaaaatactcattccttcaattttgtcctgcaaagtgacttctatagctttgggagtcaggtttgctgagtggggaaactgattgtccatgcttcattgatttagaaatgaccaaaaatgtttgccttttctggctcttgaataaaatgtttaggaatttcattggcaaaatgatgaaattgttccctttactgctgcaagacttccaaaactatatatcgtgggttaacttaacccagaagaggcaaaaaaaaaaaaaaaatgggaagcagactcagatgattaacactctgccttaattgggtgcttactcactctgccgtggcaaggcactgtgttctggactttggagatatctcatttaaaactctcaacagcctgtgggtaagggactgttattgttctcatggtagagatggtcaaactgagtttcatagaggctcagctctgaaatcatgagaccaggatttgaagccgagttcagctggttccatgggcacacactaaccatttggcaacagtgcctctagactagtctggctacaaagggacagaggtatgtatttattttgatttaacgaaccgttgtttaatgtttaccatgtcccgggcacatggtaactgctttaaaaatgttagattatttacttctcatagacaaccctgtgaggaggtactattattaatatcatatgacaggtgggaaaatggaggcacaggggtgttgaatcacttgcccggggtcactcaggctagcatgtgacagagctagagttacaatccaagtggccatgttcaggtgtgtggcccattaccttgactctgtgctggttagcatgctaccccctgtgccctgtctgcatagctctggctcagaaacactgaagacatgggcctctttttgtagttttgtaacagatttgtactttttaaagtattttccaccattaaagccatacgctctgcttctaagcgtcctgtggggttggtgggaagggtgaaaacatactcctgtccttctatagcaagactagcttagaggcaaggtggcccagtggttagagcatgcccatggtgccagtgaactcagcttcaaatcctggccttatgatttcagagctgaacctctctga

SEQ ID NO: 8906 - DNA, 2263 bp, artificial
  synthetic oligonucleotide
ttcctttggctgctctccaaatctaggaagacctggaggaaaggggggctttattttctatctttgccaagatcaggaaataatttgtgaactctcagtaaacattctgggggccttccctctaacactgctttggtggaataatatctccagttttcaccaatcttggttcaatatttacctgggggtttgcagtgatcatggggacagggctccaacatgaagtgaaggttcatgagaaggaaaatgaggggaaggctgtgtgtgtgtgtgtgtgtgtgtgtgtgtgtgctggctgagggatgaaggtgggaggaataccaggattctgaagcaatgagagtgggattgggagagagagctcatgttgaagaagaaataactcaccagttcacatgggctccttttcaagggtttttctttatataaacaatttgcctggttccaattagaagcccacattaggcagttagctccaatttggcagttcattcttaatttggctttccttatgggtgggagggagggctgacagttaaaaggttgatgggaaaaaccttggtatcctggtgtgaagacagaccctgggatcagaaggttgccctgatgactttgccaatgtgttcattgcccctgtcctgctggggcgcatacagcaggcccttctttctcatacgcccttgacagaccaggactcactgctagaaaacccctggggaagtcattgctgaagactctagtgtggggcacattaggtttgaggagcaggggaaacattcaggcagctggcaaggtctgggctaccaggagagatttgggagttagaagcatattaggtgagagttgacactgtccaaagggagtatatagaaagaaaagcagaggaaagggctcatggagtcattacagcctgtgaggtgggaacagggtttgggagtactaagggtttggggagggtttatgtgtttattcacccattcatttattcaacatttcttgagctttatggcagatgctgagttgaagaggaagctggggatttaagagggagaagagttaagaggggatccctgggtggatccagatgaaggagaagggaggggctaagtgcctaggctcgctcttgccaggagagcacatctgttaacacaaagctgcatctgtatctcagccagctctcttccatttcatctcctcctctctacccacacttgcaagacggggagccacatggcggcttcctactcccttgtaccactacaccccctgccgggttctttctaggcatttagctgtggcatcagcagcaccccttctgagagatcaggcaatccccaagggtgagtggtagtggtagtggtggggagggttgatagcttcgagagaagagctggagaaggcgctgtctggctgtaattagccccagctgctgttgtgaggcagcgttgggggccgtcaggagtgtacatgcatgtgtatgaacctgtgagcgtggcacctcattgctatcactctatttttcactgtattgtgtgctggctgcagcctcgctgctctgaaacccctcctgtccctgaggatcccgaaagacagagtgttccacaggcagcaccagcttgaatcactaatgctattaagcaggaggacaacaaatataggcccccatatgtcctggatatgcaagtccctgctctctctttccccacccctgcttcctgaatgtttccaagtgagtgaagtcccagcacttgaaattagcaacacctcacttctgcacagccttttggcaaagagctttcacagctgccatgtcatgcatcctcagacgcttctaggagaagcattttataggtgaggaccctgtggttcagggaggtggagagatttgcacaggctaacccagacagtcagtggcagacttgtgtccaggaagcaagtcctcgacctcctggcctggtggcccatccccagcagagcactgccaagagggctgctcccgggtggctccagctgctgctgtctgtgagctcgtgagaacctgtcagctgtggctccaagacctgcctcagtgattgctgaaaacgctgagagtgctgaaaaccaggaccctcaagccgagcctgacgtcacatagttgattgagtacctgctatgtgcccaccactgtgctggtgcttatgggagacaaaacaggggtagtgcatagcccgtatcctcaaagaagtgataacttgaatggggaaacaactcttagataccaagt

SEQ ID NO: 8907 - DNA, 849 bp, artificial
  synthetic oligonucleotide
cacattcatgacagcatttttcaagctcctgtctgtgcaaaccacagctggtctcctaggagtcctaacactttaattagacctagcaggtcccagaacaaaatcccataatccccaaatctatagcaacaagttaggcatgagagttttagttacattctggatgtaagagaaccctaactgccactttctttctgagtctccaaatgacctttgaccaatctctttaccagaaatatttatctagaatggccttggtctctgacaccttgaggacttctactgatttctctgttaaatccctggaaccacaccaataatagttctgaacattttacactcatcatctcatttattcctcacaaatattataaaccctgtttatatatatgtgtaatatttatagtaacaagagtagcagatattttgctgaggggaggcatggttctacacaggttacatgaagtaattcataattccacatgaacagcactatgaggtattattactgtctccatttcacaggcaaagagcaaatcacagaaagaatgagtaagttgttcaaggtcacacagcctataagaggcaaagcctgccggtgtggctccactgtgctattaaccagtaaggtcttctatagccccaactagctcaaaatggttctaaatgaagaatcgctgtgcgttttgcacctcagactgctagcatcgctgatttaggtctggagtttagataagtgaaactactcagggtctttgtgaagtatctttagagctgctgcttggacaagactgggtcaggacttcgaaggcatttccatgtgctcctggagagtcaggatgtaggctg

SEQ ID NO: 8908 - DNA, 3521 bp, artificial
  synthetic oligonucleotide
taatacttatttcgtgcatgtaatgtaccaggcattgttctaagtatacattaactcatttaagtggcccaataagcctgtgaggtaagcagtattattattatcatccccatttcatagatgagaaaactgagattcagaagttaaatcacttgcccagggtcccaaagccagttaggagcaatgctgggattccaacccacacagttcagctcttatccaccttctctgcctaacccatggggttaaattgaggctttaaatgcctacagggactgagcaggtcgctgaaaaagtaaaggtggccttatgggtactgaggcaaactggtgagcacgtgcctcacctacagggagcaggttgttgagctctggctgattgttgctatattggaatttggatcgaagtctttctctctctctctctctctctctctctgtgtgtgtgtgtgtgtgtgtgtgtgtgtgtgtgtgtgtgtttcagaaaagccagaaatccagctttctatctgaaatttcctgacttttaaatgttggcaattaattttaaaaaatgtttaaaacgttgtacgggtcaaataaactctgtctgcagtctgaatttagcctgtggctgccagtttgcaagctctgcaatgagtaaatagatgtgaaagtgctttggaaacttaaaaacgtgctctagaaacagaagagtctaattttagggttatatcttgttttttccttgactgtggtctagttttttaaaaacttgtattcccgacctgatggagatgaaaagtcagaattaaatagagacttcagtgaacttgagtacttcattcctttggcaggctggataaatgagaagcctaggtgtactggatggactaagcctcagaattcttgccacacccacaagccccttctaaggagtttccatccacagaccctagctgagggaagtagcagtttcttatgaataggtgactattcttggtaccacgtgaccctgcttcccccagcaatagccacttgagccaggagagggcatctgatccatgagcagtcactctataggctggcaaacagcctatgaaggaacctgggatgagaactttgcccagcaagtacagttactgaatttggaccaatgagagtttctctcttggggagtttgaataccagacctagaaagagtgagcaattggcaacaggggcagaagctgaacacagagaaggcaggcagcagggaccccggataagcaggaccaggagagattactgaacttcaactatgtgccagattctttacacgttgttttgtttaaaacattcaaagaacatgcgaggtaggtactgttattatgcctgttttacagatgaggaaactgaggtgaactaacttgaagtattgaggttcaagcccaggcctgtttgaagttaaaatgagagtgtaggaaccccaaagccagtggttctgaaactctagtgtttcagaatcacttgggttaaatgcaggttccttggcgtcaccccagacctatattgaatctgactctttgtgggtagagtctccctccccctacaaatctgtgttttagcagttttcccagggagcacttgatgcagggtttccccaccacacttttattttgagaaatgcagtttcagagggtatggcaagtactgtgtactgtgctacctttacctacacaaccaaggtcaatgtcaacagatgtggtcaaattccaatttaaagtcttttggaaatggggccaattatgtaaagaagagggcattagtttgttctcttctctcatcaaggaagtctacattattaccagttatttgagagaacagaagattgggatgaatgcttagtagttgtaaacacgatcggatctgcacttcagggtgggtgcaaagctagcatatgttcactaagcattttccatgaggtgcgtaaactgtagaaactcagtgctctggcaacaaagaacatgagagaaaattaccaaatgcagatagacatattgtaaaccgtggagcttaaaatgtaaacctacttgctaggctgatcatagaggttcttctcagccccagagaatttgtgtaagaatcctgtccatgcctttatttacaccattgattaaaaatgctaatcaggagaggatcaaggctatggacctccttctaggttgttgcagaactcccactctggcaatggtattcagctggttttgaatttttctgctttaagaactatccctgggaagactagtggtctgaagtttgcttggagagtctcaagccggaaactgatttgtggtccaaatgcttaatggcatcagacacttattcctacaagagaggcatgtggtccaaggggtggcacaggtcaaatgtgatggccaagtcccgcctcagcagggcttgaatccgcacttggcaacttttatttctctctgtccattcctgtggatactttatctgtgttaatgtcctcatttaggctaaggtcaaactctgttcttctctcttctggccagaaagacttcctgttttacaggtatatgatcttatctgtgttgataccttaactgtgagtgattccctaaagcaggtccttggacaagtgcccatcctccaggaaaattgcagcagtccaccgtgcaatgagaaagcctgaggactaggtagtaaatgtttcgcagagaagagaaatctatttcatgtattattctttattctgaggttatttccttctcttttggtgttgaaaggaagccccttctttttagaaaatgatgatttgtggttgttctgtttcttaatgattttacttgggaaaataaaaatctggaagttcaatatcagtccctgaaattttgggttgcattagctgcaagtctgggaacctggtctaattttgagtgttctgctagtacctctaggtacctcctattgccacttgtgttctaagtgcttataaattacctgcttcgcaatctgcagcagaatctctccgaggattgacatcaagcttacagctttggagtttacggtatactggtctgtagtttccttatttaagaaaattgggacactgcccatttgcagtcctctggtatccctcctgttctctctgattccacagatccttcagaccggcacctaatgcaaggcagttccgtttgctcttcttataatgttcttttccctatagagttggacatgcatatacatgttgtttggggaatttgcagcacatccaatgaaagcataattcccaactaacagtcaaatccttttctttggagctacccagaacacacctaccctctcttccatatgacagcccttcagagacttgaagacagtgtgtgactctcctgtgagttaagagcactggctgagtcagacagacccgagtgacaagcccagcttcgctccctctcagcggtgagagccaaggtaagttacttcattttaatttctctctagttcagttctttagctgatttagaaaatgggagt

SEQ ID NO: 8909 - DNA, 1588 bp, artificial
  synthetic oligonucleotide
atacagataaggaaaatgaaaattaaaaatcccctctaatcccatcattcaactgtggtcactgttggcgttttggtatatatccttccagattttttttctatgcagaaatctacatatttatctttatgataatcagatcctcatgtacacattagaatatattttcaatggctacaatagtggctgctacaattgcaccatgattcgtttaatcattaaacaagttgtgttctaacattagacacttaggttatttccaaaattgttgcattagaaataaacaacagtgccctgtagctgtgtgacattgggaaagctagttaacctctctgttcctctgttctcatctggaaaatgaaggtgctaatagaacctacctcgtagtatgttgtgagtgtcaaatgagatcatataggtaaagcacttagcacagggcctggcacagtaaacgttagctttaattgttaggtgtgttaataataataatagtagttgttgtgaggccattgttaatagaatggctattctgtgacttttttttttttttttttttttttgctttgaagggagaggagagcgactggaatttttcttttgagtagtatgctatagtgagctctggagtcacacagagctgtgtgcctttggtcatgtcaattcatctcatggaggctcagtttccttacctgtatactgagaatttaaaggacctagctcacagggtaattgtcaagatcaaatgagataatgctggtgaagccctcagccccattcttggcatatgggaagagttcaagcaatatcagttgttgttgttattattactacaaggattcagccatttgtagtaagaaagtttccttgctttgtggtgtggggatgtaggggagatggcagtgagaagagtactccgagtttctaatcacttgtctgattacaaagagataaaaatattttggaaacagaatggccagggctgaaatctgggatttaaaaaaaattattattattattttatgtgaccgtggtcacatagacttctccaagcccatttcctcatgtataaaatgggaatgatctcagtgcctaccttacaggtgttgctgggaggtcggaattatataatgcatatgtagtgcttagcccaagtgctcagttgttgttggtcgttaattatgaggtttataacgacctgaatgcctcccttgtcaaactctacatccctatacctaggctacttgaacttcacctggaggctttgccctatccaaggctcagggaccaattctccccttagactgagggtttctccccttagactgagtgcaccagttcaggaaaactggagtactctggtaaacctttctgctagctctactctgaccttgtgccccagttctagaaagcaggctgtagccatgtttgtatgaacaagccctcagctggtatgctcaaggctggtgtgcttttcttgctagctgtctgaaatccatggagcctttctgttgaatcctagccctatggcagggataccggtcgctggatttttctccgtgtctgtgaccctggggtaaattgtcttcgt

SEQ ID NO: 8910 - DNA, 1022 bp, artificial
  synthetic oligonucleotide
ttcattttgtcttaacgatctagtgcccagttccactttgtctatgtcctcttggcataggaatcctgtcacatacacattgcccagtggttggggccctgctatttgccaacatattgcctggatgttgactttctacttagattttcaagtgtcactcatctctggataaccagttgctgtattctgttcagccatggggatacccattatttcattttctatccctcaatgccaactactggaacattaaacaaatggttgttgaggccctgaagaatgaggtttttgctctcatttttgctctctcgttcttagaagccaacaatgattcaatatttgggacgtctgtgtccctaatggatatctctgggcctccccacagtggatgagagccttggagatccaagaacaccaaccttggctgaggaaagaagtatcatatagtccatgaaagctcatagaaactttgactcatctgacctttttgtggctgactaacgtgattttcatggctatttaaaaatttcttctgtttacattcttagtataatttttgcttgcctttctccctttcttttaacttttctttttttgatatttgtgcactttgactctgataactgagaaatacggtgaagacttctgcatgaggctttaccctctcggatgggttaacccttgcatgagtagtagggttttaacttggaagcccaaagaggtcaacctacagccctaatatctgcagaatcttaaccatggtatccagaaaaggtagtaggaacaggagacagaaccctggttggagaacaagaaccatattttgtcttttaataaagcagtgcttaacacaattcctggtgtagattatgtattcaggaaagcatctgttaaatgaatgaataactgtataaaattttaaaatactggtttagcccgttcttccagttaatatctgtaggttgtcgttagcagtgggttttttttttttaaatcagggtagggggaggtacaatactcat

SEQ ID NO: 8911 - DNA, 1094 bp, artificial
  synthetic oligonucleotide
tcttcaaatgacaatgctcacgctcattatgctattatttcccccactgtactgataagaaaacgaaagctggagaggttaggtaacattcccaaggtacataagtaagtcaaggagctggggattggatctaggctaactacagagcctccatgacaaaacctactgccccctcaccaaaataaaaaacaattaagaatatactttgaaaagcattaagctatctaattttaggtattcctttcgtctaattccacttaattaaacttctaagatgtgaacaggtccacgcatttgcttgctcaataatcacctcaaatgaccaagggagaatctggaggaggaaaacccatgccttcctggctggctctcacaatagagaagttctaagtgggcttcacatgtttcaaactttctaagtatcttcttccttcccttcaatcttttggtggcttgcctttcctgagaagtccagaggcccacttttagccaaatctgaatattggaagcttttctcttgaggagaaaaataagtgacaatctagctccttgaagatccagttaactaccttgtaaagcaggagtggactgcatgaaatacatgaacaatttctctctccagaacctttgccagacttggcacaggctggtctattagaaatacataattgaatattcttaacaattcaattcttcaacctcactttgatcaatagttcattacctaagttagatctgccaaatgggcaaactcttcagcccatttatcccatatttgcatgaatattatgctgtgaatgttacgctcctttgaacttcaaaagagtttcctggcctcattgactacaactttaacaacagagcataatggagttatacacaaggaccttttcccagctaaagaactcaaaccttgctgatgctaaacagtaacaaacttttatgtaagcaacaaatggctcattcatccattgcaatgcactatcagtattttcgggtttcctgagcctgtcttctctcttataagagaaattgtaactatggctaattagctaccagcaagtggcagcacccatcttcaccattccttgtga

SEQ ID NO: 8912 - DNA, 2825 bp, artificial
  synthetic oligonucleotide
ccgacaaacaataagaaagacactggagtcccaggcccttgtccatcagctgaaatcctctccccactctaccacccagcaagaaaagttcagttaactggtggtgtgttgccactgaaaatggcagttttaacccagggtatctcttgttggaggaaatgctttcattgctgcttatgactgacaaacaatgcctcgcatttggcttgcaaaacacctttctatcatttcatttcattccacacaactccaccttcaaaatgggcactggggggacccagagaactcaaataactttagtggcagggctgggagggactggaaagcaggctttccgggccctatgttctggcaatataccacgttgcttccagagcctagtgtctcaaattctgacccccgtagtcagggacaaaaaatgaggcagatggccagaggataggatagggagcctttcgcccatctaccctgctacattaactttaccatgtattcatcagcaaaatgagaaaacaggctcaggaatacaggcagtgattaaggggactgcagagtcccttgggtagctcagggtggagtacctaagtgacctctcaaagcgccagagcataaagaaatgcaggccgagtggggagggacgagctgtgagttcgaattcagagacccccaacttgctttggtcagaagccttgggccccacctccatccaggttgctaactgctggagcacagaacaggttggggtggcaggggaatttggggcaccctggggaaacttccagggacggctccggccaagagaaggcaacccacctgtgcaaaggctggaaaaggaggtgagggaagcgggcgccgggcactgctcactaacctgggcactggccttctccgtctgccacgcgtgcacgcgctccgagctccccggggcgctctcgtccgaggtctggggctggcaggttgtggcgagagctagagtgcgcgcgaggggggagggggaactcaaaagtgggtgggaggaaaaacatcaccgccctcacaccacgagggagcagcggcttgctcggctcccgggggcagagccaaggcgcgggcgcggcggcccggggccacctgcccgccctcccgctcgctccccacttggcccgagaagccggccgctcggcgctggcgggaagtccgcaagcacgcagccgctgcaagcacgcacactttctccaccccggcacaatggctttatttctgctcccccggcccgaaagtttaaaaatcgggagaaagtgtgagactcagccggctactttcccatcacacagcgcccccactgcagcccccactcctttggctaggcgagcgttggggtcttaaagggaccgcacagctcctccggtccctcctccccctctgcactggatgcacctaggagctccccaccactcgcgcacgccctgaagataccgactaccctctgactcccctgcctggaagcccacacccgctctcctccggcaccaaggcctttccgaggtgtgcacctggtctggtactgagctggtgccctggacacagaatgaaccctcctcgcaaatcacgccctagcatgctgcttatcatttcacggcgtttcccatatccacactgtggctaacagagtgacaaagctttggtttggtgtccttaaaggcggggtggagatgggtgtgtgtagggtcagggattagaaatccactttctcttacaaactgggctcccaagcctcatggaaagggcctgttctaactgttaagtgtcttgaagaaaacttggtgccacacactatacccaccattttttttttaaatgagtccctaagcttctaagttgggccaagagctcaacctggaaatcacagtagcactgctgatgccttggtgggcctgcctactccaaatttgtgtttattcaacaagtgatagttgcaaagaattgtcagaaacttctagggtccaggaaagtgctgcctcgacagacaaaattttaagcccctaaatttggagaagaaccgcagagcttttttctagatgaactagataaatatctatattcctaacatctgtatagtactttatggcttacggagtgttttcacatacatcaacattactttttaaaccctcaaaaccaaccgaactacctgaggtctcaagtgttagagttggtggggaacttctgaaccattcagcttaacttcatcatttcacagaagaggaaactgaattgggggaagaggatgatgtatctaaggtcacacagctagtaaatgacaaatttgagattccaatccagattccctgactttcaacccactactctctggttgttatctccagtctgtagatgaggaaattgatgttcagagaaactgtggcttgtcaaaaaaacaaacaaacaaacaaacaaaccacttatcaggaacagaaaacaaagaaaaattaaaacaagaataattgtccctgaacgttacctccttttgctttttcagaagtgttaatagtatccagctagcccctgcattgctggtgatgtttatttcactgttaacaaaggaaagggggccctttctgtaatgttgccttcagggcccaaaatgtctagctccgtcctgctgcctgggtagccatacactgccacatgcattcaatttgtgctgttgtatatcggtttgaacttgctgatttgttgccttataactgttctcatgccgtttaatgcagtgatgttttgtcttactagattgtgagttcttcaagggcaaggactggttgttcaatttctcttgtgcgtgcatt

SEQ ID NO: 8913 - DNA, 549 bp, artificial
  synthetic oligonucleotide
ttttaaaagtgttataaagttttacatttaattatgatctattttgagttaatttttataaaaggtataaggtttaggttgatgttcatattttgcctatatatttttgtccaattgctccagtatcatttgttgaaaaagctatctttctttcattgaattgcttttacaccttgatcaaacattggttggtcatattgtgtgaatctatttctggcttctctatttgatcccattgatctatgtgtctatgcctccaccagtaccacgcagtctcgattactgtagacatatggtaggcctgaatttcaagtagagtgggtcctcccactttattcctcttttttagggttgttttagctactctaggtcttgtacctttccacataaactttagaataaacttgtctatgtctacaaaatatcttactggaatttagctagaaattgcattaaacctattgatcaatttggggacaattgacaaatttaatttgttgagcattccaatccatgaacacagtatctctccatttatttaggtcttct

SEQ ID NO: 8914 - DNA, 1055 bp, artificial
  synthetic oligonucleotide
atataagatgataagataacagtgcaaggaaagatatgatttattacacagtcagggtagggaggacagaattggaatggaaggaagggcttcgttccacttaatcaaccaaaggcctggtttgtcagggctacccctcagcaaacatttggggagctggccagattgttctttgacccctttccctttgcatcatcctgggagtgtaccattttccctatatgaaattcccttcctcacaccatgtatcagagattttactagtgtgctttgtgcaaagaccaccaggagccaagtcacttaaaatactattaaaatgcagattcttgagccctagcaagatgaattgatataaaataaaactgaagaactattgccttttatttgttttgctcaataagcaaatggagcaattgccttttactttagagggctgcttagagagcatttccatttatatagtccatcatcattttcaactcaacgtatctaaacttactcttcttccattctaaattgcttccctgcatcaactcttccatgtacatcagtggcaccaccatactcccaggatcccagaatcaaacctcaaagtcaacagcaacaaactaggatgaatccattgtttgttcctatttttgttgttatttgtgattggtctttttttccatgcatgtgtcggggggtggggggggggtcatagtagatgaaagcttgttatcattgcatagacactgtcgcagcataattttttatagcacagtctccaagccctcatcaggcatgtgctcttcggagaaaacttggagtctccggaaattctgttacaagatccaaacatcttataaggcactaattagagtagggcagggtctcaactactcttcctctgggtcagtttcactcagatccatgaaattgctcctcccatgtggaatcccagaggccactcattatctagctgaagcctctctttgttaatgtcaaagtgagaagccttccacttcattatctagcaagtgctcttcattactactaatcaaaagtttccattt

SEQ ID NO: 8915 - DNA, 2546 bp, artificial
  synthetic oligonucleotide
gtatgagtcacatgtcggatcttatttcagcagcacagtctgctaactctggagagttgagggttgttttttttttttttccttttgctcttcagaaaagtattccttactgaaaaatgaaagttctctatttgtgtcaacagggctagctttcagcaaaactgagagttaggtgagaagtgtgtctttggctgcttttcattttccctttccatttctcttccctctgcattcccagatcccatggtttattcccacaaggccttaatcttttttcactttttaattttttaatgtaagatacaagtttataaattttaaggtgttgccctttaagatctattttcccaaataaacttggcagctattgggagataggatctatgtgtgtccaagaattcccctggggcttgggaggtctctcagatgattctagatattgcccattctgccaaacccatttgaggtttggactcccacagcaaatgccatcaaaggccttccagcttgctgcctgactccagtccctgaccctactctgtgttgtatttttttaattcaaatgcagtgggtcaaaagaaaccagaaaagtcaaagaaatcaccaactgtaagacctgagtgggagctgtttgttaattaggatttaatgagcaattactatgaatcaggaaatgtccttggcactttcccactcctaacctcatttaacacttccagtacccctaggaggcaagtatttccatcctgattttataggtgaggaaactgtggctcagtgcagtcttgtcacttacacagctactaagcagcacagcttatgtctgaagccctaatctatactctgggccaatggacatgagccagagccgggagtaattacttccctgtatctttataaaatgcctattaatcatcctattcatgaacacttcatggatagctactctatgccaggcactgtgctatggactggatgtactacttgaataactagagttggcctagagtgaccaactcacccagtttgcttgaaatgtggcattttgagtgctaaaaccagggttgcaccttcaagttacttacagtaacattccttcccatctctgcttcagtgatgctatgctgataaactgaaatttgccatggtgggagtgtttattttgcataaatcactaaacactacaaatcagggcttttttttttttcactttcccaggaaagctgattataagcatttatcagcacaccaccatttacagtctagtaagaaattcatccaagtagataagcagtatttatatttaaaatagtgatacagtctggatgtttgtcccctccaaatcgcatgttgaaatgtgatctccagtgctggaggtggggcctaatagaagatgtttgggttatggggatggatcccttatgaatggcttagtgccatcctcacagtaatgagttctcagtctaatagttcatgtgagaggtggttgtttaaaagaacctagcacctccctccctctctcgttagttctctcaccatgtaataggctggctcctcctttgtcctctgccatgattggaaggttcctaaggcccttaccagtagcagattccagcaccatacctcctgtacagccttcagaactgtgaaccaaagtaaacatcttttctttataaattacccagtctcaggtatttcttcatagcaatgcaaaatggacaaacagagtatctcatgcactataatgacaaaagctaatgtgttgagaactaatgatgtactaggcactattttgtgtgctttagatagatttagtctttacaacaaccctaagaagtaagaactattgttatctccattttgcagctgaagaaactgaagcttagagagtttaagtaagttgcccaaagtcatacaactaataaagtagtaaagccaggactcaaacatcagtgtgtcttattccaaatctgtactcgaggtagcctatggtgacagatttcaggatgaacagcatagtcgtggctgctgcaggtgggccgttgagacaaagaggaaatgggtcagttttgtgaggtggtgttgtaacacacataaacacacacaacttaaaacagtgtaggggatacactaagtgttatattgtttgctgccattattgttactatggttgtgttgtggccctgaggaaagcgagtcagagttgaagtgcataacagtgacatagggcagttgggcctttccctactggtactcaagtgtggctgtaggagcatgctgaagacagctggtttgaaagtgaggccagaaggtcatgctagttgtgtttagggctttcaatctgctactgagatctactggagtagcctttgtggcctgaagttgtatctttctgactcaagaatattaaaatccattatggaaaagacttatagagaagtcctctgtcactgtaagagctccaaggccattccccaaagctcttgacttgctatttaatccaggttatctctaataacaagaatgggccaagacaacctcaaatt

SEQ ID NO: 8916 - DNA, 844 bp, artificial
  synthetic oligonucleotide
ttattttaaatcatttctgtgttttgagattacaataaagccttaattagtaggactctaataaactggaaactttcactgactagattcttttttggttctctctgttttgagaaaaggtttattataatctactcataacagggatttattctaaaatttaagattcaatgagtgatctagactctgtccaccctcagtttactctcatatctctagtattatttccagttttaggtgcttagcataacaaagaccattcttcatgttaatcttgcttaaagtggcctcaggatgaagctactaggaaaaaaaataacttgtgaggagaaagccaaaagaagcaaaaagaggactgcaccttccttcctcacttctattcttgttttcatgccattcctatatatctgaaaaaatgtttcaaatatcagtttctaagcaattgctcctagttttcttcttggctgttggagtatcacagtgtggtggaaaaagctctgtgcttggaattcaagtcatggctctcttctttgagctatgtgctcttgggaaagtcacttaacttttctgagcctttattcaatcacttactaaacaaaggggttgagctggagtaactaatgcctcttagtgttctccatttctgttgtgtcatgaattagaattcccaaagtctggttttattcatggagagtctcataccaaatatgatttgaaggcactcaaagcatttctatcacccacagtgcctgaacttttatcattagtgatccattcattttgctgggtttagcattgtctcctcctgttagtctttcttttgagaagaaaagcatgtaaaggc

SEQ ID NO: 8917 - DNA, 2267 bp, artificial
  synthetic oligonucleotide
gagagatgtgttgatgcaagctaccagtgcccagaaagaagattgaagaaaggggtacgggcaccttctccccgccctcgctccccccagcccccatcccaccgacctaaacagtcaggcttgagagactggaagggtttcacttccgcctggctgcaggaaccacaagttccagactaggtcgtaattggaataatcacagtcaaaatacacccagatgctctcacacacccagacgcgcgcgcatccccgggccatggggcgcacgtgagcccgcaccccgcgcacccagccctgcctctcgccagagcatcctcagcagctgccaccgaagcagcctcctccttctctcttcctcctcctcctaccacggccgccgccaccaccgctgcggctgtgatctcctatcccctctggtcctccttcctcccccagttcctgctcctcctcccatcccctgctcctcctgcccagcagcgaagggcagaaccctcggctgccgccctccttcgctctgaccaagaagaggctggaacaggtctgtgcagggggggcgctttgttgcgggctgctggagctcttgtggctccaacagccactgggagggcacggggcgggagggatggtagattatttcccagttttcagtcttgctgtatgaatagatgcagggcgaaaggctgggaaggcagctggttccctttgccagttcgccttcctttttggttcatggcgagagagcactgaagctgcccggactcctgcccccgcccacccctaaagctctctttctttgcgtccccactccctgcatccacttccccaggctgagctttctcttgttcagggagctcagggatgggggcggggagagatggatggagatgatccagccgggcacctgggtgcctggggctttgttacatacaacaaaaccagtcctcctcagcttccagctccaggctaggctgcggtccgccggcaatgtggggtgtgggtcgggccgactagggaagtgagagaatgtgagaggacactccctgtatgtgactacacacaggaatgcagtggtgtgtgtcgtggagatggtgtgggttttgtgtggaattcagtgagtgcgagttggagtggtgtgtgtgtgtgtgtgtgtgcgtgtgtgtgtgtctgcgccatggggctgggctactcttggcattacatgtccttgggtctcattccatgccaagccagactgcagcaacacgcaggtggatcaggtccaacctgttctgcccacattggaaggataatgattgttttcaaagtgatggaaatccccccagctgggactgttgcttaggactttctggatgcggaatttcgagccaggttgaccaagccctaccagatagcgttattgttctcccaaagatgcccaactttcttagcagggtttcctctctcagccaatgaggatccaaagctcttacagtgatccctgcagtgccttcccacacccattttaattagcgcatcctaatgtcttcaggtcttacttactacagtgaagttagtggtgtgctaggatgtagttctatgtttgaactaaaaagaacaaactaaatgcacctatgtgttagtcatgaatttgatatagaggttttttttttctttcttgaatgataaggtatgaactggtatggccactttttaatcaaagaaagaagaggtcaataaaaatgaacaaaactgctaaaccttctctttgacatttttatttgtggttttaataaagcattgtttttcagggtccaaaaatatacagttaaaggtagtgattaatcaaacagcagacattttttgcatacctgctatgtgttattaatgttaagtattgaaagtatataaatgaataaaacatcatctcagctcacagggagtgcacaatctggtaggcaagatagagcgtgtaaacagacaattagagtaaagtatgacaaggggcaggcagggtattgtgggagcccaagggaggtatgcttgattggggatgggggttatgatcaagaaaggcttcatgggcgaggtgacatttgagttgagtcttgaagaattaattcaccaggttactaagtggaaaatggtatcctaagttgaaagaatggcatgtatgaaggtagagaggtcatagttaagtgagactgcagggagtccttggaagtgtgactgccaaattctcaacaaactcagaatgggtctttctggtttggagtgatgactggtggcca

SEQ ID NO: 8918 - DNA, 693 bp, artificial
  synthetic oligonucleotide
ggatgtctgaagaggtgctaaggggctatctggcatcccaacttgaaagactgagctaggatgaagagcaatggacaaactctgaattctagaactacccagaatagccgtcacccacttcaccccatccttatgtctgtgaggaaactagagaggcagagcactgctgacacgtgcccaaggtcacacggttctctagagccagcagctgcagtagaactctggtcttcaggctcccagttcagtgctcatcctccaaccccacccccattagcccctcgcattcagtgggcagcagtcagaaagaaggcatctccttttgagtgaagctactgtctggagcagtggttctcagtgtagcccagggacctgcaacatcaacatcacctgggaacctgttagaaatgccaattcttgggtctttccctggaccaactggggctggggccctacaatgtgtgctgtaacaagccctcttgatgattctaatgtatgctgaagtttgaaacccactggtctagactgacaagcaaagcactgagtgctgcagatatcaatatgcatgtggagcatcaacttgcacagcacaaaggatagtcttcatagggaaggaatgtggaaaggactgcagccctcgagccacacctgcagcacagtgtcaccttcaaacacacatgatagtcacagatagat

SEQ ID NO: 8919 - DNA, 1314 bp, artificial
  synthetic oligonucleotide
gggctttggtgataactagagtattctttagttgttaatcagagtgaacacaattcaaaatgttctcgactcgtgggtcagagggaatgatctcatttggcacattattgagtttctgagaagaggaaagatactaacagctcacaaatattttgttattgactaactgcaaagatgcatctgttaaagcaatccatctgagttggctagttctctcgaatattaaagaatatcaatatatactaaaagcaagtcaatttgtcaagcatttacaaagcaactttgaagccaaatgataccttttctgccttcccttctcttctagaagatactcacaaacacatacaaatctggactaaattccctctaacagaccctttgtaaagaaagctcactttctttggctgcagtgacacagatgtttgggtgggagggggtgcggagggtggcggaagcatgctggttcaatgcttgagaaacagtgctgcacccaacagactgaatgtcatgaattctttgtcagctccccctcagaccctccaggctttccctttgtctgctaagggatggaaacagaacagatacattgaagccggtagactgaccagctagattgacccaaattcattcaggaaatgcaaaagcctgctggctcctgggattagctggctggtgtttgaatcgctacccatctgtacatttccttctagtccagtgcagccccagcttgctacatctgctcacctcagcagcttgctttccaagacaagataatttgagaagagtctagttgtgagaaagcaatgtccaatgctagggaaactttgtggcaagcccgaagagaaatttggcccttatggtaagtgatttgctatatccccggtgttcttttcccaccatctgcccttgctcttctctaattctaggtaatgcagccaacttgtcaggcttagctttgtcgagaggatataccattttcaaggcttcattttttcataaggactgtgctaagcagctgtaagaaaaaataggatgaaaaaatgaatgttttgtttacattagtgaggtggcatcaaaaagcaatgaggaaaggcccagtacatctcatagacagttaattatgtcagaactcagactaaaggagacatggaggtctagacaaattatacccagggtttaccctgctgacaagagttcctatcccagcaatagacaggggtcacagaaaaagcctatagcacagtatttctcagccctgcacattagaatctcttggaaaactttaaaaaatatatatgcagagtcccctccctc

SEQ ID NO: 8920 - DNA, 4660 bp, artificial
  synthetic oligonucleotide
tcttctatttcattttaatgagaatgtttctaaattttcatgattaaagtaggtttgctgtaggtttctagtagataagtttatgaagataagttggtcctaatttactagaagatttgttaaacgtgaatgtatggtatactgtgtgtggtacgtacaaacttgagaccaaataccacatttattagaaaataattcataggcagcatgggcccctgggctgaagagcactggcctcagttggactgaactctgagaagatggaatctgccaattgaagccagacatctgtagaatctagaagtgaagaatttcccagagagaggtctctgggtataccatacaacctcaggcttaccaggaagtagcatcttgcttgcaagaagagaggaagaaagggctggcctggagggcgtccaggctcagcagatcatattcctactacagactgttgcctgcccacctgcctgcctgcctacctgccttaggttatgaagccaattaggaacagaagaggataaagaactgtgatttgttccactttccaactctccattaaactgtagaacccatgggtaaggaaattactttttttttttttttctgcctcagaagacaaagagcattcccttggagattgtcatcttgtttttatggaagccactacctagagttgaatagctttcccctttccatgctatactgtcagcagtgccacatgacatcttcaactactgctacctaaaaaaaaactcttacttcctaccctagcctggaataaccagtggctgaagccaaatgcctaagaggtgctttcctcaaaagaatctctgtctcccacacttctgggaaataggtggaaagcagaatgaaacaaagtgttccttagtccagttgtagtcaaatggaagaactgaatatttatagacctggatttcttatactagccccttccctcacttgctgtgtgagttgggccaaatcacctaaactctctgtgcctcagtgggagagaggacaaaaatactatctaccccaaaattcattgcaatgattgaagaagatttgtataaaatgcttagcaaagagtctagcaatttaagagttcacaaaatattatttgttaaaatgcaaatgaatgagattgtgagaatgctcagagagtgacagggaagaagagccccatcttattccatatctatctatctccagtgacatgcaagcagatactaagttatctaaatctaactaaagagaacaaagattccccacagataccttcagtagccccatgctttggattcaaccatctctttttatagggaagggcagacacatgaaactgggcattcattgcaaaagcaatgactccttcgagaccagcctggccaacatggtgaaaccctgtctctactaaaaatacaaaaattagctgggtgcagtgggggtcacctgtaagctacttgctaggctgaggcaggataattgcttgaaccctataggagaaggttacagtaagccgagattgcgccactgcactccagcctgggtgacagagactgtctcgaaaaaaaaaaaaaaaaatcaatgactccttaaacatggaaagaagctctatattcctcaatattgaggccgctgaagaaaaataatcaatggatacctctactgctcaagaaagctggactccaagactaacttgattcaacccctgaataactacaaaattatcctggtttcccagggattttattagcaagaggaacagaacaatcaagactgatctagactacagacccctttgtgtaccctgagctatgctactctgtttactaatatgaacatcagaatgccttgattgcttaaaggagaaactaggtgttatgtataatttgggctctgacatgctcctactttagacgaataatttcttatttgaagaaagaggatgatactgcgaatcatatatctttccacaggactcgttgaggaagaaaaggagatcattttatttatttacttattttttattatttttaagaattttaacttttattttagattctgggggtacatgtgcaggtttgttatctgggtatattctgtgatgttgaggttttgggtacatttgatctcatcacccaggtagtgagcatagtaccaaatagttgtccaacccttgtgcccctccctccctccctccccctctagtagtccctagtgtctattgctgccatctttatatccatgaatacctaatgttcagctcccacttataagtaaaacctgtggtatttggttttctattcctgaattaattcaattaaataatggtctccagctgcatccatgttgctgcaaaggacatgatttcattcttttatatggctacatggtattctatggtgtatatgtatcacattttctttatccaatccaccattgatgggcaccttggttgattccaagtctttgctattgtgaattgtgctgtgatgaacatacaagtgcatgtgtctttttggcaaaacagttattttcttttggatatatacccagtaatgggagtgctgggttgaatggtagttctgttttaagttctttgagaaatcttcagactgctttctgcagtggctgaactaatttacactcccaccagcaatgtataagtgttccctttaaagacttttggtggagtctttaaggttgtctaggtatagattcatgaaggtatagcattgtccatgaagatagatagttcaacttcttatttttctatttggatgccttttatttctttctcttgcctaattgctctggctaggatttccagtactatgttgaataggagtggtgagagtgagcatccttgttttctttcagttctcaaggggaatgcttccagcatttgtccattcagtatgacattggctatgggtttgtctagatggctcttattattttgaggtatgttcctttaatgcctagtttgttgtgggtttttatcatgaagggatgttggattttacctaatgctttttctgtgtctattaagatgatcacgtttttttttttgtttttcattctgtttatgtggtgaatcacatttattgatttatgtcaaaccaaccttgcatgccaggaattaagcctatttaaatgtggtgaattatctttttgatgtgctgctggattcggtttgctagtattttgttgaagatttttgtgtctatgtttatcagggatattggcctgtagttttcttttttgttgttctgtctttgctgggtttggatatcagggtgatgtttgctttgtagaatgaattagggaggagcccctcctcttcaatttgtttgaaatagtttcagtagaattagtatcagctcttctttggctatctggtggaatgtggctgagaacttatttggtaaggggctctttttgattggtaggttttgaattgctaattatgtttctgaacttaatattaatcttttcagggttccaatttttttcctgactcaatcttggaagattgtgcattgccaggaatttatccatttagtctagattttctagtttgtgtgcatataggtgtccatagtaatctctgaggatcttttgtatttctgcgggatcagttgtaatgtcatctttgtcatttctgatcatactcatttaagtctttttctttcttaatctaactagcagtgtattgacgttgtttattcttttgaagaaccaacttttggtttcgtttattccttgtatggatttttgtgtcacaatttcattcagctctgctctgattttatttatttcttttcttctggtagctttgaggttagtttgttcttgtttttctagttcctctaggtgtgatgtcagatcagtaatttgagatctttctaacttttttaggtagttggttagcactatcaactttcctattaacactgcttttactgcatcccagagattttggtatgttttgtgtctgttttcatttatttcaaacaatcttttgatttctgccttaatttcattgtttactcaaaaatcattcagaagcaagctgtttaattttcacataatttaattttcacatagttgtgtggttttgagagattttggcattgatttttattttgattccactgtggtctgcaagcatggttggtatgattttgattttttaaaaatttattgacacttgctatggccaagcatgtggtccatcttggagtatgttccatgtgcagatgagaaaaatgtatattttgtggttggcaggtggagaattctgtaaatgtctattaggtccaatatgtcaagcgttgaatttaagtccagaatttctttgttagctttctgcctcaataatctgtctaatgctgtcagtggggtgataaagtgccccactgttattgcatggctgtctaaattgagaaatagataattttaaaacaaaacaataacaatagttgtactgcaataatgctgccatttaataagcatatagtccgtattgtgtcattcaattctcttaacaactctgtgagatatgtactattaacttgtctatacaacatatgagaaaattgaagctgagagaggttaaataacttgctcagagtctcatacgtaatatttttaa

SEQ ID NO: 8921 - DNA, 2018 bp, artificial
  synthetic oligonucleotide
agggggtggctgttggatgatgctttaaggctgctgggcagatgttctgcctttccggacccccctcctgtcctgtttgtgccccagcctcgagtctcctacgtggctccccggagccctgagaccaagcgagcagtttgcatgatcccagttcgcggacaagtgggtgtgtcagggccgttcccagagggccggggctccttcgcttggtcaaaccctagactcgtttactggggcctgggccgcttgaggcaaaacccgccttgaaagctacgtcagcctgtaagtcttccctttcacccccccgcccgcccccctacccagccccagtagctgtgacagcagttccctagaaaaggggagggggtgtggccacggtctggccaagtccggggtagaacccccccgccccttacacacacacacacacacacacacacacacacacacacacacgaggaaagagaaaaagtgacgattttcttaaacgggcgccttcccctctttcttttatttttctttatccccctcccctttttttggtggggggatggtaataacagggggacccttttcttctcctgtggggattggaatgatgcaataacgcccccagaaagctcagggtccctggattggccctctctttgtctggggagcagtgtcattgggtccactgcctctccttctctcctgttccccttagctcgctgggggacattgccctcagtttgtgaactggctctggcaagattactgccgcacttttgggtgaactgaacattttagattcttactctggcaagttttccttccctaggtggtggttaaggggtggggtggggtgggggatggtgggaagagggggatgcaggcaaggagagagatagaggccccacttgtttttttttttttttttggtcccacctttcagaatccagttccagattctagacttgagggttctgggctgttggtctgtagaagcgaaggagagaagggtgagtggcttggctttgggaagcatgatgggggcggttgcagtgctatttttaaaaaacggctttcagcagggaagcctttagccatgttagtcttgctcccctcatggttttgcagactcaaatccaggccaagtgtatggctgtctgaggtattggaacagaaggaggtccattcctgttggtgacaacaccgtggccctgttctgggatgagcaaggtgtaaaggtcagtgcggttttcactgggccatttgcaaaattataattgggcaagatctgtgatttggtacttgaggcctccaatcaggggcaactttgggcaaaaagacttgatatggtaatgaatgactaacaggcagaggcttggagagagagccatttgtaagcctctgtttctggatacaagtgtcatatcccccagcccatgcaagaagcaaaatgggaagagactaggaggtagcctgggcaagagctgacagctgagaatcctgaggtcagagagaccttaggatgtcaaggagctgaccctgcaagtctccggacaggcagctgggccttgtaggagagatctgacaggaaaaggaggttcacatgcaatagggttataagctaggggacacaggaccctagggacattctcaccagctaaccattcccacaggttgcagaatttcctggtcagaggtggaaatggtatatagggcaaacaagtttgctgaggtcttgggagagggtgagtggtggacataccaggtgagggaaacgagaaataaaaagaactgcagggatgggaaggtgctgacatccgagagtttgctattatgtgttcagagactaagctactaaattaaggttaaagaaggtggccaaggcaaaaaaaaaaaaaaaaatcaggtgtacagatcagatgtagtaggcaggaaggcaggagcaaactagagagagagagaagaaaagtcgtggccttaccaacaacccaaaagccctgaattctctggtgagataggcaactctg

SEQ ID NO: 8922 - DNA, 843 bp, artificial
  synthetic oligonucleotide
agagctgctaggagacccagatctggttcattcttctccctgtaaaatgcccgctttggcatcttagtatattatgggcattaatgtctgaaaagtcactagaaatcttcagatgctagttgctgtagaaatgcaaggcaacgtataatatttctttcaaatcctaagacattgtctcctttgtggaaggctagatgattttttctttttttggcagttaaaaatgttcactacatcttcttacattatcagtcataagtgaggtggttggttcttttgtaaataacgcatctaagataaagtggatttagtatcagcataggctagttagcaaagcatggtttgtttcccagtcaagtctatgcctgaaagctcagctagccatctcgaaaatgtatgcctttggttaaaagagagcccaagaaagagccagcagttgtaactcttggattttgttgcccaccaccaaaagtacaattcagatatatatatatatgtatatatatctcagattaggaaattcaccttggaaatttctcttagtgaacagctcagtcctgtgtttgatcctctcatttgctatgaaaagggcgttaaacagccttggtgtgtgctcagatttgtgataatagccttgtgtggctggtggttttggagattttcttctgggtttgttagatcatgactgtacattgctaacctggggttttgtttttaaaaggatggcagtgttaatttagttttcattggaaaaatataaaaataaatagttatgtctaaatatgaaatagttatgtctaaatatgaaaataaatagttatgtctattttgaaagcagacaga

SEQ ID NO: 8923 - DNA, 1901 bp, artificial
  synthetic oligonucleotide
agctagattttgtatatctgtatacatatttatgtaataatcacttcatatttgcacatagtttttgaacccagaaaagtaaaagagaaaactagtgacttgtctctggtggcaaattttctctgtgactaaattaaaaccatgaacctgtccagtacagaataatgccactggtgaagtcagtcttaaattcactttaattctagagaaactgtgaatttagaaggaccaaaagtcaaaatgcaaaagataatgcagacacattagcactggtctcatattccagttcaaatatttactctagtaccgatagtatctctgaatatactttatccttgacatcacaattactttttcattgtaccttgttctgtagtttgacctaaataggaaaatgtaaggtttatgaaattgttggtgatagtgacaaaccatttattacttagtattttcactatcattattactgaaaaaatatagaattggtcttaattcattaagataatgcaagacatgacacttagcaaaacaaaagcgatctcccgttcaaatcaaaatcaaaccaattgttagttgtcaatcacctgtgcagatggagaagctattaattgatagtaacctattcttgagtaattacagactgtatatgtttgagagaatttagaacaaaataaaatttttaaaattctctacctaacatgatgtaacttagagtgcattactgagagtaataaacatactataaccactaaagggccggaaagcattgatagataatttttcagcacaacagttaatgagtagacccctgtttttgtttttattgttcttaggtttgttcatagtaaatgttgtggaaacaaagtgataatgctaagtcatgtttggagagttgtaatgttcctaaattagtaccaggtaatacttgataagtttacagagatatagttttaaagggatttgattttccttgaattcaaactggggattcatttggaaggtactattagtacctgacttgtgctggggtcaggaccttatggaaggacttgaattagagtaggaaaatacctggagacagaaacattcccttggggagttcatgcttttccagtttactttatcctcccaggggaatgaaaaccaaatatactcagatgtagacacaagatactaaagaataatgaacttggccaggcgcagtggctcatgcctgtaatcccagcactttgggaggccgaggcaggtggatcatgaggtcaggagatcaagaccattctggctaacacagtgaaaccccgtctctactaaaaatacaaaaaaaattagctgggcgtggtggtgggtgcctgtagtcccagctactagggaggctgaggcaggagaatggcatgaacctgggaggtggagcttgcagtgagccgagattgcgccactgcactccagcctgggccacagggtgagactccatctgaaaaaaaaaaaaaaaaaaaaaaaaagaataatgaaattcagagcaaataagctcctaaaacccagactggatcttacagctagctacctctgtcacctccctttttccttcttccaagacgtaaaatgtggcagggagtaaggttatggtgtctcctcgggaactggccctccaacatttgcccacctttatcttctgcctgcttgggagaatatggaacattgtttaccctaacagcacactccaactctgttgaaactgccagatctatgggatggtttctcggttaattatcataaaaacaggagagtgcattttgtgactgaggtacacacatgtaagaaataaacaccaaggacatctcgatgttaaagcagctaacaagtcattgttatgggccattaaaaatcaacagccaaacctgtgt

SEQ ID NO: 8924 - DNA, 1180 bp, artificial
  synthetic oligonucleotide
taagtgatgatgaagacaattaggaggctgtgggactggaaacaaatacagcaataagaaacaggagcaaaatttttagaacaagattaaaacctccctaagaaggtaattaaaattggcatctttacatgtgtcagatattacctgttcaaaatttgagtgacttagagttctataaagaggtgctatgatgccatcaaacataatcatattggacagaaacaatcttcaatagaacttaaatcatgtgccatttaatactgttgctggacagctgataaaactaccttctgacaaagtttgatttaattagactctaataaaaggtcctatgagactttctaaaagactatattgggaagaaagaaacctcagaaaagtctaaattatcaagtagtaccatttaaatactcttactggacagctaataagctaccttcagacaaagattgaatgattaaattgaactccatacagaactgctaaggtgtcttcaaaaaggacttgagaagatgaaagcatctttagaagggccacttaaattcacttgcttgatagaaataaagcctcaagcaagttgttataacttcaggattcgacttcactgactctaagagtatagacatccataatttgaactaatgaatagtccacttctgttcattgcttctctgtcacccccatttgccactaccataatgagtgatagatacatcttcatcacctctggaaatcatctcaggatctaaatggaaactgtataaagcctatcatttttactgatttaaactatgtaaactcattattctttttatgtaatgtgctgttgttattgtttacctgcataaaaatatttatgagggttttcaacagtttacttgagacctcatttttgcccatttttttccttcccgatatcatgatctcctcagctgaactttcttaccttgggggttgttcaggaactgactctcatggggaaagagggattactatttctgtgttcctatctcttggtaactgcttaaccacagtcagtcttgaactaatggaaggagcactggacttgggttcttgagacctgggttcatgttcagttctgccactgattattgtgacattgggccagtcacttgatttctctgagcctcagtttcatcacctgttaagtgaggatagt

SEQ ID NO: 8925 - DNA, 3213 bp, artificial
  synthetic oligonucleotide
aatatatgttttgaacatgcatgggtctcattactttatgatcaaactttgttcttcattagactcatttccatccccacacccttagcactgtactaggtacatagtaattactcaatagatatttgtccagcagaattggatatagcatagtgcttaacttcaattcagagaagacagtgattttactaaatagtgtggataagttcttagattgttttttagcgattataccaatttatgtacccaccatcagtgtacaagggttccaattgctctacatcattgatataacgtttggtattgacaacctttttaattttagccattctgatcggtctgtagtgttaactcattctggttttattgtatattttccagaatgtttatgagcctgagcacatttttgtattttataacttcaacttttgttatagattaaagggtacacatgcaggtttgttacatgggtaaattgtgtgatgctgaggcttgggactctaatgatgccttcacctaggcagtgagcatactacccaataggtagttcttcagcccttctccctctcctctcctgcctagtgatccccagtgtttattgttcctatctttatactcgtgtgtattcattgtttagctcccacttataagcgacaacatgcagtatttggttttcttttcttgcatttgtttgcttaggttcatgacctccagctccatccctttcttagattttttttatatcctaatatatagtattatgagaactttttatagatgttgggttgtgacaagttttttttgttttccaaatatcagtaattttgaatataagcaaaatgggttattattactactttaattactataaaactatttgttattttaataagtagaaagtatcatttttatgtaaattatagaaatcccatgggagtatttgtctaatgttttatttgtcactgactctggcatcttaattttcattattaaattaaaaaacagtcaatcaatttctatttctctctctctctctctctcttccacctcctcctcttttcttctctccccacccatctcttaggaagcattgtgagtgttggggacccaaagaaaaaatacacaagatttgaaaaaattggtcaagggtaagtgattgttatttgaaatataaaaagatgagtacaagcaacatacattaaaattaaaattcagtaagagcttgggtttctggtaaattatgcttctcatttcctagattatatttatgtcttgcattctcagtattggcctttcagggggagtgctgacaacagttacaacattaacctaggaacacatcctgctgaaatcttcattattgttgggctgacagtaaattctgtgtggacattttgatcctatgtagttagaagattcaaacagatttctctagaaaaagcagtagggttatggaaacttctagcttacgtaaaaaccccctttatcgcagttccccctacagccacatggatggtatgattaagatcctgttttattgtcaaaatgtggagtgacaaactgagggtggggaatgtccttatggaatgatccggaggtaggcagagttgactatctgagtatggaggaaacagacaataatccctaaatgagacctagtgcatcattttcacttaatatacttgttaaagataaagattcccaggccccactgccaaagatttgatttagagtctggagtggggttcagtgatctgaactttgcaaaagtccctcagataatcctgataatcagcaatacatgggtaccattgcattagattattcactaaagctgaaggcaggagtcaccagttctgcaagtcaactgtactaatgcatgtctctcaggcctcaaagtgaaactaggcaggtggatctgagcaggcaacagcatttgaaacagggaaaagttttatttaaaggaaaatggaatattcttaagggacatccttaaatgaggagtgagacacatattcagggacaccaactactgtatgtcagaaacaaagatggcacctcagacttttcctggctgaggcaaggggctgaagacaaagggttacagccaatatgcttgcaaaactgtgctagccgatcagccattagaatctaattattttagggtaagagaaggtagaatttcttcaagaaccacactgcttttcctggcatacttaggttcaaaaaagtatacatcatatataagcttgactatttttcatgattttatattttctttgtttttccccctagcttttgtactaaagtttcttttgaaattgccagtatatctcaggaaataagggaaagcattcattagacgtttgggctagagaaaaggagaggcactcatggaaactgtgcctggtgggaatcaagatgagaagaccctaagggggacagaaactcaggaagaaatgcatggccaagtttattcttccagtcaaaaccataatgacattgtatttgaactttccagggggctaaaatatattctcatttgctcacaaaaaagaagagttttatggtctctagaagcttcctgtcaccgaatgggtcaaattaatatttctactcattgttctaaaacagtgataaacaacagaacttactgtgatgatagagatgttctatatctgtgctgtctaatatggtagccactggctatgtgtggctatggggcacttggaatgtgggtagtgcacataagaaactgaatttatgtgaactcatttatttgtttagcagatatttcttgagcactaactatgttccaggcactatgctaagtgctagagagacagagatgggtaatgatggtgtgggccctcaaggaacttacagtttacactgataagtgcttgacagagggatacagggtaccagaagaacctagaggcaagcttactcaattcaaccaagtatagagcagggccagcttctagagccgttttctcccaccgggaattttccctgtctacttctggtggacttgttgttttgcttaagtaagaaacctataccttcccaagtctatatacagacctcagctctccttcttcatgcctaaagggtaaataccaccagacagattgcaaaaagacagtattatgtactaaagggacttagaaaacaaaagttggcttttagatttcattttcatctggatga

SEQ ID NO: 8926 - DNA, 1988 bp, artificial
  synthetic oligonucleotide
ttcattttgagaatcatagctccattttggcagaaaatagaccattgcatataggagggagtagtggtttaaacattacatcaagtgtttgtctggagccagtacaatttctgggagtctaagtgaagaaggctgactacaatggctttaatgggtgctttgtgattaactaacagtgaggtctagggaattcagactttaatctcaaacctttttcctaaacctggtaattaatgtctctttatcagtggtattaacagtgtgttataaataggtatttaaaggcagcactaactcttcacttgtggttaacatctgtctcattcaatttcaaaaagagtttgtttagtaccactgtgcggtgttctctggaggggatacaaagaaactaaatctaggtcttcaaactcaataagcttaagatactgttttctgctttttgggccaggtagaccaatgttacagaagaaggaaaaactgggaggaaaaaagagggttaaattttacagtccttttttttttttttttttttttacagagtcttgctctgtcgcccaggctagagtgcagtggcgtgatctcagctcactgcaacctctgcctcctacgttcaagcaattctcctgcctcagcctcccaaggagctgggattacaggcgtgtgtcaccatgcccagctaatttttcgtattttagtagagacggggtttcgccatgttggccaggctggtctcaaactcctggcctcaggtgattcacccaccttggcctcccaaagtgctgggattacaggcgtgagccactccacccggccgcaaattttacagtcttgatcagtgtctcctaaagtgtaacttaggaaccacctgcaacagagtaacctaaagtcattctgtgtttgtaattttgcaaaaacaaaaaacaaaaaacaaaaaacaaaaacaaaaaaaaacaaaaaaaacaatgcatttgcacttataaaaaattcagaattctaggctgctttccataaataataagatgaggactgtgaatttttgtttttaacaagctttccagatgaattttatggacaccacagtttgagcaccactggatagaaaatcttgcttcacattgatatgggtcttagggcagggtgggaacattgggttcattccatttcctataattcatctttcttgataagcaaggtttcagagagacctgattgtactgctaaagtgccgtcagatggtgtcaggtgatttgaataacctcatgctctctttgcctgaattatagggctctggtgacccttggctccatattatgatcacttggagtatgtccctcaataccttctcaaaggtaatgggcatagcacaactcagagttgacttctatcagaactgaggcctgggaatatcagagtccccaggttttttagcgtcataaggcaaagtcttttcttttcttgttatagctacttggtgggtgatgaactatgggtagtcatggaatacttggctggtggctctctgactgatgtggtcacagagacctgtatggatgaaggacagatagcagctgtctgcagagaggtaagcaaatagagcatttctagctgagaagaccaccgaaattggcagttcttcatttctgattattcagaatgtttgtatcatcaaagtaacaatagtagaacttttccactgaaaacaattggagaggccaacttcaatttaaattctgtcctaatagcactccccagcatcaccctcctgagcctcttgtttattttagctgccttttgtgaatcttttagttccattatgccatttgtgaggtgccgtatctaaacccacatgctgtagtttccgtgaacatgggaaacagtgatattggcatagcacttctttctaatttggggaagtttttacatgatacttattttatcctgcatgtgtaatatgagccatgtaaaataaattatattttcatcatttt

SEQ ID NO: 8927 - DNA, 1117 bp, artificial
  synthetic oligonucleotide
ttaaatttcctccttccttgctctcctctcattatcattttccccaccccacatatccaccaaacatatatgttttctattcattcaatacattaaacttactaccctgagcctgtggtttccttcttccagcattacactgcaaaggcatttccaaacaagtgcctatagttacttcatagcctaggagtggttcccaaacctggctacccattagaaatagtttggggcacttgttttaaatgcagattcctgggtttcatgccagaacttctgaatcaaatcatgccatctacaatgaagcttaccacagctatagaagaccaagctgaatcctccaaataactgggccaaagtatattaattggttaatttgactgtattattgattggtgctatttatcacattatcattcttaatgtcctagtctgatgtgtcagccatcatacttagcatgataatgctaagtggcatcattgatgtaaatggtaatgtgactttaaagtggtgttgttaaagcattcagtaatcgatttcacttgacaatataaagttatatccctgcccaaaatttatctagaaataaaacttagtattaaaaattatttgtgatataattagaacttttttttctgatttaatagtgcctgcaagctttggatttcctgcactcaaaccaggtgatccatagagatataaagagtgacaatattcttctcgggatggatggctctgttaaattgagtaggtattttggttcaggtggtattagagtatcagggaatttctgttctttcattgtatatcttaagaagataatggttactgaaagtgatttatttgaaagaagttacagcccagtttgaagtaaagaatttttctaacactgtgttcctgaatattgtgaccacattttttggatttaatatttcagaatttctagtgacttgtggaatgaataaatgacaaatacctaattaggaaactgaaaaattctgtaagtttgagaaaacagtgatgagagggaattagattgaagtctagtaaaaatgacatcacgttagtcaattatttcagaccttcttaaaatcaggaccagctgagacatcagttaac

SEQ ID NO: 8928 - DNA, 1380 bp, artificial
  synthetic oligonucleotide
gaagtcagtagcaacttagcaagagacttgaaattagcccaccacacacgtgagcacatacacgcacgcacgcacacacatacacacacacgtgcttagaaaaccaagtaaaactgtcctaaatgtggaagtcatggaggatggtattatactatccctttgtcagagctaggtatacataaagagctctttgagagctgggaaagcttatagaattagaacaaaatgggaggaggcagccttgagttgtaattaagctggagggtgaagtaaagatagggagggggttagaagcaaacagaaatatgaaaaatttctaacatggaggcaagggactctttttcagtccccgtaatatgtcattcatctggcatccactaatttgggatttttgaaaaatcggactaagagaggttgtagcttgttatagccagatcttgaaagaaaaagagctgctaaattaattaagcctcctccatgatgggagagacagtggggcatagggaaaaatcttgtttgacttagttaaaagtttcccagttccttcctagagctctttagaaacctcgttaagctacttgtaaatcctggccattcctgtccagttttttccttatcataaacactttggagtattaaaactacattaaaaatttacaattccaactttttactatcttagactccttctcctccttccctcctcagctggtaccaaaagagaagagactaggtatggaaagcctcaaagtactgggagctttcctgtgctatctcatttcgtcttcacagaaataaccctgtagcagagataattttttcttggttatcagaggggggcacctgctgggtgctcgggggtatgttaagtaaccaggctaaggctacacaagaaggaaattgtgaagcccctgcttctaaaaaacaattcttccaactccaaagacctcctgctttctcctagactatgttgcccctaaattgaaaataatcattgactaacaggagattaaaatatttttcttggaaaatattgctttattagtcatttaagtggctgtgaattcatgagaagagcacatgttcaaaaacagaggtcatattcataatagacaaaaactggaaatagcccaggtgtcctagttttagaaatggagaactgattagcatttgccagggtttgggggtggggagaagctgtgttgcgggagggaggtgggtgtggttataaaagggcaataccacgaaggatctttgaggtgatggcacttttcagtatcttgacgctgatggtagatacatgaacctaatgtgtttaaaattatatagaactaaatatatatgcacagatgaatatgagtaaaatgagaactctgaata

SEQ ID NO: 8929 - DNA, 1559 bp, artificial
  synthetic oligonucleotide
agatagcaggctcaaatctatttgtaacccctttgctgttccagttagggaagaggctaaactctaattttatgagagccgtaatggcaggacttagacatatgaaaatttttgcagaggcaagttggtctaatgtaaagactatcagaccatcactttcttgctgtgcaacagttcacagatcacttcctctccaagctcccatttcctgtctgaaaacatgaggataaccccaccccattctgctggggtttggtgaggtttgttcaggagaaagtttgtgtgctgcctggcacaccacaggagaactcaactattggtaagtctttccactgggcctggacttttcagccagagcaaagcatgcccaaccaaagcccatcatgataccagcccccagtgcatgacttgtctcttgttcttgtgtgcctctggtccagtctccacaaggttgcagcagaagtgatctatttacaacttttatctgcttatcacactctcctgcttaaaactctttaatgactctctgagtgctcttcagggggaaattcaaacttcttaatgtggctaaaagaccccacgtcgtcgcctctgtctgcctttctcatgtcacctctcaccacctctccaccataacactccatacttcagccacattggacttctttcagttgcttcaacaaatggtcctgttttattcagggccttcacatattcatttactctcatctggaacagctaacttttactcatctttaagttcagttaatatgtcacttcctctgggaaggctttcttaacatccctcaggttgaattaggtgtgccatggggccattctatgcttcctcatgtcacagcactgggcatactgtgtataattacatctaccttagctatatttggagctctgtgaggtgaagggccatgtctatttatcccctagagcctagcacagcacctggcacatagcatgttgcacatgtgtcaaacaaaggaatcctattttacctttccaacattgtctacatgcactcactcccccacactctacatcttaggctcttctacctcactagaagcctttctgatctccagacacattgggcacagatcatacctctttaactttgttcatatggtctttctggctggaagtctcttgttcttccctcttctcttccgcccctcccctctttgcctaacaaactccaacttatttaagcctcagctcaagtttcacctcctcagtgaagcctgtgcttgaagagaagcattaaaataaagatttatcctaggcaggataattcttagctcattcttcatcattaatgctttattataccaagtccaatatctaacagccttcatcaccccaccctagcagttagactgccctcctctgggctctctcagctccttacaacacctccatcatagcacttcctcaatgctttgggggatagattttgtttgtttagtttaggtttttctcctgaatgaggtaggaggacatttcatgtccttacccactccccaccccctgccgaccccttgtaa

SEQ ID NO: 8930 - DNA, 985 bp, artificial
  synthetic oligonucleotide
gccagtttttctccatgtttgggcttgtttttcttataaatatgccctaagttccattgctggtagctttatggcaacatctgagatttagacaggtggagagaatgtggaagggcattcagagggtatttttctaggcagggaaagaagggtaggctctgtcagcaagagtgaagtgtgattgagcattgcatagcgagagctgaagtcggggaaggagatgcatgagaagctattgggctgtccggagcagaggcccaggtctgggaacaggggacgctcaggctgagttgctcaagtcagggctttctgttcttcccatttcctccctacatccaatctgtacatcagcttctgacaattctatatggacaacttttcgctcttattcctcctctctaccaccactgctctggccttaattcagaatctgcttttgtctctatctgcacagcttgcaacagctgtgaagaccctttccagagtgtctttactggtgtaagtttcttctcaagcttgaaaaggctatctttctctacagaaactaaatatatagacctaactgaaataaacagtctcttgcatcttttcttctcctgggagaagtgcaaactaacccaaatgaccaaaaagatcatatatgctgcttaaattctcactgagtcctcaatgaaaaggaagcagaattcacaagagcagggggttctcaaactagagagggtctcagatgcctcatggagagcttgttaacacgggaatcgctgaaccccacgcgcagagtttctgatccagtatatgtgggtggggcaggcgtgtgtgtggccaaggatgtgcatttctgacaagttcctaggtggggctgatgtactgctcacactttgtggaccaggggaggacaacggaagagaggctgaggaagggaagaggcaaagctgagggaagagaaaagggagatggagagagaactgaatgctttcaggaggaa

SEQ ID NO: 8931 - DNA, 3482 bp, artificial
  synthetic oligonucleotide
gactctgagtagcatgaaaataccagtggtatgggaaagaagggcacagaggggagatgtgaaggaataagactttctaccctattttacctggagctagtggtgatttaataacctgagctaggcaataccagcctgattggaaggctggcagcccctcgatgctcaagggtgttctttccttattttgtctttgccatttttccaagagtctgtgtcagctcccactgggggcctctcaaggatgagaacagctgcagaggcgctggagttgggctgttgagtacatgcccaggactgacacctgcccttccacaaggccctggggacaaattggctcagagaaacagagacgagacagaactccattcatcagaaagaactggggtggaaaaaccctgcttgatcccttggcaccattaagccctaaggttggctctgggccccacacaactctaggttctgtttagtaaggtcaattaaaataagagagtgtgcttgtagggcccattacagttatctgttgcatttaacagtttcctggtgtctgctagacacaaagcatgagagggatattgcttttgaatcacgtaggggaaggaaaggtttgttaaaaaaaaaaaaagaaaagaaaagaaaagaaaagaaagttattgtctacctgcattctaggttacaacttgacactggctcactgctttctctctgggtctgtttcttctgctataaggagaaggtgctgatctagagccttttgagatctatatcttttttgtgtcacaagccctttagagaatttgatgaaagctgtaggtcttctccctagaaaaaatgcatatatgcccatagatagctagttttctatatagtttaggggggttaaggattcctttgaagcttgtctatagatcccaaattaagagtctctagactagttgatttctgaggtctcttctagctcagacagtctatgaaacattccaggttggacacagttaatgagcagtgacacccgggccagaatgctggcagctgtcgtggaatcccagaggcttaactgtaccccccttcccaggcttcctgagactccagtccaaaggaagcaaaaggatataagctcattctctgcaaactgagtccaagggaagcaaaggagtgcaaactgatttacggcaaaccaaagactagagtgtgcatcagacccattgcctcccaggttgctagaatttaggaaggatgctaacttttcaggagagtgtaggcatgagaggcatgacctctaaatgttccttagtggttggttgaggacaggaaaaaaaaagcatgactgcccagttggtaagggacatacagcttgattatagatattctgaaattgttacttaggagctgacctcaacatggctggacagaatactaatgaccataaacatactgcatttccttacataatatcccctactctgtaagtgtatattttgctatgcaagaagaaggttaggagagaagaaagaacgagttctcatgggtacatcaaccatcagtcagtgtaccagtaggaaatatatgacactcctagagtggataaattgagtggagtttactaaaggggattgattacaaaagtatgggcagggtatagaagaaccacagagggcactgtagaattttaggaatagtaatagtgaagttcattaccactcttaggcctcaaggagagaggggaggtatcaggaaccagaactcagagggaaggagagagaatgacaattagatatagagaacactctgataagagctatgaccttcagtcaaggaatgcccagcaacctctcaggcagggtgcctggaaatagatagcctaatctcacatttctccttgttagtgctccccattggctaaatacaactggaatccaaaaaacaagggagcctgttgataagagtcagcttcccaggacacagagcagggtggaatagagtagagagtagaaaggagatctggaggggaagtcctggagagtagatctgccactgtaagcaaaaggaaggagctgttgttatagcctagaatataggaaatgtgtgaatagtgattaagcaataataataataccattttgcatttgtaaaagcctttacgcattttgtgcttcagtcaccccattgtctcctctgaaccatatagttaccatgtaggcaaacaggtaatttattttatggataacgaaactgagggtcaaccaagtttaggtgatttgcaaagaccaaatgtctacaaaaaaaggacatggactagaacttgggtttgagctcctggtctagtacaatttccactatatcatgttatctcttctgtacccttagtccacagagctattctgatagttcttcagcgatctcctgcttcttctgacacacagtcaattccaccacaagagcaacgataagagggaaaattatatacacttcttcctctcatttttgggaaagggttagtgtattagtccattctcacactgctaataaagacatactggagactgggcaattataaaagaaagaggtttaactgactcacagcttcacatggctggggaggccttacaatcatggtggaaggcaaggatgagcaagtcacatcttacttacatggtggcagagaagagggaatgagaaccaagtgaaaggggtttcccccttataaaaccatcagatcttgtgagacttattcactaccatgagaacagtatggaggaaaccgcccccatgattcaattatctcccactgagtcccttccacaacatgtgggaattatgggagctacaattcaagatgggatttgggtgaggacacagccaaaccataccagtcagtatgggggctcatgagggaacaagctgagttggaagataggtaagaggatacagtgttctttgcactcactattttccagaacagaggttcttagacccagtttttgccaaacgactttagtcaagattccctatcctgtctccctcttctctcttctggcctctgggtgttacaccttatcgactatatacttccagtgtaacagatatgattgaatggaagtagggaaataaatgaaaatgaagaaatgacaagctcaaggtaaacaataagaaaacagaaacagtatatcttttagaattcaactgcaaaaagtaaaaagtatttacacatgtgttccagttagcatgtaaaccatctattaagtgctcagaaattgaaaccatgagcagattcaccactgagtttgcaattaagtggaatttggggaaaattctaagtgttcaatgttattaggaatttcaacagtctagtggaagtgatgagccaagcactaggtatgaaaaagcatttgggaagtatgagattgcagatgcctatagctgctaccttagttttcctggttgggagataatttagtaaatacagaaggctcaaggccaat

SEQ ID NO: 8932 - DNA, 2108 bp, artificial
  synthetic oligonucleotide
gaaccattggttgaatacataattagcgtaatgtcattatataaatccttataaccttgcccaggccttcaaacttaatgccagtctctgtttttctcccagatcttgatctatgtatgtctaaccttggccttgataacctgaccttgctttctgacacctcttttcctagttggttggggattcctcagcccagactgtaatctgacatcaccattaaagcaattaaacagtaacagccaggcttcttcccctgacattgtagactgatttcagatcatgtgtcagaaaacagggatagtaatcaggaaacccattaacacggtaaaaagtaatcagtccagagacagagctgagggttcaagtcatagggctaatggtcaagtctaagaagtcgaaggcaaccagagcccaccacaggatctgctctctaaacaatcaaaagcctggttgcttggcaaacaatgcttccttcttccctttctgctttatctagacatttcccaggctctcagggcatgatcaatccaaagggcagacataaggataagccatggaaaagatggcacttgcctgatgaggacaagagaccgagacctcaatgcttatattcccaaggaacaaggagaggtcaatgccaggtgtcaggcctaaccttaagaaacatttaatgagtgttgcatatcaagcactgtgctaggctctggcaatgcaaagatgactctggagtgacttagtctaaaatccatttaccacataacttccagagaaatatatctatcaggaatcaaaatataaaggcagtgacaacactcctcattttgagcacttaattagactatgtatcactatccatgcttgtcctccaaaatccagtaagatatggagaatgagaatagtatcgtgagtctctgtggctccaagaccccaattcaaagagaagactgagttcatttacagagcacagagggcagtatcagatttcatcatgtgaattcactacgttgaaaatgtaaatttcctgctccccaaactccaaaaattctcatctggtccaggtttctgcagtctgagctaagttggaggtaacccctcatgcatctttgtctctctggttctttactctctggtgccatgagggagcagagataggctgaacactatttcatcagggactgaatcacttccctgcctgcccatctggccttttcctgacaagatggtccctgattatttgagatctgcagacacaaggaaatggagccaaggaagactgaccctggtgtgaaatctagagagatgataaaatctcttctcagcattgcaggatatcattatgccttgcaaataacccactgtcttctgaagactgagatgagttcagtcagaggagtttccacaatgctttcttgaaaattgaggttttattacacccaggtcagtcactggctaaatgctggactacctccaattggcatccaatagagataatgctctgctgtaaaatgcgtatttaataactgaatgcctatcccctttgtctttctatagtccttcctttgtcctgggtttctgcagcaatagtagggcctaagggagtgacaaattataagcaatgtgctgtgtagtagggtacgtggcggccctttgaggcagacgttataattctgcatagcaatgatagccccctctcaatttatatttccaagtctaggaattgctggccatggtcatagccaggggaagtctagagcaaaactgagaaaaatgaagtttgttttgttagcccccaacctcttagttggcatcatcttgccccagtggtgggccctttttcccccaagttagccaaaccatcatgacccactccttagagtcttaattcaaaatgagatataaacattgataatagctaagtatgctattttttcctcctcaaacatttcaagccacaggctgcggggtggaagagttctttaccatgtttgaaaccatactacttgtgtgttcaactagcatgatcccagacctaggaacagaggttctaggtcctaggcctgccatttctgttttcaaaacagttttattgaagtagccttgcaatttat

SEQ ID NO: 8933 - DNA, 2191 bp, artificial
  synthetic oligonucleotide
agagtgcaagacaggatctgttggggagatagacctaacacacataaaaaaataactgcaaaacaatgaagtgataaactctctggcattctcagtatgcctgatgttcaaacaaggtatgtgaatcagaaaactgctcaaaaagaggtgaccatgggcatgcatagggaatcatctcacatttttttttcattttctcttctaggagtcattcaacaaatggtctctgagacaaagaataactcaacaatatggagctaaataggggaatagaaaatgcacttaacgctcaacaaattttgtatagaaggatgaatcacagagagtgcatccgattaaataaggaaagggtgggaatggggacatggatcttgaataaaaattactcttggtttccatcctctacaaaatgtggcatctacaagctgagtgtaagccaaagactcccaagccaggaacaaatgaaggccctcctaagcaaaaatgcctgataccatgctaaaatccccaaacctcattccttttcttccagacatgattatgccccaaacagatgatgtaggctagaaatatgctagaactagactaacagcacccccagctatagatttatgtccttgtgcaagatgtttatgtttcttcttggtgaaaaatataaattttcaggacatattcatttgccaaaattttaatccaataatctatatcctagcttttgaaatggagcacttactcatttgataattcaaggagacctgggaaatgaaaaagaataaaagttttatccattgtcctactagtataatttattgacagagcggatgctttgcctggttaccaattagtattttctgattctattggcatgatcatcccttacaaatgaataatggttatgttattcagagcaccttcacaggtattttgatgtctacagctctaaagttatatgacctaatattgtcctttatggccctatgaggtaggttaggcaaggtcccttaatctgttctgtaccttagtttattcatctataaaatgagagggttggactaaaacaatagttctcaatattggctgaacattgacttgcctagggagatttaaaaaatactgacactcgtgcctgggtctcagctccagaggattttgatgtaattagtctggagtcaggtctaggcattgaaccttctaaaagttccccaagatttctagtggacagccaaaattgagacccacttgattggatgaggactaaggtctcttacagctccgatattctgagtctagatgccattttaattttaaggatgaggtaactgagacacagaggggttaaaggacggctgaagttcaaaaactaaatcacttctaagatagatgataaaccctaacccatgtctttctacttcaaagcttagacctttgtttccagctgcctttagtttaccaaatgtctaaatctgtatggttattaaccctgactttagcctttatacctttatctatagaaatacaacatttcagaaatattgcccttggactattgccttcctctgttgagctcactataccttctcctccattagaaggccttcatgaattagcctccacctggccctaatctaagtgcgtatgcattattttagtacttactaattattaagtcactctccattcattcgttcattcaatatatatattgagcatataccatgttccaggcactattctaggtcctgaggatatatctatgaacatgataatgcctctgcccctgacagttgttcatatgttactctaaagatataagactttactctaggtatggagtttgtcttcttgactagattgtaagcacctcaaaactagatactttattttctggtccctatagagtctcccaaagtgctagtacaatactctgcaaataacggatgcattgcggtttaatgattataaaggaccatcacagtcagctattaatggaacctactattaagaaagtcactaaaaattggaactattgggcattttgtttattctttatatgatagataattaaaatttactgatgtctgggactcttgccagcatggaattatttctagacattgacaggaagcagcttaagattggctattttggaaagtttgaaatttgagttatgttatcatggaactttatgtac

SEQ ID NO: 8934 - DNA, 1829 bp, artificial
  synthetic oligonucleotide
ctgaggcaggttgatgttgtcagacagagatcgcgtcaggtcagccagcaaggcgtcaaagctgcgaaaacggtcagaggacacagcgtacacaatccccttgaagtagcggtccccattgcggtagaaacgtaccttcttggctttcttctcattactcagtgcctgcaaggttctggttcggtagaagctacagtgggcgctgtgagtggggctaggcaacccattcatccgggagcctcgcatgttcctggatgtcttatctctttcgtcaaagtgtccaaaatcaagttccatattttggtggaacctcagagacctgagcgtgggagaaagggatgggggtgaagagaggcaaaaacaaaaagggacaaggagaaggaaaaaagaagggattttaaatattagccagatccagatctgcaatctgctgcttgtgaaaagaactggttgaaaaaagcctgtgacccatctgctgcttgcccctgacctgcaggaatattgatcttaatagagaagaaggaggggctgggcgggggtgctggtggttgtgggggttgggagtaagagatagagagggaggcactcttggcactgttccagacagaggagaaggggagattttgaaatagctgaaaatcctgagacttactgacagtggctcctatcaaattggaacttcgggctaaatacattaaaactggcatctgtttcctcacacatgcccacatgactaacagttgtaaatgaatccatagcctgacaaaattccccttgaagagaacagaaggagctacccaaggttagcatctccagcttaggaagcagtctttgcatttcagtacaatgactatgaagggggagtgttttcattttattccaagccctctttcctactctaatgtgtgcatcccctccccccagaataaactaagattctcctttaaagggacagcctccagggaacagccagtgtctttgtgctattcatcaaaccctttccccaccaagctggtgcagctatccgacattcataagaaataagctggggggaaaaaggattagaaaaataagttatttaacaagttactagctctgtcttcccccggttccatttgttcacaaaatccttttttttcccccccaggtgctccaccccctccccactgatgcagcaacacctcttaatggaataatttaattgttgaaagattcacaaatgactctccgaacagcatacgggacctttagaaggaagcacacctttcattgttctgggtttctaccttaattgaagtgacatttaccctcacagcaggcaattcaccccaaacttgtatattgcccaggtgcattagctgagaaaagatggtcatttgtcaggctttgcttttctcccttctgttgaaccccctcccccaccaagaaccccaaacaatcaaaacatgaaacccaatacaactgaagccacaaatgctagcaaatgtagtgacatcctacgagccaaactattaacatgcatctcacagatggggataaaaggactcacaaagcaagcagggctcagctgctacacactgccacatcaatatatttgcaagggaccaggaggacaggagataagaaagactggtgcctaatgggtctgccaggctcaattccgccttttttccaatgtcaccatgacctatgctgagctcagcattgtctctgtcagacaacctgcagtggtaagagaccccacctcctcaaggcaagcagcaaacatttccccaggcatgccagtaaggctttgctttgctttaggatcagaggtagtattattctaa

SEQ ID NO: 8935 - DNA, 679 bp, artificial
  synthetic oligonucleotide
gcaattttgcataagccacctctgatttaacagcagagattgatatacatcacagccacttaacaaatggcatctatccagttggtgcctgtcacacagctattatgtgttaaatataaggcatattaggtgatttatattgctactttatgtaaaacgagaacatctatttatgaaaactggcccatctatgaattggcaaacacacctgaacaagaagacaaaagtttgatttaaacattaaatagcaataaagataatttaaaactttcattttcatttagttagaaaaaaatgtgtctcagtcaaagactgaatttgggcagatagtccacaaacagggaataactattagcataagataaagtgtggttataaaagcattgttttttttttactgtgaaatatgtcatttacaaagaaagattaagcatgcctgtagtttaaagattaatagtaaaaaataaagcaaccgtttctatatctatcactcaggttaaaaaatagtatattatcaataccttagaggcccttggtgtgtaccctctatagcacctctaaactcccagggctaactacaaccctgtatattatgctaattattccctcgcttttgtttataatttttgctgcatatgtgtgatttcctaaaagatgcattgaataattttgccttgtt

SEQ ID NO: 8936 - DNA, 459 bp, artificial
  synthetic oligonucleotide
atccaaactaatttcattttctcgctgtcatattttctactgggcataatttagcattctaacagttcagccttttaccatgtattttaattctctaattgtttcttgtattagtttgctttgccaaactagatttttttttaaagtattttgtgggcagagactgtgtcttcaacagccttggagctccctttagcacctggcggggttcttggcacataacaagtgttcaacaagtgcttattccttgatttcttctgatctaaattccattatccacggtaaccatcttcattggacaaaaacctgaaaaaaccaaatagatcaatttcttaaacagtttcaaattatttattgaagtaatacacacacagtatcaaaacataataaaatacaggaggacttatgatggaaagcaacacttctgctccatcatgccacagcgcatatgtttgctct

SEQ ID NO: 8937 - DNA, 1477 bp, artificial
  synthetic oligonucleotide
tcattctatgttccagctattccagagatgttcctgaacaagttacctgttggtgaaagcttcaaaagggatacttaagtgaccaatcctattcatactgtgggccaggagaggtaagaaatatttggaaatattacgatgttaatcccggtgaagtgagaggcattattttatttatcggcaggtgtgacaaataggcaccatctgctgcagaagatacagcaactcctacttgagcgagcttattacttaatggctccagccactgaagaagcatttgctgctggaatcgttttttcacagggtgatgtggaactagacacacttctctctctcagttttttctcctcagctaggaagataaatataaatagaatgtattaactcttaaaagctgatatcagttgatagttttgaatttcttttctgaattgttccactgaaggttttccttaactacttgatgagatttcagctctggaattatataggcaggtgtcatgcagaaaaatgtaaaattaccagtgggttgttcccagaaccttatcatgttaaagaaaataaaagtaactactaggagcaccctgagaaccaaacagagatcagggtacacttattttatatctccagcacctaaaaaagtgtctggaacttgattggcactcaataaatgtttgccaaagaaatgttaatctgattttggaggcctgtggagaacttggttgctcttgctacaaataagtttcactcaaagaatccctctcgggcttgattgatgcagaaagttattcccttatcattctggggagcaaaattcatgatctaggagtgtatgttattttgctcctatgaggttatatacactatgctgatgtcaaaaattagtgagaacttgacatttcaatgtttatactaaaaacacaagactttttgttactaagattttatttaccaaattaatgacaaaatatgcaattagaaaaccaaaggtgcatattcatgtcacttgtgagtattttggtttacattagaagtgaagtaaaccagatgtacaagttaatattggacattgaccagttattaaacactttctcttttccctttcccccaaacttctcttcctctttttttgctccattctttctcaatattacctccttcccttccttctccccctcataatcactcatttcctgccccatcttatctccatcccacatccctcatagtctttactcatttctcacatttctttcttttcctcctctctcccttccctcttcctctatcttcctttctttctttccctaattccttacccccttttccattcctcactctcctccttttccctcaacagctttcaatcacttttacaaagactagaaactgatttttattgcatgagctttccagaaagaactgcaggatactaaaataattctttccacaaaaaatcatatccttcagaattaat

SEQ ID NO: 8938 - DNA, 1202 bp, artificial
  synthetic oligonucleotide
aacctattggaggggcgattgctgtgctgaaggatagagagggtgttgcaattgtcaaatagcatcaccattttctgcttgtgtgctattgccttagctctgagagtgattggtttttaccagattgttagaacacgtccaatagatttagagacagtctaagtgactgtgaaatgcctcaagggcagtagaaatcaaatagaaacacatactaactcaagtcttgagtgatgatggaggcgcattttaaataccatggaaatctcactgggcgtgcccattttcccactctggcaacagaggttgatacctcttcagacaagtattccaacctgtacatgtatgtgggcttattcctgagcctcctggccattctcctcatcctgctcttcacaatgctccttcggctcaaacatgtcatctcgcccatcaactctgacagcacagaaagtgttcctcagttcacagatgtagagatgcagagtcgaatccccactccctaaagccaggatgaaggtgagctttagtggatctgggtaaacccttatatatggatgtccaggagagcttgctttcttgcatgaagcttcccatgtagggaatccacaagttgttcatttaacagcaagctgttcatgttttctttgtgttattcttcatctttactctgcttgtgggctatctaaaacgtttaagactcactctgaaaggaatataggaaaagacagctggttgggagggctggtttccatagtaaccaaacagtgcctgggccttgcacaaacctcagaccacagaaattcatgcgcagtggttgtaagaagcacagggtccctggaagctccaaaaacaaacaaagaagatttgcttttgaaagggctgatccttcaaagaggatatcccaagaaaaggacaagttctaatttagtgttttgatcctagagaatcacctctatacaaagttaaattatgtcagaagttaatggaagagaagccctttccctaaacagcagtgatttgatcatcttaggcaatccggtttgtttcaaatgaaagaagagatttaaagaaactgtttcagtttagagagcaagttttcagaaagaagtttctagtaaacaaactcatctagagagagaaaaatgtgcatattatatccatattaattctattcatgcagcttctttgtctttttctctctc

SEQ ID NO: 8939 - DNA, 1283 bp, artificial
  synthetic oligonucleotide
acctaatacaaagactcaccacattaattctgtaaatagtaaattctcctaatatgtttaaaaagaatccaattttttaaaatatattttgcatatatttcagaatcatgggttgtacaaaatgaagtatattgtaaaaggcttatgtattatgtattatgtattaagtaggaaatattaaggttaatcaagtaaagatgaattcatccagcctaacctttccatccatgccaaatctgaagctttggactcataactgagtttgactgctgcagatcccaccatacttactaagtaggtataagggatccattttaatacatttcaatggttatatttagtaatacattttattcacttgcatttgtacaaaagaacttttttttaacaaaatgaagaattgtgtggaataaaaaattgagtttcttttgtttgaaattattaatgtttgaaatagattcatattgtataaaaatggaaatatatttgcattaatatttagcatgtcatttttgatccctggacaataaataatgactggtttgatgataacacgtatctattgtctgaagaatgtaaagagaatgacattagtctcttcatcccggtataaattgtaacgactgcacatttgtgggacttttataattttgaggtctcattttttcttattctctgattctctctccacttgtcaagtgattggtgcatttgtttgtttagtagtaaattgtcaaaaaaaaagaatgacttccagctgtcaataagagtgacctgagggaagattgagataaggtgtctaaagtgccaatagccttccacattcctctgctgataggattttttttttttttttttttttttttttgagacagggtctcactccaatcacccaggctgcagtacaatggcccgatcatggatcactgcagcctcatcttcccaggatcaggcgatcctctcaccttggcctcccaagtagctgggactacaggcgcatgctaatttttttttttctttttttggtatttttagtagaaatgaggttttgccatgttggctagggtggtctccaactcctgggctcaagtgatccacctgcctcgacttcccaaagtgctgggattacaggtgtgagccaccaagcctggccagattttttttttaatgtagcttccattttgtactttcttcatttgatcctcacagtaaccctgtgagtagtgagtggagataatatgaagtctgcttgacaaaagaaaaaacaggtacagagagatttg

SEQ ID NO: 8940 - DNA, 998 bp, artificial
  synthetic oligonucleotide
agttctgtgaagggagagtttttttggttgtttctcttcactgctgtacccccaggacctaaaacacagcctagcgcatagtgagtgcttgataaatgcttcattgactaattcaattaatgaattctcctcaatttattagattgtaaacccatttatgacattgcaatgaagtgaattgtgtcccttccaaattcctacatcagagccttaacctccaatgtgatggtatttggagatggggcctttggaaggtaattacgtttaaatgtttggaaggtaattacgtttactcatgagagtaaaatcttcatgttgagattggtgccctcataaacagaaatcatggtggtgcacaattgtagtcccatctactcgggaggcagaggtgggaggattgctttagtccaggaggtcgaggctgcagcaagccatgattgcaccactgcactgcacactccagcctagatgacagagttagatctgtctcacaaaaaaagaagaaaccagatagctttctctctcccacctgtgcccccatcccaccatgtaagaatacagcaagaaggcagttgtctgcaagccaggaagaaattgttcactagggaaccaaattggccagcaccttgctcttagccttccagctttcaaaagtgtaagaaattaattgagttgtttaagttgtttaaaccattcagcccatgatattttgttatggcagcttgagctgactaatacaagcatgaaccatgtatgtctctgatcaattaaaaagaaccagacagtctagtccaaagtaaatcgccatatgttaaaattagaatcccagtgagatgcaatatttcttatcatacatttgttaagatctcattctctcagcttccaaattattaattcagtaaatttaacagcttagcactctgtactagatgtggtgtgtattttgaaaaaggaagaacaaggggaatttttacttccagatatttaagaggctttta

SEQ ID NO: 8941 - DNA, 863 bp, artificial
  synthetic oligonucleotide
gaggttcctcgtcgggccccggaccagaaaatagttttgaaaactaagtgaaatcggccacagataggctttttggcggccgtgctccgatgttaacgtcaaactttagtagtggtggtggttcctgctctgttttacatagccagtttaaaaggccctcacattctgatttcctctttcagaaaatcgagagccttggttacaaccgacttatcctgcaaattggtagaggaacggtggtacctgaacccttcagtactgagtcgtttactctggatgtttacaggtacaaggattccttgaaagaagacattcagaaagcagatcttgttattagtcacgcaggtaaaggtgcctaagaatctcagggttgggtcttttaattttaattttttttaagttctggggtattctgggggtacatgtgcaggatgtgcgggcttgttacaaaggtaaacgtgtgccatgcatcacctaggtattaagcccagcatccattagctttttatcctgatgctctccctccaataaggaactgacacttgaaccttttcgaggtaaaataaaatcgctagctgaactcactgtagccctttttgaatacacaacttatttgaatatgacaattgagaactttactggagagaacttagtattttggggtgagagaagaatgggaaattaaccactgtagtccacctttacaataaaaaaccctaaacacagaggagcaaaataatttacccggggaagtgtaataaattgtcaacttgacattagtacttgggcttagatctaaaggagtgttctgcctgctgattggttggattggtcatggagaaattggaattgtaagattgttt

SEQ ID NO: 8942 - DNA, 861 bp, artificial
  synthetic oligonucleotide
gtacaatttaatttttagtgaatatacagaattgtgcacatatcaccacaaaatagttttagaagatttttattattccagaaagattctttgtgcttatttgtagtcaatgcctatttccactccagccccgggcaaccacttcatctgctttctgtctctagatttacccttttggcatatttcatataaatggaatcatattccttttgaaatcatacagtttttgcttccatcttcttaggaccagtttctccaatccttgttaatgcttgttactgtctgtattgtttattacagctatcctggtaggtatgtaatgatgtcttattgtggttctaattttcattttcctaaagatcaatgattttgaatatctttttatgtgctcattagtcattcttatatctttggtgaaatgtgtattcaaatcttttgtctatttaagaaattggattttttttattgttgacttttcagagttctttatatattttggtacaaagtttttctggttagatatgtgatgtaaaaatattttattccagtctatggcttgtattttcattctcctaacaatgtcatttgcagagcaaaagtttttaattttgataaaatcgagttaatttttttttctattatgtatctgagaactcactgcctaacccaggatcttaaagattttctcctatgttttattttttaaaattttgaagttttattttacatttataccactttgagttaattatagtacaaggtgtgaggtataggttgaggatccttttttttgcatgtggatggtcaattgttctggcaccacttgatgaaaatgctatcttttttctattcaactgattt

SEQ ID NO: 8943 - DNA, 2288 bp, artificial
  synthetic oligonucleotide
ggtttgtcctgtgcattgtagggtgcttcatagcatccctggcttctatccactagaaacaaaaatgtttccagacattgccaaatattccctagaggagggagaggcacagttgtccctggttgagaaccatggttcttaagggactttgtgtaaacttaagcactcatatttgagagctaaaaagaaaaaaatgatcttgtggagatgagtagaatgatggttaccagaggctcagaagggtattgggggtgggggataaagagggattagttaatgggtacaaaaataggtagtaggattaagatctagtatttggtagcataatagggtgactgtagttaacaattgcatatttcaaaaaaactagaggactggatttggaatgttcccaacataaagaatttgtaaatgtttgaggtgatagatatcccagttaccttgatttgatcattatacattgtatgcttgtatcaaaatagtgcatgtaccccataaatacgtactgttctacacctataaaaattaatttaaaaaacttaagctgacatggatcttaacctgagggggaaaaatatttcttagagacctgagggggaaaaatatttcttagagaactaggaaaatacctcatagaagcagccagggatattaacaggcataatttattagagaatagtaatgtgtgtgattggatgactcggagtttttggggtttttgtttgtttgtttgtttgagacagaatctcgctctttggcccaggccggactgcagtggcgctatctcggctcactgtaagctccacctcccgggttcacgccattctcctgcctcagcctcccaagtagctgggactacaggctcctgccaccgtgcctggctaattttttttgtatttttagtagagatggggtttcaccgtgttagccaagatggtctcgatctcctgacctcgtgatctgcccgcctcggcctcccaaagtgctgggattacaggcgtgttttgtttttttttttttttttttttgagacagtctcactctgtcgcccaggctggagtgcagttgtgcgatcttggctcattgcaacctccacctttcgggctcaagcaattctcctgcctcagccttctgagtagctgggattacaggcgcacgttaccacgcctggctaattcttgcattttcagtagagacggtttcaccatgttaactaggctgtccttgaactcctgacctcaagtgatccacccacctcggccttccaaagtgctgggattacaggcgtgagccaccgtgcctggccatggatgactcagtgttttgatgacctatactaacctgcccatgctggggatagtgccgagatatacccattgatacagaaattacctgctggttttgtccttccaaataaaagatctagtatatccttcaaaaatacaaaaattccctccctatgtttatttggtttgttcctaggggaagcattggaaagtttaaggcagtgtggtggtgacagtacactgggccttttgctttgattatgaagcttatttgctacctctttgtttgcctgaaagttatatcagagatggacataaagcaacagaagaagatgttcaagaaaattcgagggaaagaagtttacatgactatggcttacggcaagggagaccccctcctcccacccaggctgcagcacagtatgcattatgggcacgatcctccaatgcactactcacagacagctggcaatgttatgtctaatgaacattttcatcctcagcatccatctccgagacaaggtcggggatatgggatgcccaggtaagacattgacagatttgtattttcatggtctagggaaatatgaagcaattgaagagatccaagaagatagaatgccatcaagatgagggtctctgtgacatacagactgtatttcattaataatagttagccctaatgccagtattgcagagagcagagctctttctagttgaatgtttttagaaagacagattagttctatttaactacagagactgactacttaggtattagtgaatagagagttctagtttcctttctctttattcttaggaattcatctcggtttataaacaggcacaacatgccgggccctaaagttgatttttacccaggcccaggtaaaaggtgctgccagagctatgataacttctcttatagatctcggtaagtattgtgttgaaagtcagagaaaattggtaagtctgatttcattgctgaacattaatgtttta

SEQ ID NO: 8944 - DNA, 1704 bp, artificial
  synthetic oligonucleotide
atagcaaacttttcaggaatttattctataaaacacgttcctttgtaatgaataattgtcctgtaaatatcataataaaagatacaggctctggaatttaaaagatctgggttagaatcctggttttacaacttattgtgtaattttgcacaaattattgaagctttttatctgtggcttgggggcactgatagtaccaattcatgaagtggttgtggacttttcagtaagttaataaaattttaaattatcagcagacttctaggaaggtggtggcaacaacagcattagcttttctgagtctcaaaataaaaatggaaatagtgaagtcaaaacccatgacacctacaaaaatctaggtgacaaggtatccccatgaaccccaggatttaagcaggtagggacaaaccactagtcacaagacctgcatgctatcagggtctatgagggagcaagaacatagaagcattgaggatgttgtcttatgtacctgagaattccaatgaataagaattcactgaaaagtagggcagacaatttggaagcagcagccaaaactgggaagggatttggtctctctaatactaggtgagtgcatgaggcacatagtagaaggacttgaagggcttagaacagtttaacctctaactcttcaaaattgacctgccagagttcccttttaggacagtattcctcactgggaagaaactgctaagagtggaatctgaattgatcaggatagagaaaagagcaggtcagggaaaagaacaaaagaaaaggattaaggtcaaatgctacacaaatatatcttaaggaataaaaagcagaatatccctacagacaatgaaaacatgttagaaatgaaacactaaacagatctaaataaactaaaaactgtgacaaactatttcaaaatgagctaaagatattaataatacaaaacattaaagaataacataaatcagaattagaaaaactcacctgaggtgatagaactcaggaaagaattataaaggggagaaggtcattttagtaatggagactaaactgtaatgagcttgagcaaatacaggttgagtattctttattcaaagtgcttgggaccagaagtgttttggacttaggatttttttagattttggaatatttgcattatgcttgttgagcattcctaatctgaaaatccaaaattctccaataagcatttcctttgagcgctatgtaggcactcagaaagttttggaatttggagcagtttgaatttcagattttcaaattagggatacccactctgtatgtacagcagataatgctttaagagaaataagagtgctttaggctttaaattttttttgtttgagacggggtattgctctgtcaccaaggctggagtgcagtgacatgatcatggctcactgcagcctggatctccaggtttcaagcagtcctgctgcctcagccccccagtacctgggactataggcacacgccaccacactcggctaattactgtgtttttgtagagacagggtcttgccatgttgcccaagctggtcttgaactcctaggcttaagtgatccacccacctcagcctcccaaagtgctgggattacaggcatgagccaccacacccggccataaactttagaaaaaaaaaaaaatgtaagaagagggaaatctaaaattgaaaaaaaaaaatgaag

SEQ ID NO: 8945 - DNA, 1708 bp, artificial
  synthetic oligonucleotide
cttgccaatgtatgagatgtagtgactattggttagagtgtagtagatgtttttaaaaaatagcacaaattctaaatactaattttgatactatcaaattttcaaatgtagtaagttaactgaaacacacaaacagaaaaataattcgcctaacttattagatatgacatatactatggggtaaatatttcattggcacacattaggaaactaacacatctttaagaaacaagaaaactcaatagcccccacaataagaagttgtagtatttaagaacgaaacaagccacttatacccagaaaccacaagctgacaattctttgaaatctcttcagcctccctttgatgctgttcattgacccagcatgggcagcgcgtagcactgaatggcaacaaagatgggcagggtagtttgccttatctgatagctggtggggactgctgaccacatccctcagctctgcgggaaaatggcatgagattctgaggatggtcaggaatctgtgcggcaacaagaccagcaaagtggcacctggggcttcaaggaagcatgggtgagaaaagcaaagcaaaaaggttaagcacccaactgcacctctgatgattaggtgcaacaccccttcagtcggttgtaagatggacttagtgtgtataggtattaaaaaggcaaataataatgaaagtaataataaaacaagaacaaaaatggagaatgtggctataaaagatggtgcaaataagagtttcactctcctttctggggggcaggggcagtgagggaatcatattctgtgtcacctctgagagcaaggaaattacagatttctgttgagttccagaacagatgattagggcttgacttagaggcgagttgtaacttgttcttcctgtccatcaccccatttgtgcatgagcaagtcacaagcctctccccaagtttcaaatacatcctctgaggagtctaaaagtttagaatttgaggagcagatgctggatgcacagtgaagagagctggaacaggctagagggcattcactgctctgagcagcgccctggacttcacctaattctacctcactgaggttaatttcactttgagaacaggcctctgctttccctttctccatctgagaatatctgatgtcctgccacatacagtgctgctgaacaattccatcagaaattgtgtacattggctctgaactgggttcagacatatgaccattaaatttggagaataggagacccagtttcttgagagaaggacccatgaaggagcgtttgcttgatgactcagcttttgactttccttgggcaccactggaccttggcatggttctgatgagaggtggcccatggcaagtctttttcttgcagcctaaattaaaagagacactcttggatttggcccgagccccaccactgccatcattattatcgtctctctgagacagttcagtgctgctagtggaaaagctccttggatgttttctatttcccaagaggtcaagcacttcataccgaaagctggagatgtcttgctttaattcctgggaaaagagaggagacatattatgtcaagaagcttggtctttatttcaaagtaggcacattagatacctttggtatgttccaggtttttgcctagtagcaaatcacaaaacaccagaaaaatctgccattattcaaacacaagaaaaacatatt

SEQ ID NO: 8946 - DNA, 479 bp, artificial
  synthetic oligonucleotide
gtgacatacattggtaaaatctctccgtctactggatgagagacaattctaagagaataagcattataactggctttgctatattgtaagcagatgaaattccatcaccagaaacctcacacactgtgaagattaaatgatgcttatgatatgtaaaatgaaaaaccacttcatgattaaattaccttaaaattttcttctgtaagtccctcatgtgttttggaatttcttatcatagcagccacatatcttttgactaaattcctgataacttcctggaattacaaaacatgaagaagcattcagtctccttctcaggctctcagtacagtaagaaacttacataggaaataaaacatgcttagaccttctttgcagtagaaaatcctcataggatccagccttttattgtaaaaatgagttaagtccattggctaaacaactattgtgtctctgaatttagtggcagaatcaaatta

SEQ ID NO: 8947 - DNA, 2558 bp, artificial
  synthetic oligonucleotide
ggcttaattagtccagttatagcctatccagtggataagcctacttaagtcctagacaaagcatggttaaggcctatctagggcataagtctagaggagacatagagtttagttaaggtataacctggacccagttaaggcctagtcaaggtctaagcctagaaaagctgtggtcagactttagttaagttctagccagagtttgagcctacttagggcctagtcatcctagttaagatctggccagcccagttaaggcctatccagggccaaagcctagttaaagcttagtcagagtctagttaaggcaaatgcaggccttaagccttgttaaagcctagtcaactcagtgaaggtggagccaggcttatgcctagttaagtcctagccacagcccagttagcttagccagggactatgcctagttaatatctaatcagtctagataaggcattgccaggacctaagtctagagaaggcctattcatttctaatttaatgtgtagcaagggcctgggcctgtttaaggcctatttaacccagttaggtctagaaaggactaagcttagttaagtcctagtaagagtctagttaaggcagagccagggcctaaatctagttaggacctagtcatcccagttaaggtctagtgaggacattggcctaattaaaggttggtcaagactagagtgcccaactcatcctagttttcctaagattttctatatttagcattgaaaactctgggtcttggaaaaccccttattcctggaaaatcagattggttggccactctaatcaaagggtttttttttttttttaaaaaaagaaaacttttctttgtcttggagttcatggcttataaaacacattcataacattatcttgtttgattattatggcatccacttgagataggtgtcaacatcatcctcaaaatataaatgaataaactcaggtttagagagaataagtaccttctgcaatgccatacaattagtatcagaagtgcagtttaaatctatgtttaaactcaaaagccacacttttttacaaactaaatcaatagggcatctccccataattaaacattgtctacatcacaaaattaatacttgcttattgtcatcatccttatttctgatcaggaaagtgagtcatattgagcttaagtgaactaaggcaagaaaacttttagacttgaacctaggtttctctgcctccaaagccaatattccccttaaaaataatgttttttttctgccaggcatggtggctcacacctgtaatcccagcactttgggaggccaagacgggtggatcacctcaggtcaggggttcgagaaaagcctggccaacatggtgacaccctgtctctactaaaaatataaaaaatagttgggcatggtggtgggcgcctgtaatcccagctactcaggaggctgaggcaggagaattgcttgaaccccggaggtggaggttgcagtgagccaagatcatgccattgcactccagcctgggcgacaagagtgaaactctgtcaataaaataaaataatgttttttcttccatccggcctacttcctcagtgtcagatacttcagtacatacccatgtagccaaggttgttgtatgtttcttcatgtttcagtgatgtttgcatccatgtattatctaaaatctgttaagtgtttggtagattatgcttgcattgacacttcttttttttcagcctgaggtttatttattgaattgttgcatgctgtttcattatgggatatttgttgagccttgcagcagagttgacttagtagggtcaagcctcaaccactcgatttggcgtgatcttggaaaagacagttctgacaagggcactgaagacaaacctggtctattcagtaatacttcagagggtttctggatatacccctggtataatgacattctggaggccaaagaaagagatcaaggcctccctctctggtactgtggattcaattgccagaaggtaccgaggacttggcttgcctttttctgactgtgccatttctgtcgcctcctgtgagcttaccaggggtgacaggcatctctattaaaaagcctgtatgtaaatatagctgcatcttccactatgttatcctgaggacaaaatagttgccacccctgcagaatgcagcagcttctgggttagatgccaatggtagcagtatgccaagcatgaaagtatcttgttcttcccctgccaagtaaataccagcttcctgtttggtggtacatttaaagggacagtctccactctttgcatgtgccagtggcaatggggcaaagctttcaacatgggcagttagtggcttagatggtggcacagtgaaagaggccactgggatatatgttatgttgcagatgcctttttggactctcacatctccctttatgctattacattgctttggagaactgtttggtttagtgggtaatgccagaggaaggcagagctagttaggaagaaacaaataatttattccactaagtagatgggatattcaaatgttgctttc

SEQ ID NO: 8948 - DNA, 1451 bp, artificial
  synthetic oligonucleotide
aggcctgagaatttgcatttctaacaagtacccaggtaatgctgatgctgctagtcaagggaccgcactttaggaaccactcatctaagagagagatgttgagaaccagagccagactggtgaaagacgaactagagaggagagaaagtatatgaaagatatttggaaggaaggaaccacaggactcggggattggacatgggggcaagggagccagacaaataaaagatgacttcagagtatcaaacctaggtgccttggaggatatgagaatcacagaggcaaaatcccaaacatttggaagtggaatgaagtcacttgacaggtactgggaaaatatatgaggccttattccataagcatctgcaccatggcactcaagtttaaaggcctcctgtgttgtcttcagagagaggctaatgagaagtagaaagaccaagtctgtattttgtctctccttttctagaatataacctttgagtagaggaggaaacagaagatagaaagcagggtatacgaaagttagaaggggcttaaatagtctggaaacaaagaacacatcattgggttgctaagtacattcagtgagtactgaatgtatatgggcaaacactaataaggaaaaggtaaatcagtaaaactcagcatgggccacgtagggtagctccaggatgctacctgagatcactggtgcaatttctgagatagggcatctcaattccagaccacctaaccttccctagtttcagggcttctgacctggtgccctgttgtgcctggctatttcccagcctataggaatttctcttacctgcttctctccgctgggccgcctgtagctgagcagaagctccacagcgcccaccacttccttgcgtatggcatagagcaatgcatcacccacatacacgctgtggttcagcagtagctccatgatctccaggttctcgttctcaatggcaatgagcagggcactccggcccaaggggtccatgcagttgatgttaacattatagtagatctcagcctcctgaagggcctgcttcacagtggcatagtcccccttctccacagcattgaggaaggccttctcctctgcagagagctctgtctcagccctcacaatttgcagggggatgcggtctctgtacggtgagtagttgacctttttgtagtacagttgggccatggttcatagcaatgcagaaatctgagtgaggaaacagagaaagaccaaaatatccttagatacgtggaggtctcaagtggccagttatggaggcagccctgctaaggggttagaaaatcctaaactacttcaatgacgccgtcttttttccgcttacaaagaagtataacagaaaaagcccaggctttggggtcaggaagacctgggcttaaatcctggttttatgacttaccagttctgtggccttgagtaagttactcaa

SEQ ID NO: 8949 - DNA, 1693 bp, artificial
  synthetic oligonucleotide
tcagatgtatatttttatttaaaccaattgtttaagaggtgagtaacttgggcaaagacacagctctatttctctttcaggaccaagtagtgatggaattatttgagaacagtcttttaaggacagggactcagaggttctgggtctttgaaggcgagtaatcataacagcttaggatggaaattacctttgagcttcaaagttctctgattagaccattaaaaaggatctgatgaggaacacagaaggaaatgtaatatcctagggtcttgaaggaaccttacctgagtgacattcttaggcctgaatgtaaaaaacacacacagtttgtttctccagtgttgacagtacattatcaatgtgatgagatgagcaagtattatttttgcagaggcagaaaaaataatgaaatctaaaaataatgaaatctctggggtgtgaccgtcaatgatcatatctgactctgtcaaagactgaatttaaaggtatggctgcctcctatatttcttacctttgcaggggcctgattcagatccctgtcaaatcagcttaggttatttattgaaaatcttttcttttcattgttcatttttccaaggattcagacactggggataatttttctactacaaaataatcaataatctgactgcagctgacttttcccactcatgacagcagtcaattttcaactcttctggggatatttatctagttgcctgatgcttcaggccacttgataacttccatttgctactggactttagggtctttatcttcctcgttaccacctccatcacagggccacaggagaatggaagaaactggcagaaaatcagtttgctttctggttgttagaagctttgtggaaaggtcctgtgggagctggggtagaaacaaacagttgattccactgagccatgaagaattatttatcacctatagctttttctcttttttttctgtcttccccatccttacatataattgagaacagacttcgtggtccacaaaaccctctggattcacaatatcaaatgatgtccactatgtcaacccatacagtaagtatagtaggcaagtagaataaacgaaacaaaaacagaacacagggaggcctgcggaagattagtataggtgcttccatctaattaacttctgaggttgagtcataactgaaggcttttccctactaaccagtggtacaatagaatattcataaattttgctactcatacagatgtctggggcttttcctctgattttgcatgaatctctactgagaaactgctcaggcctcagatttaccaataccaaatggaatagggaaagatgttcaaactctcagtcatatactagtgaatggtcttttcattatcaccaataccttgctgtccccacttgatgttcccatgcaaatgtggaatctaaaggaaataatagacattgaacagtcaggataattgaatatacctgttctaaataaagaccaaggctactgtgtgtgttatgtcggcatgcatgttttcaatgaaggtgatcaatagggaaaaagagtcccccataagaacactgggaggcaagatcatagagtcaaagaatgattttcatattccaatggaatgcttactggtttatagatcttgggtaagtcattgcacatcttgctgagaaaccgaaagtctgtgaagat

SEQ ID NO: 8950 - DNA, 743 bp, artificial
  synthetic oligonucleotide
cacttcaggaatctaaggaagctgagactatgctgcctagaaaagggaaatgatgcatacaatttagagaaatatgtgaataataataactgtgtaggaccttggcatttctcccatctggaatctacctctgttctggagcagtttgtagaggagactcagcaggaccaagatggacagaccatctctgtccgcttctctcttttcacttttgtctcacttatcctgaccacaatgtgtttatattaccattgttccattttccttgcttttcaagagttcaaaaacagtgcatgctagaactttccttggccgtccatcccactttgagaaggaatcgctccactagacgattagctttgtgagggcagggactcttgtcttatttccttattaaatcttcagtatgtagcaaagttcttaagcatagtagatgctcaaaaatatttgctggataaatgaatgaactctcagcacaaacttttcagcacaaaactctgttttgtgcttcaattgaggtctatattctctgatttatgtatttggaggagcatcctaggatcctaggatgttggaactgcatccatccacaaatatccattgaatattttcttgaaagtggttttcaggctttataatatatcagaatcatgtggaggatttgttaggacagattgttaggcctcacccccagaatttctgattcagttggtctgaggtaggccctgagaatatgcatttct

SEQ ID NO: 8951 - DNA, 850 bp, artificial
  synthetic oligonucleotide
gtgagggaagaaagaaatacagaaccaagatcctgctctcaagaagcttacagtgtacttgggtacaaaaaacattaagacaaaaaaatggctaataattatataagagaatcactacgaagggccaattgtgatacttagacactgctcaatagactcagaggagggagcaataaaagactgggaaagctagcaaggctttaaaatgcctggtgcatactagacatgcaacatatatttattgggtaaggtagaatttgagctggatctcaaaggatagataatattttgagaggcagtttagaatgggagctatattcttgctacaatactggtataggtaaatgcagaggaagcagaggttgtgttgggagacactgcaaatagtttttctagagcagaggatttatagagaaagatcatactcaaaacgttgttggtgccagataatggaaggcctaaggtccatgggaaaagggtttgaactttatcctataggtagtgggggaactactgaaggtagaagggtaatgtcaagggaggatgaatctagtgactatgtgcagaatggattgacagggagagacagtaggcagttggaccagctcggaggcttagcttgcggataagggcagtaagtagggtaatagcagtggaaaatgcagtaagataggcaataacaaaatgcagaattcaaaagaagagtgcttagtgacttaattatatatatggggcaaaggagcggtggaaggtaggatgacttcaacttctagcccatgagactgaggaatagtggtggcattaccacagatgtcttttatttctgcttagaagttgtttaatgatgtct

SEQ ID NO: 8952 - DNA, 8240 bp, artificial
  synthetic oligonucleotide
ctgcctagaatgaggctttatttctgtctataggctgcaaactttgtcatacctttccctgcaaacctggcaaatgactgggccagattaggccagtggcaccttgtggcacagagtactttggggagagagattctgcgccttatattcttcatcagttagcaggaggcatctgaacagcttagtatactaaggtgaaaacaggaacctttggcagaagtaaagcaggcagaaatgcttcaatctaccaccttcagtgatggagccatggcaaaaaataaattagaatattcgaaaacaggctacaggaaagcatcatgacacatttgaaatatccattcaataactaagcacctgaatggcttgcagattggaatttaatattgtaaggagagaaatgagacagcaacactgagaatgtactccaaggttcccaattccctggtactatggaattctatcattgtttacacagtgtttgcaagtcaaatacaggcaattttaagatgcttcacatatgagttgatttctggattaattccattcccagtcaaagcaaacacctggatagttttctttctgtttgtttcaaaacatcttcggttctctcatattcctctcatcttcctcccttctgcatctctaatttcctggcctagtcttctctaagtactgtggttctgcgtgccattccggttttagttgttagctatagaaagaacagaatcttaggattatagctcttgtggctgggaaggatggcagatatctggttcaggtctccatgttgagatgtacactgaagccaggtgaattagtatcagtgaagccgggggctacattggttctgaatccctgaacctgctcacatgcttatcccctgggtaaccatcaggacttacctcaacagccagatactcacatcaccaagaacagagcaaaacctacactgtaggcttcattcgtgctgatattttgagtttttccccaattatgatgctgccagttctttcctacctgtctgcaacccggtctttagtatatctatttgaaagtgtaattttaacctaagaaaatacttactatggttgctttaaaaagtaacagaatgggcaccttttcagatcctacttgagtaatcctcattctgctctctctcagcagtgaacattagaaagaattgcctgatgcaacataaacagtttcacttaatgcagaatccgtttctcttatttgctgagttggaaagaggcaattcattgcattttggtaacatagtaataaatagaaagtttaacagacgaacctgggtgctttggaagcacaaattcacctcctgctcccctctgttacaaaagcagagccaagattgtatggggttgattgaggtccttgaaaaactacatacacacacacacacacacacacacacacacacacacacacacacagattttctctctctccctatgtatattgtgaaagtttatgaaaacagcatcttccagggaccaaaatgtggattttaggtgacattcaattcttccttcgacctcacagagagagcttcagagactccttgaccctgtgggtttcttttatcccagactatatatttgctttgaaacgaacttcgtactatgtaaatatattaacatgccttttgatttagaataagcagattttaaagacatgatgaaaggtaccatgtgacatcatttatatctcagtttttaaagagtttatgggaaaggagacataatataaatcatcaataaaacatcaaaaaacctatgacaccaacaatagacaattatgaatgctgatatataaatctgtcattcttgttaaatgccatgaagataaatatatggcaatagaaaagtgggtctgggtgtgccatgtcaatgttgtaatcatttcacatttgaagccaagggttaacatgcacaatctctaaaaagagcattatcaattagtctatgtctctcctactcttataataaactcgggtaaagttcagaggttctatctttcaggctggtttccccgcttcaggcttttcctgagggagtaataaccttgctaaacacttaaccatcaccaggtacatgactgcgatccaaagagcccaggttgtaatagggaaaaagcccttctagtctcattctaagagaccatggagaaagatcagcatctgtgaattcagctcagtacctgcatatgtgggacatgatcatgaccatttgtccgagtcgatgtgtgtctagggagggagggaggtgtccactttgaagcagagatctgactgatgcccctccatttgcatttcttggttcctttaaggaagacaggcaaacaaatctggccatttcttaagtttgaaggatacaagacaaagaaggtaaatggggaccctggttcctgaaccttcatgatccggctcctggctctctatttctgaaggtggcttttgacgaagggcaggtatccttggtccgagggccacactaatcgattttaaggaggcctgggagcaggttccccacggatcttaaaatctacccaagaatggagcaaatcattgtccagggataggacaaagctgtggttcaggaaaatattcccagtgaaaggatgtttttggtcatcgcaggcagcaccttgtcctatcaaccctggagcttctccccattgcatttcctcttccaaaacaatctgttgctggcctccctctgctccctaccaccctgagcccacagccagccagtcaatgcttctccgcctacagcagcccagcatcttcattcaacccgcacttcgctgccccttgcccctcagcagcactcaggcagtgaaatggaccgcaccggccgcctgtagacttaccctgagccaagtggttttttcggataaaatctgtgtcgtctggatgtccaccggccaggatgcgtggtgcggcgccttgccggactcctcttttgcggcgcgaaacagcagccgactgggacagcccggggcctctaggctgatgggtgggtgggcggatgagcacagggaaaggggcggggtgtaaagacgagcgcaagtactggctcctaccttggcttcccctttggatgctcagttattgccaaacttgcctgtaacagatcggccctcctcacctttcaccttcgccagtgccctgaaactctttgctctaccaatgtccctaccctgttctcccagctctctaacccaacctgagccccttcaagcgcacccactcccttcacgcagccagtcacacacaataagagctagggaagaaactgacacggggaaactgacaggggtagctgacactgtagtgtgaaggagagggagaaggagggaggaaggaagggatggagagagaggggagagagagagaaaaaaagagagagagccgcattcacactcttacacgcacactcaagctccagctgttaggtagcggctggcgggagcgctggctacccctccaaaacccttttctacactagaggtttctgtccccttctgctgccgtttctggaatatgctatacagagaaggggagagaaaagcaaagaggggtggggaggggaaaatcaaggaggcacgctccctttatcctccccacccctgtctccaaaaatgtccaaccctgagctcttccttttcccttctttctgcgcccggcttccctctgctcctgttctttattcctccctttggggtggctgcgagctgcggacaacccgtcgtggttgtgatgtggggtgtgtgtgtgtgtgtgtgtgtgtgagagagagagagagagagagagagagagagagagaaagagagagagagagagagagagagattgagacaaccgtggtaggcaaaagcacccctcacctcccccagcccccgggccgaagccactctcaatctcctggcggcggggcggggcgggggaggcggggaggcgagagggaaagagggaggacggggcaggcggcaggggcagcagctcctgccttctttgcagctccgcggccaggggtggaaggaagccgcagccgcagccccaagtcaacccccgctgccccgtcccaccgtctcatctctcccccctcggtacggaattttctgtctcgtttgtttgcttccccagacctccccctcccctgggtggtggcagagacgggaggggaggtgggaggctaagcgcgggtgcgggtagaggggacaggagtccctcggagcatatggctagcagagtctctctttgccccttggcctgaatatcccctgctttgggcagtgacctttgcccacccccgtcagcctgggctctgggccggtggtggcgaggctgctccggcgaccataggtcattcaggaggaaggggagttgaacctgggggagtaagggcggcgggcggctggtaggacagggagacagcggagcgctgagtcgccagggactgacctggggtcctatggggcaggcttggatccctgatagatctagattaatctagttggagctacctaattctcccatccgtgcccctctcacccatagggtcgatctcccaagatccagcctagattgatacagggagggaaagtgatattgtaggatgggggcggggggctaggttgcttagtggtatctgttgtggagggagaggggcggtgtcaccggacacttgggccactctttgatctttacgccttcctttcacatgaagcacctctccacttctttcaccttatagcctggcgctcagaatgtccaccctcttgagcccaactggaaggggctaaatagccccacccccaccacaagcctgagacttctacctgcaacctgcaggcgcataggtccactagctggcagcatttcatggcctggccgcacagccccaaatattggctttgtcttttatctcccttcctagcgctctcaggaaaggggcatgtgagtctctgcctttctggacgccgggctggtacctgaaaacctttccctacccattctcagaacaatccctagctctgagaaaactccactgtacttcctgttgctctttaaccccctctgcacgccctgggagcctaagtgtaagctcccgaaaatgccagaatcatctcccttgcctaaatggccgagtgttttcattgcggagcctgtgaagctggtagtagctatgtttagtggaagccctaagcactctcctcctagcctaccttggaaaagtcgctcggggcaccaagcaagacaaattttccccttgtcgttagtcctcctagtcccgaggcagtccaatattctggagagtatttagcttttgtatgggagcaaggtattggagaaaagaaaattattaccctgggggatgaagagtttgtgtctggggggaagggagttggggaggaagaagtgagggtggagcttccacctcttaacaacttaaatacttcaggaagtgtttctaaagattggccaagagggtcgctgaaaaaaaaaaatcacttgattctttgcctttcattcaaaggcagttttactgtgaaccagcaaactaatatacagtctcccaaacaagggaggtctatgttgtgattaagccgtcttccctttggcatgagggtgagtagaatatgtgaccgtggataaaactttgggggcatttccctttttttagccaaactgcagtccagctgagacttccactccaagcccagatgcaaccagaagcagtgctcagggagagcaaaagccttattcttgtgagctgtttccttcaaaggccctatatccaatgcacttgtctttaacatatgaggactgtgtgtgcttctgaaatttggagctttcccagtggactgtggataaggttaaaatttctttctctgctcctgccctatcctgtttctgccctatccttctaacctcttcagatcaaggatatataaagaaaaatcctttcaaaagttaaaagcaccatacaaatgccaggcattactatacgaattccaaaacaaacttagcagagtatctcctagtgcaattagaaagctgacttaggcagggacccaagctttgtctaggttgcttgtcagccttggggctgggtggctcatcttctctgtcaatagggacatattctggttttccacttggtggctgagtgtgtatgtctcccagggtagtttgcacctagaggctacatctgcaaaagtggctcaaagccaaaaatggaagccactatctgactaatttaagcccagaactacctagcttctagactaggtttacttacatggcctggcctattcaaataccatgacaggtatgactgttaaaatgtaattgagacatactcttttctcctctcttcttacagccttgaccatagtggtaaatggtatatgtagaccagagtttaatgtaacatcgtaggtgaagagaaactgttatgaggaatccagagagtggggttttcccagtcattaagcagggtttctcaacctcgatgctattgatattttaggccagatgattccttttgttggggggctgccctgtgcattgtagaatgtttagcagcatccttggcctctgtctgttagattccagtaggaacccacaccccatttgtgacaaccaaaaatgcgtccaggcatggccaaatgtccactggggagcaaaattatcccctcaccatatagaatgagtgccatttaaggtaatgtcacatttcaaagaccatattttaaccttaattctacccacatggcatgtccagactttgcattgaacagagtctcagaaaataatgaatattttgtgaggaaacgacataaaaaggaaccctcacaaattagctaagttttgacaaatggtggaattcattgttatcaacaatgccatcttctggttaccatcaaattcttgtcaagcacacactatgagtagggtattgattatagcaaagatctgtaagacataatcccagccttcagtatgctaagaaactattgacctttctttccccaaggggaaagggttactgattttcatagataaccaatttctggattgaatccaacctggctttttccctcttctatttcctatttgtccccaaacagtggcttattgtttgaggttctgccttatagagattgcattttgttttgctaattagcatagtcctacaacaattttttgtgacttctcagcgtgtggcatttgtgtcataacactgtatccagcataaaaatgactacaacatcacaaaggctgtaacaaattgagcaatttgaaagcaggtttttgttttcaaggaaagtttctaactacttgcatgctagagaaatactcaacaatggcaaaagcaaaagaaatggaatgtaaaaagaggtgattcttaaaatactgtggagtgttgaaaaaatatctcagtgtgattatgggttttaacactcagcactatctctacctcaggaagtcaaacaacactaatgcaagttgtaggatcttgatcaggaattcagcaaaggaaaatgcaggagaaagcatggaatatctgttcaaatcagttgagtaagctcctgccttagaaaataagtttccggtgagccaggcaggactgcatcagtgttacttgctttggataattcttagcccaataccacgtatatatatagcaacatgtcacttataaagactaatgcaggaaccaacaattagcacattcaaactttacacattcatacattatgatgctattgccaagactaattatttatttaaataaaagttttgcctgaattgggacgacgaatgactgtaattgaaaaatatgtttcatttttcaagagaacatttaaactgttatatcagaatgggatccctgtaatcaagggataaagccttacattaattaatgattaatcttaataaaagatgtgtaaacagagcttcacttcatggattagctaaggactttgctgtcctcaccattaatagcaatgcaaatggggccagctctgagcaaatttgtaaagtgtaattgcagaatcataggacattgcagaatattggaccattgagaagcaccttgcctgaggttagaggatagtgacagagaaggctccaattgtgtcttgctggtctgtgactgactctgtgggacctcaggaagagtaggtttagtctttactttgcctgcccc

SEQ ID NO: 8953 - DNA, 497 bp, artificial
  synthetic oligonucleotide
gttctagctccgatgttttgtgagattaggatgttttccacagggcggaagctgaaagaaagagaagttatatagctgcagcctaaggcctatgaactttggaaaaacctgtgatctcccctaccccaccctaaactctcagctcgtctgctctcgtttcttctctccttatcatcttcagttcggtcaatagcttagctggtctagtacagttgggtaatcatagaaaggtgccatacatttgtctttgcaacaattacctctcatacatatcctagtgagcactgcattcagataggtaacagacatctggcaacatttttatgtttatgcacagcagggagcagtgtgttactcaaatctggcacagaaagcctcaacactcacatcttcctttgctgcttcctgagctgctgtccctgttcaatctgactagtctctgttcttcagctattctttcttgcttgatctgaagccttgaccttggaccttccttt

SEQ ID NO: 8954 - DNA, 9792 bp, artificial
  synthetic oligonucleotide
agtgggggataacaaagacaaattggaacctagcaagacaaactggatcccatgaggatatctgaaacccatgcttacctttcatcacctccattcttgatgatgtaggtgacctgcaggagaagctgtcacccttcagcactccttcttcatgctagcagattagcggccatgttcataaactgaaacagcacctgccaccacaatgaccttcagagtattacaaatggctgctccttcacttttgcctttcaaatcttgtgcacatgtctcctgggaccaattctaacttggtgtaatatagggaaagtaattttgggaaacatagctccagattctaaccagttagacacaaagtcaccacacagtgcctagcatactataagcactcagtaaatattagttcttaatgtctgcttcctaatgtgtttttagattcgtgtttttcttttctgctagattgtaagtgccatgagaggagagaatgtatatgtttttatgtaccattgtatccccaccatctaacacagtcgctgatgtatggtggagcttatgaaatattgttgaatgaagagagaggcagacagaaagaaaacgggaaaaactgtaacatttgccaaacagtgcatcagtaagtttttatgatgttacgggggaatatagacagatgtataagatctagtctctggcataatttgcagttgaggagtgggaaattgaatgctgggatgtcagaaacctcagtagcaccaagaaagtttgagcaggatatgagttgtgattgtagaactggtcgaactgtggggtagtctccaacagaagtacctgcctttactgaatattttccatttgtccctttacatctagcccttacctttctgcattcttctttgtgtcccaggaggctgacctttatggatatatcaactgagttattttgccttttgacttattggttggatacagccaattggagacagtggtggtgaatgagaggagagagaagtcaagatattttttctcccaggttgatgttagttgtcagtggctgaattcctcccccaaaggcaacatttgttggatagggagtgtcatctcttacagccacagctatgggtctttttccctctgggatccagtaactacgccctccatttatgcttttaggcctaggaatgataaaggctctgctgatattgcaaactttggggtgttcaccatcctttgttggtttcttttaacccttctcaaattatttaaatagctctttcattaaactctcctcaattactctctttgagtgaggcttctgtttccttctgcggccttgagtgaaatattatcagtccaatacagttctcaaagggatgtcctgggatttgtgagacatgaaagcaagaagatctaggtgacagacaacattcaaaattcgttgtgtcttggtatcctggttctcaatcatcagtcttttattaagaaccccaggcatagctgggggcaccgtggtacagaacccaacattctgtggttggatctgggcagaaagacaagataagccttcattctagggaagctaagacaaaactcaattatctagactgaatcaaattaccatgggttaggacccgatatgccatagggatataagtccagggactactccaggctcactgaataccatgcatggggcatagtaactaaggacaaacctacccacggaaggatataaagctcccaatatatcccccagccatggttagaatttgtagcataattgagcaggcctgggagtgaagtgcaggtgaataacctccaaaactaatgatatggaagggactggatgaggctaattgtggaggacatcaactgccaaacaaaagagtttggatttgaaaccatagaaaatgagcagccattgatgatttctgagcatttaatatcaatgatctttgataagtcatttgttatcttaattatttaggaatgtctttactgccagtatggagagaaatcgatgatgatgataatgatgatcatggctatgttaattaatgttagcagttaccatttattgagcatctactaggcgccagacacatgtgcccactccttacatacaatattttatttaatctttataataatcattgtagaatcagtattattattatcttcattttgcacatgaaataactgaggctcaaaaaatgtttaaatacttaagctcaaggtgatggtgctggaattgagcctaggactgaatgactccaaaccctctgctcataatctccataaaagaccatctccattattccactaccttctcttcatctctagtctactgatggtcttttgtcttgaatgtggcattgcctcctcagcaatgttacaaagaatagcaatttacaagccttattcatgggcaccaaacactgcctccatccccaggcagacactgggctctctgccaaagtaatgggtctgatagaaatcttattataatccttctgcatttggacagcaaatgatgaaaaaggaaagtctggaaactttgaagctgactttggagttgccctctacaatttccctgaggaggtcttacttagaatgagtcaccaactttcctgactgcattttactgatccttggagagaaaatgttccctagttctggcattaggcttttacggccttccactttcagtgactccaaagcattgggaagataccttgtgtccttggaatagaaaacaaacaaacaaacaaacactcaccctcaaaaaaaactaaatcctctttaggatgggatgctcaactatcccccccgcctcccattttcctatactcattacttttaagtaatgtcggagttgggaaagcatttaaggatctagtttaaccttctcagcttacaaatgggaaaagtggggccaatagagaaaaaaggacttacccatggtcacacagccacctgttagagccaggactagagcccaggtatcctgggctccagaccaattgtcctttcctgattccttttaccatctatttatgttttatttttatagctagtgtgtaaactctgaaagagtcaatcataattttgaaagacacaatcccaagcgccataatcctgaatgttgaaatcctgatgctgagcatggtggcttacacctataatcccagcagtttgggaggccaaggtaggaagattgcttgaagccaggagctagagaccagcctgggcaacatagcgagaccccaactcaattttttaaaaaggaaagagaaaaagaaaccctgaaagatcaaaatccctaaaatataattctggaaaaaaataacttttaaattcctaaaaagaatatttatttacattttaaaaagggcatttatttgaaaaacataaaaacgtgacacttcacagaccacattacacaataaaataagcaataataacatacatattgttgcaagcataaacattcagttatactaatgacaactgaacatgtgtaacagttatgagcagatgaactatattaataaagaaatagctttgggaggccgaggcaggcagatcacctcaggtcaggagttcgacaccagcctgcctaacatggtgaaaccccatctctactaaaaatacaaaaaattagccaggcgtggtggcaggtgcctgtaatcccagccacttgggaggctgaggcaggagaatctcttgaacccaggaggcagaggttgcagtgagccaagatcatgccactgcactccaggctgagtgacaagagcgaaactccatctcaaaaaaaaaaagaaatagcttttataactgtggtcatctgaaatgctgtgatgaacaatgtaagtcttttaatgagattgatcagaaacctcagtgggtcatcactgtatatggactcacccaaataacaacaacaacaacaacaaaacagaccttgagaaattcagttatctcaaaaaactttatttttcagaattgctgatatacaagataagccttctctcttcatttattgaggaattttcaacatttttacatgcatgcacaatgcttaaacacaaagtcagtaatgcgataatgcatctttgtggagtcaaatttgcaagaaaaatgcataaaatgaactagaattctccttaaaatagtagcctgtccctttctttctttctttctttctttctttctttctttctttctttctttctttctttctttctttcttttttctatacctatgaaattcttaaaggatcttgtcatacagtggattctcagtaaatgtttatttattaaacttttttttttgttcagttgaccatgtatgattgaagcaaaacagatctctttctggtttgggccattggctgcatttggaaacatcttttccactttaatttcattttggtccagtagaaaggccacatgggaatcttttcacttagcaaagggcctatcaaagaggcccagctccccaaaggacaatgtctaattctcagaaaagattctcaaaacacaaactttctaacagagcctgactctatttctttctttgagagccaagagttggtaaagtctcattggagattcattcttatagtatttatgccacaggaggtgctcctgatttgccatttcacatggaaaattcataaatgttattaacacttttctactaatttttttgtctgtcttctctcatcaggagccataattagatataatatccgtttgatttccttcttcctggggctagggagtctgagagtggtttagaagcactgccagaggcattgtaaatgaaatagctgtctgatggaaggaactctcatccccttttgaggtcaactccctgcctgtggttagtcgctgacatggtaattgatggtggtaactcggtgctacggcaatagtatccatgtactgatcttctggccagactcctgagctagagggtcacaatttgacttccactcaaacagaaaaatccctttccctatactctaagaatggactgatatgattatctggagcaggcctggcaaaatgccataatacccagtcactggatttggcaggattgtgtcttggaaggtagggatggtatataacaatgaactagtgagtggcaaaatagcaaaaatgtcaagcatggccttcatgcttacttgcttggcatttctgcctccttataaccattgcttcttctcgaagttccccatcctggcctgttctcttgaatggttgtatgtgtcctttcatgatacttccctcccataaaaaaaggtcctagtttctgacatattcccattagaagacatacatgtgccacggacagaacaacaaacttggaaatggcatatctagagtcttcattaactttaaagactataaatgaaatggctcctgaaagcccttttcttgccttctgctctctaccactgcccacaaccaccactctgtatctgtggctttgttggcatcctagggtatcatacagaaaagcctagacccatttggcttgaaaaaattttagaaattttgttgattttatgcttactgtcactatgggcttaggcattaagtatcttaagcacaaattatactgaaattctgactgcattttgtaaagacgaatttcctttctccccactataatattttcctctactttagtcatctcctgtcaccaaagaaaaagggcataggtagttaaagaaagactgatggaaagagtaggcctgcaaatgtgaccttcatccctaattcatacatgttatactcagtgaactcatcaagtgatttttgaattgtcttgatgcaaactttatcgaatctgtagatcagtttgagaagattgttatcttaacagtattaagtgttccaacccacaaacatggaatgtctttcacatgtttctcagtcttctttaatttctttcaataatgtttcatagttttttgtgtccaagtcttatacttcttgagttaaatttcttcctaggtatttcattatttttggtgctattataaagggaattgttttcttaatttagtttaggagtttttattgttagtgcagagaaatactagggtttttttttttttttttgcatattgatcatgtatcctgcaaatatgctgcactcatttagtacctttaataggtttttttttgtggattctttaggtttttctatatgcaagattatgtcatctttaagtagacagagttttacttcttcctttccaatctacataactcctatttctttccttgcctaattgtcctacctagaccctccagtacaatgttgagtagaaatgatgagactgtatatctttgtcttatttccaatcttaggggaaaagcttttagtctttcaccattaagtatgatgttagctgtgtgttttatgtctgacattttgctatttgttttctatatgtcttacgtcatttttgttcctcagttcatacagcactgccttttttgtgttaagtagatatattccagtgtatcattttaatttctttgtagtttttcttatgtttttgtgttattttctatgtgattaatttaggaattatcattaacactttaattataacaatccatttcagattaatactaaattaattttagtaatatacaaaatttttgttcttctatagctccattctctctcttccattatgttgtttttgtcacaaatgacatctttatatattgtatggccatgaacagagatttataatgattgctttgtgcagttgtcttatatagaaaaaaaatgaagaatgtactaacaacaaaaatattgatactatcttttgtatttacctatgtatttacccttatgagttctttatttcttcatgtggactcaagttactgtctagtgtctttcatttagcctgaaggaactcctttagtatttctttgtagagaaggtatactagtaatgaactttctctgctcttgtttatgtggggatattttaatttgtacttcctatttgaaagatagtttttccatatataaaatccttggttgacaggttttttattcgtcagtattttgattatgtcatctcattgcctttggcatttatggtttctggtgagaaatcagttgctgatcttttaaaataatttaaatttttaatttttatggataacataattgtagtgtatatttacggggtacatttgatattttgatacatgcataaaatatgtaatgatcaaatctgggtaattggatattcattacctcaaacatttattatttctttgtgttgggaatattccaaatctactattctagttattttgaaatatacaataaattattattaattatagttaccctattttgctactgaatctagatcttatttcttctgtctaactgtatcttgacccattaaccaatccctatttatcctccccctgactacctttctgatgttttgtatgtgatgagcttctctcttgttgctttcaaaattttctctttgtatttgctttcaacagtttattataaagtatataaatatagatccctgagtttatccttcttggacttggttctgcttctcaaatgtataaattcatgtctttcatcaaattttggaagtttttgaccattgtttctgcaaatattctttctgtatctttttctccttctgagactccctttatgcatacttgatggcatcccacttctgtgaggctctgtctattttcttctattattgcctttctgttcctcggattggataatttcaattgacctatcttcaagttgtctgagtcattcttatgctttcttacatttgctattgaactcttctaatgattagacactcagaacctcttctatctttaaagaaaagcaggacactcattgagaatatcctgaatataaacaaattttcattctggtttataaagcaggtctcatgagcttccttagtatttaatcagtcccctatggctggaacactctgaggtaaatggataaaatcaagctcttgaacacacaaagctgaatccagactgatactgatcctgtgagggtccactcaaggaagggcactttgagagatacagcctgagtagcctgctagctctctgctctccagtgagtgattattgcataaccaatagtttatctctaatttaatgtaattattttagttactttagttataattattaggtctctcattatatgcctctgttatagactaaatatttgtgttccctcaaaattcatatgttgaagccctaatccccaatgtgatagtatttagaaatggggcctttgagtggtaattagggttagatggggtcatgagggttgggctcaagatgggaagaatgcccttttatgaagagacgtcagagagtttgcttcccctctctgtaccatatgaagacatagtgagaaagcagccattcacaagccatgaagggagccctcaccataactcaactatgctggcaccctgatcttggacttccagcctctagagctatgagagaattaatttctgtagtttaaaccaccaagtctgtggcattttgttatggcagccctagctgacaaattagccttcttttcctaatattatgactctgaccttaacctgaaaatgtactagagccaaatagtgaacatcaacagaccaaccctcttccagagcagagtgggaacaggaaaccacacactgaaaggcatatgctaattaaatcataacaattatcgtgtagcctttcccattgtttttatataatgttgtgaacacctgaaaagataactacggaagtactaactcacatgccaaacagaatatactaagtttagaatgaaagctataagccacggggtgctgaaggaaagagagcttaatggagcatatgccatttaatttagagcttgaagaataagtaaggtttagatggaagataaagcatgccaaacactgttaatggcatgagcaaaagcatggaagtaggataatgcaagatttctgtttttaggaaaagtgaacagaccagtttgattggacaagataatcaacataggagtagtaagaatagatgaggcttgaaagaaaggttgaggcagaatgtggatggtcctaaagatgaagcatgtgaactttgtcctgcaggaagtacagagccatttcagttgttttagttggtggaagagaagagttgacatggtgactatcatattccctagtgaagatgatcattcacttcaagcatagagacaggaagctatttgaaaaattgaaacagtgaagtaaataaatgttcaggtctatgaattgggactaggaacatattattatagaagacattcagttagtcgcattctctttcacttcagccatttcatttattgctttgtcccatctgtctactcatttaaacaatcaactcattcctccatcattccccaattaagttggaaagtcccacttgattcctaattgtgaataagctctaggcttggtgagcctgaagttatcctctttggggtcttgggtatttaaaaaatagaccctctaactcaaaacactacggctgtgaagtactggtctgctgattgggagataagtagtactgaggttgctgcatgagatttatattttgcttgagtatttcacataggattctagttaatggagcctagaaattgccccacagtaactgtattaattggtatgtatctttcaatgtacaatatcct

SEQ ID NO: 8955 - DNA, 450 bp, artificial
  synthetic oligonucleotide
gaattgttcctgatagcacaatagacccatctagcaaataataaatgggacttgacttaggcctcttataatggtacatgtctatgtgttgtgctgaggaaggttctagagcagtgatctccaaaatggtgatatcttaacatcattataagaaaataatcagaatgtacttatatttaattctcagattggcattggtgcccttattcagtatctatgtcacaggatctcatgccatgccatctgagatttacaaggcatctcaagggaataagaattccagaaatagaaactcatttatttgctttcaaaacattgccatgcattgaagttcacatatgcccagatcagtgtatttatgagtattatttatttattctttaaacagatcctcaaaaaacggacatgtggtttaataaatatttcttcaaagcaactttggcttgaaga

SEQ ID NO: 8956 - DNA, 846 bp, artificial
  synthetic oligonucleotide
tttaggggcaacaagaagaagtgccttgctcagaagaattcacattagagttatggaaggaacgtgtgtggtttgttgagggggtaagacaattagatagtggcctatggagcaaagtggtttgctacgtagctacttcactcagacagttcaaaggatgggcaggggctagacttttgcccttagaattctttgaggatcagagaagtgaccttcagcttggtatttcttgaagctgaatggcctctgaaggtcaagttcatgagggaagtattgtagccagcaggagggcagaaggctgctatttgctgattggcaatttctccaggaaacagctcccgtattactctagtttaagtataaaatgaggaaaacaaatttttcttcctccaagcttatacagctcaatttttaacatgctattgaactttaaggagaaattaatctaagcattgttataatggaggtaaatactctatgcccatttctattatagttcctgtttaatatattttattaccgagcgttacctgtatattattcaacaatatttgctcagcacctagcgtagagaagggacacttaccacattctttgtgaatgaatgaagagcgatttattcagagagccaaatgatgctggctgaatctcagtgaggttgagacatgaggaaagctaaaaggcatgctctattgaaagaatatgtcattctgttccagtgttaggaaggtggcccactacagctgcataatgaacacttcttcagagaaaatcctatttcactaacatggctgctactacaaaacaaatgtgtcttttgtcttccattaagacacttaaaaaata

SEQ ID NO: 8957 - DNA, 1400 bp, artificial
  synthetic oligonucleotide
agattttaattatcccctccaaaaaaaggtacctattaatagtcattccctattcccatcctcttccctatccctagccctatgcaactacaaaatgacgttttatctctatgggtttgcctattttagacattacccatgaatggaatcatacaacatccagtccttggtaagtggtttctttaacttaacagtatgttttcaagtttcatccatgttgtggcatatcccctcattttttaagctattatttattaggcacaaaacatgatgccaggaactatgatgagttcattgggtgcttcattttgttttctcttcaagacaatactttaaggataaataagattatctgtattacagatgaggaaaatgaaactcagcaaagttaaatatttgctcaacatctcacagcgaataagtgactgagccagaaattaaatcccggtttgatgccaaagctcatgttccttccactatgccatgccacttcactgtccaaaacagagtggatctgttccagaagacaatttggaatctgcccagtgatcagtgatgattgttttttggccataacaatagtacttgagggtcctattggcctcaacttgagctagttcccttgggaacaggaaggactggtttcctccaactgtaaaagctgaccttgcagaactgggtgtatcttccagaacctcccatatctttcatctgtgaccaattctgctgcatgtaaacagatttggctaatattcttccccatctacaccaaaggagtcaaccggcctcaaacctttgagtttttagacaaaagaaatatatgttaactttgtactacagttggcagtgatttatctaggttttcatgagtaatcaatgtaagtggaagacattgcttgtttactacagatagctataattatttccaagaaaaacttgaaatttccagagaaatttggtgtttccttctgtagattctttctatagtctctttaaaaaaatctacttttcttttgtggtgaaaagagcattttaaaattttctctcagagacttaagagcagaaaatttgttgagcaaataatgtgcagtttggaaaagcagcttgagtagccagattttcagtggataatttgatattcttagattgtcagatagtttaagccatccaggtaatttgctgctttaaaccaaaacacaatttcctctccaagcccctacaacttatttttgttgtttgaaatgttgccttacaatagctttctcctttcaattcgccattctgcaccatctgttagaagagtgcctattttgaatgcagtgttcatataccctatcattcttatagcttctggaggagccaggccatttggagaatgaatcctggcattgggaaaagaa

SEQ ID NO: 8958 - DNA, 4298 bp, artificial
  synthetic oligonucleotide
aaggatccagtttggatgagagtcatgaaagctctttgcaaagtgaaaggcatgcagatgtgaagggatgataactcccagagcgtggccttgattcagaagaagacaggaagggagagtccctgcataacccagacagaagggggctttaatttgttttcctcctgttaaaacaacttccatgattcaagctggtactgcatgtggaacattctgtcctttgagatcttcagggacaggagaatttgcaaagcagtgaggctgcaaccagctcatgatgtaatgaaaaatacatgaaatattgtggggttcataattgtgcttcttcaaacattccctgcctaatagcagtcaagtgagataggtagcttgtcctctgctcaattccctaataaatctttcccttcttgcccctgatcttgcaatgtggtcaggccccacagctctgtgttggaccatattatcttctctccccctcccttttccctttcccttcccattttcccctccctttatccttcctcctcctccatgcataaccttaaccattctcttggcctcacgtaaccacctcccaattctgtgccaccttcactctagaactataatgtgagccatacacctgaaactctactcagatccccccacaggcccctcacagtcaccctctccagaacctaactttcccttcttcccacttcaaatctgctgcttcttcagtttgacgggagtgttataggccttcccttgtaaaagggcaaacaagatagccaccatcaaggacttggagcaactcagtgttatgtatggataccctcgaggcacacatttcactggacatgaggtctaagattgggaacatgaaaaagacatagattggtttcacttgccatataacacccaagcagcagacttaattgaaaggaaaaaatggcatttcaaaggcacaactgtgaacacttctgcaatccaatactttgcatgggtgggtgaaggttttgcctcaggtcactaaaaaccttaatttggtttaaacaaataccgggctggcagcataccaatgactcagaacgactgcaggagaaggtccattgaccatagttgtcaagaaagtccaaccagacacatttctaccacagcacataaaaagcctatgacaaatgttatttaggactcctcaagaccttgaactaggggagggggaggggacatgaatgggggttggactggcaacttccctgaggttggataggatatttcttgccagagagtgaggaattcccctgccagataacgtggtctccattgatactgctggagtcccagccaaaatgctccacataaccatacactggaacagggccccttttaaagttggccatttgacatggtcttttgctgcccctgtaatcttacagataatatcagtaccttctcctttcaggcaacatgtttggtatggactctcagcccataatccttagaccacctgtttcctaactgagatgtcatagctctcatagttatgacagtcattctgtttgatggggaagaaatgccctaccaagtacttactaaacacttgtatttctacccatctacctgtgaatgtacctgtattttttctcttctttcatgttactgtgaaagaaccatctctgctccctatctaaggccaaaccctccatttgtgcactatctcccaacacctctaggttactcaaagatattgctctagcaattttctcttaatctcctgcatcagtggagctctactggttcattcccagcactatataaacatactgttatcactcacatcttaaagaaactttcccttgaccccacttgccataaatgtatggcctcatttctctggttcccttcttaacaaaactcctcaaaggagttctctacttactgtccccaattttctttggagcccactcaaatcaggcttttgcctcgatcactccatcaaaactgttctttgtagaagtcactaatgacctccactttgttacattaagtgatcaattcctattccttatctttccttacctatcagaaacaatgaacacaatcaacatcctttctcaaatactttcttcacttgacttccaagagtcctcactctctggttcttctcctatcttactggttgttccttctcagtctctgctgattccttttcctccctctgtcctccaatctctgtgatctccatggctcagtctcacagtcttctcttctatttgtactcgttgccttggcaatctcatccagattcatggttttgaatattaactatataatgatgattccaagtttatatcctaggcccaaaccttttccctagtttgcagactcatacttccaaaatggaattccccatcttcaactccaaacatgtttctcctatagtctctcccatctcagtaaatggcaattccactgtcatccttggatcttttctcactctctctttcttccccctttttttcccaccccaccctgtttatctctctccacatccaattcataggggaaattatgttagcattaccttcaaaatatccaaaattcaactatttctcatcatttttattgccatgactctggtccaaaacatgatgtcatgtttggatcattgcaatagcctcatcttacttgactctctgcttctcttctatactcctacattctattctccacacagaagcataaatgaacattttgaaacataagccaagtcatgtcacccctctgcttataaccctccaatggctgccatttcactcagatgaaaagccaaagtccttataatggccttcaagatcctacctaatctggcaccagtccccatcctttatgtactctgaccttatctccaaccactctcttctttttcttactttgttctaaccacattgatctcctgactcgttttacaacatggtggttatattcctgcctaagggctttctctcttgttacatttgcctagaaggatcttcccccacgtgtccacatggcttgttctctcaatgaatgaaagaaccaaaacacgaatgtatgataaataactttctgaaaccctcacaatacccaagcccttaaagcaattcctttatatatttttattttatatatactctcttagggcagattgaactctcacctataatctcatgactcccaaatctctattttcaacccagatatctcttaccaaacttcagatccacatttctagctagctactagcagagcaattgcaaaagtttctgggagaagtgggaggtataatccagttggtgctctgctcaccaggccctgtaccagcctgtatcaaactggataaagaggtgtttttttcttcacacaaaggtactatctgtctgtccactaagtcttgtgttcagggctctgtctggagagagcatcttgttagatagccacacaaaaattctaaaaaggctaactgtaagtctgcctgctgggcatcactgcctgaatgttccactggcacctcaaacacatgtacaaaaagagctcattatcttttctacctctactgcaaatccactcctgttctagacttccaaatatcccttaatggcataatcattttcccagtcattcaagctccaaactctggccttatcctcccactccttcctgccgtttgaatgcagagtttcaatttctctcagttccatctccgtgacatttcttgtctctgcacccctaggatctattgtctccagttgaatataaccatgttctaactaattctgagagctgcttaggaaattgcctcaacaaatagctatgaaagttgtgggctacagatggataatagtccatgtaaactgtcagctggcataagtataaaatctaggaaaagactggataaggagtatctccttttcatgtcccttatctgaataggagtgagtaatgcagagtgatttatagatttcctcagaatattaaaatatgaattcatagcccattcccattttacaaatcagcttagtaaaccacattcaacttttctaaacttttgttttctcatctgtaaaactgaaggcaatgatttagagggacctttagtttcctcttgctcttacagcccaaatatctcaactttttgctctaaatcacacttggtatcagggtaaaaaaaagaggagaaactaacacttattaagtatctcaatacttaacacttataaaatggaccaaactctttatatccattttgtaatttattactcatcacaattatggaa

SEQ ID NO: 8959 - DNA, 913 bp, artificial
  synthetic oligonucleotide
taacatgttctttgaaattttcttggtgttttttagatggccaacttcctaagaagttcatttcattagcacttagcaagctcaatacctgatctgaccattgaatgatagatgacctctttttaataatagatgacctcatgtgtacattctaagagactcaccatagtgtaccagccaacaatagtgaagaccagtctctgactgagcagactctggtttgactacaataatcaaatattgctacaaatgcattttcttgtaattcaactttaaaacacaatttctttttgtcatcaaacaatgcctcccaaagattaggacatttgaatcatagcatgtccatgagtttctctatagaaggctttttggaggcaacacagcagctacttgttccttgtggataactttattgcttctaagtgtatccaaaatgattttggccactcagagaccttgaattaaatgtcttcgggtaagagctggtattttttttatctcccttctcatagtcttccaccactgagaccttctgctcctcatttgatgctgttgtcttctccatcctactaacatctccttatctccctggcttctagggcagtatgctttttggtcctgctcaagaggttccttttaccactcccacttgaagtatagaaatctgcttctcttctcttcatttgttgccttcaagtggtttcagtgagcacttttcctcaaagggtcattccaagtgcatcacttaccctcactgcaggtgcctgcctgccagcacaaatcaggagccatggggacagcccacacatgagatctgctggtagcccacacaagggccatcccgcttctacttatgtccttctgcaactccaagcctcagagataaattcagtgctatgagccttccggggca

SEQ ID NO: 8960 - DNA, 1198 bp, artificial
  synthetic oligonucleotide
catgatatagttagctctggaagtaagctagtccgatcttgtttctttgacagatgagcaaacctgaggcctgaagcatattagtgattgtgatggagccaagaatagaaaccctagtcccatgatttcattgtcatcccctttctactacactcttctgagaatgaaaattgtcaagcctctttagttgaatgggcaggccccaaaaatcatttgaaaattaaagatttgtcaataaagtaatagcagagaagggttaatagaattgcataagctatcatcattttagattataaagaaaataactccttctttcaagatgcatttcccatgtcatgattgcatataattatatataaatcaatgagcaaataaacctatgtacagaaataaattgtatgtacgtgagagatagtctaggagctaaatatacaggtacaaaatgtatgacatggctcctaactgaagagagtgtatattctaattgaggatcgatattataaaagtaaaaaaaaaatctagtctgagactccataccgtaagtaacagtgagtgttctacatactaatcttaaaaaagagaaagagttctgttggttgaagacatcagaggcttcatggaatcagtggagtttgaagtcatccttgaaggaagaatatagctgggataactatgtaatttgttgttcaaatgagtacacttctgagagtgaaatgaggcatcgttaataattacattagggtaacgtttgcaaactgagattgtcccaggtgaactgggacagatgatctacgtgttcataaaggcagaaaggaaagttcagagcattccaaattagagaaatggtttaaaggaaaagacaaagataagagtgagttgagtgtgttctggatacagaaaaggtggttcataataaagaacaaatgagaaaggattagaaagtgtcttgaatgttaggctaaggagttttattttgttccatgaaaataagaaccatgtaagcatgagtgattctcaaaatatttaacaaccaccacatcatgggcgctaacaatgaaaagactaaagccataacagtgtataatagctgaatatcaattgtgcatttaagtttttttgtgcaggaaaactgcaggatgaaattggcattttagaaaagtaaaaatggcagtgatgtgcagaatcaatgagaagagac

SEQ ID NO: 8961 - DNA, 1188 bp, artificial
  synthetic oligonucleotide
aacacgactaattaagcattatgtgacatgaaattaacttaaaaaacttctttatgaaatgcttgatgtgggcaaatggaaatatttagaggacagaaaaaaatgatatcactgagacctgatagcaggcaaaaaaaaaaaaaatgcaattgtcaaacgacagttaagtgtggctaacaaagttagcggtaggaaggagggaaggttgactcaaaagactctggcaataaaataagttcattaattatccctactcaaccaggatccagtggacatctgaaactatcccctaagatgttagagcaccaaatctttaaccagttgtttagtcagtgaataagcaataagttgaggagatgtcaatgagactgcaccaacatggtaccagaacctctgttcattttggtcagttccctcaaatagttggtccttttgtgagtgggaccaggggatcaaatggccttttggtgtatgctaaagttcaccatgttggttttattaaattgactggctgtatcatcaatttggtagttgggtaatttggtggcctgtatagatacaacctatattctgacttcattgtttagggtagaaaatgactggaagaagttattaacataaaaaaatagctctcttattccagttccttataagattccaaatatattatcacgtttatataccaaatggataacaatgactcacagttagttcacaagcagcaaatgtagagggtcagatgagtaatcttaaaactggaaggggagagcaatagaggagtccatgaaaggaagacagtaaacttttgatgcaattcttggcacaatctctatgtaagtaatgtttcttttcctgtaccctccctactctctcctggccttggtaggtgacaggctgatccactatagtacacggtgccagtgactaataataactttaatgtactgcttctccagagggtatttgcattttaagaggactccgggggcctaacataaaagaacacatctctaaagggagagtttctagcactgtggttagtctgtagagaatttaggggcacatgagaggtaaatctactgagggcctcaaatcacctcgtgttggcagacacctactctggttgagtataaattcaatgcagaataatagagtcatggtatctaccataccaggatgaacactttt

SEQ ID NO: 8962 - DNA, 576 bp, artificial
  synthetic oligonucleotide
taaccagaacattccatggcagcccctgataaatcactttttctccaattatgagagaaggacattttttttttttgtatcatggaactttcggagtaaatttctactggcttctccagcgccccagatgtgagaactataacccaaagcctgttgttcaccataactttcagtctgactcttcagtctgctaaacacaaaacagtccttaaacattaattctgctggctggaggagttccttaccaaccagaaaaagtcagtagtcacccaggagcctcagtggcagtcacaggatagcctgtgaaatgagaaacactgggctggtgtttagggcattttggctccgtgatggaggatactttatcctttggatttgccatctgtaaaataggaacaaccagtgtctttcatataccaatgatagtaaatggagatgatgaacacatttgcagaaaagcctccaaatttattaaattgaaacatacaggccttattccttctgggccattagcttctacctactttcctgtctcagtcacgacttggcagacaatagatggaaaagatgaagagg

SEQ ID NO: 8963 - DNA, 1771 bp, artificial
  synthetic oligonucleotide
ctgtggtgaatattattggccacattttatggataaagaaaataaagcttgtgaaggttaacttgcctcaggttacacagctagcaactagcagagctcaaagctctaccaacctgtatctgtcccaatgtcaaggggttgagaaatgtcagacaatgaaaaggaagagttctaatagtaacggtgcagaaggaaggttgcagcagctgctgctatttgggctgctagagaagcccacccattcctactttgtctttttacactccccagaatctgctctgtttttcaaacttgtgggccagttatgcatagggcacaacacatgagatgtaggtaattattctgtcttcattaagggtggttgaaaataccattatctttagacaattgttatctggattattttgcatttgttttattctaaattcttctagataatattgacataggccctgggctaatttgaaactgtttgaagaggagagtagccacaaactaaatgacccattcatccaaacagaacacattctcaagggtctccaaggctactgtttctcactattctggctaaacccactgaagtccacagcttggacatctgcctcctgagcatttttcccactgccaccagtcttgttctatatttctatctggttaacttgggcatctgtaatatgaaaacatactgaggtacactggagcagggctgggttttccatttacatcaaggaataggccgggctcagtggttcatacctgtaatcccagcattttgggaagccaaggcgagtggatcacttgaggccaggagtttgagaccagcctggccaacatggcaaaactccatctctactaaaaatacaaaaattagcccagcatggtggtgcatgcctgtaatcccagctacttgggaggctgaggcaggagaattacttgaacccgggaagcgaaggttacagtgagtcaagatcgctccattgcacttcacctaggcaacagagtgagactccatctccaaaattaaaaaaaggaataataaaagaagagatagtgaatggggaacagtaaaaccacctctgctaaaatctagttctaactatggctgttatggacagatcgtataaattcgagaaagaatctctgagtgcctctatgtataaggaagtaagctagtgctaggccctgggaatacagaaataaataattcccatatttaaatatttccatattgaattaatagggacaacaggactgcaataactaattgcaagtgatatgagagtgcaaaggagaaacactagagcaagtaatatgctaagtggcttagtttaagtcacttgctccataccaacaaattcaggtagaatcaccttccccagaaaaacatggtttctcagatagaaactggagctactgacaaagatgtttggtaggcaaccttccagtggctctagaaaatagtggcttctattgttgatatctgctggatgccaggaaatttacatatattatctcaactatgtgtaaatacatatagtgtcttgcaacacagatgtgaaaactaagtctcagagaagtaattcacccaaggtctcataggttggaatttgaatctagactgggattttaatccaacatccgtctaactccgaagcccatgagttttttctactgtttgaaactatttccagaacatagtggtgttagcatcaaatgtggagaattctagtcccaaatttaatactaagtaactgtatgtccttagacaact

SEQ ID NO: 8964 - DNA, 2405 bp, artificial
  synthetic oligonucleotide
acaactgattaattcagtccagagtgcctcattagtttcttcctactctaaaacattcaatatccacatttaccactcagcctgagtatgagaactttcttaactgtttctcattttatttctgccttctctatttcataaaaacaagttcttgtttctctgagctatatgttttctcccctgaatacatccatactcaagcttttcatttcctcttccaagccttcttggaggaggaaagaaagattaaaatttatttctcaatatcaagatttctttcacacctttacttgccatgttttctgtatcctttcattctttttttcagatggtttctatgattcacttccttcaggtagtaaaaacttagtgcaaaatctctttgggcatgatctttccaaataggtgatatcctgaacttcaaacaggttaaccctcttcacactcactctccccaaccctcaatttattaaaatgttccttctttgcttcaatgaacttaggattgcatctctgtgcattttccccacaattttcacagtgaaaataattatgctatccatacacatcattaccatttgtctagatggtaggcaccttaagagcaggaattatgattgatgatgtatcctttcacaaaaatgaaacagaccatgatataccaagagagccttctgtagaaaaacatctttgagagctaggcagaaagtgtgcaggcattttaggtaagaaaggccagataatacccactgcctccatcttttttttcctcttttttgagatggagtcttgctctgtcgcccaggctggagtgcaatggcacgatctcggctcactgcaagctccgcctcccaggttcacaccattctcctgcctcagcctcccgagtagctgggactacaggagcctgccaccatgcccggctaaatttttttgtatttttagtagagatggggtttcaccatgttagcagggatggtctcaatctcctgacctcgtgatccacccgcttcggcctcccaaagtgctgggattacaggcgtgagccaccgcacccgccaccaactgcctacatcttaaatcctcatgcctttttggctcccatcactttagagacaaaatcaacgctacaggcagtgaattcgtgatgggtgtagaaaataatcctatgtcattttcctccttccaggtttaattcagatgtaattaggcaaaaatatctgtcagtgttaaaggtaggagaagagatttctctactaagcaattgtatgctcttgggaaagtccctttgtctttcaactcccttctcctcctctagtataaggatggtaacaatagtattacctatattacaagagttgttgtgagtcttaaatgacatgtaaatcagttataacagcgtgtaacaaatattatgtactcaaataatgttaatgctgctgatgatgatgatattatccaatacttactttgccttcaaaccttctttaggaaagaaaagccttttatactgaaaatcaccaactcgtcaatcacttcaaccagactacatttttgctatgcagaaataacacatatgaatcttgggactggattttagagtgtgcttgtgtaggataagctatctcccagtatcccttctgagggattctggccagggggcgctattaaatttgttgtcttacaggatagccaaaaaacaagatagcttcgctaactcccagatactccctgttgctagctatggtacatattactctccagtcctgagactctagtttaagctaaaggcagtaggcaaattgtctcaggcaagtaaattcaggcctttttaaccactcaccaaatgcttttctgggaaaaaaaaaaaaaaaaaaactagtataaggaaaaatattttgccatttcaggtaaggttaatattgtaataatcaaggttaacatagcagcttaatgaggcatgatcctagtccttggaaactttccttataaatggaaagagttctctttctatcatcttggttttttatttacctctctctctctttcactctttctctctctctctcctctactattctttattattttgtaaacaatataagattttaattatatacataggcaatagctaaaagtaaaaaataaaaatctgtagcacatcctccctaagacaagcactactactattttgctatgtggcctccctgaagcttgcttttgctatgcagtggattgtttgcatagttgcaatcacattgagacagtgtgatgtaacaggaggaaaatggcccggggggtcagacaaagctgatttcaagtcctggctttgtagtcatgagttgtgtgtttggcctaatttcttaatctctcttggcttatatttctttatctggaaaatgaaa

SEQ ID NO: 8965 - DNA, 1095 bp, artificial
  synthetic oligonucleotide
aattttgataggtattgcattgaatctgtacatcatttggagcagtatggacattttaacaatattaattttccgatccacataatgagatatctttccacttatttgtgtcttccttaatttctttcatcaaggttttatagttttcagtgtatagatctttaccaagagatattctgatataagtgatgtattaggagaatactctcaggagaatcctgtgagagaattagggaagcaggataaaaaaggagacggggctaaacaaggatgtaatttcagatgaaatctagtcttaatcttatcccacagttaacttcatcttatcccacgtaaaaaatgctctgaaaagtctgtcctattttgagataaagggttgggaattttgtactgctaacctaattagttcatcagctatggacaggcttaggagaaagacataactctcgagcaccttcaggtgatatggctcaacttacccaaggataaacctaccaagaaggtaacaagtgtgagcctttagcaacagcacccaccacagctgaaggatgagcacatcagaccagtaactgggatccctggggatctgggtggagaacttacaatgtcatctagaactgctcagctattttgaacacccttcccctgttttgggaattcctcaccttaaaaatcccagactcctcaaagaaaccagataattgcttttcaagcctccctgctgctagagttgaggcttgtgatccattctccttcaacccaatgtgcttactcagagcttgaattagaagttagtgatgcagagaaacagaaactgtatggagtccattctggccatggcagtgtcagtcccatttagttggcagaagcagcagtcacaatggttctagtggtagcatctggtgctcacaataagtgatattggcagttgtcaatgccctgtagccaaagactgccaggaacacatctgggtagttgaacaagttgggtttatccctcattgctgcaagggcaaatgcacagttcagggagaatgatagaggggacttattacaagattgaggtttgtgttagatgatttgggtgagggtttaa

SEQ ID NO: 8966 - DNA, 987 bp, artificial
  synthetic oligonucleotide
ttgattgaaggtgactataaatagataaaactgcctagctaaatggggattttgataaacaaaaaaaaacttaaagtgggaataataatagtatctactttattgggttgtgaggattaaaggggttaacatatgtaaaaacacttaaacagtacctggcacacagtaagtgctatataaatcatagttgttaacatcatttttattattattatatcatcatcagttgagagtattttaaattatttacaccatttccctctattctccggaggtatgggccttgggaaacaccttcctgtactgatatgcttccttgcatagacggacaagtactgggaacttgggctatccagaattggaacagagccaaatacagaactatgatcctagggaaggactctaggcccaagaagtaccatggaacaggggccacaaacatgtctctagtattaaaaatgggttttataatgtgtatactttagctacctgtctcaatgtacatgtttacatgttaaaaaatccctaccccagacatgaaaattaaaattctgggggtagaacacaataatctgcatttttaataagctgccaaagttgggttgtcagatttaagaaataaaaatacaaaatgtccaattgaatgttatgttcagatgaacagcaaatcatattttattacaaatatgttccaaatgttgcaagtggcatacttatactattatttgttatttaatctgaaaaattatttgttgtttatctgaaattcaaatttaactgggtgtcccgtatttgatctggcagaatacacctgattctgatgtactcagaaattagagaagcactcctttagaagaacttcagttctggacaaattccctttccaataatttgtgttaaggaaactggagaagtaagcagttattgaaacaggggtgtgaagagggggctttggtcaaagagaaataccaaagtccctagttcact

SEQ ID NO: 8967 - DNA, 676 bp, artificial
  synthetic oligonucleotide
acaggtacccgctgaaagaacaggaatctctgcaaagcatttgttcaggtctagtgcatgtagctccgtgctctgcccaacctgccctcccacccccgccatcttccccagtactccatcctcccttttagacaggtgagcacattaggttgtaaacatacttcatggacatatttgacttgtaactgacagctgattccattacattttatcatagctggagaaagatgcccctgggaacacattaaaaataaaaatggattcatagagtaattcattctcaattatatttgtctccagcagttctcattaatttggagttgtgaagatgtgcttcaagtagcaacagggaagtcatttacaagtgtcagtccctgccaccttctgaaagaatggaggttcattaaaaatgtggattcttggacctcagccccaggtatttgattcagtaactgcagcccaggaatatgcattttaaaagcaccctgtaatgtggacgtatcttgtcctggtaccaacatttaagaaaaacaccactaaaaatgttaagagcagaagctctggtggcagagaaaacttgtttaaatcccagccctgccacatatgagctgcagccctggctctcacttctcttctgtgtcattgctaactcccagtttgacttcccctccaacca

SEQ ID NO: 8968 - DNA, 1128 bp, artificial
  synthetic oligonucleotide
actgagagtcaggagcactggaccatattcccagctctgctccaatttgctacataagtctttgctagtgggttaacttccttgaataccacttcccaaacagaaaatcgctttcataatcctttctcagcatggtaaggataaataaaatgatatctggtaaaactctgaaggactttccaggaaaaaaatagtttccagagatgatgatggtttttagaaacatggcactcttcctgaaatcaagttctcagtgatatgtctccaatggcaacttttattcagtttgaagcatgtaatattaggaccttacatggagaaaagcactggtgtgttgaatgctgttctcttaacaacaaaaaaataatgtccagggtagtgatcctcccttaggctggggaaagggaacacacatacacatcaaagtcactggggagatttgactaaatatgcaaccttacacctgttgttgtgtacatcagaatgggaaacgagaccagagagttggaaagctcacatttttaagcaccccaggtgattctgatacattccttggtcgagaaagattcttggcctcccatgagtaacctgattcaagatcttacattgtttttctgccaagaagttccttatgtgtactactcacctatttgttctttgtttagctctcactgaagatagaggatctcataagcatcttgcatatgtataaacaggggaatgtgaatagtggctatgttctcagggactgggggccagctgtttagaaatctcagcatccccagtgttgacataatctcctggccaggtgtttccttcattgattggagcagggcatggaggtcccagtggaaggctctctggaccctgggcttatccagatggatcagctacaggtggagcaaatgggacccatgggccccatcaggtcactttgctgagtatgagtcaggccagcagctctttatttcttcctgtctctcccacttcccaccactcatctctgtgggcagccgccaaactggggagcaagagtcaggcaggggaagggggtagttcttaatggatactccatctcttcagtggtttggggtctggcagagagaaaccagacctgacaaaaattga

SEQ ID NO: 8969 - DNA, 594 bp, artificial
  synthetic oligonucleotide
atttttctgttaattatcctttgaacctctgttgatgttgttttccaacatattttaagttattttttcctcttttgtcagagcgtcttcttctcttattagtatgttctgttctagtcttccaagacagaagcatttattttgtaaaaaaaatcatttctagaatcccattgcccttgaacttcgggaaatttgtatatatgtgtttgcaaatttaaaaccatgtgaactccatgacctgtcaccaatacagattggatatggaaggtactccttgcctaaactatagtttcagttatagattgaaaacctagagatgaaacttatatttctttagtatataaaaatgagaaccaataactcttttgttgagtttcctttttgacctcgaaggatgaactgatagtgttaagcagtgatgtggtgtgttggtaaacatttagtaactggcttcaggaggtgggaggtggagggctgcaaaagagccctgatttgtggcatctgctgattgccatagtataaatactcccatcacagccaatttcaagctaccagcttgacatcagtaaaagtagaattgggaagagatacaca

SEQ ID NO: 8970 - DNA, 528 bp, artificial
  synthetic oligonucleotide
tcctctgagtttctgtgtttggcccatgttctctctaggtggtctcaacccttctgatgacttttaccggcatctgtatgctgatgctttccaactctaaatctctaactcaacatctccccggggctcaagattcacatatcaaaaacaaaaaattgtccagtgaacatttccacctggatttcccataaccatcagaaactcaagatgctcaaaatgaaactcatcactgttctcccagaatcagttctccattatttttcttgattggtgaaccaaagttcacttgtcattaaagccaaaaacctgagcgtccttctcaactcctttttctttaaccaccatattgaatcagttaccaagtcctgccacttttaattctccaatcacttatcccttctctgtcgcccctgccttgccttaaaccaagcactcctcatctctagtatgatctgttacaatcatttcctaccagctttctctgcttctggtcttggcttttctaatctaacccactccaatcctatc

SEQ ID NO: 8971 - DNA, 531 bp, artificial
  synthetic oligonucleotide
tgattaaattgtacacttcatggtttccatattttatctggaggaaatgtttgcttgaatagagtttgagagatggagactaaggtacttctttctgttaagtgggagctgagagaggggaacatttgaagctgcagccgaaattccaaacttctaactgaagcaagtatccccatcaggcattctggactcagtaatgtcaggtgtgaagaaagccaacctcctcatattcccttgaagggccttgatgtttcaacatatcgcttgtttcaaattgagagtcacattcattctgactggttcagttagtgccctaacccagctctcccatcaccaagtctccctttcatggatatctactaaataggttccaatattgcattcagaagaatcctccaaagaaagaaaacttaaatgtgcacagtgatcattcggctgtaaaacatgttgaaatattggaatgtgcaactaaaaaggcgagttgaatctggtgggcctaaggaacagaaggatctgagaagcttgagctgg

SEQ ID NO: 8972 - DNA, 2328 bp, artificial
  synthetic oligonucleotide
accaaaagatattacaagtatcagaggaccaagaaaggaattaacagcaacaaaaagggttaaaataaaaatatatataagcttccttcctcgggctctaaaaatgtgcctcgtggtatccacaatatgtctggggttttgattagaggggagggaatggacaggaacggaatgaaaaagtacattctgttctcatctcacaacactgtgggaacaaaacctgctacccaaacgatttagtgtaactaaaactctgggttctcctattatagaggaggaaggaacacagaaatgccggaattttgacatttggaacgacacaaaggccacatgggctttggagaaagataaaggtgccacatggcaaaggccaaatctgagaatagtttagaggaaattagagttatcttccttgacacccaaatgaaactcaagattcttgtcctctaagccttggcctcaatcggtattctcaccgggagacttcaaagtgtggaggagctccagaatgtggaactagggtctcaggaggaaaaaaaaactccaaaaccctggtacaccttcctctctagaacctggaccatcatcccttttccttaagcatgggtgcttatctcagggctctctttgaacacgtgactataatcttccttatttactgtcattacctaggctccccttccagctcttgtcgtctcgcttttcttccatgatgggggagccagtcagggtggatgagtgggagagcaagcctgatccagcattggaaatggacatcagagacttcgctggccgcatgcacgacagctgctctgtcttgctcggctccttccgggaacgctgctggagtactttgatcatggcatccttctcaataatctgggcatggagggtcttaatcctaggagccaaaggcaaagaacatataaagaccttgttgtgggctgggcgcggtggcttacgcctgtaatcccagcattttgggaggccgaggtgggcggattgcaaagtcaggagttcgagaccagcctggccaacatggtgaaaccctgtctctactaaaaacacaaaaattagctgggtgtggtggcaggcgcctatagtcccagctactcgggaggccgaggcaggagaatcactttaacttgggaggcggaggttgcagtgagccaagatagtgccactgcactccagcctgggtgacagagcaagactgactccatctcaaaaaaaaaaaaaaaaaaaaaaaaaccttcttgctacctccacattttggtctaattgactacatgactacgtggagctcccattatcttttcgactaaaggctgatctagttagttctgagttggaaaacaagggatggtgtgctacagtttttaaaacatgttttttcttttttctgcacacccaaatggatacagcagagcatccaggagctgttgcttaaatcttagtaagtcacaataaagtaccagtgaaaaaaaaggctgaatatgagagaatgaactgatgtactaggtgctgtagtgaagaatctcagtcaatggaaacaatttactcagtgagaagatgagatctatgaatgagcgacaacctgcaggtagtaagtaaatgatcatgtgtttataaaaggaatcaggtatcctacctccactttgagtagatgttctttttgttgttgttgttgagacggactctagctctgtcgctcaggctggagtgcaatggcatgatcttgactcattgcaacctctgcctcccaagctcaagcaattctcctgcctcggcctcctgagtagctgggactacaggtgcccgccaccacacctggctaatttttgtatttttagtagagacagggtttcaccatattggccaggctggtcttgaactcctgacctcaggtgatccgcccgccttggccttccaaagtgctgggattacaggtgtgagccattgtgcccggccgagcagatgttcttttactcttttattaagcaatctgctgtatcacagggttgtggtgcagtgctagaaagaatactccagagtgcaaatgccaacaattcagctcaggcagagggaagaggaaaagcaattaggaaggccaaagggacagaaaccctacctggaattccatgtttagtggagattatcaaggtaaaggtcattgcatctcacacctttaagtgacaggctggcaggggtgatggtggagcggggaggctgcatgatcagatttcctagctgtgaataaagatcctatgtggtctctatatcaatgtctcagattcctcagggtccagaacaacattttacctgccc

SEQ ID NO: 8973 - DNA, 2179 bp, artificial
  synthetic oligonucleotide
attttcattcatctaaaactgaaaagtggtacagccagatgatttctgaagaccatttctagttctacaatatcaagatgtgtatttgtgtagcagcgctaattcttacagcgtctactgttcctggagttcatgtgaaaataaaaggtgcaagataaaaggcttaaaggatatttctgggataggaagctaaggaaacagactttgtattcacaattgggaggcactctggagtaagattaggtgggagaaaaatgtaaaaatgagcaagtgtgtgctttcagtgttcatgtcaaatgctaactgaaaaataagcaaccaggaataatgtcattttcttacttttttttccctttcttcctttaagttctccatacctgctggattctcagggattccagttccctctccagtcgtgtccggagacggtgctctagctgctcacgtttttcacatgctgcctggagctgtacaagggcctgctgcatcttctccaccttgtcaacgtacacttgcttctttttcagctggaaatccatgttgggtaatttgcaaggtgaaaggaaaaacagcaagcaacagggtcaattatgtatcccctaaatccagccttgtgtttagatctcttcttgttttagagtccagctgcaaaaaggaatggatggcgagaaggtccttcacaatgagtagcaggctgccttgtattgctcataaagagaatgtgaaggaatcgagaataccttttaaacctcttccttcttccctatctctataccttcccaaagtctactcttatcagtaccatctatgttagatggccaagtttttcagattcccaattatgcacatccttatctctggcctttttcattctcatatggattattcttgggaaggcatatcttattttggttattgcattaggcaaatgctttaaaagggtggatctccaggaagaaaggtttgctttggtatggaaagaaagcccaccccttttatgtagctgtctcttctccaagtgggagaaaaagggtgatcaactgctgaaggtacaagaaagtcagaattgtctttttgaagtctttggtcctggtaatcaccccatataatccatcactgctctcctggaaagtttctgcttctcaaaagtaaaggcgtcacgtgatgggtcaaaagcctttagtctccacatcgcctagcactgccttgctagttctttaggttatttgtgattgctacttcatgagcctgaattggagaccctgggctatagtctctcaacttttattctggaaccataaaagatcccgaaagcctcaaattaatgactcaaaagtgaaactaaatgagtcaaacattattattcctctttgcaagcctataagccatatccaaaagcaaatgtagaagcaagtagggaataagagtgtgagttctttgcaaccttgtagcttataagcaaaagcttgactatgcagataaaataatgagaaagatctcagagctctttaaagaagatatatatcttcttctttaaagaagatatatatcttcttctttaaagaagatatggggaaactgcaggcttcccaacttgttaataaataagcagattatgcttctcgtaatacttgtggggcctcctcaatgctaataaatcaactcatagctgtttccaaagcagaaattcttccaagtgggtcacatctgtcattattcttctgatggaagttgatgttagggatcaacatcaacttgatgttagagacaccttcactcttcagattaaaatatgaaaatattcttgataatctagtcaaaaagaaattcaggcatccgattctgacttttcaacaaattcccaagctcttgagttacctaggtagataactgcaacataagaagttacccaccctaccagcattgcctaacagccacttagctggggcccagctggcagaaccaacctgactccctcattgcagaaaccttcatggtaatgagtccaaatcactacttggtagaatttccagtcagacagcactagcatgtagtgatagaaaaaccctctttgtcttataatggccccctcctcaaattagaattgctgaactttctctaagtcgaaggaaccctatcttgtattttcctaccagacctgtagtatgccttgcctagg

SEQ ID NO: 8974 - DNA, 596 bp, artificial
  synthetic oligonucleotide
agagggaaaaaggaaccattatgaaatatgccagagcattctgttcttaacaaggcctgccctcaagagaaactatttaaccagaacctaatctatgagtttttgggattttgtttgcttgcttgtttgtttccagagcctaaccgacccacgggaaaggaaacatccaactccagtctgctctggccttccacacgagagaaggaaataaccagctgaagccctttctagtgatcctgcaccacctaaaggggtgaaaaaaaactgagatgcacttgtgaagttcagtccagaggcacaggctcactaaaagactgagacctaatcataggtctagagcacttccctttcccccagattttactatcacatcctgaaaggcctatttaccacagttgccttttaccccatacatcaggtctgccatttcacacacacacacgaaaaaacctacaagtcacactaaaaggtaaaatatacagtttgaaaagacagggcaagaatcagaaccagaccccgagataaggcagggatgctggaattaacagactgggaatttaaaacaaatatgattcatatgctaacggctctaataa

SEQ ID NO: 8975 - DNA, 1071 bp, artificial
  synthetic oligonucleotide
ctttttacagctacaaaatcattccaaacactttctcatggatacccaataacctacatcttccccaagagtcctcaaacctgtacaaaccctggattctgtcgctcaggcccatctatgcctctggtgtacccacattcttccaatcacatacatctgtcattataaataattgctgaatattgaagagggcatgcgaactatttgggcaaagaagaattgacatggtactcataagtacaactggaaagttgctgccatacataatatttttccccagagctcaaagcactcattcaatcaaaagcctgggagttatttatacatttatttggtgaagagctcctattttccattctatggatcttcagtttcctcacaggtaaaagactaagtgctcttttttctctttgaatgagagctattacaatttctacatgcctacagagttaaaatataatgtcctgagatttgttggggcttgtgtgtctcttttctgctttgtgggcagaaaagaggggcttaagtttcatgttctccaatgcagctctcaaattttaagggaaaaaaatcactatattaaccttcatttttgttcccaggatttgcagtccaaggcctgggaggtattctcttttaaagactgaacgcccagttctgaaatgggctttctctccacagctcccctgggcctcatcaagcaacccaggcctctctctcaaacaaactcagccactggcctccctcctgcctggagactgaaaggcccctgcattccctggacaacagcacatggccttccagggaccttgggaaggaggagaccatgaggtctccagaaggaggtctctggggtcagataagctgaggatgaagataagcagagacaaggcagctgcccctcaattccccaggctggaaaaggaagcagatctcagtgcaccgtgatgttgggaaaaccaaggcagcccgtcactggctggtttgcaaaccagcaatggcttgggcagtcacaaagggagagaaagcccttcagtgaagaactcaatctgggctccagcatccacccac

SEQ ID NO: 8976 - DNA, 1455 bp, artificial
  synthetic oligonucleotide
cattagcctctcctggcatttgagaaacaaaatatatgggagtcttcatgtgtcctcggtcagattctgacttagttcctccacatgggttcacaaagttaagtcttgggtgggctcttattgaaaagcaacattgtatatatctgtggctccaattatctaaaactcatgttagtacaggaaccaggacttgaaaggaactagaaaaaatgaaagcaggtgatctcttaggatgatggaattcttgaagttttggacagagtcttagcttcttaattttgggttgttaaaatgtaaaacataatgcatctatattcatatatccttacaggatctttttttctttaacatgatgactagatgattgaatttctaacaactgttgcacttcattctagtagcaatcattcacattcatactagatattgaggcctagaaagaaaaccataaacgtataagaactggctctcaaaattaccctgtccaaacccataatttacagtggaaaaaaaaaaacttaacagaggtagtaaaccgagttacagttgggcctagagcccaggtccttctcaccaataggctcactaggaaatcttattgcagattcttaggttaaagtggcatcagtcgccattatttactagaaataactttctggatccctgggttagtcaaatacagtagctggaaataaaacattttacctatatggggtggatagtctcatccttagaattgttcaaaatctataaagtctgatttattttcaaaaagtaatactagctttcttctgcaagcagttgtaggccagagctaacgtggccagcattattacaagccagaatgatttagacaattaactaactccattccatataacaaaaagatttcaaaggccaaataatggcctcacttaatttaagcgataatcattacaaattcttatgtattcctttatgcaataaatatgcttccgagaaggcccagttagagtgaatttttatatatcaagtcatagtttaaaggcactaactaggaaagctagtacttacaaagaaaacctgttgtggattcttttataaagcaaatgacctcctattttctttctttctttttctttttctttttttttgttcagattgtgtgtgttgtgtgtggaaggggcgacttccctcctttctctgggttaaaaggggtcagaagcccaccatggaggagagtaatgcagtatggccagcctgtttaatacccccttagttcctgggacaaaattctaacctttgacttgggggtggaaccctagaatttggaccaaagtccacaaaaggcagcaaggagggaaaagtaagtaagactaaagacaacacatcatagtaaaacaccaacaaaaattcctggggacaggaaatcaatggatcacaattctaaacaaattggtttagtccccagctaat

SEQ ID NO: 8977 - DNA, 4795 bp, artificial
  synthetic oligonucleotide
ctatttactaacatctttggatcttctaaagcagataggggcaactccctcctcaccaccactatcactaccaccacaagcactaccaccaccaccacacatctcaaagagtagccttgttttagattacacagactttaaaacttcaagaattcacggtcctacccctcctgctcccgcctcagggagtgtgagtccccaccccaagcctaagcacttagcagaaacctatctagttatctgagataagcactgacatgcatgctgggctaaatgtagatttcagcttccctcgggtctttagctcctcaatgtgattaattacctagagacccacaagaaccccaggaggtaaagaagtaaaagtaccatctagtagtggtacccactagcatctcctcaccgaagtaggacgggaaagcagcgcacactctaaccgatttaacttgctgcacatccaaaaaaactcatggcgagctgcaaagaaagtagaacacacgggcattcccacacgcgcctagatcgattcactcacgccgagggcacgaccaagttcatgccaccatggattcctgccccagttccccgcgaaaagtaaccacgcgtctcctacccctgaaggcaaagaagacaaggtgacgactctctgctcgctcaagtggcttcggtcccgggccagcggccagggatgggcaggggggaagccccaactcccggctgctcccctcctcgctgctccgtccgggctctccttggtggcagcggacaggcaggataccgggccagagggtggagcagcggatagccggaggcgagactgactggaggtggtggtagttgagggggaggcggagagaactaagagaagaggaggcgaaagagagcggagatggaggagtaattcagggggtctaccagtttaggcagccagaaagctcctcggaaggaaggggcgtgactgccaaggcagctcctgggcaaaggatgggaggtaggggagggggacgaacgggtggcttttcttcttgcggtgagcggctaggaccgccccggagcagggcggcgggaggggtggacgagggaggaaggcggagtagagggcggggaaagaagggcgggagcctgcctggaccctggaagtgaggagtgaggggagcgcggaagagaggcggggccggggggcgtggaagtttcaaacaattgaaccgcggggtccgggagctcgggcgaaagcaagggaccctcgctctcgccttcccactagaggggcacgactcggttgccgtagccgtgagagtctgcgcggggactggctgggaagaaggaaagggttttgcaaaagactacaataataatctgcggcaacagcgcggcatagacgcgtgggagagccagtgcagctccccgccccactgcgggaggaagaaaaacaaataatagaaatgctgaaaagcagcttccaccaaagcctgcttaaaataatgcaggaaggagaagcgctccttcgttttccttcccctcttgcttcctattaccagcaggcccccacccaggtcacagctctgcgagacaccctcctttcttcctccgctcccccgccccgggcgcttgcccccctcccgttggcgggccgcagaagctgaggggcgagggaggaggggtcgcgggcggcgctccgcggaggctccgcccctgggcgggctgggagcgccggcctgggcggagcgcgtccctgaagcgtaagtcccgcccaccattcttttgcagctaccggttggcccagcctggcctagtatacgcttgcgattgggccctggagtcgccagtctgatccctttgtcccacccgccctcaaaattaataaaactaaacaagaggctattgtgtagttctatgttctaccccagctactgctggcaagagaaagatgagacgctttatttctcagtctcataaaagagtgcaacagtgtgtcggccgactctggtacgcctttatgtttatggcactgtccagctttctgcgaataggtaacttttcttcccccttagtttattaaatcaggaggggggaaagtacatgaagtgtcattgtggtgttctgctgactgtgaaaaaagctgacattggttaaaaacgagagggttgagaacagcatcctgggacacggaaaatctaccattttacatctagaaaaacgaaggcacaaagaaacagtgtcagggtagcaaaataacatggaatttggaaccaaaggaagaattcatttggggccctggcacttactagctaattgtatgacttctgttaagtggcttaacttctcagccttaatttttctacctgtaagtaaatgctgtaagacatgccctattaacttaaaggcactggtatgaaaataaaatgtgtgtgaaaactataaagcactccacacatgtatgtgttcctacttgtgtgtgaaacataatggagagtcttagatgtgttagaggatcaatattttgctcatctgttttaagcatttacatccaaggtcgtgtaggttttgtggctttattttaaaaagtcaactcttttcctacaattttgggggtggatatgaagttgactccctgcagttagaataataaattaccccttttctaagcagggtgggtgagatttcttttttaaagttctacaatttcatgacaacttaaagctattgtggttctggtactgaaagaggaaatcatgctgtgtatctccgaagtgaacttaagaaaacaaatatgaaggaacatttaccatggaaaccaccattctctacagatccatatttcctagaaaacatttcaagtaggaagcaagcctaaatgtaaacgccttgacagcgcaaggccattataatggctcatgccaatgaaagagtgacatccaattcaagcctgcctaatgggagccatctggggggccatggatcaaggcatgcaagaggaagtgtgcttaaaggaaacactatcacacagtaaacaggggctcagaatccaactctgcaggaaaagtagtggactattgcatgtcatggagtgtgcagcatgctctgctaggagctgtggaaagattcagaagcaggagtgtgcacaaaatgattctcgttatgattctgtttatgtatgaagtgaggttatttgggtgatttttcatggagaaagtgagtttttgaatgttcaaaatatggagacacctggtttgtgaagcaaggaaaggttatttcagccttgttatttggagtggacaggagagctagatgtgggggggcgggtatatgctgcaggactactaccaatcacagaggcaaaaggatatttgttaaaatcaatgctgtccaagtgaaaaaagttaaacatgcacatggaagaattcagataaaacggtactgggctgggcacggtggctcacacctgtaatcccagcactttgggaggctgaggcgggtggatcacttgagatcaggtgttcaagaccagcctgatcaatatggtgaaaccccttctctactaaaaatacaaaaattagctgcacgtggtggcatgcgcctgtagtagcaggtactcgggaggctgagacaggataattacttgaacctgggaggcggaggttgcagtgagctgagatcagccactgagctccagctactcgggaggctgagacaggataattacttgaacctgggaggcggaggttgcagtgagctgagatcggccactgcgctccagcctgggtgacagagcgagactccgtcaaaaaaaaaccaaaaaacaccaaacaaaaaggtactgaaagactacagtgaaaagttcttctccaccactctgctcccatagtcccattctctttatgactgtatgtcatcttccaaatagattatttgcatattcaagcatgagtgcatattccctttttgttccttacaagtgggatcattaatcaaggcacaccttgcatttgtttactcaacaatgtatttgaaatattcttccatctcaggataactatgtttaccttatttattttattataactcaatattctattgcatagctgtgccaaaattcctttactcatccccttattaaatggggatttgggagacagacacggtggtggcacacgcctatagttccaactactagggaggttgagggaggagaatcccttgaggccaggagttcaaggtcagcctggtcaacatagcaagactctatctctaaaaaaaatggaagcaaatttgggctatttcccatcttttgctactacggaagatgctatttaaaaaaatcctggtaacaaaggcctggtggctcatttgtagtatgcctgcccctagccttgaagttgccttcaaaacacttttctaacatgctttcctttccccacagcgacttatactgtggagcaatggaattggagcaatggaaacctctaaaacacttaattcgtttaacatccgctcctcaaaccctgcttgggcattactcttctccaaattttgatggagtagagttagcagaactctgaacttaatggtgagtcaggctgtgtgtgagtcatttcttaacctgtggcaaacagctttttggtacttctgtttaacccaggtcttccaagccttctatcctgccatgcaagacttctttgttttcaccctgaaaacctttcagtttgtttaaaccgagtttggatttaaagctgtgcattgcctgcactacttaaaagagagggggagggggaggccaacatcaacaaacatcgat

SEQ ID NO: 8978 - DNA, 2686 bp, artificial
  synthetic oligonucleotide
catgcatgtattttctgagcttgcatgctcaccactggaatactctgacacacactaggatttatgggtgtacgtgctatggctatgggcctgttttgacagtgtatttgtgactttgtcactgcctcattcaccctccaccatttagatactgttgctattgccatataccttgaggatactacttttagatctttccctgagatagtgtcagatcactggagtcagctggtgttgcaaattattaaatgtaggaaggccaccaaattttggttttgttgtttgactttttataggtgttaattttgtctcccagctaaattgtaagccccttcaagttaaggaatcccaggcttacaagcaatgccccattaatgtttgcaaacatatgctatatctcttatggccattagtcctttatcttacacagccaaaacttacttgttggagaagttgtgcaaacaccatgatgggatttacggattcacaagtgaaagccggggaagagatagtggagagggaaagacaggtctaaggtttggataaccccatcaaaatgcaaatgtgtaatctggtaggggtagtgcattaaatcattgctaaccatcaacatacttgctagataaattgaccaagtgaatttgatcgagtttctatatgagaatgtgaaggagggagcaagttttgacttggatagggaggatgtcgtggaacacgaaatatgttaagggggtggcagggagaaggcaagctcatgctaggaggcttcaacatgcatttattcaagaagtatttattagctctgtgactacatagggtggaggagtagaatgataagaggagatgcgaatgcagatggcgtgaaagagaaaacagacaacctccttcacaattttgtcaaaggctagccctttccaaaggttatttttttctgtaaacatcttatctcttctttgttagtttgttttagaccatattgggcttctcttatcttcttgttccttatctgtttttgattcttttgcttgttcattgacaagcagggctgagagcagcctgtgagatccctggcttcctggaaacttttctctgcagtcacggaagacatttgctttgccctctaagctgccttggctgggctctggggatttacataaacagattatttgaggcagaaaatgaagcccatctcatcatgttttggtgttgcctacagactgggttgatgaaggggttaacttcttttcctgccaaggtcatcaagaagaaaaccatcctcggagacttgctaacattaacctgaggactaaagattagggttgtggagggacctttgagctacaacgctttcacagtcaaactgcactgaatcagaaaaaaaaattaaaataaggagcaaggccacttaaagggaaaagctcaaattttacattttttaagaagaaatgcatcttcgttccttttaggactagtacaaactctcacagaacgtgtctgattgcaataagacagtatttggaaggtggcacagtatcagaaaggtcacatataggctttggtgatgaaagacatgtttaaaacctggtgcacacttaatagctatgtggccttgatcaaagacacataactgctattgccttagtttcccaatctcaaaaatagatattcccatgtctatcttgcaggatttttagaattagagataacactgagaaagcactagcacagtgctctcacaaactaggtccccagtcagtggtaggcaataataatacaatattaatgatgtgagaatagtccaggttctttaccctctcagagatgggctagaaaagctgggatagaggaagagggtgccctgttcctctgcaagggttacatgattttcagagaggtaggagagattctgtcaagccagagaaataataaaacaaaaatgttttagataaatgggaagagtggccaggcacggtggcttatgcctataatcccagcactttgggaggccgaggtgggcggatcatgaggtcaggagttcgagaccagcctgatcaacatagtgaaaccccatgtctactaaaaagacaaaaattagccaggtgtggtggtgcgtgcctataatcccagctactcaggaggctgaggcaggagaatcacttgaacccgggagatagaggttgcagtgagccgagattgagccactgcactccagcctgggtgacagagcgagactccatctcagaaaaaaaaaaaaaaaaaaaaagagaagagcacactggatgaacaaagttacattgcttaacaggcagccctaaatactgaaatttatgggaagttcaactgtgggacaagtacttataattagtaacattaattttctcatagactctaaatatgctgaggcacttatagattgttctgttaaattgattaattctgcctcttgtttacactgatgagaagaaatgctttgctagacccagaaaatcaacactggtctgaataatcacaagttctgaattaatgggtttgtgacacagccaggtaaagctatgcttgattttcctttattcaaaatctcctgcttcacgacatattcttctttaaattgaggcaattcctatttaggcttctattatcagcaagtggcccatgggcattttttaaagttttttttttttaattg

SEQ ID NO: 8979 - DNA, 1122 bp, artificial
  synthetic oligonucleotide
ggatagtaaagtttcctgaaggctgaaagtgatctgcagactatccagcttataacgctctgcaggattacctttgaataattcccctaccgcccaccccagcagccctaaatcattacccatcatgttttatagagctccagagaggacttttgagacaattttgcaatgttaatgtttaatattccataaactattgtcagggtaaaataaaattctcttttctatttaacttacctttttagcctattttgatataaattttccctgaaggtggctattgctcattaagttcattcacattcttttgaaggttattaataaaaggcatgaagcttatgtttttaatctcaatgctcaattttcggtggtcatttacttgatcactcagcagcattggcacaaatgacctgttccttccaagttgtcctttctccacttggcctgttgtacacttcattattctgggtttctgtttgtttgtttgttttgtttgtttgtttttcctgctacctacgtcattagccattccttttcagtcttattttctggattattctctacttttccacccactaaatgttggagtgccccagggctctgtccttagacagtgtttcttctttatctacacttttttttttttttttttgagacaggatctcactctgttgcccaagctggagtgcactggtgccatctcggctcattgcaacctccacttcctgggttcaaacgattctcgtgcctctgcctcccgagtagctggaattaacaggcaggtgccaccatgccttgctaattttttgtgtatttttaatagaaaggtagttttgccatgttggcaaggctggtctcacactcctgagctcgtgatccacccaccttggcctctcaaagtactgggattacaggtgtgagccaccacacctggcctatctacactttttccataggtgatatcattcattggccttagatattatctacacactgttggctcccaaatttatatctccctcatagacctgttccatgagttccagactgatatattgcactgcccccttggcagctcaaacttaacacactcagcattgagcttctgaatctaccctctcc

SEQ ID NO: 8980 - DNA, 2839 bp, artificial
  synthetic oligonucleotide
ctactcaagtctcctgctgtggcatggaagcagccatagacaatacataaacaaatggatgtggttgtgttccagttaaactttatttacaaaaatgctgcagtgagatttggcccaggctgcagctagctgacttctaccataaaatcaaaggcctgggaataacatgctctaaacaggcaagggcaaatttagtatataacccagttttgcctttttacatgagcaaataaacccttctttagttagctctctcttcttccttcactccagttcttgcttcatagtttaaaggcagttttagaaagttccttgtagagtgttgaactctagtgggaattctacagctctaaaaatatggcatattagtcagggttctctaaagggacaggactaataggaaagatgtatatatgaaaggaagtttattaaggagtattgactcacacgatcacaaggtgaagtcccacagtacgctgtctgcaagctgaggaacaaggaagccagtccgcgtctcaaaacctcaaaaataggggtcaggcatggtgtctcatgcctgtaatcccagcactttgggaggccaaggcgggcagatcacttgaagtcaggagttcgagaccagcccagttaacacgttgaaaccccgtctctgctaaaaatataaaaattagatgggcatggtggtgcacgcctgtaatcccaactagttgggaggttgaggcaggagaaatgcttgaactcgggaggcagaggttgcagtgagctgagataccattgcatgccagccagcctgggtgacaaagtgagactccttctcaaaaaagaaaaaaaaaaaaaaaaaaggaaatccgacaatgcagccttcagtctgtggcggaaggccctagagtccccggcaaatcactggtgtaggttcaagagtccaaaagctgaagaatatggagtccgatgttcgaaggcaggaggcatcaagcacaggagaaagattgtattagcctgttttcacgctgctgacaaagacatacctgagactgggcaatttactaaagaaagaggtttaatggatttacagttccacatggctggggaggcctcacaattatggcagaaggcaaggaggagcaagtcacatcttacatggatggcagcaggcaaagagagagcttgtgcagggaaactcctgtttttaaaaccatcagatttcatgagactcatacactattatgagaacaatgcaggaaatacctgcccctgtaattcagtcacctcccaccgggctccttctatgacacgtgggaattgtgggagttacaattcaagataatatttgggtggtcacacagccaaaccatatcaaagatgaaggctggaagacagccagtctagtccttccatgttcctctgcctgcttttatcctagccacactggcagctgattagatagtgcccacccagattgagagtgggtctgcctctcctattccactgactcaaatgttaatctcctttggcaacaccctcatagacacacccaggaacaatactttgcatccttcaattcaatcaagttgacaatattagccatcacaaattgtgtcaccttaaagtcttttctagggtaacccaattaaataaacgattaaggatacactaagtgcctgctggaaaagcaaacttaagcctacataggtgactcagagtggcattctacccaacaccaactgagcttcagggggccctcatgaggctctacaaggatgttggttgcaaagagacttctgaatgctattatttcaacttgacctgtcctgattttcctactccaggctcagctggccttgaaatgtggtatagcaagaaaaacatgagtatgcatttcagctctaaaatgtagtagatgtatgacttggttacttatcctatctgtgcccccagttctgtcatctgtaaagtagtaatgatcaaagccatttcacgagattgttgtgaggattaaataatataaaacatatgaagtacatagagctcagtgtttggaaattacacatatataatttataataccacatacattttattatattttagctagatatagtatagctatgtatactatatctatgtattatatatttattaaattatatattatatattatttccaagcatatatatgtataactctaatatacaaattaactcaaaagtctgttttattcaattcttacttatctctgatttctgtaaccatggcaatgacttaactaaactgaaatacagttgacccttgaacaacatgggtttcaactgggcaggaccacttatatgcaaatttttaaaataaaagttgcaccaagtgtgcctgtctttcttgcctctccttccacctcctccatctcttccatctctgccactcctgagacagcaagattagccccttctctcctcctccacctcagcttattcaacatgaagatgatgaagaggctgaagtcctttatgataatccacttccacttgatgaatagtcaatatattttctcttccttatgattttataaataatattttcttttatgtagcttactttattgtaagaatatacagtatataataaatataacatataaaatatatgttaatcaactgcttttattattgggaaggcttctggtcaacagtgggctattagtagttcagtttttagggagccaaaagttatacacaggtttttgactgtattggggttggtacccaaatccctgtattgtttaagggtcaactgtattcaccaagttactaggtaatgatgttattctatactcctgaatcagtagat

SEQ ID NO: 8981 - DNA, 291 bp, artificial
  synthetic oligonucleotide
atttattgaattgtatgtttgatatcacagaaaaataaagatgaaagtgacacaattacttgcccttgatcttttcagatataagcatgcataaaattgtaattcacttccaaaaacttatcttttgaaacagacaacaccaaaacgagcaaacaaaaaagataactaagtttaaaataatcagaaagttgtctttgacacctttttcagataattatctcagaaattgtatatagtgtactttcaaaaccatattatttttctcatatctgtagaagatacagtgcttta

SEQ ID NO: 8982 - DNA, 841 bp, artificial
  synthetic oligonucleotide
taatctgctttactcagagtccactgatttgaatgttaatgccatatgaaaaacaccttcacagaaacatctagaattatgtttgaccaaatatctgggtaccatgatccagccaagctgtcatacaaaattaaccatcacatctacttagttttaaagttctgaaattcttcatacttaaatctctgagtttgctacttaaataagaggcatcaaactacttgatataattaactagaattaaaaatatagcatagaagcattaatgaaactccctttaagacatgttctataacctcacattagaacagcaatgtttcaattcattcaacaaaatattttcaaccatctaaaacctgccaatgcaacatcatgctgtacatggaagatgatatggagagcataaacaagcatggcacctgccctcatggtattatagtttggtaagctgatgtaaccagatatcaactaaaggttcacataaataaatgtaaagttacaactggaatgaatgctaagatgtatacagtacttcggaatctttttatgagacttctgtctgaatgattcgaaagcaacatttgagctgagatatgatggttgatgagacattaactaggcaaaagctttgaagaaactagtgtgtggtaccacctgtattgggaggaaacatggtgaatatgagtgtctgagagaaggctagtgtagttaggaaaaagcaagacatgattcaaataatgtagatgtatttacggacagaaccatcagaagtcttgatgagcatattaaggaatcttgccttaaccctaagcattaaaggaaaacactaaagatttttaag

SEQ ID NO: 8983 - DNA, 591 bp, artificial
  synthetic oligonucleotide
acatttcaccagtgatatgtgagggttctggtttcttcacattcttaccaacacttgttatcatcggactttaaaaattatagtcatccttatgggcattaagtggtatgttattggtagttggattgcatttccctaatggctaatgatgctggttatcttttcatgtgccacttgtctataaacacatcatttttggagaaacggctattcagataagttttccattttttgaattgagttgtttgtattcttattattgaattgtaagggattttttatatattcttgatacatgtcccttattagatataggatttgcaaatattttctaacctcagattgtgtgtaaaatggggaaatgggtgacctttgctctgtgggcttgacctgccattttgtcattagccattttggatccctatgtccacatctgaaaaagaagtgttcaaaattcatgctacatggtggtatcttatgggtacttgtggcaaaagttaaatataccacatattctggaggcagccattttactaaaacaattcaggcagataacattctatcaaaataatattttggttttacaaatta

SEQ ID NO: 8984 - DNA, 452 bp, artificial
  synthetic oligonucleotide
aaccaaaataccttcctctaaatgcccaacaaacacaataaaatataagttccccacaataatactttctccctctattatagttatcagtgaattatttaatgatggacatgattgtttggtctaattaaaatagccagactccccaataattggtatcttccttgtgtagagctaataggttaaaaaaattaaccatcaattttgcccagagtcatatagcagaaaaggcaaatttcacagtagaataatttgctcattcaacaaatactgtacatctaccttcagctggctactttgtcatgcactataaatataaagatgaaagaccagtcactgctttcaaggtttagtgggagaaaataatttcagaagattattatagtacacagtgacagaagtgagtgatgggtacttagtgaaagaagagtaagtgaagatgttgtttgtgg

SEQ ID NO: 8985 - DNA, 718 bp, artificial
  synthetic oligonucleotide
ttctctgggaggccacaaggagctctaggattgcaattttagccctcaaaaatagcatgagagatagtaagaaaacttctggggataacacagagggtggtggtattcaaatgagcacgtcagacttactcctttccttaaaactccaagatagaaagagccagtataaagtacatcaacctttcaggagacagataaatatgagggagaagagttcagaaaaagtagaatttaggattgaaaaccaaccaaaaccaaacttgaatgagagaaaaaacgtgaattaaccaaacaagtggaatacaatacatttgtatggaagaagttggtttttaaggccatgcaagcataaaattccagtattgatgaagaacatacttctggctccagaaatgcatcttgagcatgttaatgaatgtagttaaatacgtccagtatccaaacatcaaggaaggcctaatatacctggagaaagtgttgctgttactggtgtgactaagaaccacgggatctgactgcctccaaatagcatttccttccccactcaacctccacattctttttgacttccccattacccacatcttttcctgttctcttttacacattaaactagtcccagtaagggactagcagagggcttctgagagaggttttcctctggactgaatgaacctactacagaaaagcacagacagtgaggaggagggaagtcaga

SEQ ID NO: 8986 - DNA, 628 bp, artificial
  synthetic oligonucleotide
actttctaagcatggctttaaacgcaaaaacaatgaaagaaaatgactgatggattacagtatatgaacatgctaagcagctttgtgatgtgtgtccaaaaagaaaatcagcaaggctcaaatgcaaataactaatgttatgtattgtacatgcaaaaaactattatattattataaatccaagagataaaaattaagtcaatggaaaaatgcccaaaaggcatgtatggaaaatttgcaaaaacagaaaaagaaaaaaatacagatgaccaaaaaatggcataaacttgcttgatttcattgttaatcaaatacaaattaaaacagactgaataattgcctttcaccattttattggtggaaggatgaggaagtaagtgatctgatacactgctgattccagtataaattggtatgaacttgctgtggagcagtttggccatatgcataaaaattatatatggtcattgactgaacaattctataactagaaatttaccatatatagataattccattaaaaaagacaactttaccaatgtgcaaagattcatgtgcaaggatattcaaatacagtattgcttttagtagaaaatatctaaacattctatatcagtgtagttccaat

SEQ ID NO: 8987 - DNA, 216 bp, artificial
  synthetic oligonucleotide
gagagtgtggagaaaattgaaaccctagtgatgagaatgtaaaattgtgcagcttatatggcaaacagcataaaggttcttcaaaatactgaaaatagaacttctatatattccagtgattgcacttttgcatatagatccaaaagaattaacattagtatcttgaagaaatatttgcactttcatgttctttgtagcgctagttacaatagctaa

SEQ ID NO: 8988 - DNA, 1187 bp, artificial
  synthetic oligonucleotide
tatgttgttaaacataattcagtttaataagcattcattgagaactactgtgtacaaggattcaccgtagctctaagaaaaagtaagatgtagctcctgcctatgtgatactctcaatctattaggctagtgcaaaagtcattgcggttttagccattgaaagtaatggcagctgggcgcggtggctcatgcctgtaatcccagcactttgggaggccgaggagggcagatcacgaggtcaggagatcgagatcattctgactaacacggtgaaagcccgtctctactaaaaatacaaaaacaaaattagccgggtgtggtggtgggcgcctgtagtcccacctactcaggaggctgaggcgggagaatggcgtgaacccgggaggcggagcttgcagtgagccgagatcaggccactgcaccagcctgggagacagagcgagactccgtctcaaaaaaaaaaaaaaaagtaatggcaaaaaccgcaatgacttttgcaccaaccttaatagtaaggtaataagacaagtatgcaaatgactacaacaaaatgttgattaaattaagtaccaatagagagacagggacaaagttccaaagaggctcaaaggagcaagtttggtgcttggagttagcctcagaagatacaggaactttgacaagaaataaagacaataaaggcagatggaactgcacgaaccaaaacatgaagataagaaattgcaaagtgggtgtgaaaattcttagtggagaccaaaaacagagatttgagaataatcttctgagggacagaatataaagaagggatcctgggactgtcagcccattggtatacatgtctttaccataaattcattcctcattcagaagcaatgctgtatggtaaatcatggtagtgactaagttatgcataaattcatagaaagtgatgctggcagaagcatagcaagcaatgaaggaaaatccacatctgaattatgtttctattccaatgaagacaactctcgtccacaacccctccccaccatgatgataaatagctgacagagtctccaagatgtggagggggctcaggattagtcactgctattggttgccttgggactcaacggtgatgataagcaaaattgtgttggaaagtgaaagtctacgtaactgagcacatccataaactccatctctgctac

SEQ ID NO: 8989 - DNA, 7352 bp, artificial
  synthetic oligonucleotide
taacaaacttgggaaataaattaaatccactttccttaagaaaatcccttgaacatttgaaatcagctagcatgtaacccaagagtcatgtcttccagatgatacaaacccatctaacatgattccagcactctactgatctgaacattcttgtgaatgaattcccatcattctgataaatgaattccaatcttcattcttaaagtatgtgcctgaaaataccgtatatagcccaactgcattttgactctttttatgaaagttgcaaaagctcaatataaaattatgtttcccagcaaccagatcacactgaaggcttgttgatcttgatgtcaactaaaatcaataagtattttttcaccaaatgttcccagcttcggtgacctaaatttgtgcagagaagtttgatactcaaattgagcatctcacatttattactatttattactattaagtttcatcttggtcggttcaaactgtcatgatctttttgcatgaagggccaatttggtaaaacatcttttacatttgtattcaggtcattgaaaaattcgagttttagaagtccagcccttcttgaccattcatcttaacctcttgcataacaacaatggtagttatcattgttgcttatattctttgtgcgaagtattaggatagttgtggaaaaaaggagaagagaagcttatggttaaatgcttcctcctgagatccttataatttggttgagggaatagttcttacaaaaagaaaagaagggattcggtagcaatgagtgatgttgtgactcatttgaaataatgtaatgatattgatttacagaccagagaaaccaagcccattactttactttagacataactccgaaacaaggaaatgtttggttgcatggttatagctctaattattacagaaatgggaagtagaaatcataatggtctgaaagagtcagagtaagatatatgggtagcaagactactgggcttcagcgaccagtagtcttgagctaagaatgaacaagaaatcactgtagtcctggactttcaatctcagtttaatttaaataaaaggtcctaattgccatctttgttatcctaaactggaagagtgaaatgcatgcctataatacaaaatgcattcgtcataacacgaatgcgctccaagacaacacatatttccctacagaactgatgtcaaagtagctcctagctctttctcctttttgaggctacaagattccattcccaatccctattcaaacttgcatgcatgttgctattttttcaaacatatacttggttactggaaactacacaaaatacatattgtattactagaaggatgttagataaaattaattaaatacggttttttgcataaaagaaataagcacagatttttaattgtgatatacctttttttttccttagacgtggcagaaatatgtgatgggaacttccaactccccctcccaaaaagcttccagtctttttctcttcccttcaatgggaacttccaactccccctcccaaaaggcttccagtatttttctcttctcttcaatgagagcgtcagagaaccagtgttgattgttgtttttctctaaaacagaagatctttccaaacagaagtttcacttacagagactgacacgatcagagactgccccctgccttcctacacagcacacagagttctactgcgttatttttttattaaaaataatcctaccaactttaaaaagactgtgtataataagctatctatgtctaagatttttttctaagtctatgaccatgtttgaggcacagtaagggaaaagtcaattgtgttcgatgtcataaaagtttatttctaggtgtggcatgcctcaacgatggacattatggatctgatgctgggtttttacgattaagtagtaatagcgaatgctgaaaatataatttgatacaattgtattactaccaaaaacatatctggctatgataatttgctttaaaactgaaaaaatatgggtagaagtattatcaaaattccttgcatttatgtcctgtggtaaataagaaaaaaaaaaaaaactcccggtagaattcttgtgtagcttcttttgatctgtgaaaatacctgccttcgagaattttgctagaatcctgtcactcattttttaaacctgtctgtcatcctttaggtgtgttaaaatagggctctctggtcaagagggggaaataataatgagtagagaagtaaactttctagtcagtttatttttttaaaaagttcccaaagtttcaaatgatgaggaactttttcctacgtagtaacaatcttctttaattctttcccgaatttctaaatcagtagttttggaaacatatgtatttgtagtaggaggaaatcgccccggttcgaaagttgtaaaaacaagtccacagccttagaaaccgggaaatatttggaaaccgtgttccggggggcactggggattttaatcaaacctgaggaattcactgtaaataactcctctttccagggacaatttccatacacctgaggaacggaaaggaaagcagtgaaaaccctgggctgactccccaggcctcgttaggcaggggttccagaaaacctctctggcaatgacagagcgacagaaagcgccagcatgtgcttgttttgagtttgcttccccagtcctaaagtgcgccctaaatttctccttacactaaattctctggtctggtgttgccaaaatctccaaagtccgtcggaccttgcagcgctctgccgagccgcagcctagagaacctgaagaggcagtacgcgccgcaaatgccaagaaagcagagccttcggtcccggcggaacccggtaccccgagcctcgccgcggaccgctccggctcagtcttacaggctctgggccgctcggcgagcgccgctcaaaggctaacgtgcctgcttgtttctacccgacctccgaagcccagacgtgcttcagcaagccgcgtggctagcaaactttctctctgctgctgcgggaaccttcccaacgaccacgtgggtttcacccctggtcgctctcggcacttttgcctttcacaaggagaaggagagaacagcctttagagcgaaatatataataataaaaactattattaccatcatcctcatcctcataattgctattatcatggtcaatttctccaagccggttcccccgggagccggggagcgagaacaggttttggcggatgctaacttccactcgctgctcggcagatccattttggcttagcaaaaatatcacagggatttatatttacattttttgaagtaatataaatgtctcagcctctgacaaaataaatacgagtcccgccagaaaaggcaagactaagcattccacattcatagagtaaggggacacttggggagtttttaaagatgagtgcttaattatttaaagagaagacatacgttttctcttccatatttataaattactgttcgctaccaaagcatttctaaagatgcgagcgttgtgcagtcggtggacttggcagcgctgtcgcagccacctgtgcggcatcatacagcagcattcaacagatgcttcaagaaaactgcgatgggtttttgcttttcgaaacagaacttgggtgccgacagtatgttcactgccaaattaaatttcaaagcctgaattcagtggcgatggagggaatcagaggattcccaaaatgccccttttggaatagactggacagctcctttcacaaatatggaaacagaggcacagagagaaatgactgttcctagggcatccagaataaggaaggggcctgacccttatcattgcttccacttccttctccatctctaacttttggggctactgaggcaaacttcggccttcagaatagccggcagctcccaccccttttgcgttctgccgggttaggtcctccaagcctctctctgtacggcctctctgtagcctcttctatacactcgctgcgctgccgtccggtcctaagtagccaaaccggaggctcgatcttttgcttcggtccagctacctccgacaggcggggagccaatctccacttttcccaccccggtcctcggtacagggccgagaaacctcggccgcgacccgagaccaccacccccgctcgccccttcgttccctcttaggagagatctgcttctgtccccattctccgtgggatcatctccattactcagcttggttttggtgcctctgagccaagggggccccgttcacccttctctgcgctgccgccaggacaccgcaggcacctgcccggttgcgcctgggagcctgtgaaaaagagctctgcctgaccggttagagctctgcctgaccggttgcagctcggcatcccagcagttgccaaaagagagcctttgtggttcacctcttgctgccttgaccttgcattgacagcacccctccctcccccacaacgactgggcaaccgactggctgtgggcccaaggccctgtgccagagagatatgttcacccccttggaaacccgtaagagctgccctcaagttgtctttctaatgaggcctgtggggtcaagaaaggaactaaactgtgccttcccggggctcgaaggccaagagcttttctttctcctttggggttagggaaaggatggggagacaaggatggggaagtgggccttataacaggattgtggcctttgcgcactcaccaaatgtttgaccctgtgagtgcctcagttgctactgttggaagaatgggcaagagtcggaacagagacccttgaagggagtttcaaagcttgatgaaatttgcaagacttgagaatgctgtttgttgaaatgaaatgtacaggggtgtgtgtgtgtgtgtgtgtgtgtgtgtgtgtttggggaggggtatgctatgaatctttgagggtacattcttgagaaagccttccctctctctctatccggtgccatggctgatcctggttccccctactctctaggccttgtgaatcagattaatcatcacccccacccccatctccaccatggggtctcgcgccccctgccagcaggctccagatgcactaagagaccggtccaaacaggcccgggggccacgtaatgctgagtgctgattggctgctcttggctcctcccctcatcccgcttttggcccaagagcgtggtgcagattcacccgcgcgaggtaggcgctctggtgcttgcggaggacgcttccttcctcagatgcaccgatcttcccgatactgcctttggagcggctagattgctagccttggctgctccattggcctgccttgccccttacctgccgattgcatatgaactcttcttctgtctgtacatcgttgtcgtcggagtcgtcgcgatcgtcgtggcgctcgtgtgatggccttcgtccgtttagagtagtgtagttagttaggggccaacgaagaagaaagaagacgcgattagtgcagagatgctggaggtggtcagttactaagctagagtaagatagcggagcgaaaagagccaaacctagccggggggcgcacggtcacccaaaggaggtcgactcgccggcgcttcctatcgcgccgagctccctccattcctctccctccgccgaggcgcgaggttgcggcgcgcagcgcagcgcagctcagcgcaccgactgccgcgggctccgctgggcgattgcagccgagtccgtttctcgtctagctgccgccgcggcgaccgctgcctggtcttcctcccggacgctagtggtaagttggagccccgggcggcattgctagccgagaccccaacgatttaggcgggggatggggtggggagcggggacaggtcccggatggctgcagcctgcaggaccgcactggccctagcggaggttggggggagggactctgaacgcgcaaatcgcgaggagactgagtctctggaagaagagaggagcttaggttccacggaaggagcatagaagtctctaaggggattgggagcgggggctcgagatgaagacgctgggcggaggcgggggtctagagaacctggcgcgggggaagccgagacagaaacggaaggcgggggtggggtctcaagaagtgaggagtgggaggagagaaaggagggaaactgaacgcaatgtcgctgagtagagggtcgggctgcggaagatgcaactgagttgcaggaccgactacaattttaagaaatccgacagcaggcaagtgggagggggcgcaaggtttgggacagtgtgtgcagagggggaaccaaggatcctttattatgttctcattgaaaagcgaccctaatttttctggcgggtctcagcgaacatccgtaactctggggagataacacactgcggatctgtgtttggtctaacagctgttagctgaatttgaacagcgctgctggtgatcacgtaagcttaagaggagaggataaaggcatccagtgaacctttttttaaataattaattagcttatctaagtcatttggttactgttctatattttgaaaaggattgcgaaaaagtctccagcgctgcctcttattcctgtactcagttttacctgacaagcagtctttacagcgttcctcggaattgctaaacatgagaacaggttgccgttcctgatgtcacataaagttcgtcattgcaaaacgtgtctgtgtgtctgtttcttttctgcgccatgccctttgccttttgcttcctgttgggtagtatgcgacttgaggtgacaaacacttgcattgtgtttgagaaccctgtattttaagcaacagagctccccaactcataattcagcgagtgacattcggcagttaaaagatttggtctggaatcactgccagtaccgcgcagcttcttcattaatattaccagtataagtcccatccaaggaagcctctgattgctgagccactaagtgcatatgccccttacctcataccttttaggcaggctaaccgagggacgttcatatatggttgagctaagatgatttggggggcggggggtgaggaaatgcggcgcactgagtaacctctgagctccccagtttgcagacaattgcgacctcacatacacggtaatgaaaaaagatatctgggctccagagtttaaatttttcatgaagaagtttacgtacatatcagccattctgacaatcaaaatatgagtgcaatagaaacaaggtgttactgtgtagttggctacatatgtgtagagacaatgacaaaggccaactgacatgccccacagaaaatgatatctaccgtgatcattgcatctcttttgca

SEQ ID NO: 8990 - DNA, 1656 bp, artificial
  synthetic oligonucleotide
ggagttataataaatgtttgatcataaatgagtgctacaaggaaagcaaataatcgtgagggtatttattttctccagattgcacttttacacacagaacacgttgtaaacgttgttaccaggggtttcctctcacttttggtgtggttagggattggcagggaaactgaagtcctttcaggaaaatattcatagtcagtaccgtttactaattttttaaaaaaataagtgaattttaagtgttaagaaatttctactagctttccacatagatctgttgacattttttaagtgtatttttttttcagaaatacataatcttgtaggtttaagcctgtaaatatacagaggcacttttaaaagtgttaaatcagagatatgaacaactgaaaactaaccaataggagctggaaatagagttgtaagcaaatggttgggaatctgtcttttcaaatatactgcatgagaaatataaatcagtctttgttttattctgccagtcatattagaatattctacaccctcaatctataaagcactcaaaactttgaaaacttctgactaaacaaggagaagtaggaagaggaaaagaaaaaagcatatggaattgcttgacaatgtgctgaaatattaagctgcagacatctctgactaagtgtatgtgtaaaataaagaccaaatttgaaagtagattatttattttgaaaatgagctcaattatttcagggtctagaagcaaacacaacgtaaacctctactcatcgtgtatgtgtgtcggtatgtgttagtgtttaattaccactgtggcaaaataagagcatgatccaaattctgtgcctcatcccagaactttcagagattattgacaccttacagagtcattgtaaaggatcaggtgcaggaaggaaaattaaaatgcaaactcacactgacgtgcagagtgagtaaccagtcttagaaaacctgaaaagccatgacattgagcaaggcaaactgggttttaaacaggcaatgggaaggcttcgttttttgcaattgaaaaaaaagcaaaattcgctaagggagagtgagtgtaaacctaaaagaaaggaagcttaattgagacctacaagatggtgggtatgtcttttttccctgaggagctatgaaacttttcagggacagaaataataagaaaatagatctgcatccattgtggttcagggtaactgactgggctctttgcctaactactaggcaactttgcttaatgtagaaagaaatgactcaggttaaacagaatgcttcgctgatttttccaaacaaacccacttaaagaatttcagaaacagggagtttcctctcagatgagctagtgaaaacctactcatgccccaaacaatgtagtaaacacaaattgagagcgagcaacaaaatagcccgagagttcaatataatgtggaaattcataatttagaaacaaagtctgtcatttttaataccttcaaacaggaatttaacaatgtctgtcactgtccatctttgaaatgcagaggtatgagatgttatataaccaagatctttaggttagcaagcatatagatcaaatatgttgtaaatggaatccttgtacaattttaaaccttcttaaagtgataatttgtaatatgtttttga

SEQ ID NO: 8991 - DNA, 204 bp, artificial
  synthetic oligonucleotide
taatctgtcaatgactacaagccagccatcttaacatcaactgagaacaaaattctaaaaacaaattattcttataactttaagtaaaaaaattgaagaactaatttaagtgcatactatttgtctgcttagaaaatggtaaaatgataggaacttcttaaaggaatttctattcaaaatatcgttgcagacacttagattaaa

SEQ ID NO: 8992 - DNA, 1769 bp, artificial
  synthetic oligonucleotide
tgctgcaaacttcaaaatactgatgaaataaattaaagacccaaataaatggagagatatatcctgattatggattagaagaagaatcaatattattaagatgtcagtttgcccccaaatgatctgtagattcaacacaattgcaaccaaaactctcagcaggtttttttaatcaaaaagctgatcctaaaatttatgcagaaaggcaaaagaactacaatagctgaaacagttttgaaaaacagcacaattggagaactcataatactggaatttaggacttactgtcaagctacagtaatcaagaagaatggtattgttggaaagaaaagtgcatatatgaatggatataaatagaggatccagaaatcaacaaatataatcaattaatatttttactaaaaggcatttcaatggagaaagaatagtcttttcaacaaatgttggaaatccacattcagaaaaaaaacctgaattcatattttacaccttctacaaaaataaactcaaaatggaatatagagctaaatttaaaatgcaaaactactaaacttctggaagaaaacagaagaaaatctttaatgatattgggttaggccaagagctcttacctatgatgtcaaaaaccacaagccataaaaagaatgggtaaattggacttcatcaaaattaaaagcttttgctctttgaacaacaggattgagccaatgaagaaaagccacagattgataaagaatattcagcagtaacatattcagtaaacgatttgtatcctgaatagataaagaactctcaaaactcaaaataagaaaaatggctaattaaaaataagaagttatttgaacagacacttcaccaaggaagatatgtagctatcaaataaatagacaataaaatgtcaaaaaaaaaaccacacaaaacaacaacaacaacaaaccacttgctgagtgtggtgcctcacacctgcaatcccagcaccttggaatgcggaggcaggaggatcgcttgagcccaggagtttgagaccagcctgggcagcatggcaaaaccctgtctctataaaaaatacaaaattagctgggcatggtggtgtgtgcctgtagtcccagctacttggaggctgaggtgggaggatggcttgagtccagagcccaggaagttgaggatgcagtgagccgaggtcacaccactgcactccagcctggttgacagagcaagtccatgtctcaaaaaaaaaaaaaaaaaaaaaagaaaaaaaaaaacagtacttaggagtcttacagtagagaggctcaaaagcagacagttaccctgaaatatggcaaataggatgaaagagaattgtaggatcaaaaaaggtggtcaatttagtgtcagaaagcttcccagaggaagtgacatctaagtggggatctaaaagatatgcaggaattaatctcattacaacctgagtgacagagtaagacactgttaaaaaacaaaaacaacaaaaaaacaaaaacaaaaaaagcatttgtagtaattaaccaaaaggatagtaatcatatatctttaaggaaaaaaataaaaaatcattgctagtctaaatctattttcattataaaccgaaagcaacctcaaattgccccttaccattacatgatatttcaatatatatgttttcattcgtagagctatttgcagattaaagctaggttataaatatgagctcattcaattcctatacagataacagactttaaggctgaagttaggtgatcatgaagact

SEQ ID NO: 8993 - DNA, 700 bp, artificial
  synthetic oligonucleotide
tcctgtcagcctgaaatagtatggttttctaggtatccttgaaaaaaaatttcctctccatgcaaaataacccatggaaacagataaccctgcaggttaacaataatttccctatgttttcattttgatgtttatcaagctgttctaggaaacgtattctctaatctcttttgtatcactatttattattcatctcttggcagtctgtttcctgtcttcactataattgttctctctataatcaccaatgacctcttcattttcaaagatagagaaaatgtttcaaattctagatctctctgtggcatttgaaactgttgcggatgtcttcttcagaacactccttccctttgttcgtaatgacataacttttcacttacactgaattgttgtcatgtagctgacactcattttgcaaattttgctgctggtagttttgatctttccagaagatgtcaaaagaagttattcagaccagtttcacacatgtactgacaatgacaactatctaatgactagtttctggccaacaatgattgtaagacactatgggttgtatgaagcatcacaatttcaaagatgttaaaatctgaaagaaatgtgcctcttagaatcattggcatatgaccttatggtttggagagaactgatctgtgttgcttgaattcaaggttttaagaaataatgtaaacatatttat

SEQ ID NO: 8994 - DNA, 640 bp, artificial
  synthetic oligonucleotide
tgtcctgtagatggtttgtctccaacacttagcagcctctctacattcaacatgtattcattgagtattaatatttgcaagtaccagggctggtggctcatgcctgtaatcccagcactttgggaggctgaagtaggagaatcacttgagttcaggagtttgagaccagtctgggcaacacagcaaggcctcatccccaataaaaataaaaaaataattagccaggcactgtggtgcatgcctgtagtcccagctacttgggaggctgaggcgattgcttgagcccaggagatagatgctacagtgagccatgatcatgccactgcactgcagcctgggagacagagcgagacactctcaaaaaaagaaaagaaaaaaatttgaaggaattgtgttatctgttccagttgccaaactaggtcttacaactcccagctcttcagtcatgagatgtggcatgatcaccttaatttatctcttatatcaactggctttggatacctccaaaatcatcagagacatgatactaaaacaactctcttcttccatacctggaaccagggatgacagaatacgttgaccttttctttcaacatatatgctcttctgatgctgggtgagtgtagaaaatactggcatg

SEQ ID NO: 8995 - DNA, 1194 bp, artificial
  synthetic oligonucleotide
tatcaatacagccatagtaacacgtggaaagatttaagcaggggtgttgtataattggatttgcattatagaaaaattgctcaggggaaaaatccacactgtcacagaaggaagtttctattgtgctcaaatttttctggggcttaatttctattctcttaaccagtgtagcccctgttctgagtgtgggacgattaatctaacagggcctaaagaggaattatgacaatctaaatcactcaggggttaaggtataagagtcagtataacaaaatggcacagctgacccataagtagtaacttgaatcacccgagtcagtacttcaggtggaatagttcacaaagaaactcacacttgttatttctataagacaagagattgggacagtgtgtttcaaaactgttttaagttaataatgttctaactaaagaaatgaaaattttggccgggcgcagtggctcacgcctgtaatcccagcactttgggaggctgaggcgggcagatcacgaggtcaggagatcgagaccatcctggccaacacggtgaaatcccgtctctactaaaaacacaaaaaattagccaggcatggtggcggacacctgtagtcccagctactggggaggctgaggcaggagaatggcatgaacctgggaggcagagtttgcagtgagccgagatcatgccactgcactccagcctgggcaacagagtgagactccgtctcaaaaaaaaaaaaaaaaaagaaaagaaagaaagaaatgaaaaatttgaattttctctcataatttatttgaacttatcagtcttagaatcgattgtccaccaaattttctcaacctctttcacctcaagacatacattgaagaagctcattatcacaactgttttgaagaccctgcaataactgtaatgtagtgaccctcatgaccaatctacctgaagaatgttcattttacaaggaagtattgtcatgaaggcggccaactgtactagggccctgtcccacttaattgtcatggaatctatatgactccaatgtcataggaccattctttggtgccttaaattctttgtcatcttcaagttcctataaaatccctaataataattacacaagaaacaaaaatactatgaataatgtagtactttctatgtgctagacaccacatgcattatctcatgcatgtacaaaa

SEQ ID NO: 8996 - DNA, 1729 bp, artificial
  synthetic oligonucleotide
atgcagtattatcacattataggaaaggaacctgagctgagggaacccaaatcttttatcatagtaagcatgcctgccttttattctaagggagacattatctttattttattcaacattaagcatgattatcttttgctttggagagaaatactatctaatttgtccaaggatgcaagcaaatctgccctttgctttggtttgtttctgttttctttgtttgctttttaagacagtatcttgctttgtcgcccaggctggagtgcagtggtgtgatcacagctcacggcagccttgacctcccaggctaaagcagtgctattgcctcagcctcctaagtagctgggactacaagcatgcaccaccaagcttggctattttttttaagagacagggtcttgggtgggggcagtggctcatatctacaatcccaacactttgggaggccgaggagggtggattgcttgagtctaggagcttgagaccagcctgggcaacatggcaaaaccccatttctacaaaaaatacaaaaaaatagccgagtgtagtggcatggacctatagtcccagctacttcggaggctgaggcaggaggatcacctgagcctggggaggttgaggctgtggtgagccgattgtgccactgcactccagcctgggagacagagcaagaccttgtctcataaaaaaaaaaaggacagggtcttgctatgttgcccaggctggtctcaaactcctgggctcaagcaatcctcctgccttggcctcctagagtgttgggattacaggtgtgagccactgcgtccagtctgcactttgttttgaaggcaaacagtaggtttatcttgcaaagctgttcactgtaccaacatcattgaaaataaagttcagaacacagggcagttagtgtctcacttgtaagatgcgcagaaacatgaagccatggtgaactgtctttgaacagtaccattccttttccagcagggcttagaagttgcagcctaaccacggaaaacatacaaggtaaaatattcaaatatcttaatatcaaattatctgtcgtcctgcatttccagagtctgtgatagaggcaagcaaattctgatcctcaccttccaagcctcattctccatatttgccaggtagcatcctgacttgactcacagcctttatcatccatttgacaaaattccattaaacattaactataaactaagcatgagatgttagggtaaatcaaaagctcaaccagacaccaactctaggtaatatcaattcttattccactccaacaccaaataatacctgcttagatagtaacacttcagtgaaagaatgcaaaaagaatcacctccatttagttctactaaaattgtagtttctataatataaagctcttggggctagaccaatacagcatcatccttggggtatgtctcaaagttcacagaagtcttactgactaaaaaagaggggagatgaacactagacttgatctgaactgcatttctgaatctactactacctattaaatagtgccaaaatcacttaattcctatttcagagctattggtaatgactaaatattctgcaacaacctaaaatccctagaagaaataatcaatagaaatgaagggaaaattgtcaacttgtacataatgataggtaatgttcataaagatagaaaataaaatgatggaaattagaccattatattcatttcttgtaa

SEQ ID NO: 8997 - DNA, 1840 bp, artificial
  synthetic oligonucleotide
gatgctctttcacccctaacatcctaccagtttctatacatccttcaggcagcattcctcccctcccctattgcttgattcgcccctcacgttcaggagaacgggctgccccgactttgttagtctggcggtccccgcgcacccgcccagacccgcagagtccaacaacgcagccacgcagccacccactccccgcacctcctccttcacagccagcttcccctccccccgtcctgtcacctgcttgggtggtgtccgtcaggtcgtagccgctgcccgggaagtctcggagtttccgaccactgaggctcaggatgccggagctgcccgcctcttccagggcccggtccaggctcctcacggtgtgctgaggctgcaggctccccgggttccacggcggcccgttggggaacggctgaccgaaaagagtcggtaccgggatggggaccaccagggtcccgccgccgccgccgcctccccctccagccccgccacctccccctccagccgtgccacagccaccgctacttccacctccaccacaaccgccgcccccactgttaccgcctcctccctgactcgccgccatgttcctgggagagagaatagcccccgacaatactgtcagcctgtgccgcgagtgtaaggggttcttaggacgcatgcgcagactgggggcggggggtggggggcgaggtagagagtgggaaggaaccagggggcgggctgggaggaggtgttggatagagaaaagatgatgtttgaaagtgcagaacgcttgctttaagaaatgtatgataagaaggatgctaaatcccggttctgctgctttgggtaccaaagtcttgcgaaacgacaccaggcgaactataggtcatctgggctgtatgtccccaactctctaagttgcttcactgtttccgttctgcaaaacagaaacaaatatatgagctagggatgaaagggattcgtttcagaatatacagaaacagcacttagaagggctatggggcagcttattgagaagcttactgcaaatgcctcaggaatcctttaccagtgttagagaaacgctggggagtcacttggggagggaaatgagtgcagtgttgagtttggggcatatatgaatttctccatagtttagaattctataataggaaaagatttgtaaaatgttttcaaggaagcctctcgtttcaatgtatgtaagtctcagccagactgttgccttccaaaacttggaagagttatccacattctgttctatcactctttgaagttgtgccaagatctccaaaatacctctagtttcttctcatcgtgtcagtactgcctgatgaaaatctctttgatcatcaaacaatcttaagttatttctgaaatacaggttttgtttttagatggaattctgaagatttaaccctgggtattatgaagccaatcgatcttgaattttaggagttcattctcagaacctgaagatatttttaatgtagaagacatagagaagaaagttcaaagtcctttatctggcattccaggcctccataatttaaccccagactatctagccgagtttatcacccaaccatttaggccactgccatccctttacccactaccctctccactctcaatcatagtcattcaaatctttttctctagtattcagtaaagttgatgaagaaaactatcagaatgcttggacatattcacttatcattgagtatcctatgtatctcttttacacctatttcaatttgagcaatgtgtcaacagcctcattttttaagagaaatctccacttcaaaaaagtatatctgccataggctctact

SEQ ID NO: 8998 - DNA, 439 bp, artificial
  synthetic oligonucleotide
tgagtcagaaccacctcctttaaaaggaaatgttgattttaaacataataatggcctataatcagtctatcatgaggaaggattgaagtgggaaaaaagttttgatgattgacagagcaatacattaaaataagggattcagagtaaaacaatttgtctatttctccagtaccacacaagaaaggagattccattcttggcaacatcatccctatagaggcaatggatgcaattgattatcatagttggattacagcagcccattgagataattcagttcttcgtgctatctctaaaggagacttttatctgacggtaatgcttttcattgtgaacattgcctcccaagtctctgatgggtagactgtatgcattgtaactccctcccccatacatataaacactctgtaagacacaacctaagcagctagtgaggctc

SEQ ID NO: 8999 - DNA, 159 bp, artificial
  synthetic oligonucleotide
tcctatgaggatggttccgtttctgcagctgccacctcgtctttcataagaggagttataaaatgatactcatgctggggccacattccagacctgctaagtcagactctctggggatggggtccggcatttgctcttggacaaatgctccacgagaga

SEQ ID NO: 9000 - DNA, 1238 bp, artificial
  synthetic oligonucleotide
gggcaaagagatcagaaaaagagaaagcaaatgacacacaggcactcaataaatatttgttgaattttggggtaaattgatgaatgaacagagtctgaaattgaggaaggagaagggactaggagaaaagccagaagaaaagaaaatttaggaaagataaaaggaggaaagtagagagagaacaaagatgtggtggtggtggtagagttaaaagaacagaaattgagggggaaaaagagatcaaaggtagagggaaagggagcagggtagagatgaaaacagagattgagtcgagagaaagagaaaatgaaaaaagaaaaagggggtggtgatagtgcacacagggataaaggcagagacagatagaccaaggggcacgaaagggacatgaggagggatcaatgagtctagaggattatacaaagattcatagaagtgagaacaggagtggagaggatccagcaggggtagagagtcagtcagacacaaacataaaaaaatgctgccagaaattgcaaaaggctaagtaagtttagggaagagaatcatggccctaattgagggagatgagagagagactgagggacagagagaagagagtagagaaaatgacaagatcaaaggatagagacagagaggtgactaaagcagggggatgagggttaagaggggtgagagctgagagacaccaagagaaagacagctagagagagcaagaaggagagacagatgtaaagaaaaagggcaaattggaaagacagagtcaaaaagtgagacaagataagggacagtacaatgggagagacatgggagaatgtgagaagactaaagcactgacactgtgaagaaagttactgagtagaatctactagcaccctcagccttatgttttgagggacaggtcagctcatggccctgccctcatatggcaacctccttcatctccctcccttcctgatctcatagaacaagcaccctccccgtacctcacaaaacaacctctttttcttgttccatcccagagcaacctctccccctctcatgggctgtcacagcagcctgggttggtatgtggggccaaggcatgtgggccctgaaattggaaaagacagaagggttgttggagggactaaatgaaacaatccaagttaagcctttagtatagtttttggcacatagtaaatcttcaataaatgttagcttttcttattaaaattccagctctccaatttcattgt

SEQ ID NO: 9001 - DNA, 816 bp, artificial
  synthetic oligonucleotide
aaatcagtaaggatgaaaatcagaatcccagctctgccaattccggactgtgtgaccttgagcagtagtcctcttgggacaaccaaattttcttatttgcaaaatgcagcagttagtctaagtcccttccagttctaggtatctagttctgtctctctctcttccaaccccctttcctcctcacctaggaatgctttgaagaggacccagggcgcaagtggatggacagcttgctcagtaacttggggtgccagtctgcctctcatgtagggcccttcatcgatagctaccgctgcttccaaccaaagcaggagggggccttcacctgctggtcagcagtcactggcgcccgccatctcaactatggctcccggcttgactatgtgctgggggacaggaccctggtcatagacacctttcaggcctctttcctgctgcctgaggtgatgggctctgaccactgccctgtgggtgcagtcttgagtgtgtcctctgtgcctgcaaaacagtgcccacctctgtgcacccgcttcctccctgagtttgcaggcacccagctcaagatccttcgcttcctagttcctctcgaacaaagtcctgtgttggagcagtcgacgctgcagcacaacaatcaaacccgggtacagacatgccaaaacaaagcccaagtgcgctcaaccaggcctcagcccagtcaggttggctctagcagaggccagaaaaacctgaagagctactttcagccctcccctagctgtccccaagcctctcctgacatagagctgcctagcctaccactgatgagcgccctcatga

SEQ ID NO: 9002 - DNA, 564 bp, artificial
  synthetic oligonucleotide
agagatttccagcaggaaattatgtttggtaggagctgaacatagctttactccttttcaatggctctaagtcatctccaggggcatctctgacaacataatgctctcatacagtggtacttccaggcttctgagtttcatgaggcaaattggctctaaactgaatgaccccagactgttgttttatatctttactgggtttaggtcttatataagttttttgtagtgactctctccactctttccccatagccagcctgtctgcagtcaacttccattgcctaatgtggcacccctcctttcttgttctgctttgctgcttctgactatatcctggaaagttagagaaccaaattaaaatgttgagcttatggttgcggatttggccgctctgagtcccctggtttgcctttctttggggtttgtgctggagaaataggctctagataagagttggagtgttaccataccttgtaaccatgttcttttgcaaactgcaggatcagtgaccgtcgttctctggtagtgttggtggcatcaaaaacctagaggcaggtaatgaga

SEQ ID NO: 9003 - DNA, 1232 bp, artificial
  synthetic oligonucleotide
gcctaatgccagcttcgacagaggactgagtaccatcattggctttggcagtggttccaacaccagcactggctttactggcgaacccagcaccagcacgggcttcagtagtggacccagttctattgttggcttcagcggtggaccaagcactggtgttggcttctgcagtggaccaagcaccagtggcttcagcggtggaccgagcacaggagctggcttcggcggtggaccaaacactggtgctggctttggtggtggaccgagcaccagtgctggctttggcagtggagccgccagtcttggtgcctgtggcttctcgtatggctagtgaggtttcaggtaactgcaatatttccatagccaggacccacagggatgggtacaagagctgggagatgttgtaagaaacactaaggcaggacagcagggtggaaaggtgagggcaattaaggaattatgagaagacagtgtatttggtgctaaaatgtgttcctatttgttttgttttcagatttattccccatgtttacagataccgctaataaattgcagtagtccttcccatggagccaaagtacatccttggaatctttgtccacacagcagtcaaggcagttatggccaatcagctgagggtgtcatgtgatggaaaaatctgtttgctgttcctgctttattgtttgctttctgtgtgctgtcatattttggtatcagagttacattaaatttgcaaaatgaattggagttttttctgtcttttaatgtgcttaggtagttgtggagtggcatcttgggttcgtagaagagctggagatcagcatagctctttggagaatgtgggtctccagcttttggctcaaaggcaaatatgatttcagcaggatagaggcctggggaaagcatggcaggcaagaggataacaggttgaggaaagatatggagagggaaagcctggagcagaaggcaaacggagaggcttctggacagtaagtacagattgattttgaatcactggtgtaagaatggagggaagggcagaggtcactaggggtggacataagaacaagggagggtttaattgggataggagaggaaaacttgggcatattgtatagactgtggggcaaaagctaacaggaacaggagatagatatggaagagtcaggaattgactgaagtagcccatccctgagaaggtgggatggaatagggtaccagagaagacaacc

SEQ ID NO: 9004 - DNA, 177 bp, artificial
  synthetic oligonucleotide
ttcttggttttaccttttttttttgtccagatttataatgactatttcattcactactttgcccccagaggccttccacctatggagaagaatgtggtttttgttattgacataagtggcttcatgtttggtaccaagatgaaacaggtaacaaggatcctggagacctttcttagt

SEQ ID NO: 9005 - DNA, 2026 bp, artificial
  synthetic oligonucleotide
gaaatgagaacagacccttgttcatgtttttgccatctttatcagcctggaggccgttactgtgacgaatgaactcccacaattttcagttttttcttcagtatattattaagtaaattccaaataattgtagattgtatcatgtatcttccccttggctagtggtggccagagcccctttagcagctgctccacccatttttttttttattatcaccctttaagaagcctttttagacatttttatcctaattgtccttccccatgtagttttatttacacagatatactgtagatatctatttaataactatgtatatttgtgctttatacataaaaaataaaccttactctttttattcaatacagggttaataatgaataaaatatttaagtaaaaagttaatgtgaaggtaaatcaatgttgaactggtgcataacatccatcccttctactatgataattttgttcattggctcattgaacaagcactgggtgtctggagaagaggttgacagacttccacgggctgggtaatcatgcaccttttggtgagcactcacatgggacacaaatatccccacacaacccatcctgagagatctgtccacttgctcctcatatatatgcaggcaaatcaattagaactgtgccttgcacataatgagtactcttaagtattttattacatggtcattattgctatcaattctccaatctcattccttcccagtctctatctggcagacacaatctgtattgatcagtgcccctggccaagtcgctttctggacagagatcaacccacatgcatggctgttgagttttgactccgaagaggatttcctttttttacttcccgtcagggtcacacctgagtgcggctgttgcaccacagctcagcctccagctagttcctgcttaccatgtgtgtcatttgcaaaccatgctcctgggcttttttccttctttgggaagctggttgttgggaactcggtacaaggccctcggtgtgagctgagggagggcaagcaatgcggcaggagaaggtgttatggggagggtgagcctcccgtaactcacttgtgcctgcaggacctgctccggtctgatctcctgtgaccactgccctttggtgatgaagcattgtcattacctgcctgactttatggtttggtggataagatggcacaggcctagggtgagcagctcaggtgcatggtcacttggggtcccgtggttaagtgctcatactctaccaggagccagtagttcaaccttgttgaattaatcgtcaggtgccaggtgccacttctcaaaaggtgagtggttatttgatgaagagagcatggcttttgctccaaaatgctagaagctcacgctatgattctccagatggggcttctcacaggctccacacagcatcccaatctgtcagacatttatttgttccttcaactgccatgtatagtgactgcagggttccatgtagtgagcaccctgtgctgggtgctggggtgttcctgttctcaagacggccaatccggtgagggaaacactggcagcaccgaggggaaccataaagggctgtgggagcccagaggagctagtgatttcctcctctgtgtataggcgtgttgttaaccgctgatggcatgtgttaggaacatctgcacaggtgcataggtccaggcacacatttctatatgcggctataggcgtttcatacatacatttcattatggacatgagtcagcagtcagcgtgctctcgtggaaggagcccttgactgggaggaaggagccgtagggtaaactcccccagctcccttacatggtcccttgtgccctcggacacgtccctgcccctctctggcctcatatccaaagagcattggctcacccggcctgctctctgggggccgcactttagatagtgggtggggagcacccggaccgtggcctggtacatggggggtgctgcgcaagtgagagttacctcgacggggaggtgctttgtaaactg

SEQ ID NO: 9006 - DNA, 1486 bp, artificial
  synthetic oligonucleotide
atggagcttccctcttgtgctggaaacctcttttccatcttggaaatgcctctgcccacatctgggaagtgccatagccttgagtgaatttatttgtttatttatttttctttttcttctctcaggatacatcattcactctttggggacgtgaagaagctcatcactgatgagtttgtgaagcagaagtaagtatctctgtctggtgttcatgtgtcccatgcatttggcctatttcagaactgagtgataaagccgtggtgcatggatgcatgtgtctatgtgtgtatgtatttgcatatttgcatgtatgcaggtgggattattccttgggcggtgatgggaaacaggagcagcacatgtttcctgatctgttacatatacctcaacatttgtcttgagaccagttctgcaagggagggattatcattaccatcattgtacgtatgcagaaactgaggtttagagaggtgaagtcatttggtcagggttacacaggtagcaagtagaagagttatgtttagaacttggctccaaagccttagttctttttattctgctaactagagcttcatagaaattaatttccgtaaagaaatgacatagaatggtagcttcaggcaaccaggtaccatgctggggagttgacttgtacatctcatttcattttcataactaccctgcagctgtcatcccatccccgttttacagttgagggacctggggctccgagaagggagatctgagcatggcccacagctggtatgggcctggagcccagtcctcttgaatttctggccaaagctcacctatccttggtccttggaggacatgcaaacactcacacagccacacgcatgtgcacacagaaacacacacaaagggtcaggaattcagcatgtgtgaagcatgctgctattggctgttcttcctctgtagtctttctggtcattttctgtggtggacctttctgggcttggccaggctgaggccaagacacttgcagtggggtgtgctcagagcagggggcccaaagaatggctcctctgtttacaacacacccaacaggaatctggggtcattgtgatgagggcgtcaaacttgtggcttccctatgaacaaacgtcccccaacacctctatgtggcttctgggcaagaccagtgggacagggctcaatattggaagaaagactgtagtaattagtggatgatgttgccatctggagcctgtccagtctatgcatgggtaggccatgaatggtcttagaaataaaggctttgaacctctctttccaaggtacctggactatgccagagtccccaatagcaatccccctgaatatgagttcttctggggcctgcgctcttactatgagaccagcaagatgaaagtcctcaagtttgcctgcaaggtaattggagagctccttgagcttggcaagtcaagagcatggggtgcccctggctggggcaggctgtgtgcag

SEQ ID NO: 9007 - DNA, 1237 bp, artificial
  synthetic oligonucleotide
ttggaaaggatattctgggacttaaatcattggacaaagtatagtgtagtggttaagtctttggtatttgatattccactgactcgggttcaagtcctctctgtgccactcattggtcgccttgccttgggcaagttacccctctcacttttaatattgccatctgtgaaatgaggctaatgttcacacagtataaaaataaaccccttaagagcaagggccacctctggagaggtgtctaatacatagttggtgctcattttctgttgaatggcctaatcatagctcacaagcttgtgctgaggaaggactcaatatacagagaacaggggagaatgagggttagtccaaaagtgggtagcaggtttcctcatctatgggaaatttgtcttttgtttgacaaaatgtcatttttgctgtggaaaggtaacccttagggcttagagtgaaacaaagttaactaaattgccctacatataaaaggggaaaaaatgagatttcaccagcagctcaagaaagaagacataggccaggtacggtggctcatgcctgtaatcccaacaatttgggaggctgaggcgggtgaatcgcttgagtccaagaattttggaccagcctgggcaacatggtgaaaccccatctctaccaaaaatacaaacaaacaaacaaaaccccaaaaattagtagggcgtgttggcatgtgcctgtagtcccagctacttctggaggctgaggtgggaggatcgcttgagcccaggaggtggaggttgcagtgagctgggatcacaccactgcacttcaaccagagtgacggagtgagaccctgggggaggtggggggaagacagagagagagagagagagagagagagagagaggatatagaagcctggaaatggaaaggagagaagttgccagcatgttgggggacagaaagggtccaacaggggtggggcatggggcctaggagaaggaacaattattaggcctttcccagtggtgggaatggttatggaaatctgaagaacaagaaagtctgatgtccaatttaaagttgatttctatgctgagctgcatggtttaaatgactaaagaaatgacaggcagccttaaaaggaaacctttgctaccctctcccaaattttccaaaattcagagatacggattctgtatagtttaggagaaagtaaatgtgctaggataggattggtggtggggatattctgggctttccattt

SEQ ID NO: 9008 - DNA, 14490 bp, artificial
  synthetic oligonucleotide
tctgtaatatgtgagttcctgtctgtgagagagttgggcttgcacagccttgaaggtccctagggatattttgcctgggctgcaggaactccaagtattgttttaacctccctgtatagagtgagcctggggcccagctctttgctgccaggggctgggagttgcagggcctccctctcctcctaaaacctcctttctgctgttgctgggcagagcagggagaggaggagggaacctaagctgagtgagctgtttattcagaggggattggttacaccaggtacagatgccttgggctgtcctggatgtgattggctgctgactcccctcccccactccattcctccctctgcagagcctcggggctgggacagctgagggaaggggaggggaggggggctgggagggcccctcaggaccagtctcagctcagctcagggatgtctgtgctggctgagggtctgtgctaccctgaagctgaagcaggctctgcccagggccacaggcttttgctcctctctgcccttcagtcactctctgaccattaggctgtacactacctcttccctctgaagaggaaagaggagatgggaagacatctgctcttccccctccaccccagcctttgaattaattcacatgtgcaattgcagcctctgtctctgctaatcctggcactctggtacagttcaaaaaggcctgtgtcacccacattacaactgcccaagccaacagcagaacccagtggcctctgcacacctcccatacctgggccggtgagtgcttctgggaaaatcatgcttatctttccccgatcccatgcccaccagggcccccacttcctatcacataactcaagggcaggaccttgctcaccaacctctcccagtcactttagcagtcattccatcctacccacctgactcaggaagagaattaagagcatggagccagggacactttgattgcccaccccacccttctagagggtccacatcaccataaacctcctccctcagcctaaggaaaggaggtcctgccttggaccccatgcactccaagtgcccagcccctccagtactcctcaggtcccctctctctaactccatttaacatgtaccccactgggtcttcttgaaatatagaattttattgtcttttccatgcactaagactagctcttgtccccagtccactcccaaacttctctctagcctcttttttccctgaagcatcacaggctgagaaagtgggcaccctcaatgggctcaagtgcagatcactcctggggaccaccacagactggctactgtgcccaccccgcatagacacttcccttgctaaaggcaactgtgactaacttgcctccaaactcaatggctggaagatgggtgaagcaagatggtggaataaaagctccactgatcgtcatccccctaggaaggacaccaatttaacaaccatctacacacaaataagcaccttcaaaagaaccaaaagctcagtacctggttttaacttcatatcaatgaaagaggcactgaagtggtagaaagaacagtcttgaattgccaacaccacgcctaccccaccctccaactctgcccccagcagctgaggcacggtgggcaagagcatttctgtgtgttgggggagggagagtgcagctattgtgaggcattgacctcagtgttgccctcttagaggagtaaaaaaaaaaaactgaaccaaactcggctgatgcctgcatacggagggagcattcaaaacagccctagctacacgtgaattacccatgtcagcatgtcagctgttggcacttgagttcctgcaagcctcaccgccatggactaaagtgctctagggctctaaataaacttgaaagacagcctagacacaaggactgcaactcctagtaggggcctagtgctgaactgggcccagagacagtggacttagggggcacacaacctaccgagatagcagctagggcagctaagtgagtgctagcatcacccctcctctaaccccaggctccacagcttgtggctccaaaagagaccccttcattctgcttgaagactggagagggaagagtggaaaagacgttgtcttgcatcttgtataccagctcagctgcagcaggatagggcaccagtaagagtcgcgaggccccctttccaggccctaactcccaaaccacatttctagacacaccctgggccagaaggaaacctgctgccttgaagggaaggacccagttcttgctgcattcttcacctgctaaatgaagagcccttgggccctgaataaccagcaataatgcccaggtactacattgagggccttgggtgagactctgagacttgctggctttaggtgatgcacattccaagctgcggtggctattgggagagtgcttatgttttacaaaagtagaggagaaagtaaattggacactgtcttgaagcttaagtaccagcttggccacaagggtatagagcaccaagcaggctcttgaggtcctagattctaggcatgggctcttggatggcctagaatccaacttccgggcctgccctaggccagagaagagcctactgccctgaaaggtgaggctaaggataggcagcgtataccacaagctgactgaagaacctttgggccttaagggaaaatcggtggttgtctgtcagtactccttgtgagcctgtggtggcaatggccatgaggtgaggctcttctgcctttgaaaagggaaaggcagagtgagaggaagtgtatcttgtggtttgactgccagtttaccagcaggacaatagaacaccaggtagaattctaaggagtttgactctagtctctggctcctggatggcacctctggatccacctagggcctgaaggaactcactatcccaaagtgaaggacacaggcctggttgtttttgacactttctgattgtacagccccagggtcttgagtgaacataggcggaagccaggatgtggttacagcaggctttgggtgagacccagtactgtgctggcttcaagtctgacccaacgcagtcataggtggtggccacaggagtgcttgtgtcaatacaccccctgcttcaggtggctcacaacagagagagagagagagagactctgtttgggagtaagtaaggaaagcgaattagtctgcctggtaatggaaagaattctcccagatattgtccaagaccatcaagacaatacttctatgagtctgcaagaaccacagcattacgaggcttggggtgacccctaaagcagatgcagcttagatcacaacatgtatgtacatttgaatatctggaaagtctttccaagaaggacaggtacaagcaagctcagactgtgaagactataataaatacttaactcttcaatgtccagacacagaagaacatctaaaagtatcatgacaatccaggaaaatatatgacattaccaaataaactaaataagtcaccagggaccaattctgaagaaatagagatatgtgacctttcagacacagaattcaaaatagctgtgttgaggaaactcaaagaaatttgagataacacagagaaggcattcagaattctatcagatgaaagtaacaaagagattgcaatgagattgcaataatttaaaagaatcaagcagaaattctggaaaatgcaattgacatactgaagaatgcaccagagtctttttttttttttttttttgacagagtctccctccgtcacccaggctggagtgcagtggcacgatgttggctcactacaacctctgcctcctgggttcaagcgattctcccgcctcagcctcccgagtagctgggattacaggcatgcaccaccatgcccggctaatttttgtatttttagtagagacaaggtttcactatgttgtccaggctggtctcaaagtcctgacttcaagtggtccacccgtctcagcatcccaaagtgctgggtttaaaggcatgagccactgcacccggcctgcacctgagttttttaaaagcagaattgttcaaccagaaaaaacaattagtgaattacaagataggctatttgaaaataaacagtaagaagagacaaaagtaaaaagaataagaagcaatgaagcatgcctacatgatctagaaaatagccacagataggcaaatctaagagttagtggccctaatgaggagatagagaaagagataggggtagaaagtttattcagagggataataacagagaactttccaaactgagagaaagatatcaatatccagatacaagaagctaccagaacaccaagcagattttacccaaaaaagactactttgaggaattttataatcaaactcccaaaggacaaggataaagaaaggatcctaaaagcagcaagagaagagaaacaaataacagacatctccaatatttctgtcagcagacttttcagtggaaacctttaaggctgagagagtgtcatgatgtatttaaaatgctgaaggaaaaaactacttttaccctagaatagtatatctggagaaaatatccctcaaacgtgaaagagaaataaagagtttcccagacaaaaaagagctgagggatttcatcattgctagacctgtcctacaagaaatgctaaagggagtacttgaatcagacagtaaaggatgttactgagcaataaataatcatctgaaggtacaaaacttactggcaatagtaagtacacagaaaaacacaaaatattataacactgtaacagtggtgtataaaccactctcatgcttaagtagaaatactgaatgatgacctaatcaaaagtactaactaaacaacttttcaagacatagtacaagaagttacaaatagaaacaacaaagaaataaaaagcaagaggatgaagttaaggcatagagtttttattagttttctttttgtttgtttgttagtgcaaacagtgttaagttgttatcagcttaaaataatgattaataagatagtatttacaggcctcatggtaacctcaaaacaaaaaacatacaacagatacacagaaaataaaaaagtaagaaactaaatcatattaccaaagaaaataatcttgctaaaaggaagacaggaaggaaaaaaaaggatgagcagaccacaaaaagtaggaaaaccaataacaaaatggcaggagtaagtccttacttgtcaataatcacatcgaatgtaaatgggcttaactctccaatcaaaagacatagagtgactgaatggattaaaaaaaataagacccactgatctgttgcctataagaaaaacatttcatctataagacacacatagactacaaataaagagatggaagatgatattccatgccagtggaaacaaacaaaaaagatgaggaggagccatacagagaaaaaatctataagaagagacaaagaaggtagcaatataatgataaaggggtcgatttagcaagaggatgtaacaattgtgaaaatatatgtacccaacactggagaaccaagatatataaggtaaatattattagagctaaagggagagatagactccaacatgataatcgctagagtcctcaagaccccacatttggcactggacatcttccaggcagaaaatcaacaaggaaacatcagacttaatctgcactatagatcagaaacctaatagatatttatagaacatttcatccaatggctgcagaatatgcattcttttcttcagcacatggttcattctcaaagacagacgatatatcaggtcacaaagcaagactcaaaattcaaaacaattgaaataccatcaagcatcttctctgaccacaatggaataacactaaaaatcaataacaaaaggaactttggaagatatagaaatacatggaaattaaacaacatgctcctgaatgaacagtgggtcaatgaagaaattcagaaagaaattaaaaaatttctcaaaacagatgacaatgtaaagacaacatgccaaaacctatgagatacagcaaaagcagttctcagagggaactttatagctgtaagtgcctacatcaaataagaagaaaaatgtaaacaacataatgatgcatcttaaggaactagaaaagcaagagcaaaccaaaccctaaattagtagaaggaaacaactaataaagattagagcacaaataaagaaattgaagtgacgaaaacaataaaaagatcaaggaaacaaaaagagttttttttttaagtttaacaaaattgacaaacctttaccccgactagttaaaaaaagagaagatccaaataaataaaatcagatgagaaagtagacattacaaaatgatactgcagaaattcaaaggatcattaatgcctactatgagcaattatatgccaataagttagaaaatctagaagaggctagagaacccagaaataaggccacacacctgcaactatctgattttcaacaaacctgacaaaaacaagcaatgaggaaagagtttcctattcagtaaatggtggtgggataacaggcaagccatttgcagaaaaatgaaactggaccccttcctcataccatatacaaaaattaactcaagatggtttaaaaacttaaacgtaaaacccaaaactataaaaaccctggaagacaatctaggcaatagcattctggacataggaaagggcaaagatttcatgatgaagacgccaaaagcagttgcaacaaaagcaaaaagagacaagtgggatccaattaaactaaacagcttctacatagcaaagaaaaccatcaacagagtgaacagacataagaaaatgtttgcaaactatgcatctggcaaaggtctaatatgcagcatctataaggaacttaaacaaatttacaagaaaaaaaacaagcagccacattaaaaagtaaggaaaggcatgaacagacacttctcaaaagaagacatacatgcggctaacaaccatatgaaaaaaagctcaacatcgttgatcattagagaaacacaaatcaaaaccacaatgagacaccatctcacaaccagtcagaatggctactgttaaaaagtccaaaaacaacagatgaaggcaagattgcagagaaaagggaatgcttaaacactgttggtgagagcataagttggttcaaccactatggaagacagtgttgcaattcctcaaaaacctaaaatcagaaatagcatttgacccagcaatcccattactgggtatataatcaaaggattgtaagtttttctattataaagacacatgcacatgtatgtccattgcagcactatatacaatagcaaagacttggaatcaacctaaatgtccatcagtgatagactggataagaaaatatggtacatatacaccatgaaatagtatgcaaccattcaaaacaatgagattatgtttttaacaggaacagagaagaagctggaggccattatccttagcaaactaacacacgaacagaaaaccaaatactgcatgtcctcaattatgagtgggagctaaataatgagaatacatggacacatagaggggaataacacacactggggcctgtcagagcaccctctggagggtggtaggagagtgagaatcaggaaaaataactaatggggttggacacagtggctcatgcctgtaatctcagcactttcagaaactgaggcaggcagatcacctgaggtaaggagttcgagatcagcctgaccaacatggagaaaccccatctctactaaaaatacaaaattagcagggcgtggtggtgcatgcctgtaatcccagctactcaagaggctgaggcaggagaatcgcttgaacgcaggagaccgaggttgtggtgagccgagattgtgccattgcactccagcctgggcaacaagagcgaaactctgtctcaaaataataataataataattaaataaaaataactaatgggtactaggcttaatactggggtgacaacatggggtgtctgtaaaacaaacccccatgacccacatttacctatataacaaacctttatgtgtacccttgaacttaaaagttaaattaacaaaaagaaaatctagaagaaatggacaaattcctagacacatacaacctaaccatcactgcagcatgaagaaattcaaacatgaacagaacaataacatgcaacaagaacaaagccatgataaaaaaatctcccagtaaagaaaggcccaggacctgatgacttcaccactgaattctaccaaacagttaaagaataactaatacaaatcctactcaaattattacaaaaaatagaggatgatggaatacttccaaactcattctacatggtcagtattgccctgataccaaaaccagacaaagacacatcaaaaaatgaaaactataggccaacgactctgatgaatatggatgtgcatgtcctcaacaaaatactaacaaacttaactcaataacacactcaaaagatcattatgaccaagtgggatttatccctgggatgcaaggatgggtcaatatatgcaaagcaatcaatgtgatacattatatcaactgaatgaaggacagaaaccatatgatcatttcaattgatgctgaaaaagcatttaataaaactcaacatttcttcatgacaaaaaccttcaaaacactggggatagaaggaacatacctcaatataataaaagccatatatgacagacccacagctagtatcatactgaatggggaaaaactgaaagcctttcccctaaggactggagcacgacacggatgctcactttcaccactgttattccacaaagtactggaaggcctacctagagcaatcagacaagagaaagaaataaagggcatctgaattggaaaggaataagtcaaattatccttgtttgcagatgatatgatcttatacttggaaaaccctaaagatcccacaaaatatattagaactgataaacaaatgcaggaaagttgcaggatacaaaatcaacaaaataaaatcagtagcatttctatatgccaacagtgaacaatctgaaaaagaaaattaaaaagaaaccctatttataatagccacaaacaaaattaaacactaggaattaacttaaccaaagaagtgaaacatctctataatgaaaagtataaaacactgttaaaggaaatcaaagaggacactaaaaaatggaaagatattccatgttcatggattggaagactcaatattgttaaagtgtccatactacccaaagcaatctacagattcaaagcaatccctatcaaaatcgcaatgacattcttcacagacattgaaaaaacaatcctaaaatctaaatggaaccagaaaagacccagaataaccaaagctatcctaaaccagaagaacaaaactggaggaatcacattatctgacttcaaattatacggcagagctatagcaacaaaaacagattggtactgggatagaaacagacacatagaccgatggaaaggaatagagaacccagaaacaaatacactaatctatagtgaaatgattttcaacacaggtgccaagaacatacattggggaaagaacagtcgcctcaataaatggtgctgggaaaactggatatccatatgcagaataatgaaactagacctctctctcaccatatacaaaaatcaaatcaaaattgattaaagacttcaatctcagacctcaaactatgatactattaatactacaagaaaaccttgggaaaatcgccagggcattggtttgggcaaaaatttcttgaataatgcccaataagcacaagcaaccgtagtaaaagtggacaaatgggatcacatcaagttaaaaagcttctacactgcaagggaaatgataaacaaagtgaagagacaacccacagaatgggacaaaatatttgcaaactacccatttcacaagggattaataaccagaatatataaggagctcaaacaactccataggaaaaaaatctaaaaatccaatcaaaaaagggcaaaagatttgaatagatatttctcaaaagaagacatacaaatggcaaacagacatatgaaaaggtgctcaacatcactgatcatcagagaagtgaaagtcaaaaactacaatgagatatcatctcacctcagctaaaatggcttctatcccagagacaggcaataagaaatgccggcgaggatgtggagaaaagggacccccatacacagttggtgggaatgtaaattagtagaaccatatggagaacagtttggaggctcctcaataaactaaaaattagggcttcatcatacaatccggccattccacttctgggtatataccccaaataaagaaaatcagtgtatccaagagatgtctgtacccttctttttcttacagtgctgttcacaatagccaagacttggagacaacctaagtgttcatcaacagacgaatgtataaagaaaacgtggtgcatatacacaatggagtactattcagccacaaaaaagaatgaggtcctgtcgtttgcaacaacatgaatggaactggagatcattatgtgacttgaaataagccaggcacagaaagacaaatctcgcattttttagatcactcatcagtgggatctaaaaaatgaaagccgttgaactcatggagatagagagtagaagagtggttaccagaggctgcggggagtggggtagcggggagatggggggtggggaaggcagggatggttaatgggtacaaagaaaagtgagaaataatggataagacttagtatttgatagcaagacagggtgactatagtcaataatactttaattgtacatttaaaaataagtaaaagagtattaagtggattgtttgtaacacagggatacatgcttgagggaatcggtaccgtgtgatgtgattattacagattgcatgcctgtaccaaaacatctcacttaacccataaatatatacacctactgtgtaccctcaaaaattaaaagtaacaactttactaaaaaacaaacccaatgtctgtattttgagtctcttgggactgccttcccggcccatgaatgtcacagttgaacatggatgacttctgctgtcttcaaaagtcgtttcccctgcgatctgcgacagtgaactctccttattctcctaccgcctctgtctgcccactcccttcgcagtgcttcccattatttgtcaggtcaaagcatgaaaagaaaatgattatgctggtgcagctcagtggagtgaactgctggggactggggctctgggcagctgtgtgcagttgatggggcagctgagggtatccatagctgctggattgggctgcttcaccttagctttgccttcagggattttcccttctggctccacacatgctccctgggtgacctccctttgtcacttggcttccaccacagaacccctatcaatcactctgcatctcttctcccgtctagggctcccacagttgcccctcaccagtgggtgcacactcactgttggacatgtgccccaggatgtttcaagaagcctctgatgcatcctgcccaagcagtgaattcgttgtactgcccccacgtggcccttttatgccttcctggtcaggggcaccatcatccacatggtcactctggagacaaatctgagtgttgccttcaatcctcgggtggcccccattccccacagccaatcagcctcctgttgcttttctctgctggatacttctccaggccaccctcctcttcatccctaactgacaaagcccaagctcaggcctcattcgtctcaggtttccttcttctactgcgacctctcccatccatgctgcttggaggcagtggctgggaccctgtaaacacgacctcacaatgtcattttatctcatggctccctggtcacctacaggacaaatcccatgttcctttcgttgccctgcaggactctccagccttctatgtggctctttgggtttttcatctcaaatctctgctccagaacgccaagctatttgcaattccatacacacgtttggtgagttttagcctgtttcttttctcgtgcggcccccactttgccggaatgcctttccctcccacaggccccctcccatggcccacttttattcattccgtaacacacaggtcagccttggttgccttcagggagccttctggaactggctttcctcttcattatggcttccatcttaccttgtgtgtcatggaaagggcacttctaccttagtgtcagtattgggtttctgcatctcactcagagacgataagtaggctgtgtgtgtgatacccttccgggttcccaacgttggccaactcaaggtatgacacagattaggtgcccagtgagccccagcggggtggatgatctgatgatgtgctgggctttgaacgaagggcacactcaagtaggaagtgggggatgaactgagtgttcctggcggggtgtcaggaggggtaagggctcacggtgcatgggagttcctggttgtactagtcaatgccttccatctgtatttcaactgcaggcagctgtgttaatggtaaagaataaacctgcagaggcatacctccatgagctaaacacacccacatgacagaacaccaggttaaagcccctgctgccacctgctggcaaggtacccttggctcctatcctggcaggagaataacttttattcctcctgcacaacagactgagccacacctctgtgcctctgcacatgctgttccttctctctgcatgtctttcccttcacctgactgactgacttgcagatatatccaattcatttttcccatgcttacttaaattccaactcctttaggatgacggccctgaaaccctcctccactggcacctctgcagaatccatgacacactcaaacacagcacctagaacatttgatgaccgacaaggctctgtgtatctgggtgcttcaggatggggtgatggcagagggagatgagtggctgtgtccgactcacttctgagttgtcagagtcaatgagtacaggactggcctagttcacatattcattcaacatatgaatgaatgaatgttgcatgagaaaacgttcaaccataggtcatttttagtccagggcagacaaacgaattgttggtggactggagtcatcaaggaggaggtgtttcggcagtgtttcaggaacacgaggatgctgagcagtggagcaaggaggaagaagtcattctcagggcagcggccactatgaacaaatcctcacacagaggagaggcaggcttgggtgttttggagaaaggtgtgatatggtgtggggcagctggagggtggtttgtgtgctggggttgagagtcctgtggtgggagaggcagagtggaaccagatgtctcaggctaccccgccatccttgtgctcaagccagggccctgggatcggtgctctgtgctttcccatctgggagagtgtgggacctctgctctttcttcatgaatgtggaaactcagaactgaaggactctctgtttaggcagatggctccactgaagcaataaggattgttaaaagccgagagagagcaaggaagcccaagagaacacaggagagtataggagctgcagaacgcgtgagaatccataagcttaggtgcccaattagtggccaagggtttactttgcagaaggactgttttcgagtaggctatgacttgattcagttagggatgggtcctttgggcacttgattcactggagacagttccaggtctccaaccctttgggggatttgatgtgcctcccaaagttgaagccgtgtgtcttttcacgtcagcctatccttgttccctagcccttgcttatctctagggaaactggtgtgaacagctggagaggcctaatgctcaggcctgtctgactccagagcccatcctctctcctcttccccaggccccctcacctgcacgtctccaatgatgtcctccatgaccacatcgtactgaaccaggaagtcagccatgatgcctgacccagagatggacgactggtcttgcaatgtcgggcagtaggtgattcggacacaggtctctcccctctcgatcctggtggatgggggtgaatccacctcacctgtatgggtggggaggatcggggcggggtggtacagaggactcgcaagacagaagaaccagggaaagggcagcacaaagggtgctatctggggagggtgagaagtctaactcttccccaaacctctggtgcctcctgcctacatctttccacctgccccatgctcctctcccagtcccacagccagctcctctctgcatcctccattgagcctagccggacagacccaacctggccatcagctcccaggccctggcaatgtggccctcactggcaacctcaccctgcttcattttccgtgcaacctggggc

SEQ ID NO: 9009 - DNA, 1504 bp, artificial
  synthetic oligonucleotide
gaaagggaagaggttatgtctatttccccagccccagtcccagtgcacaagctgccctgtactcaaacaggggagccatgggggtgactggcttacctgaggaggagaaggtgaagatgctaggcaatgtgcctgcaaaggagagagagactgtgttgggaagggactaatgtatcacattcctaggaattctgggacatactcccagataagggccaaattcctgtgttcagcatttaaggcttttctgaaatctagtccctgcctagctctccagtctttgtgctctagcccaaccaaactattgttatgagtgtcctaccttctcttcctagtgaccctttactcctgtttttcctgccacctggaatgttttcctttcccttaactaccaaggatgaatttctagttatccttcaaggccagcccaaatgctcttttctcttgctctctgcctgtggtaggtagaattctaagatggcccacaggatctcttggtgtacacactctgtaaaatctccagagctgtgaatatgatgaaatatcctcccagaaataggttatttcatgtgaccctattgaacttatgaagggtatattatccaggtggggcctgacctaatcacgtaagcccttaatatttgtatctagaggtcagagacagaggagtcagagaaatttaaagtgtgagaagggtttggcattaggggaatgctccatagctgcctttgaagatggagggggaccacatggcaaggaatgcaggagatttctaggtactgagagtggccccaggtaacctcttgcagctgagagcgatcctccagccaacagccagcaagaaaatgggaacctcagtcccagcaacacaaataactaaattctgctaacaacgtgaatgagtgtggaagaggatgagagctcagtgtgacagacaccttgatttcaatcttgtgagatcctgagcagagaatctaactaagctatttctagactactgactaacagaactgtgagattattaattggtgttgttttaagctactaaatttgtgataaatgttacacaacaatagaaaactaatacattacttccctctggtctcccacaatgtcaataagaattctaatggaatggaaatgaaggcccaggggatctttgtcaggagagctccttgctcaccttttgctaaccccacagaacttccttgagattccatgctgcctccagctcctcccaggatctcctcagaattgccatcccagtttggacttcctgccaagcacaaaagaaataagaaaacccttcaaattccaggggcaaagtctcaaaatctttctgacaaggagagccctcactggctctgcaggttgacctgcccatctccaggactgggaccttatgctctccacagcctcttaatctctcaagctcagatatgttcaaagttcttccttatagcatttatacattcatttgtccattcattcattcattcattca

SEQ ID NO: 9010 - DNA, 473 bp, artificial
  synthetic oligonucleotide
caaagttcagactgtttccaaagccactccaggttttaatttatcttttgagtcacgtaggtgcatgcacacagcctcaggacagggcaggatgcttgtgacctctcaggctccacccaggaatatgcttgtcccaaccatgacgacagcctcaggatagtagagcctgaattgttaggttctcacccacttgcccactgtcaagcagtcacttccactgataatgagtcttgtcatgggcattgtctactgttccaagtcaagtgagctcccattgacagtggtagggaaactgcaggtgctcattgcctgcaccacccttgcagaacttcttcgcttgcctagctaagggatggggatgggagtaacccaaggccagaatgccatagatttccaccgttctcgttccaagttcagcagtttttaaagtataaacacttcttagattgttgtatgcctttgggttctgaaag

SEQ ID NO: 9011 - DNA, 2856 bp, artificial
  synthetic oligonucleotide
atccttcatgtttctgatgggcagttaccatactctgattagtggtatagatcattgtaccttctttagcctggttgtttcctgaagatggaaccgaggccgggcgcggtggctcatgcctgtaatcccagcactttgggaagccaaggcgggtggatcacctgaggtcaggagttcgaggccagcctggccaacatggtgaaaccccgtctctactaaaaataaaaaaaattagccaggtgtggtgatgcacgcctataatctcagctactcgagaggttgaggcaggaggattgcttgaacctaggaggcacaggctacagtgagccaagatcataccactgcactccatcctgggcaacagagcgaaactccatctcaaaaaaaaaaagatggaatggagtcactcatttctctgtcccagcattgccccacacggagctggacacaaagtagatgtcaaaaaaaaaatttttttttaagacagggtcttgctctggcacccaggctggagtgcagtggtgtgatcttggctcactgcagccttgaactctgggctcaagcaatccccccacctcagcctcccaagtgcctgggattacagatgcaagccaccatgcgcagctaattttatttttatttttattttttgagacagggtcttgctctgttgcccaggccggagtgcagtggtgcagtcttggctcactgcaacctgcacctcctgggttcaagtgattctcctgcctcagcctcccaagtagctgggattataggcacccctcaccatgcctggctaatttttgtattttcagtagagaaaggtttcaccatgttggccaggctggtctcgaactcctgacctcaagtgatctgcccgcctcagcctcccaaagtgctaggattacaggagtgagccaccatgcccagcctcccagctaatttttaacagaattgtttgtagagacgaaggtctcattttgatgcttaggctggtctcaaactcctgggctcaagtgatcctcctgccttggcctcccaaagtgctaggattacagacctaatcctagtgaaccactgcgcctgccagaaaatttttttttttgagacagagtctctgttaccaggctggagtgcagtggtgcgatctcggctctctgcaactgccgcctcccaggttcaagcgattctcttgcctcagcctcccgagtagctaggactacaggcgtgtgccaccattcccagctaatttttgtatttttagtagagacggggtttcatcgtgttggccaggatggtctcgatctcttgactttgtgatctgcctgtctcagcctcccaaagtgctgggattataggcatgagccaccgtgcctggcctaccttttcattttattcttgtagaagccatgcaaactaccccttatccaccccccatttgacagatagggaactgaggctgagagttaactaagcacctgctggagtgtggtggggccagaattggagcctagttccacatggctccaggctcctgttcttacccaagcctgtgtccctaccttttctgcagaagtctttggaggttctctgggggttaagacctcatcgttatgttttctgtctcttcctagattggagatctcactgggtattgcaccaatccgaaccgtcatcagatggggtgggctaaacgcaatgtggaccaccgccctaagagcaacagtatggtggatgtctgctcagtggaccgccgctcagtgctgcagaggatcatggagacggaccccctgcaacagggccaggctctggcatctgccctgaaaaataagaagaagatgcagaaacgtgcaggtgggagccccagaccaaccctgtgctctgaaaggggcccacatgggatctttttttgttttttttttctggctcactgcagtctccgccccctgggttcaagcgattctcctgcctcagcttcctgagtagctgggattacaggcacctgccaccatgtccggctcatttttgtatttttagtagagacgatgtttcgccatgttggccaggctggtctcaaactcctgacctcaggtgatccacttgcctcggccttccaaagtgctaggattacagatgtgagccactgcacgtggccccacctgggatcttgattggggctcctgaatgagtatctctctgtgtccagctccagtctagggttgggggcagggatgagctaggaggctcaactactagcacagtggctctcaaacttcagctcgcatcaggattccctggagggtttgttaaaacacagatttctgtgcccctccctcatagtttctaattgagtaggtcttctgtggggcctgttagaatttgtatttctaacaggttcccagctgatgctatttctctggggatcacactgggagaaccactggcctgcctagtctatgtatcaaataacgaccatttatttatcaggtactctctatgtgttaggtagcttgcaggctatatatcaataggcaatatactcaaaatcctacacgtacaagaggatatacagtaaaatctctcccacccgctagtcatccagaccgccccctcgtcagccagttagtttattgtgtcttttctgagacacaagcaaatatctatatattctttgttctctttttccacacaaatgccaatctactggacacatggttttgccctatcatttttccactcactatgtcttagggatatgtctatgttaatacacaaaagaacttcttcccctcgttttaatggtggtacattgtgtagctggcccatttgggtttccatgctgtacttttcactaac

SEQ ID NO: 9012 - DNA, 846 bp, artificial
  synthetic oligonucleotide
tttttttttttctttttaacaagagggaaaaatagtctcagcttggcactggtgagtctggagggctacgttctctacctactgacccccggataaacgtgtggcagtgaaaacaacaaccaccttttgagaggcctgcaagtgaagcattgtccttgggagagccaagtatcaaggcaggagcttggacaattgatcccagggagaggttgttaggggagtgctgatcacccaggtgggagtttcagagaatgttgtgggaaatttgatgctacggcagaggaaggatgaggggaatgaagtcagtgggtgtacagggacatctgtgggtgacagtatgggagatgagggattagcgaatacagagatctgcttttgagtactgatgaattggtgattttaggcctagatgatattggtggatgcattgaggctcagagaggttttaaaaaattcttcaaggtcatatagctaggtagttgttgagccagagtaagaatgtctgctggttataaaatggtagctgttttctctctggagttgttgaaaaacctatgagcagaggctcctgagtgctgggagggatgactgactgcacccccttctcctttttccctccccccttctcttctcccctctgaagcacattctttttctctccaagtgatgtgttttctttcactgtgtgcttgtatccattgcaggcactcagtttccagggaagttaggcagatggaaattgttgagtgaaatgtccagacctggttcattccaaacctcacattttttttgttgttgttgttgcaacatgagtactttagaagaaaggagactggtggtctgttt

SEQ ID NO: 9013 - DNA, 5932 bp, artificial
  synthetic oligonucleotide
ctctcagacatcccctatctctgtctctattttgctttttcttgtctctctgtttacaactgtctggctgcttctttttcctgtctctcctattctctttctcaaactctctcccctctcactcttgttctctcattctattagttatgttgctggctaccctgtctccatcctgtctgagtctaactcatgatcctcatcttggtccatgtctctgtccttatatatatgaccacattgttctctctcatctgtttttttttttttttttttctgagacggagtctcactctgtcacccaagctggagtgtcgtggtgtgatctcagctcactgcaacctccgcctcccaggttcaagtgattttcctgcctcagtctcctgagtagctgggatcacaggcatgcaccaccacgcccagctaatttttgtatttttagtagagacgaggtttcaccatgttggccaggctggtgtcgaactcctgacctcaagtgatctgcctgcctcagcctccaaaagtgctgggcgtgaggcaccgcaccctgcctgtttctaaatttctatgtgttccagaatttctgtcttttctgttttcctttcaatttcccttggctccttggcctcttttatgtatttccagaagtctccatcactctgtcccaatttatcctatttctggctgtctctctcagtcctcatctctgcattgctgcattcatctgtctctgctccccgctaccactgtctttctctattctcacctttctgttcctatctctgtatctctgtcttcattttttccctcttaacatttacattcttgtttctgtctttccctctctcacacacactcctatgttggtcttcttgcctccttctccctgtctgattctctctcattactctatatccaatttttacctctatttctctgtcaccatctctcttgttgggctgttttcctcatgtgtctgactcttgtccccatctctctgtcgctaggtgtgcttcatctgctatcttgtccccagctccacgtccttttgtctctacctgtgtcactgacaaagtagtcaagagtatggtctctggtatttgactatttatttggattccagtcctagatgtgccattgacttgctgtgcctcagtgtcctcatctgtaaaatagggctgataatagtacctgtgcttcatagtgttattgtgaggattaaatgagttaatacatgtacacctcttagaagatgtttcagacagaacactcaaacatgtagactttgacatcactgacatttccctccccattgtcatcaccatctctgtttccatctttgtttatctaatcctagtcattccccctccaactacctggctattactattgctttgtttttctctctgcccacaattgttttgtttataattaattttatttatttatttatttatttatttagagggagcctcattctgttgcccaggctgaagtgcagtggtgcgagcttggttcactgcaacctccgcctcctgggttcaagtgattctcctgcctcagcctcccaggtagctgggattacagacgcgcaccaccatgccaggctaattttttttatttttagtagagatggggtttcaccatgttggccaggctggtcttgaactcccgacctcaggcgatctgcccgcctcggcctcccaaagtgctgggattacgggagtgagtcaccgcacccagcctaattaattttattttaaaacaatttttaattgaggcataatatatgtacatattttggggatacatgattttttttttttttttttgagacggagtctcgctctgtcacccaggctggagtgcagtggcgtgatctcggctcactgcaaactccacctcccgggtttatgccattctcctgcctcagcctcccaagtagctgggactacaggcagccgccaccatgaccggctaattttttgtattttttagtagagacagggtttcaccgtgttagccaggatggtcttgatccctgaccttgtgattcgcctgcctcggcctcccaaagtgctgggattacaggtgtgagccaccacgcccggcctgatttttctttttaagatggagtttcactctgtcccccaggctggaatgcagtgctgtgttctccactcactgcaacctctgcctcccaggttcaagtgattctcatgcctcagcctccagagaagctgggattacaagtgcgtcaccatgcctggctaattctgttttttttaattattatttttattatttttattttttttgagactgagtcttgctctatcacccaggctggagtatagtggcgtgatcttggctcactgaaacttctgcctccctggttcaagcaattctactgcctcagcctcccaagtagctgggattacaggcgtccgccaccacgcccagttaatttttgtatttttgggagagaaggggtttcaccatgttggccaggctggtctcaaactcctgaccttggtgatccacttgcctcggctctcaaagtgcagggattacaggcatgagccaccgtgcccagcctgatttttgtatttttagtagagatggtatttcaccatgttgagcaggctggtctcgaactcctgacctcaggtgatccatccaccttggtctcccaaagtggtgggattacaggtgtgagccaccacgcctggctggggtacatatgatttttaacaatgtttattattttttcagatagggtctcactcttttgcctaggctggagtgcagtggtgtgatcttggctcctatagcctctacctcctaggctcaagccttcctcccacctcagtctaccaagtagctgggactataggtgggcaccacgtctggctaattttttgttatttattgtggagatggggtcttgctatgttgccctggctggactccaactcctggactcaagcaatctacccaccttggcctcggccttccaaagtagtgggattacaggcatgtgccactgcgcccatccacatatgatattttaatacatttacacaatttgtaaaaatcaatcagtgtgattgggatatccatcaccttaaatatttgtctttatgctagaaacatttgaattattctcttctagctattttgaaatgtgtaataggttactgtaaactatagtcaccctactgatctatcgaacactaggtcttatttcttctatcaaatagtatatttgtacccattaatctctccctcatttttaatgtagctgcttctctgaccccaatctctgtctgtctctgttcccatctctttatatctctccctacattcctgcctcatttcagccagtcccttgttctccattttgctcacttcatctttccatatatctgtctccatccttctgtttcttcatatttatacaaagaaatatttgagacagggtcttactctgctgcccaggtaggagtgcagtggcacaatctcggctgactgcagcctcaacctcccaggctcacgcgatcctcctacatcagcctcacaagtagctgtcgtggcatgtgccaccacacccagctaactttgtctttatttttgtagagacaaagtctcactatgttgcccaggctggtcttgaactcctgggatcaagtgatctttccgccttggcctcccaaagtgttgggattacaggcgtgagccactgtgcctggcttatttttaaaatttttttttgagagatgtggtctcattattttgcccagcttcgtctcaaactcctgggctcaagtgatcctcccacctcagccttcagcctcccaaagtgctgggattacaagcgtgagctacagcacccagcctccttctattttttttttttttgacataaggtctaactttgtcactcaggctggagtgcagtggcgtggtcgtggctcactgcagcctggacctcctgggctcaagtgatcctcctgcctcagcctcctaagtagctgggactacaggtgcacacaaacatgcccggctaatttttttattttgtagaaatgggtttcgccatgttgctgaggctggtttcgaactcctgggttcaagtgatctgcccaccttggcttcctaaaatgttgggattacaggcatgagccaccgcacctggccctccttctgtttctttatctccattttttactgtctgttctcacccttcaaaccctatttcttggtctgtttgtctttctgtccctctatatatctttatttatttacttaatcttatgctgtttctttgtccccatctccttgtgttttcctctggctgctctggacaatttagattggaattgttttggtagataatgtggagctataaaagggttcaagaggaagaagtaggcctggcaagaggtgagtggcagggtgtggaatttcatgggtctgccaaatcctcctgaaagacgtggcctctgaggtcaaggttagcataaatcccctcaactcagtctcttgaaagacaaagaatgctgcatttattgggaggaccaggaaggggtacttttctgagtgaaattccatccggaagctggaatccagagcatttcctgttgtaatgtttcttccagacttggagagtctgaacctaccacgtagcatgtgcactccatgcatatgcttctacagcgaaaggcatggatacatacagaatcctctacccttagagacccagatgtgtgcagacacatagagacacacatagaatcagactctcacagatgcagatactcagagacatggaaaagcacacagaatgaatcacccgctggcagagatggagacatgcatagggacattgagagacccacggaattaccccctctcagctcagggacctgtgtgaacagatacagaagaatagctacacagaggataatttaaccaattcccttttgaaaaattgttcttgctgggcgtgatggctcacgcctgtaatcccagcactttgagaggcagaggtgggtggatcacccaaagtcaggagtttgagaccagcctgaccaacatggtgaaaccctgtctctactaaaaatacaaaattagccgggcgtggtggcgcatgcctgtaatcccagctactagggaggctgaggcaggagaatcgcttgaacccgggaggcggaggttgcagtgagccaagatcgcgccattgcactccagcctgggcaataagagcaaaactccgtctgaaaaaaaaattgttctctttcagtcttatattttcatataaacagaagcacagtagagcatcatgtataaacatacacattcctagaagtatgcacaatcacatacagtcacaaatatccaaagtcacagagaatcccattcctttgctggaagtacaaaggtaggcaaactccctctgttccccaaatgacaggcatgctgctcctctgctgccctcccctctgtgaagccaccatcaggcactcaagtcagaaacctgaccattaggaactagatgggctgggtgtggtggctcatgcctgtaatcctagcactttgggaggccaaggagatgggggatcacttaaggtcaggagttcaagaccagcctggccaacatggtaaaaccctgtctctactaaaaatacaaaaattagctgggtgtggtggtgctgtagtcccagctacttgggaggctgaggcaggagaatcgcttgaacctgggaggaggaggttgcagtgagccaagattgcaccactgcactccagcctgggtgacagagtgagagtacgtctgagaaaaaaaaaaaaaaaaagagagaaatataaaataagaaaaatggtatctgaagaaatagagaatttgaatagaccactaagtattaatgaaatt

SEQ ID NO: 9014 - DNA, 5365 bp, artificial
  synthetic oligonucleotide
gtctgtgtagcacaaaggcagtggtctgtggcctcagcctgacttaaagctgctccaccttttcaaatccaagaaaccatcctgatttcacatcacaaccaacctcgtggacctgcagctctccagctcctgctacaactggcttctgcctctgttggcttttctgctgtctccctacctatcagcccctccagccttctcctctagcctgactcccaaggcccacctcttccacctttctctctcagcaccttctactccttccttcccttgttctcccgccacacacacctggcaaaatctcaaccttggatcaatccaccgtctttctttttttttttttttttttttttttccgctcatactccagggctgctgaatagtacaggagaaaatcacataagcagaaggcttggcattactttcatggtctccagcctcagtttggggaagcagaaagaccacagactttggacacaaacagatctggtttgaatcgtggctccatactagctgtgtgaccttgggcaagttgcttaacttctctgagcttcagtttccttccctacaaaatgggactaatggtatctacttcatgagggttcctgaagctgaaatgaaaatccatgtaaagcacccagtccagtgcctggtacaatgtaggcgcttggcaaatgtaaggctcctttttttcttctgttctccaaacgaaaccctggtttccccaaccaaatatccaaggattgctgccttgcaatcctccctctttttctcgcgagtgctccctctcccattagcctcagcagacagaggagaagggggttggagaggttgaggggcacaagggacagagagaggagatggggacagaggttgaaaggactggacataaggccaagggacgtggggaggaggaggggtttgagggaacccaaagggccgaggtaagcgagcctgttccgaggtggggcttagagggctcgagaacaagaacccgctcccagtaccaggcccgtggcccgggctcccatgctctctcagtcgctcactcaccaggccgaggctgcgagccctccaggtggtaagagaagcgcagggcccggtggtgctgtggactgggaccgcagggcaagacccggtggcctggagcagcgcccaggctggtgtccgagggtccgacaaactggggatccagtgggccgccaagagccgaacctgagcccctgcgcgccagcagtccgggttccgaggctccagggtccgagtcggcacaggccggcggagcggcgcccggcgggttcgtggccgggtgttcgggctccgaaggcccggcgccccccggggctcggtggccatgcatggtccgggcctgggcgcggggcccgagctccccgcttggctccagctcctggggcggaggcgcgggcggaggaggcccggcgcccggcggagcagcggcctcaggatcggggggcgggactgcgggctcagccccactgcagagactcaagcccccagcccgggcccgggccagcagccgtggcagcggtggcagtagcagcagcagcagccgcggccaccgccgctgccgtgccaggcatcgccggccccggccccggccccgcgcggggagtgggctcggcggggccgggggcccgctggggagcgctgtctatgcggctgcggttgggcgagggttggagggctacgctcggcggggactctccggtggacggcgagccacttccgtggccccggggcgagaagtcggtcggatccaagtgcggggtctcttctttctccccgaatgggaatagatctgggctctcctggctggttgggaagcgttcttcctcccgccgcagccgaggccgggggcggaggagaggggaggggagaggaggggagggaagagagaacggcggtggccgggggcgcgcgtgtgcgctgcgcttgggctgcggggctcgccttcagccagtagtcccagacgatgctccagccgcgggggcaggagaacggcctgggccgggctccaccgtcctccccagcttcagcctgggtctcggcggcggcgggcgggaaggagccctgggaaggggggtggggaggcgggagcctcgcagaggcagccgcagccacagcggcactgggacccagttaccggggccccgccccctcgcccgggatttgcgcctgaccacgccccctcgctcggggccgcctcacttctcgctgctaccgctctcaaggccctcctgccccttaaaaaattccccctcagcctgctttccccacaggcaagtctccgggctcaaccccctccccccatatctgcccttccatcccatctcaggtcttcccccctctgcttgccgttcactctcttttccaaaaccctttcttcatgttcctgagtgttcctagggcttggctcatagaggacctgtctctgattctccttcactttgctcagaccagatatcttggtcccttacttagtcactttcttaaataccctcagttccctgatttgtcgcatccgcctggcaacatcccagtcttgaatcggtccaactgtccgccttttccatgcctgcgcccaggcagctaaacattgctggggaaaactattcaacttcacagatttgtgccactataaacccatggttcccagcttctaccaggccctcagttttgacccacaaccctactagtcagctctccctctgttctccacagtgaccatttcaaaccttctcctttcccctcaaaccccaagtgctccatctgccctgtaaccctcagcaaataacctgacctgctgcagagagtaaacagagccaccgtagaggaagctcttgactttttgctacgaagcctaggaatttgtccttgctccttcccaacagcatctaaacatagacctcttccatctaaaaacaaataaacaattaccaagaattctgcctctccaaccacctccttctcttctcttctacaaacttctcaaaagagttgcctacacccaactgtcttcattttcccacctcccacttatctttcaacccactccaatctgcctccactacttgcttgaaactgctctctctcatcagggtctgccatgaaacatctcactaaatcccatagaatcttttctttttttttttttttgagacaagagtctcactctgtcgcccaggctggaatgcagcggcacgatctcggctcactacaatctccgcctcctgggttcaagcgattcttctgcctcagcctcccgagtagctacgcccagctatttttttgtatttttagtagagacggggtttcaccatactggccaggcttgtctcgaacttctaaccttgtaattcgccggcctctgtctcccaaagtgctgggattacaggcgtcagccaccgcgcccagcccccatagaatcttttcagaggttatcctacttggtttcttgatagcatttggcactgttgaccactccctcctccttaaaccacttccatgacactgcactttccttgtttttcttctacttccttagtaattctttttttactttccaggctcctctttgtccaacgctttatgctggtgctcttcagggctttggcctgagcgctcttgtcctctctctacatgtgatttttttttctttctttctttctgagacagagtcttgctctgtcgcctaggctggagtgcagtggcgcgatctaggctcactgcaacttccgcctaccgggttcaagctattcttctgcctcagcctcccaagtagctggcattacaggcatgcaccaccaagcccgaataatttttgtatttttagtagagacggggttttgccatattggccaggcaggtctccaactactgacctcaagtgatccacttgaggaaagagaagcctcggattacaggccgctcttttctttatctcatttgctcccctggcttcaatgatcatatctttgctgatgactcccaaattgatacctcaaaaccagatatttctcctgacccatgcattcaactggttattaggcagctctacctgaatatcccagagacacctaaaacctcagcttcttcccaactcaaggcatcctccttccaacctgtttgtccttctttgtgtcttaccttagtgaatgaccccagtcaaagcagaaacccgggttacacccttaattcttttctctcctccatcacccatgcagtcaccaagtcccatcattttgacctcctaccaaatctatttatgtagtctctacatttctggggccactaccctggtttagaccagaaccatttctaacctgcaatactgtcacagcctccctatttcagtcttgttctctggaatctattctctacactataggcagtgtatatcttttgaaaacataaataaggccgggtgcggtggctcacacctgtaataccagcactttggtaagccgaggtgggtggatcacttcaggtcaggagttcgagatcagcctggccaaaatggtgaaaccccatctctaccaaaaatacaaaaattagccgggcatgggggcggatgcctgtaatcccagctacttgggaggctgaggcagagaattgcttgaacccgggaggcggaggttgcagtgagccaagatcatgctgcttccagcctgggcgacagagcgagactcgtctcaaaaaaaaaaaaaaaaaaaaaaatatatatatatatatatataattaaataaaagttaaatcaaattatatcactcccatgtttaggacccttcagtgagtctctactggctcaaaatgaaacccaccttccttaacaggaaaggttaaatggcccttcatgatctgtgcccctgccagcctttccgtgctgaaattcttagactattccttagtctctctagcctccaagtttttgcatatgctgttctcgctgagtgaaactttctctgcatctccccaattccacttcatttgttcttcagatctcagctcattcaacgaatgtcttttgaacacaaactatgggccaggcaccatgtgatgcactagctatgcagcagtgaataagacagacatgaacaagacaatggtgaaaaaactgtcctcagagttcattggctggtactggagaggatgtgaaataaacacataattacaacacataaacacacataattacaaattgtgataaggttataaagggacagaacagggtgataggaaagagaataacgggtatgtgtgtgtgggggggtgtgatttagcctgaggggtcaggcaagggctgctatttaagctgagccctgaaggagtgggagttggcagatga

SEQ ID NO: 9015 - DNA, 2278 bp, artificial
  synthetic oligonucleotide
aaataggaaaatccttgcaaaaattgtttctggttgctgcatgcccctgcgtggcaggtgccctgagcacatgcttctgggtttactggcagagaaagtccagcatctagctgtgtctgaggacaagggctccttttgcccattcccactggaactggaccctgcatctccctcaacccttcctgggaatctcagctgccaagttttccccctcccagctagtagcagcccctctcacttctcccagctgtagccttggcttaatctcaagacagctactagggccccagactggcccttggccattaactccctggtgtcctggggcaagtggcttcaaagctctgggccccaatttccccatttggggcccacagctatgaaggatagctctgcagagatgctaaaatggggagaaaacgtgtgttctgcttgttgtgagcaatcagcgagatcctagggtgagcagaagccagcccctagcacgcaggtctcctgacagcccaggcaaacttctccctacagccctcaaatcttttcctttccgggcagagaggtaggctcctgggacagctggaattcctgggggtggggtggggaaagggagcagagggagtggagaagaacagcagaaaggaaagtgccttttgggaagccagttctgtcaggggaaggggcatccctccgcttgacaaaaaaaaaaaaaaaaaaagccataactgccccacctcttcccacctgccccttgaatgtgaactgcaggccagctgccccactccgccttcaaggccagactgcacccaggctgcctgacctggcagatgttgtctctcaaagttcaaacacaaagctcggtcaagtgtgaaatgtgcagaaggagctgtttacaggaaccctgtgggtagctcaggggttccttccctgaagtcgactattcttctcaacataaggactctgcagaaaaatggaggcactttctatagtgtgaagacactttcaagaagtgggggccattctggcaagtcaggagcttcctaactctttcgagtttcctgaagagtgttccatccttcaaaacggagacactttctgtgaaatggagatctctttgataaacagaaggcccttctgtaaagggaagaagtttttccaaaaagaggagccttcttcaaagtggagggacatgctgtaaagtgaggagagttctctaaaggcccttttgtaaaatggatggcctgtttgtaaccaaaggactcttaaggatcatgacaaaacagaagactgttaaaaaggagaactcctttttgtaaagtgaggccccttctgtaaagagaaggatgtttctgtaaagtgcagaccctagtataaagtgaggaactttctgtagagtgggacagtctaaggccatggggaatggtggggactgggttaaactggaaagcacatgcctaacctgaagtagaagcagcagcttctcccctccacccaggtgtcatcttgcagtaatgtggcgctgtattgtcaggtcttccaatatttcaagggaatccagaaatccagatttttcttctttttttttttttagacagagtgttactctgtcgcccaggctggagtgcagtggcgcaatctcagctcagtgctacctctgtctcccgagttcaagcgattctccagcctcagcctcccgagtagctgggattacaggcacacgccactacatctgcctaatttttggatttttagtagaaacgaggtttcaccacgttggccaggctggtcttgaactcctgacctcaggtgattcacccgcctcggcctcccaaaatgctgggattacaggcatgagccactgtgcccggccgggaaatccaggtttttcatgtgaagtcccttaattttaaaaactgtgggcaagccaaatgaaacttgtgagtcaaattcaacttgtgggccatcatgttgcactatctgagttagatgatcctgaaggctcattctactcctgctgtttatgccttgccctatctcacatgctcttgcccttgagtagaagccttgcaggtcctatctcccactccctggaagggcccagtttcctctgtgtctgagcaggctcagggagctggcccatgcattacttgtcagaagttccctgaattggaatctgccttttgttctgtgtgacccgatttaccttctgccctgtgcaggatgcctaaagaagagagagcaggagattgtaagaatatgcagaaatctctggaactcaagctgt

SEQ ID NO: 9016 - DNA, 769 bp, artificial
  synthetic oligonucleotide
attccacatccctgagctttgtccttggccccctttcccctccttttacactcactccctttggtgatcttggccagccttatggctttggaatactatctatgtgccaatgacatccaaatctctccctgaaattctagattcatctaactgcctgactagcagctcactttgaacatgtccaaagtcagactcctaagatcatctcaggaaccatcaccaccagccaaaaacctttaagtcattcctgactcttgctcccaagcccagcatccactccaccctagtcctctcagtgctgcttctgaaaagaatgtatcctgaatccaaccatttctcaccgattctactgctactgtcctcatccaagccaacttttctcacttggattattgcaaaaggcttctaactgatctctcagctctctctctcttgctccccaagtaatcatgatcgaaaccttcccatggctacccaccatactcagaataaaatccatctccttatcttggccttcagtctttgctcctctctccaacctcatttctaccattctactcttatttgtcatgttcaggtcacactgaccttcttcctgatccagagatatgcaacctgtccagcaccccacctcccctaatatctccccttgccttggaccctatacttgctgtggcctctgcctggaacatgctcaaccccaacaggcatgtgcctaccttctttttattcaggttttgactcactgtcttctagtcagacaggccac

SEQ ID NO: 9017 - DNA, 409 bp, artificial
  synthetic oligonucleotide
gctatgcaataaaacaaatctcaacaaatttaaagagattgaaatcatacaaagcatgctctcctaccaaaaatgaataaattagaaatgaacaacagggtaaggacagacatataggtcaatagaactgagagtctaaaagccgtaacatttatggtcaattgattttcaatacagaggttaagaccattcaataggaaaagaacagttatttcaaccaaacttgtggcataactgcaatccacatgcaaaagaatgaagctggaccccgacctcgtaccatacacagaaatttaaagtggatcacagtcctaaatacaaaagctaaaactataaaacttttagaagaaaacattggagtaaatctcagtaactcgggtcagacaattcccagccacaacactaaaac

SEQ ID NO: 9018 - DNA, 1306 bp, artificial
  synthetic oligonucleotide
cccaactacatgcagattggacttaactgcctatggggccttgcacacttaatattcctttttgcttctgctcattttcttcctcccacttaaagcagcctcctcccaagcttgtgactcattcaaatccaatccacctttgaagacccaggtgaggtccgacttcttcagggaagcctcccctgaccactttagtccaaagatatcccaccactcccacatacagaaaacaggaactgtacttactgtctggaccataaggcataatcacatacacattgctataattaaatgtttcatgtgtatacatttaactttccaagggcatgagcagtgtctcacatgtctttaaaacccttacactcagtgagttaatacttgctgaacagtgactgaatcagtgggtttttatgtgtttaggctaaggcaggaggaagaagatgcatgttgaaatgaaaaaggctgaatggacacagatgggtaaaaaagcagcagtgggtgaagacggaaaaacaatgtagaagaaaggtgttcagttcacacctgcttaagtgatttactgcgaggttggaaagagatacaggagagagatgtcaactggcaaaagcagggtaaaggcatttcagtttgaggcagaagacaccaggagaaagatgaggctacaaaagaaattctgactagattctgctgaaacctagtggtaggccaattggataagggaagctaaagggagctactgggatgacatgagtagagatatggccatgtaggtgagtgaatccgtagggggtggtatgaagggggaggtaaatggataaaatggtagagggtagttaggcaggtaggttagctgttgggcgggtaggtgggtgggtagatgggaggtagggtagtgggtaagtgggtaggtggttaggtatttagttgggagggaataggtgtggggcttattatttaagatccggcccctccctcaccttgacccggaagcggatgagtgctagcctcacgcagtggctcaggcaggccggtggcaggaaccaggcccgcggtggaggggtgcccttgttgcccacgtgtcccacgatcagttgcgctgtctgccgctcggcctggcaccgacggccccactcggccagccggtccttgcccaggccccccgggaacatgaccacgagctccaggccgtcgccgccaggataggcacaagcctggcacagcgctgacaagtagcccagcatggcgttccattggccgccacacacccaatccgtctggtagccgccatagagccgcggcagcgccg

SEQ ID NO: 9019 - DNA, 2440 bp, artificial
  synthetic oligonucleotide
gggatgcaacacagctggtgcggctgtagggggcaaccagagaaagtccacccggcccttagaatttctttcacacgtaaagaacggagctcaaccttccaggcttcccaccgcccccacactctccactccccaccccccaccttcttcggccccgttgtcagtgataacttctttccgggtttcaagaaaatacctgaagccttttcgggaagcttctttcatctctcactgaaccctcccctagctgacccctgtttcacagggctccctctattatgacgcaaaccacagcgtcaaaaatgaggctgggggtatctcaagacaagaccctcctctcaccacctgaaatagggccaaccagagagagataagggatccctgaaagtctcttcaggttactcaaagccttcacgaacaagacagacaagactaggcgcccaactcaaatcacagttctggggtcgtgttcggagagtttaaataatcctttccatcactctcaatatcattccttccccgaccagtcaggagtctcatcacccccaaaactgaaataaatataaatctctaaactgaccagctcgttctgtactttaaagatgacagggttctggctgcatccctgaaactcaaaaggatctattcaaaacccctcaaactgactagaatttcctcacactcccgaaactaagcaaggattcttttgcatcgctcggaaactggcagcgtttccttgcagccccccctcaaactgatgagagctccctagtctccccaaatgttcaggtacctcacagtatatcctaaaactgacagtaatagcctcgcagcccccaaaacttacaggaatcttaacgcttccccaactgacaggaacctcctcacgccccaaacctgacaagaacgtcttcagtccagaatcctacagggacctcctcatgctttgggctgcaaggactccacgcccgcggagctcagccccagcgacacgccggcagccgggctagctccgggactgcgaagcgcctcagcggaggctcgtccggtagttccggcccctacggcgacgcgcgtcgaattctgggatagtccccgtaccgccgggaacctcgctcgccttcccctcgagccccccgctgggtcgcgcggcgccagccgctcaacggtgcttcagagcagcctcctccacaacattcccctcggcccggccgttcgggcctactggagaccgcggcttgggcctagtctggcggccgcccggcgaacgggcaagtggcgtcgtcgctgggccggcaggagatactcgcgagcaaaccaacggggaaagagatgaaccggccgccacgtccgaggcacacggcccgaaaagtcgctgggagaagcccagtggcggtggtaggcaattcggagtagtcaataaagtttattcaaaacaatgaggaagttgaggcggagaggggaggagaaatacgggataaacagctaccatgttgagagtggcggcgctacccagacaaccaaggcgaccgccatcttatgagggctggactcgcgaggtgagcgcggcggaggcggggaaccgcgagccgccggctcccgggtgacgtcatcgggggggcggggcgccaccttgagaaaggagggcggttctcagccacctttggacccgctcgtctctttaaggtgcccaatcgccgctgaagaccttgagcccagaggcggagaagccgccatcttaggcgaggcagacgtttggctccattttgagtggggcccgaaacttcctagccttccccctcctccgggcaaacagggagttcagctaccccgactcgcacactcctcctccccagccttctcctcctatgagaggaggtgaactcggtgactccaaactacaaaattaataggtggcggcgggggcgggcttcagccggggtagaggcggagtactcaccgcggctcctgttcattgagcaccttcgataggctgggctctttcccacggtctctgcgttgttggttcttccccctgtgaaggaagctctgtgattatcaccaaatgaaggcaggggcttcgagaagccaagtgacttgagtcccggagcagggacgttgaaccttgtgccctgtgctacccgcgttctgtccccaggccctcagtgtagttcctctgtaaagctgctgccaactccacaactccctctgaactcttctttgaccctactgtttcacttcagttcaaatacagttcaaggatttgtttgcacctgtcccacaattttctgactatagcctgaggggaggggagaggaggggggatgagaggaaaggctgagttagtggagctttgctgagttagtggagcttcgtacatatgcttcaagatggcctaggttttctcaaacattctagaaaattctctaggagttatctt

SEQ ID NO: 9020 - DNA, 250 bp, artificial
  synthetic oligonucleotide
tccaagttatcagcatgtcctatcaactctctttattagctatcaattgtgttaatttgtcatccttactgcccctgcgctagttcaggccactattatctctaactcagttattgtcctgccctcctaactggactcctggcccctattctgtccctacccaatcggccctccacactacagccaaagtgatcatttaaaaacacaaatttgatcctatcaacccatgcttaaaatgcctcacagggtc

SEQ ID NO: 9021 - DNA, 975 bp, artificial
  synthetic oligonucleotide
tacttggttagtcattgagaaggagggctctttagccacaagtcctgtgcacttttccactccatactggaaagggggatgactgaagttgggtgcctcgtttccctcccaattttgagacaggaacctctgaactgctggcacctcctgcctggactgaggaataaggtgaccaagattctagcttatcctctaacctgaggctggtaaaaacaaagcacgaaaaagtgctttgtcccttgactgaggaaggtggggtgggaattggtgacaaaaataacccagcccatcattcctgcaaaggctttaaagcccttctttcctgtttcctttctaccaggaaatacagttctctatgcttcagacatgaacattatcaaaaccccacctactcctgagacagactgtgagaactggaggaggtcatttaaccagtaggtgccaaaaccagacagcctcactccagacccacagaagcagaatctccaggaggaagtaaatcttgactgggttcaaaatactttaatagatgacccacagacagtaagcagcctgccctggctcacccacagagtcagggtggtggtgaatttgaaactgaggctcccaagatcaccctgggagctctccttaggagataactctcaattctgcatcttgcacataacagaggcttaataaagatctgttgggtgcttgagcctcagaagattttctaatatggtgaaggcaaagaacataagttttggaatcaggcagatcctgctgcagaccactggcaaacttcagtctccttaaactgttaaataggacgaatatcctcatggggtttttcagtgaggattaaatgagatatccctaagtaaaatccctagcccaatgcctggcacccaaaaggcacttaatataatggtagtgtttatcagtgagaagtggtagaacagagtggtaagaatacacattctggaaccaggt

SEQ ID NO: 9022 - DNA, 2131 bp, artificial
  synthetic oligonucleotide
ccgagccaccgccgcctccgcgcgatcccgcgagaacctctaccggacgggaaaagcctgagcccagccctttccagacccctcctccctcccaccaaagccgaagtagctacagcttcaccctacgcgaagcgaaaagcaaatgacgcacaacctaacgaagcagtgaggggcggagccaacctaccacggccggctcccgcatgcgttgagaactatcgcgatattacgctttagcctcggcgagaccttcttaattcaccgcaggatgccgcccgcgcctcgcctttaggaaacatgagatatcgcgagacctggtgcacactcctaaaaaggagaaaggcggagcttcatgaaaatgactgggagtttttcgggggaagggaggaaccctcccgtcctgcagggatctcgcctaccacgaggtttccgacccactgcggagctggctgccaaacctcgcgatgacacagctcagcgccaaatctcggccatgtcctgaaaactgcctccgcccccgatctaggtgtctagagcctagtgcttgaggaaaatttaaaaagtcaacctgtttattctcacgcttccgggcaaggctgtaccaattagccaaactccattctggaagcggagcaaagagtcccccattgttacctgtctccaggaataacatattatcctggactaacatttaaaagacgttcaatctcacagtaagcacacaaatgcaaatgaaaacaatgacataacattttttgcccattagatagggaaaaaaatttttaaacctacattatccagactccttccctcgccgcactgcaggctaacctgaatccatcttaatctaactaaaggccatatcattagttctagttccaaagccaccaattttaactactgaagctttaccttggcataaccaaaaagatccaataaagtggttttctccaaacaaaggagtctgccctcaaaggaatattcaagcttcggggatggggggaaatgcctgaagcttttaatatggcagtttttccacgtctagccaacagtgtttctccaataaatcttgggatccaatctggcttgatttgtgggcttttccattctaatgcattgttctgtccgttctaatttaaatagttcctttagagtacattttaatagccagtagtacaaatatccctatctttacttacgttttaaaatattttttttcagttattcttagccatttttttcccccggatgaactttagaatcatagtaagttccaaaaaaacttggtatatttattgaaattgcatcaactgtataaaccaatataggaaaaatggacatcactaaaatattgagccttcttattcagaagcatagtattccttctcttttcatgcagatgttcttttatggtattcgtcaataaagttttatagtttacttctaggtatttttattcgtttctcttgctattgcgaacaggttttttattattaaaatttcaaaatgcttattgcttatagataggaaaactgcctatataaactattgatatttgcctatttacaaacaaaaatatgatcaatttcgccagtaatcagggaaatgcaaatgaaaacaatgacatacgatttttttgccctttaaattggctaaaattacaaagattgataatacgtgttggcataactgtggaaaaataggcactctcgcacaacattaaagagtgtaaattagtacaggcttttgggaaggcaatttggacaaatctatcaaaattcaaaatgcatatacaccctgacccagcggttactcttctaagaatttctcctacagaaatactcatacatggcatgatacatatacacaaacccattcattatggcattgcttgtaatagtcccctccctcccccaacagagaaacaagctaatgtatatcaatcgggaaatggttaaataaactgtagtacaatcatacaatgcagctgtttaaaacccaacataaatttggattcccggatataagaagatctacaagacatattctcagatttttaaacaagcagttagtcgaaatgaatgtgtgtgtgtgtgtagtaccatttagatatcaaaacatatatatgcaa

SEQ ID NO: 9023 - DNA, 966 bp, artificial
  synthetic oligonucleotide
gatcacagcactgagtaccccacaattcatttcattctaaatcaaccctgaagtagatatgttaaattcccagaagaggaaaccagtgtcggcgctagtaagcagggccaggactcaaatctagatcttattattgcattatacttccttctcacacagaattgaatctaattttgaactttcctttcagaagtgaaattgccacttttgaacagagagattttgtttggtgagcagagattaaagaattccttcaaaattacttaataactgagaatacttaggttttaaaacagggcaccaatagttctaactcaattaggccagtgaagttaacttagggattctaatatattttaacactccaagaaacacctgttgaaaggaaccatatgctccaatttttgcacccctccaactcttcacccaagactcacctctgccaaatgttgtagccgagttagcagcggggtcctcttgtcagatcccagacgagtgatgtagtttgatcttttgctaaatacatataggagattgaggactgccagcaccacttgcatatcagaggaagccaataaagttgtcaaatgctaaagggacaaaaaagggcaaagctcaaggtatcaggcacaactggccttgaaaacaaaacaaaatgtacttgtcaacatttacaaagctatcaagaagtttagtcacaacaatacaaaaaatatataagtatttgtactcgggaggctgaggcaggagaatggtgtgaacccgggaggcggagcttgcagtgagccgagatcacgccactgcactccagcctgggcaacagagggagactctgtctcaaaaaaagaaaaaaaaaaaaaaaaaatatatatatatatatatatatatatatatgtatttgataatctacaacatgcaaccttatccccaaggagcttaaaatctggcagttagctataaagtgca

SEQ ID NO: 9024 - DNA, 1215 bp, artificial
  synthetic oligonucleotide
taagagagagagccattctcttacctgtttggggtacacagagagaggaggacagtgctttcccacaccagggaacagtataactggctcagcttgctcaaaacactcagacccaattgagagccccactggtttacggagatggaacgaatttcactctgcaatcataacaagaatttcacctttgggatgttctctgaacaattatacttaaaaaaaaaaattgaccttcaacagttttataagggtaagggatttttcttcattgctattctcagagttatccacctcatcaaaatgtccacactcaagacgacagttccacaaggtatcctcttacaatatttacaaactatttccacaacatccgttctcattgttttttataaagtgaaagaaaggcatcagaggctactctttttttctgaatcaaagaaatggttttacaggttcattaactactttctaaattatttggtaggggtattattatttccattcaatttctttacttcagtaagtacctagatttatttaattccttgaatgtttcattttcattttatttcatttaataaagaagtcataaaaatcaatccctaagctttgttaagtaatttaattttctaaatcctttatacttgtgcttttttaaacttcagatttgattgattcacaattaacagagaacacactcctgctcaatagcataaaacagggctgttgaaccctgttttgtttaatgttgataccataaatctttagaatcaattatctgaggaataaatgtagtaaaactgtgaggacatacacaaaatgccttctttctggaactatggattatggattacaggtcaaacgtttgatatgtagaaaatttttagtaatttgttaattactattgatttaaatgttctttggtaaaatgtcctacctatgccatcccattatcagacctataaggactggtggaaagattagaaagtactaaggccagatgaatacccaattgatgtttgtctgtaataacatgtttcgctctcaagaaagtccacttcatcacataataagttatatagtcactcaactttttgacagtcaaaaaaatctcatcctaaattggactgttcttttagctgctacctcaggcagacctcctttcaagcatagtaaccctgctaggtgtatgccctagatatttcactgcctttaaat

SEQ ID NO: 9025 - DNA, 1970 bp, artificial
  synthetic oligonucleotide
agagtatctacattactgccagaaggcctggaaacagaacatggtttttgggtaacacttcagtggctagagctctgggattaggcataagaatgggggaggggaatgagctaggtatctccaaggaggcttgagaaaggtgggtgtccagtccaagggctcttcatagtaacagctgccctcttaggtgtctactatgtaccaggcactttacaatgactgtacatcatcctttcagggctgctgtacagcttagagaatgaagccccccacccccaccagctttttgttgagatggagtctcgctctgtcacccaggctggagtgcagtggcgtgataccggctcactgcaacctccaccccctaggattcaagtgattctcgtgcctcagcctcccgagtagctgggattactagtgcgcgccaccacacccgactactttttgtatttttagtagagattgggtttgccatgttgcctaggctggtcttgaactcctggactcaagtgatccacctgcctcagcctcccaaagtgctgggattataggtgtgagccacgacaactggccgagaaccacccatttttgagatgataaacaagaggctcaaacaggttaagtgacttgccctacatcacacggcgactgagaagacagcagagattccagcccaggtatcatccatcgactggtaaaatctgaccatacctaagtctaggagacaatgctagtttctgccttctctagactaccaggagtttgtggccttgtaggaaccaatcactcctttcacattttggcatgtcaggcccactctgttttagcctggctaactcactcctctatacttccttagcctaggtgttacaaactcaaggcaggtggttagttgttttactacttgcatgggagacaagtggtgttccttcttgttaaaaccatagttagcacctgctgccggcctgcttttgcgattgtggtctttggtagcaagactaaccaaaaggtgtagttttctgaatggggagtccaaagatctggctctctcacttattcaaggaaatggcttagagagaccatccatcctgcctgtcaggatttcagcttctccacctataaaactaagggagctgggctaatagacttgagtggtgatatggtaaggtaaaaatagacaaaggtacctgttatggctgctgctaccccccatctggaaggtgccacctctctgcacagcaaggcgagtatactggaccccacggttgccacttaagcgactggtgaaagctggaaggaaagaaaaagaaaactgagattgtggagagggtgtaaactggatataggtaatacaaaggtaagaaaacatagcctcatctggctaaagctttccagagccctcccacttgcctccctctgtacccgggcttcggagaatagcagagagtgcggaggtgctactgtgcccaaacagacgctcatgcatgagctgtcgctgccgggcttcttgctctcgtctcagggcttgagcctcagctgcaatgtcaggtggcatcacagctaacacactgtcctccatatcctctaggacactacggcgcaggtctgagggcagagtctggatgaaggtcacagggtccataggggtgtctgagctggcattctgtgctagttctcgtcgctgctgctcagctctctgctgtgccagtacctatggagcagaaaaagtcaatgagggcatttctcctgccaggcagcctggccccaccaccttcccgctcacatacttcctcctgaatggctggaggcagggcagccagaaactcagggctcacttcagtcacaccaggattccccaccactgcaggcgctgagctatttgtggagggggcagtccgggttggtggacgaatgcctagctggttctgtagaacttcccgacggatgtcatcaggcagggcagccagaaa

SEQ ID NO: 9026 - DNA, 3595 bp, artificial
  synthetic oligonucleotide
agaaacctcaccagactctcactggatgaacagagagaatctggagaaagattccttcttgctccctgtggtgctggctggaggagggaaacagttaccacacttcctagaccacgtagcctgttacccttacggaacaaacggcttaatctacaggggaaagtgtaaggcttatttgagggactgtgtctcaggtacgagatctcttaattctttggggatctgtgtcttagggtgtgatatctacaaactatttgaggttctgcttctcagggttaacctaaataacagagaggctctctaaagaaaaagatatttggctggccgcggtggcttacgcctgtaatcccagcactttgggaggccgaggcaggcggatcacaaggtcaggagttcgagaccagcctggccaatatgggaaaccccgtctctactaaaaatacaaaaattagccaggcgtggtggcgggtgcctgtagtcccagctactcaggaggctgaggcaggagaatcacttgaactcgggaggcagaggttgcagtgaaccaagatcgtgccattgcactccagcctgagtgacagagtgagactctgtctcaaaaaaaaaaaaagaaagaaaaatacgttcattcagggatggggcattgcaatgggaatatgtgtgccatagtaaactatgtacatactcagggaggtaaaggaaagcaaaggtttttaaaggaaaaatgaggagagttatgtaattgttttcaaatgattgtccttggccacaaaatcagtaacaagggtgataccaatccagagttggataggcagttgctaggcagatgtcctcaaagtattttttgcttaaggttgtaatggcctttgtgcaaaattgtgggggttttttcttttttaaatatatttttttggccaggagtggtggtgcactcctgtagccccatctactcaggaggctgaggtggaaggataaattgagcctcaaccaaggctgcagtgagctgtgatcatgccactgcactctagcctgggtgacatagtgataccctgcctcaaaaaaattttttttctttaaaaaattgttttagagatggggtctcgctatgttgcccacgcatgtcttgaacttctggcctttagcaatcctcccatttcagccacacagagtgctgggattacaggcgtgagccactgcaccaggccttttttcttttttttcttttgagatgggatctctctatgttacccaggctggtcttgaactcctgggctcaagcaatcctctcacctcagcctcccaagtagttgagattacaggtgtgcaccaccacacccaaacaggattttttttttttgcagtctttggtgatactttttgttatcaggtatacaaacttgagaaccctttcttccccagctctatttgccagtttttgtttgtttgtttgtttgtttgtttttgagatggagtttcactcttgttgcccaggctggagtgcaatggcacgatctccgctcactgcaacctctacctcccaggttcaagagattctcctacctcagcctcctgagtagctgggattacaggcatgcaccaccacaccctgctaattttttgtattttcagtagagacggggtttcactatgttggccaggctggtctcgaactcctgacctcagacgatccacccgcctcggcctcccaaagtgctgggattacaggcgtgagccaccgtgcctggctctgttttttttttgttgttgttgttgttgttgttttgttgttttgtttttctggtttttttttaaacataagtgactccatttagattctgacacctttcatagcaataatgtgaggaccttgagtactttgcattttttttccaaggtgtgagctttctgaggtatttgacctcaggaggtggctgaccaacagtatgaggtcctgaggtgtttaggagcctgtgtcacaagatgtgaagtcactgaaatatttttctttcagactatgaatttcttgggatatttgggggtctgagtttcagggtgtgaagactgtaggctgtttcccaggtctctgatctataggccaggctgtgaggcttctgaaccctttagggttctacctcccaacatgtgaggtagttctttgaatgtgagttctacgtgaggcagaaattttaaaatactactaatagtaataataagtactgcatttattcattccaagaaaagtaacaggcaaggcaagggttaaaaagaaaagaacaagttttcctctgcctagcaagttcacttcaaagacagttttaatacaatgctgtccgaatacccaaggccaaagggatgggctccagacacccccaccccgccccgccaacttccagagcaaggttgaaggaataaaaagagaaagacagattcttttactgttactcttttcccaggcttcttaagcattattatgttttataaatgtctcctttgcctctaggggctggctttagctcagcggttacttcgacaatgctttccatggttaggaaaccaacctctctgggtggtttgagacccgtgggccctctccagtccttttgtggtcgccaaaaatgttgcggtaaactgaggaacagagagaccaatatggagtacatgaggattgttgtttattttaggtacgcaccggctcagtggattcatattcaaaaagctgagccagtgtgtacctaaaataaacaacaattctcctctactccatattggtctctctgttcctcagtttaccgcaacatatgagctggtttatttttatcatggtgttagttctctgaactctttatgggtccattttcatcattgtgaggtgattaccatttttgaggattggtatccctgaccgtggacatttctgaacttttgaggttctctccttgagtttgaggccacattgttcttccaaggcatatttacccatataccaggtctctgagccaatttattgactatatctaaaatgtgaggacaatgagcttctttctttcttccttccttccttccttcctcctcccttccttccttccttccttcctccttccttccttccttccctccttccttccttccttcctccctccctccctccctctctttctttcttttcttctttcttctttctttcttttgttttttttttttgatggagtctagctctgtcgcccaggctggagtgcagtagctcgatctcggctcactgcaacctccgcctcccaggttcaagcgattctcctgcctcagcctcctgagtagctgggattacaggcacctgccaccacgcccagctaatttttgtatttttagtagagacggtgtttcactgtgctggccaggctggtgttgaactcctgacctcaggtgatccacccacctcagcctcccaaagtgctggggttacaagtgtgagccaccgtgcctggccaatgagctcttcagtatctttttgtaggatgttaaatgtacaagtaattttgggagtctgtatttcaagttgtgaaatctcaaagactggtgggagcattttatcatgtggtga

SEQ ID NO: 9027 - DNA, 1158 bp, artificial
  synthetic oligonucleotide
acccttatgggagggacccccacaggttcccaggccggtgttggtgacctcatgcacaccctgggagaggagaggtgaccccacttacgtcggctggggcgaaaacgcagttgtttcctaacttcttggcttgggcctccccacccgagttgggcaggtccagaagcacagcagaggctccctgccccacaagtcgctccgccgtggccaggcccaggcccgaggctcctccggttattaccgccaccaggccctgtcaaaagggacatggtcagggtcagctgttacattgcccagaccatccccacgctgtcgcctgcctgttctccaggcttctgaggagaaggggggaggggagaggtcgtggtcacccctgcgggtaaactaggtgtgctgcttctcctcagcgttgggacctcgggggcagaagggatctcatccccagacagcccgtcccgtgacgatagatagatagatgattgatagatagatagatagacagacagacagacagacagatgcgccgcggagtgctgactttcacctcttgagcccaacggccacaataccaggcctacataagcatgaccctttccctcgaaaccgatctctttctcctagttccacggccgcgctgtcccggcccgtaaaggaaggcaagcaacagaggcaaagaaccttctaccttcacgctccgacacgctgctgccatcttgtcgccggccactccacgggatggggatgggggcgcgggcgctcgttgattggccgaggcgaagcggcggaaggggcggatgcgacgggccggggcgtctgccgctgccgcatgagacgtgggggcgtggcctggtacgctagtcctttggccagagggcggattccgcctgctaaggtatccccagagttatttcaactggggaaagagaccaatagcagaagtacaataccacaacacccctcgccctactctctagctggccttttggcaagtggcctgctccgcgtgggggaagaggggtggatattgagaacggatgcctttctcctctgaaaaagtcttaattcaagtatgaatgtatttgagactcctatatgctagacggtgtgcggggcacctgggatacccagcggaataataaaagattcatgccttccagg

SEQ ID NO: 9028 - DNA, 3363 bp, artificial
  synthetic oligonucleotide
tcagtctccaggaaaggtactcagtatgtgctacttcagcaagggcagcctcttaggctaggatatcattcagctagaacatctctggggtggaagaatacagcaggattccaaatggacatctgaggtgagaggaatccacggtgtatcgtttagagttgggaagacacaaaatagaggctttacctgaccaccctttctaaagacaccacctaagtcactttatcacatccacctgtctcatttcctgtatagcacttatgacagcctaaaaccatcttattttctccttatcttctttcccctctggaatataagttccctgtgagcatggagttggtttattctattctccgctgtttccacaacttgcaactgaataactcctgataaacaataagcattcaacaaatttggtaaattagttaatttcggcttttgacggtttcggtggtaggaaaagggcgagttcgaggcaactacctctgacatagcggtggggggtggggatcgacacctcaagcattctaaagactggagcgctgggtctgaaattcaaaagtgccgcctccagagaagagtagaaaggagttggagtgtaccaatgcgaggcgagagaggacgctgggctgaaacagaagtgcaccgtttgggaccgaaggccacgggagagctaccagcgtccccacattctccggagggggtcaagtaaggctgggaagccggctccggccggtccggcggggagccgcgcggcggaggactgagctggcgggaagctggttccagacgcgactcctttggcgggagggggaagtaggcggggtaactggcagctcggcctgtaccactgggccggggcgggggccgcgcaggaagcggcaagtgacacctggaaggggttcgagttagagcacccgcgcggggagagtgggttcgagcagaaccccctctggacgggcaaggaacccgtaaggtccgcgacgtttcaggttacatgggctgggttgtactactccggcaccggataaggggtccaggccgggacgtgcgcagggccgcggccaggtttatctcaccagagccattgggtccaatgatggcggtgaacctctgaaatggtccgataatctgtcgacccttgtacgacttaaagttctcaatctcaatcagtttcaggaaccccatgacggccgcggcgccggcggcagtaggacaggccgcgccgtacgcccgagaactgaggtagcccgcgcgggaaacgccgcagtgcaagccgggcgaccggcaaatgtcgcgagaatacgtccaggcctaacgggattttcgccttccggcaggagtgggaccaggggcggggactgatgttgcgtatacgaggagcgagctgacgactggcgtggtgcctccgcccccctttcttgttgcatggcaacaacaaacacttgctcctgcggaccagatccccggaggagttgttgctgggcggagtcagagcagttcttgaggttcaaggaggcgggggagacctgagctcacgcttgctgagacagaagtcacagcaggattatgcccctcagggcaagaggaaggtgggagctcggctgtggctttagcctggccagctttcaaggctaggacaaggacagggtcgggaattggaaggacccggggggagcggagagctggacgggaaggaggggccaacgggaggattcagtgttaggtgagctcagactttgctaatggtggggtgggattggtggcgggacgggttgcgaaggcggacgggttgtgaatgggactggggctactcccaggcaacagggatacaggctggggaaggctacggcctgagatactacccctatcccctgcctccctcctgttgtaccaagcagagttcagaaactgccgccgtaacccaagaacaaagttgcatgcagagccaacctaagagcttcaaaatcgggattccttactgagaaaggtattttgtgtgaacccccaggagtcagggtccctaagccagcgctctccacctccacctacctctgcctccatgcctctcccccatcccattcccacagctctataccacaatgccaccttacctctcttccctctctgctctctatcattaataaggcaggggccttagcaatccaagaagcttaaaatgtcagctgaatcttccccttcagtgaccttatactgtaatggcaggtgaaaccagtaggtaagttggtgccattctcagacttaaacatggaaaggatctggtggttgccataattattcctttaactatttattaaattatgtccgaaggctagaaagagtcctaaagacttaggacaagtccaggaaagtgaggaagtggctgggcatggtggctgacaactgtaatcccatcgtgagggaggcaggccaaggcaggaggatcacttgagaccagcagttcaagaccagcctgggcaacatagtgagaccctatctctactaaaaattaaaaaattagctgggtgtggcagctctcacctctggtctacccaggatgccgaagcaggaggatcacttgagcctgggaggttgaggctgtagtgagtggtgtccgcaccacttcactccagcctaggtgacagagcaataccctgtctcaaaaataaataaagggaggaagcttggtagatggaatctagtaggggagccataaatgaagttcagctgggagaaacaatcaggctgaggggataaaatggctaaaagacagcaatctcatgtaatccatggggaaatactgttcccttttaaaagatgagatggtgagcctgggtaacatagcaaaacccaatctctacaaaaaaattttaaaaattaggcaggcatggtggcacacacctgtagtcccagctactcaggaggctggggcaggaagatcctttgagcccaggagtttgaggctgcagtgagccatgattgcaccactacactccatcctgggcaacagagagagaccccatctaaaacaaattaaaaataaaataaattttattctctgcctcagccttccaagtagctaggattacaggtgcccactgccacgcctggctaatttttttgtatttttagtaaagacagggtttcactatgttggccaggctggtcttgaactcctgacctcctgatccacctgcctcggcctcccaaagtgctgggattacaggcgtgagccaccgcgcccggccaaaaataaaataaaattttaaatttaaaaaagatgagatggcacttggggggaaaattaaattggatccttatctcacaccatacacaaaatgcaactccaagtggattaaaaac

SEQ ID NO: 9029 - DNA, 1567 bp, artificial
  synthetic oligonucleotide
ctcaggctccccacgctgctccttgatatactgaatacagtcccggcctgtcttctccgagtccacaataatggcatccatgttcttgcccaaaaccttggttacagcaatctgatacttcttttgtgtgggctggcataggtcaatgaggcggccgtactgagtaaagtaggaagggaaaactgaagtatgaagcttttggaagctggctcaggaatcctaattcccagtatggaaagggggacagactagaatctatatcaggaagtgaatgcaactgtattgcctagtggttaagataacccaataccaagcatggtagtgtgtgtttgtaatcctagctacttgggaggttgcaatgggaggacagcttaagcccaggagttcaagaccagcctgggcaacataatgagaccctgtctcaaaacaaacaaaaaagacagcccactagttctgtacccatgcaaccctaccctatctgaatgagactgtatggactgaggaggaggcaattgcagactagcttgctgtgtgcactccagatcagcacagtggccaatcctaacgtccctttgaaaggtggaaaagtttgggtaagagaagggaggtaaagaaatgaataaatgagttatgtaatgagggaaactcagtattacattaacacctcaaaagaggttcagagcaagagatgatattgtctcttagcacaattatcccagatgcctgaaagtatgaagctatgtttgccgagaacactcctggttttggaacctaacaagattgaatagaagcctgcaaacctgaatggcctcaccctaggagacatttttacatgacatgatcatggactagactaattattaattaatgactcagtgggattctagtaatgtgccagtatctttctactcttttttggagacggagtctcactctgttgcccacgctgaagtgcagtggcgcaatcttggctcactgcaacctccacctcccaggttcaagtgattctcctgccttagcctcccgagtagctgggattacaggtgcccgccaccatgcccggctaatttttgtatttttagtagagacggggtttcaccatgttggccaggctgatctcaaacccctgacctccgatgatctgcccgcctcggcctcccaaagtgcgaggattacaggcgtgagctaccgctcccagcatctttctatttattacatgattgttctgatgtaagggatctgtgtttgaagatcaaagtggactgtggttttatgaaatatatatttagtcttctacccgtgagttcctgacacacaactcctaaaacccttagaatctcaggaatgagcagtgtcttttgtatgttaatgagatgattatggctggaggcccatagatagcttctggataggggctggttaccagaaagaccaaggcaggattagatttgggactcttagctccacccctacaaccttcaggaggggagaggggctgaaggttgaactgatcaccgatggctgatgatctgatcaatcatgactacataatgaagcccctgtgtgg

SEQ ID NO: 9030 - DNA, 1321 bp, artificial
  synthetic oligonucleotide
ataagggggaggggaaataatatcacctacctcataaggccctcactttctatccgcacttctcttctaccacggctccctgctcaagacctatctggtttgggatcctcggccaccttactctgcgtcagctgacacaagccacgcccccataaaccacgccccggggcggagggaaaactgttgctaggcaacaagtgacgtcacgcaggccctcgggctagagtgcacaatcacagaactgaaaacaaatttcattcgtcatccaaccattcatgctcctggattccttcaatgcatattcgccgccccttccttttgggaccatccaggtgctgggctttgctgaagacagaattcctgccctcagggagcttcctatctgaaaggagagagagccccagacaacagttctgcacggtacaggagcagaggggcgctgtgggagcccagatgacaggatctcatccaacttgggaacaaagataggctgcgtgaataaagtgacacttcaacagctgaattaatggggtttgggtgtcagtgtgaaaggcctttcatgcagaagacattgcaaagacacctggggggaaaaaaaaactggtgcagtctaggaagcacttgtagttagttgcacttatagttatgtgctcagtggtcagagcacagggtgtgaggccaagagtggcaggtgatgagactcaagaggtctggcaggggccagaacttatgtgaccttaatgacctatcaagcagctagactttaccctgtggggtatggagtgtcatagaaggaaaggttgtgttgactagcatcaatgccctcttactgctgatgtgccaagtattaggttgaaaatggccagtctggaagccagggagtagatttggggtcattcatgtgagggatgttgaggctggaacaggatagtggcagaagatgaggaaagaaggtagatttgacgtacagaaaggagagactcaactggacttggtgaggaatcagctatgaggagacaggaggattttaggctgcacataaggcagagaacacagaggaaattgcacaagtttaagggggtgattaagacaaagataagtgccagaggaactctgagggctgagaaatcagtgtgggatagaatgggcagaaacatgtaaaatgaggaggatcattatgaggaggagggattcgggctaagactcactgtgtgactttggaccagtcactatctttctctggtcctttaggtttccacctgctaaactgggagatggagaatgataattgggaggaatgaattacataagagaatgttca

SEQ ID NO: 9031 - DNA, 352 bp, artificial
  synthetic oligonucleotide
gaaggttttatcttatgtgtgcattacatactccaaaattcccctcaaatactattgcttcccaaaagcctaccgtgctttcccttacttctctcaaacaacaatctctctttatgctatctcctaaaattagacatagagaaaatcaaacctaaaccctggccaaacaaatctaaacaaagcaagaaaaaaataaaataaatgccaaaacccacgcagaaaggaattccgtaagtatatccactcaaaggagtattttgtggccatttaaatgatgtttataaaaattttaatgggaaatgtttatgtgaaaatggcagtatgtaattgaacatacagcatgatcccaaat

SEQ ID NO: 9032 - DNA, 3440 bp, artificial
  synthetic oligonucleotide
taatagagaaatcatttctttctttctttttctttgagacagagtttcactcttgttacccaggctggagagcaatggcgagatctcggctcactgcaacctctgcctcccaggttcaagcgattctcctgcctcagcctccccagtagctgggattacaggcatgcgccaccacacccggctaattttgtatttttgtagagacagggtttctccatgttggtcaggctggtctcgtactaccaacctcaggtgatctgcctgccttggcctcctaaagtgctggggttacaggcgtgagccgccgtgtctggctgaaatcatttctttagaaaggaggaggccagctcctgcatctatggagctggccttggctagccttgcagaacgcatatacggccagacaatcaaagcatggggcaaacggcatagctttgtgaaagcgcccattgtgttcagacaaaccaaagctacttgtcagcatctctccatttccccagtcccctaggaagcaggcagttctgccacagtgggacagactggccaccacctgctgattcgggttcgggcacaattggcagtcagaccacagggcagaactgaaaggaaactcctggaattcggaattcacaaatctctctatttctcaggattctgctctccaggaggaagattgagagatctgattggggccgggtgcggtggctcacgtctgtaatcccagcactttgggaggtcaaggcaggtggatcacctgaggtcaggagttagagaccaccctggccaacatggtgaaaccctgtctctactaaaatacaaaaaattagccaggcgtgttggcgtgcgcctgtaatcccagctacttgggaggctgaggcaggggaatcgcttgaacccgggaggcggaggttgcagtgagccgagatcgtgccactgcactccagcctggcaacagagcaagattctgtctcaaaaaagaaaagaaaaaaaaaagagagagagatctgattggtcctggaatgagggatcagttctgcacctttccggtgggataagacctactcccaggcataagagagtattgccctctagtggtaataataatgataatgatgataatgataatgataatgataatgataatgataataacaactagtggatgtggtccttgcttgggagatcaaccatacccgtttgcccaagattgttttagcacttgaaagacccacatctcaagaaacctctgagtctcaggcaagcctactccttgatggtgttcaatgcactcgtatacacatgatctcattacatggctcctaaccctcgatgccaggaatcaggattcagtctgcacagatctgtagagctttagagatccagcccattttccagatgaggaaacaaagcccaagaggagggaaaaaatttccttcgtcagcattacattacaaattaatggcagaaccagaatcagcatctaggtgtccaggtccacagccccggccactgttgcccctggctggcatgccctcagctactctgtcagtttgtctaggtcccatgtcctccagactcgctaaactactcaccccttaatcctttcagaaaacttccccctctgaaagcctgaaacactcatttgacacttagcatgtgctataggtaccgttttttatcccttaaatgtatagttcaaaaaaaagaaagctcctcagctccccacaagcccaacccccagagatactaacaaggagagcggcctctggtcagaagagtctcaggagtggccctagttggtccagggccccgaggaaagtgcatttggcactgcagagcaagaaaggaagcagagggaggcttttgcaatcaccaggtgggatggatttgagagccaagagctgaggagaggtgaaaaggcatccttgcagcctcaagacaaaaggagaaagtgagagccttctttgccccagggatgccgccagggaatgggtcctgctttttctgctgccaaaattgctgtgcccttctccgttcccctggtccctgacaaggacccccaaaatcagctcttgcctttcccctccactgagacaaatttgcaaactcccacatctctgtggaaacggcagagagcaggagagaagaaaaaaggagaaaaaaatccacccacatgccaacaaactggaaaaaaaataacccaggccttgtcgcactcagctgttggcttgctgctccctcccactgtggcggctgctcctgcctcctggacatggacccaatgctgtgcagttccccttcccatctggagctggcttttgtcaatgccccttgtccctacccccaccccagctctgggagagagagtcctggagtccaggaggaggaaagctggaagggaggaccggcagagccacccagggctgtggctgaccacagactctgtgcccatcaccgtctcccaaactatggaggggaacttcctcccctcccagggaaataagttaaggagatggggcactgcccacaggctggccccaccaggccacttctgtctcagaggctgtcccctgcgtcttctgtcctccctcccccaagcccttccccttggctgcctctctctaccattttcaagctctgttttcagtctaactccttctattttcatctttttgtgccctcgcctttcttcaccttctgctccagttctgggcaccatatttaaacaaagcaaaacaaaacaaaatggagtgtgttgctaggaaaggagggatgtagaaatcatcactattaggaaaacggagatgttttgcccgtagaaaggaggatatggactcagaggagcatggaaggatagaaacacaaggagctttttggataaccttattttacagatgaggtgatcgaggcccagagagggaagaagacctggggctaccatgcagaagaggggacagctttgttctgtgggcctccagaaaaaagaaggaggaccagtgagtacgatttatgaaaaggcagatttatttatttatttatttagagacagagtctcactcttgttgcccaggctggagtgcagtgccatgatctcagctcactgcagcctctgcctccaggttcaagcaattctcctgccccggccactcgagtagctgggattacaggtgcccaccaacatgcctggctaatttttgtatttttagtagagacagcgtttcaccatgctggccaggctggtcttgaactcctgacctcaagtgatcttcccgcctcggcctcccaaagtgctggtgttacaggtgtgagccgcccgagaaggcagaagatttaaatgacagttttgtttcttccttctaaatccgtattcctgttgtttcgtttctttgccttgttttgcaggatctccagttcaattctgaccaaaagggatgataatg

SEQ ID NO: 9033 - DNA, 2910 bp, artificial
  synthetic oligonucleotide
gtcttcctctgcccccggcccaccatgaccctccctgaatggaccttggtctacctctgtccctcttccagtgtggcgccccaaggcacacagtcggtcctcccggactgagctcgcagcagccctgcctgggcaggaaagcccatttcctttgcccccagactcctcaggggcagtccacactaaaattcagcttagggtgtgctgcagtggagcccagccgagccctcaagctacagctgctgctcctggggcccagccatctcaacccagcaccccagcctgctgcctcaccacgggggagttgcagagagctgtctcccggcagatttcctgaggcagaaggtttccccacccccagcccagcctccaagagacactccactggttgtggcacatggtaggaccagctgagcagtgagaggagggggaagcctgtccattcgctacaggacttcagacttgctctgtagtgtggctggattaaacatagaaccatcaaatctgagctggaggggtacttcaagatcatccaaggcagaccttgccatttaaaaagatacgggggaactgatggcctaagagagaaagagactcagtcaaggtcacaaagccaatctgcagcagagctggaaggggaactcaggtctcccaactcccagctcagtgttccttcgaatacggcagaaaagaaataagggagcctttagggcagccttgggagtctgcacgcccttgactctctcagcctgatacatgtaacccaatcagctcaccatggtatctacacagaaaaagtggacccagcccatgtcccaccaacccaagagatagtgccaaggtgtcccaaatagacacacagaccccagtgcaggaactggaaccgatccagcagaggggcaatctagacttcccttcccggtagggctctttaaatgggtgttgtttttcttgaagggtggagagggggtggactttgaggaactagccaagggcttggcctccatctttgctcccccatctttgctccccccggccagaatgtgctgcagttcccttcagagggatgtctcagcctccagcagccattctggtccccacctgcctctttggtaagggatggagctgaggcggccagaggagaaaagatcaggcaaaaagaaaaaggaaaaaaaaaaaaaggcgggggtggggggctttctctcccctggggctctgagtagacaccctcgccgaccataaaaattccaaccagcatacccaaaataaataaataaatgaaaacctatcttctggcaaggatgcagctaggggttgaagaagtggaggcgggggaggcggcgatgactgctctagtccctcgctggccgcggtaccgggaaagaagagacgcctgcactcatctggccaacccagcctggggtggccagggaaggggtgtcggctggatgagggggacctggcttctcctggcgggttgggacaggagaggaagacacggaaccagacactggcttcttactctatcagctggacaagttggagagggatctagagggaagagccgggggtacaaacacacattccttactttctctggagggtcgtggccgggctggtgctggtactggtgctgtggcctccgccggcgccgggactggagctcctggatgcgccacggctcagctggccccgctcccgcggtggccgcggccccacgcccaccgccgccgaatagcccgcttccttctcgcggcccgggtgcgccggcccggcctcccgcccgccacgctcgcgacccagggctgggttctcgtggtgcaggtggcactgggccacgtcacgctcgcgggctgtgtaaccggtagtgtcctggagcgggtaggaggcgtcccgctccttgtcccgatacacagcctcccgattctggtaggcgccttcccggttcgggtagcccacgtcccgggccgcctggtggaactggctctcccgcagctcgcggtggtggaactgggtctcgcgcaggttctggtactggctctcgcggcccgggctatcccgcgcgccgtgggggtcccggtgcagctccccgcggtgcagctggctctcctctcgcaggtcgcggttctcctgggtgagctggtccagctggccctccagctcctcgatgcgccgccgctgggtttccagcagctgctgctggctctcgatgatgttgttcagctccagcaggtactccacggcccgatttgggctctcggatcccgggccgcccgggggccccgaccccgcctccatcctggcggcccaggggcaggggaacgggcaggagagccctgtccccgctctctcacggcgccaccctcccccgggcccagccgggggagggggccggcgggacgcgagggcgcgcaccgggcttgagggcccgggggccctagggggcccgggagacagcgctggggccggcggcacggggagcaggagctgaggctgccgccgccaccaccaccaccacagccactgctcgggaggacgcggcccacggcgctccgcccgctgcggagtcactgcgcagcgcggccgcgcgggaccgccccggccgccggcccgccccccgcccctgcccccacccggctcgcccggcccgcccccgcgcgccccacctgcggctgccacccgcacccgcagctggactggccccaaggcaccggcgcccggccagggccagccccatgacagcccgcaagagatctctccattccacccgtccctgggtcctcacttaacggagcctaaagaagccctccttcccagagtccgcccgtccctcgggttcgccaggttggggatcttcatccaaagccatcccgggaggaacccccatcccaggcagtccccaggtcccga

SEQ ID NO: 9034 - DNA, 1554 bp, artificial
  synthetic oligonucleotide
ggtgttcactgcgtgcagggaaggggcagaggaggaccatggaatttgaaagtgggagcgtgtgggacacggacatcccccttgtcatcttcctccatcttcacctcaggcctcccaccctcactcatgctgcgaaggagacagagatgaacacagcacaggctctgtcctcagctgagagagccaagacgtggctttagtgaggggagtgtccatctatgctaagcgctaaatgacagagatacacacagggagaggagcaggtgggcctcagaagggagcatttgttgaaagaatgaaaggaggccccgctggcgaggtggggcaggcaagcatcagggtgctgcaaccacagcactcccggttccactattcacaagccatggaatcctagggaaggtatttcactatgttgagtgtcagggctttgccttgtaaaatggggctttgggggtgggctgcggtgagagtcactccctttatggggtgtggctgtgaggctcagcctagcacagtgcctggcacatggtacatgctcagcagatgccagtagcaccaatccttagccttctcagccccctgaaggaacagaggaccagggccacagcgcaccttatcacatttattaaaatgttccatctccttctgcagcaacaagattgcttctgaggcctggcccaattattctcaggtaccaggcctgaggggcctgacttcaatgactccccagatgcctacagaactgaggccaagcctctcagcctctctccctaacactaaccctctgctctaggcagaccgatctcttcaccacccacctacccccaaacccagcacacatgtattcagtctgctgtctaccaggccctgccctgggaatacaacctctcaaggagctcgtggactggccacttgtcccaatctacctaaggtttaagcaacacatctaatcacccccaccaccactgtgaacaaactatgagtacctactatgtaccaggcatagtgttagcctctttttgtacattatctcctttgatcctgcaaagtgggggttattcatccaatttcaagatgatgaaactgagactcacaaaggtcaaaatgacttgcccaaggtcacacaagcagagaagctcagagtgaaccccaaagctcatgttcctaccaccacgctccactgtaccagaagctcagtgccgggcacgtacgcactatgacggtgagttcccttatcttcattcctcaatatcaagccagagaggcaccaacagacctttcctctccagtgctctttcacctgagagattatgagaaatatatctctgctccaaaagtatttctatgtgatatgtgacagtcctcaagatggcagcaaaggggagcaaaagagctccaagtcatgatgcagcggggaattcgccaattctcgctatggactgattcttactagcttgagggtacacagcatcatatgactctcaatgtgggggtgcagctcaccccagggtccatcaccctttatgcatttagcatattattcattatgtatag

SEQ ID NO: 9035 - DNA, 2131 bp, artificial
  synthetic oligonucleotide
tagcagctgtaccatcagtagctttataccagttgttctgaggttatgaaaaattaccacaagctggtagcaatggtaatattcactgtacatttaaaagctttttcggcataaaataagagggcacttttagacaaaacagcatgttttgatgcaaggatatggaacttgaaagcacagtgagcaaaggtcatcttgctataaaataggaaccaaaaacaatcttacaagtgtttgcctctgagccgaccagctctgacctcacttgggtacacataaaaactgtgcttactgcagaagaaacaagaagtaccaagtgttttctctctctcctctcatccaattctgagggaatcaattatctcacacggccccttgctgccttgtgttaccacaggctggaggatcactgcagtccaatggcaggaggggcagatcctgaagctggaaaaggtcacatagcttccaggttggtggccatgtcaggccatgggcaagcagaggaagctggtccagagagagaagtccatgaaaaagagatgataggctgggcgcggtggctcacacctataatcccagcactttgggaggccgaggaggggggatcacgaggtcaagagatcgagaccatcctggccaaaatggtgaaaccccatctctactaaaaatacaaaaattagctgggtgtggtggcacacgcctgtagtcccagctacttgggaggctgaggcaggagaatcgcttgaacccaggaggtggaggttgcagtgagccaagatcatggcattgcactccagcctgggcgacagagcaagtatccggctcaaaaaaaaaaaaaaaaaagaaaaagaaaaagaaagaaagaaagaaaaagagatgacagggaccaggcaagccatgagagatggagaaagatgagacatgggcccaggagatgcagacagcgagacagcaaccttggtcctcgacttcctggtcccacttccagttggtgtgaggcctggctgtttttcattaactgttcttagattctgtgaaatgtagcctcacaatagtcccctcattagccctttattcttgagctagcttgagtgggcttccgttcctcacaacaaagtgtacccagactaagacaagtgaaaattgggaatgtaagtgcagggtttgtgtaagcaaaatcgcataaagaacacttaggtagagaggggtgaatgcaattgtccagcgtttgtgtttgttcacccagaagctccctggttccctgacacttgcaaccacagccacacgctccagccacacgctcacacacactgacattcagtggcacacagcaacaaacgcagcagcaaccagatatggttctctgcagaccccctgacatgcagggccacgcgccagcatgcagtgttgcactttgctcttcacagccacgctgccatgcagcagtgcacacccacatgcataaacacagaggtgctgcccgtaaggctcagggcaggagtcgaagcttcactgagctctgtgcagcctccctccccagctgccaagtgactcatccccagggctgctaattaaagccaggacagaggggacagaggcaaggggaggggaagagagagaaggcaagtttatttcggtgccaaccaggcactcagccagcttaggggtcacccacttcctggggctgggccaggcggcggcagaacacagagaggaaggggaggagaagagaaacctcttaccccttcttgcccttctttagcttcctggaaagttacctcctcctctctcccactgtcaaaatccagctctgactcctctagacttctgtcctcacaaactggctgtctacaccatcatcacgctcccatttgggctggcccgagctggctcatctgtgtctgcagcaaccccagactgtgaagcagtaagtggcaaggttccaggcaaaggaagtggtaggaacagggcagggtgggcaaccgggctgagccaaatgggaggcatcatgggaggtgatgcagctggatggctctggggatgggtagtgtcttggacatgtggatgggggagccacagacggttcatgaggtcttggccatcccagattgccaagaggtgaaaacaagag

SEQ ID NO: 9036 - DNA, 1677 bp, artificial
  synthetic oligonucleotide
aaagggcatgagcctacaataaagactttggcttttgctctgattgaggtgagcagaggagggacatgatctaacttgggtgttccaggaatcagcagccatgggataaccttcaacttcctcactgtggccatggatggctctcctgacttgacccccacctcatatattctctgccccattgccccaacctggctacctcctgctcagccttcaatgctctgctcaggtatgcctttccatgcctgcctgcctcctccacacaggctgtcttacacccgctcctctcgggctgcagtagggccctgttgtcacctctaattcctagggcaaaggcactacttagctcattgaattcttgaaacttaccaaggcaggcaccattagcctcatttcatagatgaagacactgaggctcagagaggtgacataaacttgctcaaggtcacatagctattaagtaaaaaagctaggattcaaacccagggcccaggcttttcatgacatcttgttgcctctcctcactcccggctccgtgctgcccctggctctgcactctttggcaattcctcccttgagagctcacccccgttttggttgcaaagggaatagtggcagggagatcaggctgtcagcacagcctcccacaagggagcctggcaaaaaaaggagggtgcttgacggcgttgcttctgacatcatacatactgctgaagaaacagcactggggatgtggaatccctcaagtcagagcccccagaacaacactcggggacatgctgatcacatggaaaatctctcttcttctctttctctcgcacacatacacacacatgcaaacacacagagagagaaagagcctgttgtagagtaagacgctgggcaggccaaggctcaggtcctgactgccactgaccagctgtgtgagcccgtgcatgtcacttttcctctctgcaactcagtttctcatctgtgcaggggtcaagcaaaaccaactccctctttggattcctggacttcagaaacggtctgggagcaccccctctctggactcttcccagccaggagcaaaacatctgcatgtgcacacacacacacacacacacacacatacactcacacacatgcatgcagaggtacaataacacagacacatgcaaaggcagacaaacctagaaacaaaaacacatccacagacacaagaaaatagacacaaacacatgcagacatgcacatatacggacacaaccacacacacacactcacacacacacacacacgcccatgtgcgctgtctgctgggctattctgtgggggaaattggagagcatcctctgcagagggggaaataagctatgctacacaaataaccacagtacaaagcagaaagttatcagggctggggaacagaggaagtgctgggggagtgcaggagagagatcccttctgtttgggggtggttgagcagaataaaaataaactcgcacttactgcgcaccttccctgtgtcaggcattttccacacattatttaatctgcatggcaaacgtgagggaagaattaggattcctattttgcagatgaagaaaaaaactccaagaggggaaatgactgccaaaggtctcagagctagcaagtggcaggacagagattcaaaccccaaagcttgtgctagtt

SEQ ID NO: 9037 - DNA, 1794 bp, artificial
  synthetic oligonucleotide
ctggcccctgccccctggtgcctggactccgggccaggccaagccagttcccagggttccctggttgcgagggcagggccagcagcagggcagggcgagcagcaacagtgggaggcgcctcccatccagcatcctcacaggtaaagagcagccctgcggggcagcttcctttttctcctcatggcctcctctgctcagctgggggaagggggcaggggagtctccacgcgtggcaggagctgggccccgggtcttgcctgccctggtttcccagagctgttgttccaccagaactgctcccatggtgccatggcaaccaggctgccagggaacccaggtggcgacagagcccaggcgccttgagccgagcctgcacggtgaagagccacagaggtggggaagacagggaaggagtcgggcgggaaggaacacgcaggtgaggcatggaggaggctgtggggggaatgggtgtggctgggacccagagaatggtctcattatggggggcacaaggttggaggctcttggctggtaaacaggtgaaggggtactccccagcccctattcggcagaggcaaaggcaaagggcagaaatgggctggggtaggtactgggggggaccctaccagtgcaggagctggaactgcaacaggcctgccagccttgcagcagagcgctttgcactgggggctggatgtggtgtgaaggctgcgcccacgaggcccggtcccgggctgcagcgctgtggagctcggctccgccctggggagagctcccacccatcgctcgctctccaccccaaattctctctcctcctgggcctggggcggtggccctgacatcacccccactccagggttcagccccagctcagcccacccccggcatccaagatgttcctctcctccctgccaggactgcaggatcttgcccattaatctctcaaacctcccctcccagcacacggctcaagcccagttttgatcaactgtctcctgtatgcatgaaccatcatctataacttccactgctcagaagagatagcccaagtcccttattctggcatttgaggcttctccaagatacaacagctaatatttatagaccatttagcacatttaggtaccattcttaccacttcacactgaataacttgcttgctcttcaagacaaccgtatgaggtaggtactgtaatttatcttcattttacacataaagaaactgaggcccagagaggttaagtaacatatctatggtcacacagctactaatgatagagccaggattcaaatccaggcagtctgactccagagcccacactcttaaacattaagccatacttcagggttggctgccagccccctattccatccacccatcattccagcctggcccacatcctgcttttcccaaatgctcctctgctttctacctccaaaactgctcatacagtacctaccacttgaaatgcaatccccatcgtctccgccatctgcaatctgagaaattcccccacatcctagttccgtcaagattcaggtcatatgccaccactaagaagccctcctgaatcccgcctccagccagaaattattgctgatcctgttcagagctcccacacacagcacatgtctgtcctgctttttatggcacaggttagctttggcaaagcatgacagctatttgtgttcatgactcccagaatcccagctcaggaagagaatttgataatctcccagctaacacagagcacacggcctggaacagagtaggtgctcaataaaagctgccgt

SEQ ID NO: 9038 - DNA, 837 bp, artificial
  synthetic oligonucleotide
gaggtaggcacacctgaaggcttcgatgagtcgctccactttctgggcctcaccctgaacccggatatgggactggaacttccggagcgcatcatccagatccatggaggagaagtccatctcatccaccacacagctaaggagcaaagaaggaggtgtggcgctttcaattcctctgcagaaaacctctgacccacctggacctgctcaaatggaccaacacccccactgatagactctcaaattcaggacctgtggcccgagcaagtacacatgaggacagaatgtttgaaatcaaatccatctcagaaaattgaggcaaggcacgtggtcactaaaggtcctttccatcaagccactcatttcagagacaggaaaactgaggcccaaaacaggctacaggatgagcatgtcttgcccagggccacccagaagactttaggaatagagccaaacaagatcagacccctttggggcagaagggtacaggggcaggaaggtctattcatcctgttttgaaaagcttatctgagctaaagggacaggctgcccccttcctccctcttgctgtccttttccaggaatccctggcccagcctgccccatcctggggtcctcactccaacacgtctctgttgaactgcttctgccggttccctaggaattcccctatcatctgccggctgaggcctttccgctccaggatgaagtgagccactcccaccggtgtgtctgacaggaagccccgctcgatcagatactggatacccttctctggcttcctgcagaaagaggagaggtagatgagatgactgtcctcctggaactgtgctctct

SEQ ID NO: 9039 - DNA, 3213 bp, artificial
  synthetic oligonucleotide
agtgggccatctaggaagctggaccctgaaagtcccttccaacctgcaaagtcctaagagtcccatccctaaaagacaaacatctctacttgtaatgagctcagtttgaagaatcacttcaagcatctttttttttttttttttttgagacagagtttcacttgtcgcccaggctggagtgcaatggagcgatctcagctcactgcaacctccgcctcctgggttcaagcgattctcctgccttggcctccccagtagctgggactacaggcatgcgccactgcgcccagctaatttcttatatttttagtagagacgaggtttctccatgttggccaggctggtcttgaactcctgacctcaggtgatccacccacctcggcctcccaaagtgctgggattacaggcatgagccaccgtgcctggcccaagcatcttttttaaattttgtttttattatttatttatttatttttgaggcagggtctggctctgttgcccaggttggaatgcagtggtgcgatcacagcacactgcaacctctgcctcctgggctcaagtgatcctcccgactcagcctcccaagtagctgggactacaggtgcacaccaccatgcccggctaatttttgtattttttgtggagacagggtttcgacatgttgcccaagctggtctcaaaactcctgggctcaagtgattcaaactgccctggcctcccaaagttctgggactataggtgtgagccacagtgccgagcccacttcaagcatcttgattactgaagatttccagactgacctggggggtcgcaggttcacccctcttcacacaaccctatgggctattgaggtggacagggatatttcctaccacttcccaggttgtaagtctgtcatctcctttggtcctcatattttctgtccctgtgtgtctgttactacctccaaatgcatctgtgaggaaaaggaggggcagagaaggcctgggccttgcctgagaccatgcagatggcatggcagaacacctcgcccgccacactccacacaccacacacctacatcaatatggttcacaccagacttaggtgtcaagctcactctctccctcccatctcctcccccacagtgctcataccacaaggagatcattgaagaggaagacctcccgctgatgcaaccctagcctctgggggcggtttggatctggcacctcgtagagctggcagcagcaaaccagtcgacggtgagggagagacaggacctagacaggcatgaagaaacaggtgtcagcaaggccagcccatcagcttcaggcctcctggcaccttaactttcaaccgcaagaagtttaccactcatacatgtgtgtcactctgacacaaggggtatcagcaactaagacctaaacttatctgctaccttgcctttgcccttctgtctggaatgtctttcttgcccagctctgcatggtcatatttcaactccctttcaaatttccatcccggccgggcgcagtggctcacgcctgtaatcccagcactttgggaggccgaggcgagcggatcacttgaggtcaggagttcgagatcagcctggccaacatggtgaaaccccgtctctactaaaaacacaaaaattagctgggtgtggtggtgggcgcctgcaatcccaggtactcaggaggctgaggcaggagaatcgtttgaacccaggaggtagaggttgcaatgagccgagatcatgccactccactccagcctgagtgacagagtgaaactccatgtcaaaaaaaaaaaaaaaaaaaaaaaaaaattcaatcccaaaatgatctcttccaagaagccttccctgatttctccaggctgaaaatggtctctctctcctttctcctctcctaaactggaccataaagcagaagtattatatgtgtctttgtttcacaccccgactggtctgtgagtgcccccaaggatagagaacacgtctgattcatatctatgaatgcccagcaccaactctggtgcccagcaaatgctgggctcagtggaaaggcatccacaaatgtttgttggctaaagcgttttctttttttttttctttttttgagacggagtcttgctctgtggccccaggctggagtgcgttggcacgatctcagctcactgcaacctccgcctcccgggttcaagcaattctcctgcctcagcctcctgagtagctggaactccaggcatgcaccatcacgcccgcagctaatttttgtatttttagtagagacagggttttgccatgatagccaggctggtctggaactcctgacctgaggtgatccacccacctcggcctcccaaagtgctgggattacaggcacaagccattgtacctggcctaaagtgtgttcttactttggttttctgctaaccattagcttggctcttcacttaggatggacaggcaaagccggaggtgaaaaggatgctaatatttatatagtacccactatgggccttggaatgtgctcgatgcattcactctgcaccacagccttctgaggaatgcattatcacccactctgtattgcaggtaaagggcacctggggctcagggaggtgcagtgacttaccacttagtggcagaggcagacctgaaccctggcccctctgcagcctcccaaggcacttactggtttctttccaacaatcatgcgctccacagcctgcacctgggacacatggtcatcgttggtccgcagttcacgcccctggatgcgctggtagatgcccaccaggaggtctcgggggatgtcttcaccattgtcaacccctgggggagggagtaacacagggatatgtcacataattatgggcactgggtggtaggggtgctccaccacccccacacccaggcacgggccacgatagtcaggactgagggtcaatgggtaccctcggccccttagccaggattggggcagggagggtgtccttcagtacaacagccagttgctatcttccccagagtggggaattttttctcaacaactcagaatacactgtaattaaaacaatcagatactattgtttgccttcctaattagcaaaaataatttaaaatgaaatccagtgctaggaagagtgcagggaagtgggcatgtatggtaacataactcttttggaaggtaatttggcaagaacctaaatgtttgtacccag

SEQ ID NO: 9040 - DNA, 1374 bp, artificial
  synthetic oligonucleotide
ctgggcacctctgttgggactggtgcaaggtggctcatacataaaataatttttcttttctgctcttttttttctgagacaacatctctctgtcacccaggctggagtgcagtggtgccatcatggctcactgcagccttgaactcctgggctcaagtgatccttctgcctcagcctcctgggtagctgggaccatgggcacgcaccacatgcgcagatttttttttattttcagtagagatggggtctcactatgttgcccaggctggtttcgaattcctgggctcaagcgatcctcttgccttggcctcccaaagtgctgggattacaggtgtgagccaccatgcctagcccatgaaataatttttctactgtctaactctgatcatgcctcttctctgcttgagcatgtttagcagctcccctttgccccaaagccctcaaactcctggtagctgtggccctcttactccctgtactgcaggatgtaaaggcacacaactatgcactgctctctcgaaaccctttccttctcacctctgcctcaactcacattgcttctgctgccaggaataccacgcaacaaagctcctcctggttcatccttcagagcacagcatgatcaccgtctctttggcccaccagagaacacatgcactgtggttctctgcaagaccatgagctaaccaggggctagacccaagtcatactccaccctggcctgcccctcatcctgggaccaagtaggtgctttggagacccttagtccggttgtaagggactccgaaaactggagctggtatagatgacgggtgagcatgggggccatgacatagactctcaggagctgggatccaagaagggactcacatgaattctggaagagctgcatgtgcatttccacgagggggaaagactgacggaaactgtacgtcaccaagatcttcttcttctggaaaattttggtgacctttggcaggggtgggaaaaagacaagaggcagcgctttgggtgggggatttccacgtggcacctatttctggtaaccaccctcccctcccaccccattaacagacacacacacacaaacacacatgcccacaagctggggagaatggaagcttgagggacagaatgggagacatggaagaaaacgcaagttcctgatgtaatgaccacgcaccacagacatttaccacatttccagaaactaactgaatcctgcttcctccaggaagcctgctccaacatcccacagagatttgtaaaccccttttctgagctccagaatggtgattcagtgcctttcccttgtcaggcactatgctagtcctctgagtgtgtgatcgccccctgctggactggagggcagga

SEQ ID NO: 9041 - DNA, 1686 bp, artificial
  synthetic oligonucleotide
ggtgcagggggtggcggccatgtggagcaaactgagggtgtcctccagccccccgtctgggtgccctgcctggccggcccaaggtatagtgttggggccctgggactgggccatgggcgtggaagtggcgatgtggccccacaggtggggctgaggcgggaggcggtggaatggagcccagctggggcaagggtgggggctgctggggaggtgggggaagagagggctgctggggtgggaggtagggtggcggggcagggcccggtccttggcaatactgggcatgcagggcctggagcttggactgcccatcaggcagcacccccaggccaccgtggctatggccatgatggtggtggtggtggtggtggtgcgtggaagaagcagatgaagaggaggcagaggcctggcctgttggcggtggtggcatctggaagggccccttgccccgcttgcttccaaatagggagcccaggaaggatgaggagttggagacgggcctctggctcttgtactcctctggcggcgggggtgggggcggaggtggcatcctctggtgagggcgtggactgctaataacagacccctggaagcggggaggggggaagtcaggccaggctagatgccctaaacccccagccctaaattccacccctgtccctgagggctggagctggggagacagcaaaccccaagttgtaataaaaaccaaatcacagtccggtacgcgtatgtggagctccccagcttgcaaagctcggctgtcacatccactatctcagctgagcctcagctgggagaggagaaattagcagtacctcctcctcatccccattttgcaggcagggaaaaggttaggcccagagaggcagagtgactcgcccagggtcaaagagcaggacttggaggtaagagcttctcgtggcccaactccaagggcatccctactcgccgtcggccctggggttgagagggggcacgggagagtggaagacagactgagagacaggcagaatgaggacagacagagttgaggacagatggagagagtggttggctgggagaggcagccgcatggttcccagcagggaagagggggagcaacaggtcccctcctcctctgggtctccatggccggggcagggctcatgcagaggacgagtggggcaggagctggcacttacttcgatggtgctgtccagcgatcccacgctgttacgccgcccccgcttccctgcacccacaagcaaggagcccagcgtcagagcagcaaccccccccctaccctgctgggctccagagctgggcaccaggactgggcccctcccggggacagacaccccattatccctttcccccattgaagagggggaggcggggaggaggagaggtggagaaggaggagaaagaggaggaaaagatggagaaggaggagtggaggtacaggagagacagaagagggagaagaggaggagagggggagcagcgagagagagggaccaagactgtggccccacttcacactccctggcccaaaagctgggctccccctgctctgacctggctcccaggccccctgtggcgcagcgcccagggctctgggtgaaggcagggtgcgtgcatgtgtggcaggtggagggaaggctggcggccagtgacaggaggcaaagaggacacccggtcccg

SEQ ID NO: 9042 - DNA, 597 bp, artificial
  synthetic oligonucleotide
tttttttttcccagaagtccattaagccgagaatgaccttgttttttatgacctaacagttttaaggaatactgttgaatgttcctcagtttgtatttgtctgaagttttgcttatatttagagtggagttgtttttggaaagaacaccagagtttaaatgcctttcttatcagatcatatcagaggtacctggtatccattggcatccctggttttgtgaaccttcatcccttggttaaggtgatgtttgccaggttttccccctggcaagttgctgcctttcccttttcatagtctgttctttggaagactctagcccaccctcaagtaggtgggaagaattgagctatagctcctggaaggagagggtgtatctctgtatatcatttgaaattcttctgtaaagatttgtctcttatcccttatttatttattcagtcacttatatcagtatgaactcatgcatttttatttaataatttgagttataaatctaatactgtgttctttgttttgttggtcaaatcagtccagttttggccactggggactcttgccagttggctcctgtgtccctttcacatgctcccatcctt

SEQ ID NO: 9043 - DNA, 1873 bp, artificial
  synthetic oligonucleotide
agccaatcgccctgcagtttccctcccgtcgctgagggagtcagcccgttgattggcgggcccgaggggagccaatcggaaactgatgatgtgtggtgttggcaagcggattgcgtgagagcgggcaggggtcgcgggagcgcgatcgccgccgcggcggccggcagccaatggccaggccgagcggacccctgcgtcaggagtgggcggggcttcggcgattggcgcggagggagtagagcgggcgctgtgggagggaacgccagagcgaggtggtgaggagagctggttgcgtgagtctcctcagctctgcttaccggtgcgactagcggcagcgacgcggctaaaagcgaaggggcgagtgcgagtcccctgagctgtacgaacgcggtcgccatggaccgcccagatgaggggcctccggccaagacccgccgcctgagcagctccgagtctccacagcgcgacccgcccccgccgccgccgccgccgccgctcctccgactgccgctgcctccaccccagcagcgcccgaggctccaggaggaaacggaggcggcacaggtgctggccgatatgaggggggtgggactgggccccgcgctgcccccgccgcctccctatgtcattctcgaggagggggggatccgcgcatacttcacgctcggtgctgagtgtcccggctgggattctaccatcgagtcggggtatggggaggcgcccccgcccacggagagcctggaagcactccccactcctgaggcctcgggggggagcctggaaatcgattttcaggttgtacagtcgagcagttttggtggagagggggccctagaaacctgtagcgcagtggggtgggcgccccagaggttagttgacccgaagagcaaggaagaggcgatcatcatagtggaggatgaggatgaggatgagcgggagagtatgaggagcagcaggaggcggcggcggcggcggaggaggaagcagaggaaggtgaagagggaaagcagagagagaaatgccgagaggatggagagcatcctgcaggcactggaggatattcagctggatctggaggcagtgaacatcaaggcaggcaaagccttcctgcgtctcaagcgcaagttcatccagatgcgaagacccttcctggagcgcagagacctcatcatccagcatatcccaggcttctgggtcaaagcagtatccttctaatcgatactccgtaggtcagaagcccgtgacaggaaaggggaaggtgggggagggacagaaaaggtaaagcgggtggaggagagccagaggtgggcatgatccccctatcggaagacggactagactgggtggaagagggatggaaggaggagggcaaaacagcagagaagctggactggagatgatgaagggtggtggagggggggcggacataaaaactggaccacagatgggaaagggggaagaggaggaacatagcattaaaaaaaggatcacagatgataaaaagggggagggtagtaaaggggcacacagcaaaaaaattggaccagagatggtgaaaggaggaggggaggggcacgtagaagatgaactgactcagagaccttgaagagggaggggaatggcacacagcagagaaactgcccagaaagggtgcttgagccatacaaggctctgtaaacctagatttttgcttaagatactaggagaccccaatcctggctggagtgccttgcattggagggaggggggctggagcccctgaaagatcaagagagggagtgtctaggtatagagaaaaaggagttaaatgaaggaaaggggagagtagacacatacacatacatgtaacatgttaggaacatgagtcgaacat

SEQ ID NO: 9044 - DNA, 2051 bp, artificial
  synthetic oligonucleotide
aaccttagagctttgcaaaaggggagaagagctgcaccaacatccctgccccacagatccaccagtggaggaaacaggtaaccaaagacatccaaagaaatgcagcatcctcacctgacaaggagcgggtaggagcaggagtggcccaggggcagggcctggcaccagccagggcataattggggagggctcgtagacacactaaccctaccctttctgtttcttcctcatctttcctttccatctgtttctcatggtctcctgtctgtctctctctctctcccctctttctctctcctcgctctttctcatcccctccatttctgtgtcaatctcaatccatttatatcggtggccacttttctatctctttgttctatctctctctctctctctttcccactttgtctctgcacgcctgttgtgtttttctgcctgtctctctcttgccctcatctctctgtctctctcttgccctcatctctctgtctctctgtgtctgtgtctcccccgctcattcccatttgcaggtgcaatgtagcaggacaactcatggagcccccccgggcccatcgagtaccggactggctgaccccctagggttggcagtagcccctgaccctcagtatggccaacactaccggagagcctgaggaggtgagcggcgctctgtccccaccgtccgcatcagcttatgtgaagctggtactgctgggactgattatgtgcgtgagcctggcgggtaacgccatcttgtccctgctggtgctcaaggagcgtgccctgcacaaggctccttactacttcctgctggacctgtgcctggccgatggcatacgctctgccgtctgcttcccctttgtgctggcttctgtgcgccacggctcttcatggaccttcagtgcactcagctgcaagattgtggcctttatggccgtgctcttttgcttccatgcggccttcatgctgttctgcatcagcgtcacccgctacatggccatcgcccaccaccgcttctacgccaagcgcatgacactctggacatgcgcggctgtcatctgcatggcctggaccctgtctgtggccatggccttcccacctgtctttgacgtgggcacctacaagtttattcgggaggaggaccagtgcatctttgagcatcgctacttcaaggccaatgacacgctgggcttcatgcttatgttggctgtgctcatggcagctacccatgctgtctacggcaagctgctcctcttcgagtatcgtcaccgcaagatgaagccagtgcagatggtgccagccatcagccagaactggacattccatggtcccggggccaccggccaggctgctgccaactggatcgccggctttggccgtgggcccatgccaccaaccctgctgggtatccggcagaatgggcatgcagccagccggcggctactgggcatggacgaggtcaagggtgaaaagcagctgggccgcatgttctacgcgatcacactgctctttctgctcctctggtcaccctacatcgtggcctgctactggcgagtgtttgtgaaagcctgtgctgtgccccaccgctacctggccactgctgtttggatgagcttcgcccaggctgccgtcaacccaattgtctgcttcctgctcaacaaggacctcaagaagtgcctgaggactcacgccccctgctggggcacaggaggtgccccggctcccagagaaccctactgtgtcatgtgaagcaggctggtaggcagacaggcagagagaaggtcatggccaccgtgatggggccaacagcaagggaggggtaggggcccatacaggagtcctcctttctgagctccagccccagcccctcgaaccacctgtaatctaggcacctttgccaacacctcccaaggatggaggactgggcgagggactgggaaagaggcatatttagttttgtggggcctgtctccgctgcctccttctccacttctacaatctcattctctctctctctctctctgtctctctctctctctctctctctctct

SEQ ID NO: 9045 - DNA, 1542 bp, artificial
  synthetic oligonucleotide
aaatttcttgtaacaaatgcaggccaggtgcggtggctcatgcctgtaataccagcactttgggaagctgaggtgggaggattgcttgagcccaggagtttgagaccaacctgggcaacgtgacgaaaccctgtctctaccaaaaatacaaaaattagccgggcatggtggcgcgtgcctgtgatcccagctattcaggaggctgaggtgggaggattgcttgagcctgggaggttgaggctgcagtgagccatgatcacctcactgcactccagcctgggtgacagagtgagaccctgtttccaaaataaataaataaataaatgctcacaaattgaatgcaacagaaaattttcattttgtgtatcttaaaataatgatgaagcttttcccctaagtgaatgcagacattgctctacttaccctaataagtcttctttagtattcaaattgcaacaccaagtaaacatcacccagggaaccatacttgacttcacatttcctaagttgaagttttgcttcgaatccataaactctgtcagtagtcttcacgctattctttagtgtctttaacattttttatgtaactttattcgtgtgcaaaaaaagccatttgttgaagccagtaaacataaaatctgtgcctgagctcagaagttcgaaatcagcctgggcaacatggtaaaaccccgtctctactaaaaatacaaaaaaaagaaaaattagctgggcatggcagtgtgcgcctgtagtcccagctacttgggaggcagaggcaggagaatcgcttgaacccaggaggcggaggttgcagtgagctgagattgcactactgcactccagcctgggcaacagcgagactcaaaaaaaaaaaatctgaaaaatgagaagcattcacaaagaaatgttgccatgtttcttttacctcattattattattattactattatttttaccaaatctctacacatttgggtttaaaacaacacggaagggtgtactgatcccagttccttacagaaagctgaaaggcaggtgggaaatgtcttggatttaattacattcatctggcataatttactgtggaaatgagacctatagacaaacttacaggtgagggctcctcagtaaatgaatctcagagttttccaaacaaactgctgttgtaaacagcagcatctgtccacagacttatggagtttccacagtatttcaaagtattcatgtatcactttgaatatttcaaacttagtttatgttggtgcttcttgtacttctcttcaagtttctaactagtactgtaaactatgcaatgtcaacacccatagatgcatgggtagaaaatgaaaacctttctgattgaacatctaagttagtgtcatctcaatgccctttgacctgtcaccagtgtatctcctaacagcaataattgaacatggcccctttcctattccctttacctcattggtcttaaaaatagtgtacacaatttccctgcacaccgctaacctgtgagattctactgggaggggcatcttagc

SEQ ID NO: 9046 - DNA, 1255 bp, artificial
  synthetic oligonucleotide
gaattgatttgcagctcatcttagaaaggtttacccctttgtatatggcaatttcccataagccacataaaaatactgtgacttgaagtaaatatttctgaatctagctgtatgtgagcatttccacaaacattaatgttgtttctaaagtttttgttcatttattcctgcaaaaacaaatgcaatttgtgtgtgtatgtgtgtctgtgtgtgatgtgtgcgcctgtgtcttgaatgcttcatgttcccttgtgggacatgccagtcgacagcctcatgttgtctgaggtgcgtcacgactccccaccttgcatgaggagttgcggtggcgacaggtgtgggaaagtgcatatggatttaactcctgaaagtggcttaaggggattgtgaagatccaggtccagtcccttgtggtgggaaggtattattggaatcgttgattaatttgtacttgttcttcctctagacaagcagatgcccagtgtcgggaaggcagcccaggatcacagcagcacccaccgagtcagaaggcaccgaacccacccacattctctgaactatctcactgccggggagccccagagctgccccgggagggccggggccgagcgggaaccctacctcgagattatagatactcggaggagagcaccccagcagacttgggaccccgagcccagagccctggctcacccctgcatgctcgaggacaagactcgtggccagtgagctcagccctgctctccaagaggccagccccacagaggccaccgccacccaagcgcgagcccaggagatacagggccacagacggcgcacctgctgacgcccccgtgggcgtcctcggcaggcccttcccaacgccatcccctgcgtccctggatgtgtatgtggcccgcctgtccctctcccacagcccctctgtgttcagcagtgcccagccccaggacaccccgaaggccactgtctgtgagcgtggaagccagcatgtgagcggggacgcatcacgtcctctgccagaagcactgctccctcccaagcagcagcacctgcgcctgcagacggccaccatggagacctcgcgctccccctcgccccagttcgccccccagaaactgacggacaaacctcccctgctcatccaggatgaggattcaaccaggtactgtcctgcgacggtgttccctccccatgaggctcctaatgtgggacgcgggttctcagtgggtctttctggggagtcacctgggcacct

SEQ ID NO: 9047 - DNA, 1698 bp, artificial
  synthetic oligonucleotide
aggcctctgcgggaaggtgggaaggccctcgtggaaacggggcacggtccttctgcgcccgccttccaagcccctccagaggccggacccgcgcccggctcaggctgctggggggcgcccttcccggctctctaagtccagagtgtgagtgcgcgcagggccgcgcgggacgggcggtccctctgccccggggcagcggccacagcgcgggcaccagggcctcccgcggcgcttccgctctcacctgcgcggcagcccgcggtgcgcgagaacaaagtgtgggcgccggcgggccgcgcgccccgagacggaggaggccggagactcccgccacgccaccccgcgcccatctcacctgccgcctcacctgcccggtcctggcctccaaccggcgggcgggggcgcccagagcttcgaagcactgcagagctctggcgcgggaggaaaggcccgacctggcgccggggcctccgcccccgtcctcgcccgcgctggctccgccagccccggggcgcgcgctcctcgaccccgaccccgaacccgctgaacggcgcgcgcgcctgagcgcccctcccggcccgctcccctccaccgggcgagagaaccggggcgcgcccctctccagctctccccggtacgagcggccgcgtgggcccctgagcgcgcacctgaccccgtccctcacccttcgggccgcgggctggacctctggacgcgctccccgtgaccggccccgcggtacgagctcccgaacgcgcccgccccgccccccgtcggccccgccccctccccgccagccccggccccggccccggccccggccccgccccctccccgccagccctccgggctccctccgccgccgggccggcactttctttccaagttacggcgcaagttctgcggcgctcggagcctcccttgcgatcccacggccgggactgcccggagtgcatgggcgcgggccagggacgctgagcggtcgcgccatggagggcgccgagccccgcgcgcggcccgagcgcctggccgaggccgagacgcgggcggcggacggcgggcgcctggtggaggtgcagctgagcggcggcgccccgtggggcttcaccctgaagggcggccgcgagcacggcgagccgctggtcatcaccaaggtaaggcggccgcggggcgcgggcgctgacagccgggagctggccgccctgcggggcgcgtcgaggtaggggcgcgggaggggcggtaggctcgcgcccccgggtctggcgcgcgcgtctgctggggtcacctgccgggcctgggcgccgggaccggcgtgggcgtgtgatcctggcggttccccgcgcctcgcagagtttaaatggctcctgcccggagtccctttcccctccccctccctcctccgggcaggggcctggccgggtcctctggcgctcccgggcccgccagtggcggcctgcacctgcggggctgcctggaggccagcgaaggaacgtgtccccgagccgtccccacctatgtttgcctctctggggtccctggttcggcaccccttggacccgtgcctgtgatcactacgaaatccagagtagcagctgtcgccagcgcaacttctcgattcccttcagcccatcaatgtttactgactttcggcttccagtcccagatccactgcgcactggatacctgcgcaaacttaga

SEQ ID NO: 9048 - DNA, 2285 bp, artificial
  synthetic oligonucleotide
agcctgagattggcttcacattaatccagtgaggagggtgaagaggggagcagatgagccgggtacccgtacctcacgaatcccacgtacagggattcactgtaagtgtttctattatagactgcatttacgcatggtggaaatgttccaaaaagctaaacagaatggccaaatctagctgagaggtctgtataaagtgtcacataatagtttaaagcagatgttggcaaactcattcttaatatttttggctttgggagccatactttctcagtccaatattcaccctgcccttgtagggtaaaggcagccatgaataattcacaaatgcacatgaacaacatagctgcgttcccatcaaactttatttgtagacattaacatttaaatttcagtaatagtcacatgccaggaaatattttttaattttgatttttaaaaacattttagggctgggtgaggtggctcacgcctgtaatcctaacactttacgatgccaagggtggtgatcttttaattaagcccaggagttggagaccagcctgggcaacatagtgagaccccacatatatttaccctagcatggtggcgtgtggctgtagtcccagctactcgggtagctgaggtgggaggatcgcttgaacccaggaggtcgaggctgcagtgagctgtgattgtgacactgcactcaacctgggcaagagggtgagaccctgtctcaaaaaacaaaatcattaattttttaaaaagtaggatgtaaaaccattcttagctcgtggaccctagaaaacgggcaggatttggtctgagggctgcagtttgcgcacctgtggtgtaaaaaccatacccaaaaagcctggatagggaagggatttcagcttacaaaatactcgagagaatatatagtgcacaatagaaaagaatttacacacgcgcacacacacacacacacacacacacacacacacacacacagagcgagacagagagaagttaattgttagtctctccctggtgcagttgggcaaaaatgaggaaatcttttctggtctgggttttgcttaactgcgccatctgaagtttccatataacaaacacaataaacggattttttaaaacccaacgtcccttggatgggaattttaccgaccatgtgtttgcaaaactacctagtcggccgggcgcggtggcttacgcctgtaatcccagcactttgggaggccgaggcgggtggattacctgaggtcaggagttcgagagcagcctggccaacatggtgaaactccgtctctactaaaaatacaaaaattagtcgggcatggtggcgcgcgcctcccccagctactcgggaggctgaggcaagagaatcccttgaacccgggaggtggaggttgcagtgagccgagattgcgccactgcacttcagtctgggcgacagagcaagactccgtctcaaaaaaaaaaaaaaaaattacctagttgtcccatccggtccctagggaacagcctccgctttctcttttctctgtggttcaagtgttaagacggccagcccaacccgctagccgtgcgccatcacccgggcaccgatcaagttccaacccgagtggatcgagttccaacctgcgggccatgcgccctcacccgggcatcgatccggtctcaacctgcgggccacgcactctcacccggggattgagcaggtcccaaccccagggcctcacgccctcaccccagcactgagcaggtcccaacccgcgggcctcaagccctcagccggggaccgagcaggtcccaaccagccagctacgcgccctcagccctgcaccgggcaggttccaacccgcgggcctctcgtcctcactccatcacggaacaggtccaaatccacaggccgtgcgcccttatccgggcaccagtcgggtctcaacctgcgggccacgcgccctcacccaggcgctgatcagattccaacccgcgggccgcgcgcgcccttacccaggcagccgagaaggtcgcaggcagcggcagcgcgcaggatgcggaccgaggccggcggggacgtcgcgggggacccggggcccgcgggccggcggccgggcagcagctgcagaaggcccagcgccaagcggagcccgccgctgcccaggcagagcgcgtggaaggcccgcggctggaagctcagcacgagctgcgtggctgcgtcccgcgtggggcagcagaaggtccctaggcgcggggaggccatgggctgtgttcgcggacgcggctcgggtgtgccagga

SEQ ID NO: 9049 - DNA, 619 bp, artificial
  synthetic oligonucleotide
ttattttggtacaccccatcacgggattgtgtggtgtttgtctttggttttgtgtttgtgtgcatttagctcagacaacatctggaaaaaaatcacatttttagatccaagcctaattattctgagacactggttgtgaactgggggccactgtggctccccaggagacatttgtcaatgtctagaaagagttttggttgtcacaattggggaggtgcaactggaagctagtgagttcacatgagaggtgctgctgaacaccccgccatgcacaggacagcccccgggacaaagaatcctctaaggctttccaaggggagccctgggaccccgaagtctacctgctgtggcagacagggcattaccttcagacagcatgctcagggcttcgtcagaagtctgcccacccacttgagacaccttcccggaagcagggttttcatggggcatcagtggggatgggtgagccccctcagcagccgaggtggtcagtgattcccactggatctccttcctgggagactgaaaacccaggctgcatcctgtccagccgtagaaggccaaagacaagagaaatccctgggctggattcaggattccctggagagaggacagaaag

SEQ ID NO: 9050 - DNA, 1354 bp, artificial
  synthetic oligonucleotide
ccaaacaatacaatggtgatgagagccaaaagtccgatgtggaaatattaaaaaatgtgaggtgtcctaggcagcaaattaatttctgaataaaagccttttcaattctttttagattaatgtatgcaaattcctgcatagggttaccatacaaaatggtgatgactgcatgttatgggcaattttaagatattcaaagggtgactagatgtaaacttatgaccctaaccaccacctcagtagcaccgccactttatacttttttttaaagagatggggtctcactatgttgcccagtctggactccaactcctggcctcaaacgatcctccttcctcagcctcctgagtagctggggatacaggttcatactaccaggccaggccactttatacttttgcagatgtttgttgttaattctgaaaactcactctatgcttcaagctctatcctcaaaaaccctgacagatgttacctaataatatgtcacttggagttctaaattggcagctgccatttttacaggaattcttcccacaataaaaaaataccgattgtatttctcatttttctcaaaaggctttccttttgttctttccttttcctccagtgttttctccaattggtatttccattgagtgttctattgttagaatagaatgattttttaaaatattttaattttctccaatagactgtgagatccttgagggccaggtttacacatctccagtatctccaccccactcagctcctagtacacagcctggtagagtttggggcagtcataagtagttattaacagaataagagtgggccaggtgcagtggctcaggcctataatcctagcactttgggaggccaaggtgggaggatcatttacaagagtttaagaccaatctgggcaacatagggagaccccagctctataaaataaattttaaaaacacacacacaaaaccaaagaaaattagcagggtgtgttggcacctgcttgttgtcctagctactcaggaggctgaggtggaaagatagcttgagcccaggagatcaaggctgcagtgagccatgttcattccactgcacttcagcctggacaacagagtgagaccctgtctcaaaaataaataaataaaacaaagaataggtgtatccatacaacgaaatattatcaatccataaaaagaatgaagttctgacacctgctacaacatgggcgaatctagaaaacactatccgaagtacaagaaaccagacacaacaggacgaatattacacaatgccctttccatgtaaggtctggaacagcaaagccatagagacagaaaggagattcatggttgccaggggctgg

SEQ ID NO: 9051 - DNA, 263 bp, artificial
  synthetic oligonucleotide
atctcttaatatattctgctgttctgcagaccctcgtgcaaagcttccctttatttgaggtacatggttcagtggtagagagaggacaatctccacattgcatttgtcagttgctggaaggagccacgtggtatggggcgtgccctgcctgaacttgcacccactgaggggtgagtggcacaggctgtgtgtgttcttcaggcttcggctttcctcatttgataaactgctgcttcccaccgtagaccgcagatttctctgag

SEQ ID NO: 9052 - DNA, 530 bp, artificial
  synthetic oligonucleotide
gaacacctataaaatcttttccatcatgaattccttcagcacgcatttattaaatgccacactcacacaccgcttggaaaaccttgagaggcaaaatctgtgcttaccatgtaataaatgcttttcattttttatctcatttaattctcacaaccctatgagggctgtactttagccccactttatagatgggaaaacaggcttagagagaagtgacttgcttaaactaataccttgaatgacataagaaagatatagagtgctagttatagggctttcctcaatggagtaaaaatggactcattacccttttgggcagatcaagacaagcttcagggagaaacaggtctgtgagcagtcaaatggaatttagatagttggagaaggctgagaagacaggtcaggcagagcaaacagtgagcaaaagcaagcagtggataaagttcagagtatgctctgaaagaagcaaaataaatcaggagtccaggaagactggagcctagaaaccttggagccaatctgaactccat

SEQ ID NO: 9053 - DNA, 1046 bp, artificial
  synthetic oligonucleotide
tttaggtgaagttctaaaccactagagggatatggacaccataaattgaaagggagccacatggatacaaactatcttgctaacaggagctcaaaatttaatacagcatacggtataggttgttgtggaaatacaaagaaacttgtttgctttccataaataatcctactttctgagtacacaatccaatggttactacaggtgagcaggggtgaccagttacatttctccaatgaattaaacattcttcagcctcttccagtctggctactctctttcaagcaatcattgagtcaattctaagatctatggacacctccgtctccttttataaaatcatgtctggggattggaggaaggggtgtgacataagcgatagtagagaggctttgcagcggcggtcggggggaggtccccagtttgagtgctatgctctggattctgctgatacgtgtatacaacctgtgtgttcctttcttagtgaaccttttttttcctctttcaaatattgtggatccatatgagatttggttgcaactcagagttgagacttcaatgtgggtgctcagtgcacatttgctgtggcaatggtctctgatcatttttcatcagacattgtactggattgaatgatgtcccccccccaaaatacatgtccaccctgaacctcacaaggtgaccttatttggagacagtgtcttcacagatgtaattcgttaagaggaaggcatacccgattggggtggacccgcaatccaatatgactgatgccctcataaaaaagagtagagaatacacggagacacagacacacgaggaggagaacaccgtgtgaacatgaaggcagagattggagtgaggtgtctacaagccaaggaacacgaagattgccataagcaccagaagctggaagagacaaggaaggatcctcccctggaggattcagaggtagcatggtcctgccaataccttgctttcagatttctagcccccagaactgtgagagaatacatttctgttgtattcagtaacggagtttgtggtaa

SEQ ID NO: 9054 - DNA, 1210 bp, artificial
  synthetic oligonucleotide
atccagcggaccccagagccggagggcaaagaagtttctcgaacctgggccatcagatcactccccgacctgaggagcaaggcgtctggaaaacagctgcgactgtagatgaaaggagacagagacttctgtgaatgatctgcccagcgtcatggccgcggtgcgcagttagcgcccccaggacccctcccatcggcccttgagctcagcccgcggcttctgtcggctccacccactcaactgagaggcccctggagctgatggggagaccgaggcggttacctgcttcaaaggcgatcagatcatgccaggggactgggaacagaaggctagcgagcggtgggggtggggaacggcctgagctttaggacagaaaggatggaaacttctttaaaaaaggcgccaccctctgactgcttttttgcgccctgcgcagcctcgctttggtgcagcttcctctgacgttctttccctgtatcctaaaaaacacttgggtcaacattttctctccaaaatggctgaaaggacgcacttttggaaaatgaactcacaggaagaaagtgtccctctgtttctacctaacctatacttctgtgacccggtgtgttccactctaagccgttgcccctcagcgcactttcggtccacccagctcttgcgccctctcacgctttttcgcgcttgtgctctcacaccccttttcttgcttctgcgacttcaattcctatgatttctcctagaattcggattactactccctcccttcacgcatttgccacctctatggccaccactatcctcgcgcgacccccgaagtctccgctcccttttccctctcctgcccccgcaacacccccagcccggcagtttgtttaaaggtctgggttaccttgggccccaggcgcgtgatatagaacgtcagcaactgctgctgtccaggcgctcctcagccagccttctctcctgacctctcctcagggctggtcacaagggggccgccccctggcccctcccctctcgacgtgcggcccccaaccccggattctgccctcctgcagtgatgaatggcaccgctgtcccgcgcaggcaggcaaacctcttcctgaaacagactctgctggaggcaacagcagcaacagattctacagaaagcccctgaaatggaggctcaggcctcacctagctccaggcccgcactccacagaaaaaa

SEQ ID NO: 9055 - DNA, 234 bp, artificial
  synthetic oligonucleotide
atctcagtcacatactagcacccggagggaaagtgctttggaattatagactggcttgtgcaggaaaacgtgctttttctcccctagggaagggcattttctcagccacagctaagcaaagagttgctccactctgggttagcagccctagaaggaaatgctgagtcagtcatttgctagctgtgccacctgtggcttggatcccagctgctctgagacagccctgcacccttt

SEQ ID NO: 9056 - DNA, 1436 bp, artificial
  synthetic oligonucleotide
ctttcaggattgggtactttccagaagcaaagctgtataacggggatgctatattgaaataataaatgtgagtattattgattcttctaccataaatgttttgccttgcaacagccctgatggccccagaggatatccccttgaggaaaagggtaacattataccggagaattaagtctctggcaattagacaaaagaggtaaaacacaatgcttcccccctccccggaagtgagacagaaagagggtggaatacatggagagagagagggaggcagagacagagacagagacagagattgaaattatttagctatatgtgacctgaaacaatcttgtgaaaaatcctacaggtggaggcattagatggatgagaaagccagatatagagggggccatgtgctgtccacactggggccgttctgactgttataagaggaaagatttgttgcagtctgtgcgaagacacgtcaatcagagtggatttggagagactggacccacgtctgcactcctgaactttcctcagctcccatttgctttagaagagattgagaatgtctcaccagcctgatggaagggtccagaaggcagctgaatgttttctggcaagcactccatggccaccctaatcagggtgaggagatcttggagcgcctcgttctacaaaatgaggtgtgcacatgcagagatggcaagaagagccattgaggcatgggaaggaaacattagcaagtctatgcatattcatttttattactttcttttaaaagtctaattttggtgtgtgtgttttatactgagaattccatatttatacagcgtttccagtacataatttgtaaatttacaaagatacatatattgcaggtgtgggctcaacatcttttattactgttggtgtatttgtttttcggtgctgctgtgacaaattaccacaaactccgttactgaatacaacagaaatgtattctctcacagttctgggggctagaaatctgaaagcaaggtattggcaggaccatgctacctctgaatcctccaggggaggatccttccttgtctcttccagcttctggtgcttatggcaatcttcgtgttccttggcttgtagacacctcactccaatctctgccttcatgttcacacggtgttctcctcctcgtgtgtctgtgtctccgtgtattctctactcttttttatgagggcatcagtcatattggattgcgggtccaccccaatcgggtatgccttcctcttaacgaattacatctgtgaagacactgtctccaaataaggtcaccttgtgaggttcagggtggacatgtattttggggggggacatcattcaatccagtacaatgtctgatgaaaaatgatcagagaccattgccacagcaaatgtgcactgagcacccacattgaagtctcaactct

SEQ ID NO: 9057 - DNA, 442 bp, artificial
  synthetic oligonucleotide
taccactaattgaacatctactatgtgccagatactttactcatttaagaatcaaatttactgaacatttattatatgctaggcactggtccactcattgggattttaaggatgaggtctcagtctattagagcaaacagggaatttagaaaggtgggtataacaggtgctgcctttgattaggaaaatcttgaatgatgcatacaagcatgaatcaggggaatcagcctaatttttagtggtcagggaaggtatgtatgagtaagtaagtggtctagattgagacgcaaagtttggtaggagttagctaggagaagagtgagggaaagtgttgcatacaaatggaacagtatgtttgaggacctggaagccaaaatgaactcaggcacttataagagttttggtgattgtaaacttttctctctaagagtcaagttttatt

SEQ ID NO: 9058 - DNA, 271 bp, artificial
  synthetic oligonucleotide
catttttaattgcttttttatttctatctgtattgctttccttgcatatattttattatattcactctttgttgctttgactatactgaccatacttattttattatccaggtggctgtataacattattgttttcttgagtgaattcattacctaatttttcttgtcattaaatttcttcatgtatttttgggattttggttttctgcctgatttgaatggatagttttggttctccacctcttgcctacctttattcattagcctgtgt

SEQ ID NO: 9059 - DNA, 1150 bp, artificial
  synthetic oligonucleotide
aaactctgaactatcaattcctgcttgaaaatccagagtccagcaatccaatggcttagtttcactcattattttgcttttttcttgtctagtaagatgctttttttccttatatttgagcttgatttttttatggtctatctatctgtgtaattttattccttatatatttggagcaaaaagaagagggttcctaaagtgtattaaatcagcataccaaattgacctggccataatatgtgtttaatatatgtatgttggtgtgacttgtcctgagaatagcaaaaagcagctgagattatgtgaaacgtgtactggacctaaaatcctgactctactctctgtattctgtatgttcctgacatgccatttaattcatattgcagaatagattcattacattaagctgtgcaaaacttgacccaggatatagccatctccgcaaggtttttatctgattttatgttttcttttgttttgcagacagtctccttcccctttccaggcacttgaggctgaacccttggaaagaaaaacaagcagtaagtgacaattaacaaggggttattgccttttaaagcatctcagaacacttgataaaaagtattccaaataaaaaggtaattttctcccacaaattcaaaactctcgaagccttggaataaagtaagactccaaattttgttggattgaggattttagttcaaatcgcagctcctaaaggattaaaattcaatctgaagactcccaagtaagctttccatgcatagttattaaaatcaatcctctttgtttgtcactatcatttctgtgtgatatattcaagtttaagaaccagtgttgcccttagaataacataacataataaaagtttacatttatggaacactataattgtcaaacactaaacttagaccttgatatacacgatacataaattaatgatacacattaaagtatttcttttgatattctcaataactcattgaggtaggactttttattatcttcattttacagatgaagaagcttagtaaggtgtggcagaaacaagttggtgagtctattagcaatcacttattccaatagcctactttagtttgctacatgcacagctacttcaaatataacatttccagaattgaactat

SEQ ID NO: 9060 - DNA, 1557 bp, artificial
  synthetic oligonucleotide
cttgatttaatcattctgcattgtatacatatatcaaacattgcattgtacctcctaaatataaagagttattgtttttcaattaaaattttaaagtacaaaagcaaactttttgtagcaactttagactggctcagcagtggcatttccttagtgagataaagttatatagctacatttttagattaaatcaagtctgagtgtagtatattttcatcaatacttcttatattagtaattagaaatttgtataaaatatcttgggattgaaggtagaacataggttcccttcatttgaaaagcaagttaaggctgggcacggtggctcatgcctgtaatcccagcactgtgggaggctgaggcaggtgcatcacttgaggccaggagttcaagatcagcctggccaacatggcaaaaccctgtctgtactaaatataccaaaaaaaaaaaaaaaatagccggacatgatggtgcatgcctgtaatcccaggcatgggatggctgaggtggggggctcaggtggggtggctgaggcatgagaatcacttgaacccgggaggcggaggttgcagtgagctgagatcatgccacagccctccagcctggatgatagagtgagacttggtctcaaaaaaaataaaataaaaaagaaagaacgaaaaggaaagcaaggtaattggaactatatttcataaattctagatttgaaaggactctcaaaagtcactttactaaattcccttttagtacgagagtatagaacatcattgacgagtgctctctgtgtgacatgctgacattgacaggaaggctgcttaccttcatgaggctaccttttcccttggacagttctcactgtcagatactctcttgctttctatatttgttttgataacttgcttgttcttttgatgtacatactttgagcatctgttgtatgttaggcactggaggtatgaggggactttctctccccttccagagcacagagtcttctgagagagaaggacagaccccccaaaataagtaactgcaatgcattatagtctttgcaatgaaataacagtgccatgggaggacagaggtaagacacttaagtcagcctagagcattagactcagaatatcttcttgcaaaaatgattactgaaccaagtcttgaaggataactgcaatttagctgaaggaagaaaagagaatggatagtttactggcagagagtactgcgtgaaacaatggcacagatgcaggacctcccagacggctgggaacaatcagagggactaccagcagttcaattaagtgtggctgtaagctaaaagtttcaggccaggagggacaggagatgagggatgagaagtaaatagactagatcaaggagggtcttatatgtagtctaaggacttcatcctgcaggccatgggaagcttttgaaaagaaaaaggagggacagtaataaatggaataagagcatagaggtaagtagaagggatgagatcaaaggcagaggtggaaagattgaccttgatcagaaggaggaagaactttcagttatgtt

SEQ ID NO: 9061 - DNA, 1316 bp, artificial
  synthetic oligonucleotide
ttgagtcccttcctagttcttactcagcggtccagggtagggaactgtgacagagcaaggtattgacacaaaattacattgtgttattatattcattcattcattcgttcattcatttgacaattacatactgagaatctactctgtatcatcaccacacaagactctggggaaaatatgccttcttggagattatattctaatgaggaggtgttggtggaggggactaacaaaaaacaatgaacatatacgttgagtggggataagataggagaaaagctacagggcatgtggaattggggtgattttaaagaatatatctgaatgaagtgagggagccagccgtgagaatacctgagggaaaggtgttctagacagaggaagtagcaagtgcaaaggcatggtatgttcaaagaatagtaagaaggtcagtatcactggagtggacaagaggaagagtgcgggatataaggtcagtgagatagagggggctagatcatatgggaacttgtaaagactttgacttttattctgaatgagacaggaagtcacttgtaaaaaaagaagtaacaatcattctatttgaaattctattgcattaaagagaatgaatcttgaattatttatcttatacaatcaagatggattgtatttttatgtttggaatctaatgctcctttaagaaaaacttagtaaacttattgctaacttgttcatgtcaattaatacaatttaatttcataccaaccattgttttataaaataaatatctgaagaaggtttcaaatgcacttgaaactactgttgacagcacagaggttagagatgctgaccccacacagttgaaaatccatatataacttctgattccccaaaacttatctactagtagcctacaattgaccagaagccttactgataatataaacagttaattaatatacattttgtaagttatacatattatatactgtggtcttataataaagtaagatagaaaaaagaaaacgtttagaaaatcgtaagcaagagaaaatatatctactattcattaagtgaaagtggattatcataaaggtcttaattcttgccatcttcatgtttagtagattgagaaggaagaagagcagggtgtggtcttgctttttcaggagtgggagaggtggaagaaaatccatgtataagtggacctgcagttcaaacctgtgtttttcaagggtcaactatacttaaatacaaaaagtctcttcaatgtacttcaacaaaatatattacaataaatttattagcactagaaaaagtctcatctgctttaa

SEQ ID NO: 9062 - DNA, 1530 bp, artificial
  synthetic oligonucleotide
gggattttgtaacacaaacaggaagaatcgggtgaaagcacatgtgaaaatcagtgtcagcaaatttcctagtggaacaaagtgactgaagtctctcctattattatgtggaggattggtggtttcgtggtggttttttttttgttttgttttgttttttgcttttttttttttttttttttttttgtgagggagcctcgctctgtctcccaggctggagctcagtggcgccatctctgctcattgcaacctccgcctcccgggttcaattgattctcctgcctcagcctcactagtagctgggattacaggcatctgccaccacgcccagctaattttttttttttttttttagtatagatggggtttccccatgttggccaggctggtctcaaactgctgacctcaggtgatccgcctgcttcagcctcccaaagtgttgggattgcaggcgtgagccaccacacccggcctggtggtttcattttttttttttttttttttttagcaacttttgtactccaagtgttctaccgtaaataaactatggtccctgccatcaaggagctaacagtttagttcggaaaggaggtaacatttcacttgtttttgaaagaagcctatgtattaaccagacaaaagggtaagggggcaatacatgtaagggtgcaaatgcatgaaaggccatggatttctgtcactacacacgcatgcacacacacacacacgcacacacacactacatattatactgtcttaactaggagcagcagcaacaataccatctgttgcatttactacatgccaggcaccatgccaagcactagggtaagggatgaatatggcttgatctgtgctgtaaacatatttatgatccaattcggtgggtgaggcccataaagaaataggtatacaaggcaatgaagaatgcccaacatgaagggaagatacctggtgctccaggaatccagatttaaaaccaattagagtggacaagatggttggaaaagacctcaaggaggtggaaaggcttgagctacatttttgaagatgaaattttatcaagggcagaaaggagagattggcaatttttgtggggataagggatggtccaaagtcagcctgctagactataagttccatgaagacaggaaatatgtctgccttttaaaaacatttttaaattcttgtgggtacatagtaggtgtgtatatttatggggtacatgagatattttggtacagacatgcaatacgtaataatcacatcatggaaaattgggtattcatcctatcaagcattatcctttgtgttataaacagtccaattatactcctttagttattttagcaccatattcttggtgcctagtacatggtctgacacttagtagaaagttgataatatttgtggtcatgatgtgtaacctctgagtagacaagtttggatgaagcacagattctgctgtgtgagtagttagagataaggataagctgtaaaaagtattttgcatacctgtgacactgatgc

SEQ ID NO: 9063 - DNA, 443 bp, artificial
  synthetic oligonucleotide
acctttaatagacctgactaaaagctcccccagggtgaatagaccattccatggagccatttgtcagaaataatcagagaaaattatgtatatatatataaaatctaccaccaataattttatatcacatcacaacacctgaggtggtagataaggattggtgcaaacattaggttaaccaaaaagcttacaaagaaaatatggggaataagatgtccataagtgtgttaatgggcatgcaatatttaaatatgtaatttataggacaattacaacacaaaagatggggagggaattgagatttataggggcaaagttttgtatattatttaattttaaattataaactatagtaatagaaacaagggaattaagatggtatatggcaaaatatttataagaaagaagacagcaatggaaaacaaaatatataaaacatacag

SEQ ID NO: 9064 - DNA, 2796 bp, artificial
  synthetic oligonucleotide
aagtttctaatttagattgtttttgattgtatttatatattcatttgttgtatatatgtatatttcagtcacaaactttatatagttcacataggctcatagttgggaggaggaagggcaggatgtaggaagtctcaaataggaggaaattcctggagaaggtgtagatagagagaatgttgtatgtaactctgttttgcaggacccaggatagcttttcttaaatctgtgagggattatcttatctgagccatggaatcaaaagtatttgtcatagtttgaagagaggaggcctgtatgtgaaagacagaaggaagagaagttaaagagactgatctacttcccacagagccttctttcctcctactggggtccgctttgacagaagagagcttttatttcctttgctaaagtgggaaaaggaggaagagggtcatggtgggagaatgaaaaggttgcctctgtctttgctgcctgatccccaaagagcctaatgggagagctgaggaggcatcccaggggaggccagctgaagcaagctggctgtgacagagcaatcatcacaccaggttccgcttattattattttttgagacagagtctccttctgtcacccaggctggagtgcagtggcgtgatcttggctcattgcaacctctgccttctgggttcaagcgattctcccgtctcagcctcccaagtagctgggactagaggcgcatgccaccatgcctggctactttttgtttttagtagagacgaggtttcaccatattggccaggctggtctcgaactcctgacctcatgatccacccgcctttgcctcccaaagtgctaggattacaggtgtgagccaccgcgcctggcctatttttagtgattttaaaaaaactttaggttttggggttgttttgttgttgttttaacgtagtctagtttctgtaggctgactagtttctcagttacagaaggggctgacttctccagtgtgcctgcaagcagaagaatgggttgtgcaagtttaggtctggatctgcataaggtaggagccataaggtagtacccaagtattctttgggtactagaaaatttggaagtccacgtagttgatggttactccatttcggcccttttacactagcggagggtgtttagaaaggctatatatatatatattatccttagtttttagtttaaaagtatctttggaaactttacttttaactaatctggaatctacaatgtaagtcccacagtatgcttgcagtgcaaatagagctccaaaactagtcttttagtctcctactttttttccaacccaacttacctaagctcttccgatgtgggaattctggatgccaccactgccttgtctcctttttcttatgccacccaatccgaaccctgatgctaacagtgcccagctttaggtagaatgtccagggacttcaagctacagccctcttgaaggcttaggatttcatttttcagctttggtaatacaggaaattttccctgagttttttcgacttttaaacaaacactatttcccactattcagctgacctttgtgcagtggctaagctctcccttaaggaagagaccattccaggcagctggccaggtgtccaactatttgtctgtgctcttggttcctgcatgaagggctcaaaagagagatgaaagagaaaaatgtccccagcctgaatggctttaccccatttcctccatttataccagctctccagaaattcccatggtctcttaggccttgggatgagtgttattgctagctccagaaacatgcttttggtcatcccttcctgctgccactcactcacccaccacctagggcctttccctcttcttttgtatgaaggtgagagaaaaagagaatatgccccacctcctcccctttgaggctcaaggaagcataaattctgggttttagagggcatgtttccaagtgagggtgagagtttgacctttttcattctttctcaagtaatcctgctagcttctgagcagggtgactgtagcatgccctggacctaaagaaaacactaaattccgggccgaacacagtggctcacgcctgtaatcccagcacttttggaggccaaggtgggcagatcacgaggtcaggagattgagaccatcctggctaacacagtgaaaccccgtctctactgaaaatacaaaaaattagccggacgtggtggcgggcacctgtagtccctgctattcgggaggctgaggcaggagaatggcgtgaacccgggaggcggagcttgcagtgagccgagatcccgccactgcactccagcctgggccacagagcgagactccgtctcaaaaaaaaaaaaaaaaaaaggaaaacactaaattcagacaccacacacataaggcttcctgcctatgactgtgaaagggataatcaagaaaggaaaagataaagggcaaaggaaggagaaaggatggagagaagggctggaaaggaagaggttggagaaagaatagcctgcagttagagaaaagggagaaaagtgaagaaaggggagaggaaagagaacgtttctgagtgggcaggactgacttgtctattggcattatttattgcttttggacttatatcctgactcctttagttttcacgtggctgtaattttatcagactgccctgaaagctcagttcttctgacccggaaattcttttcccaaagacagagaagaattgtgatttatcttttcatgtttctgccttcttcagcttttctttagcatcccagtaggat

SEQ ID NO: 9065 - DNA, 1933 bp, artificial
  synthetic oligonucleotide
ctccacctcctcccactttgcactctcctctagcggccgcctgtcctttttaaggaactccaccctaggtggagtcctcacgatagtcacacctctcctttgggcctagcagggccagagaaagacggaatcactctacccactcaggttgcccagagagcactttaggttctgactcgcgtggggcgcgaggtaccccgtggggcagctaggtgcctccaagaaaccccgccccagaggacccgcacgagttgctgccatttttcgctgaagcccctgccctggggctggtgttcttctctatgattctaccaatcgtcggcatttttttcctcccttctttctttttaggaaggcgctggggtgtgcggcggcaacggcggcggtgaagggatcctcttgtggtatctcctcgtgggttcctgtcttgaaggatttcttctccgcctcaactttatgttcaagtagcgctttgggggttgggttggttttcatagcccccacccccggccctctccttttaaagggtgtgtggagttcagaggatgggtggagagcgggcttggccggaactgaattggtagaggtaaaaggggaacggaggaccttaagctctggccacttcggcccagcgaacccactttatttttgtccaaggaaaagctgcaggggggaggattctttttaggaagtctactctgccggcccctgatttttgggttggatgcttgagagctttgtttcccttgttccgagagtggcccagctgggtctgaatcgactccctcccctttcgaccccctcctcattttccagcccggagaaataggggagtgggggcccaagaacgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcggtaagtgactctgggactaatacccacccactcccacctctttcgtctagattctatccccctcccagtccccctgctccccccacacaccccacttggggtttcagcagtgggggcgggagcggaaggttaagaacactatgtggaatcaaatgaaactcaagggaaaatgactttgctaaagggctgggcaaagaaaggccaagaaggagaggagagagcttggtggaagaagtgaaagggggcaagaatggatggatttgtctagtctagtctcccctggctcggcactcccaatactccttaagcggtaaggattgtctttgacttaaccccacacagccaaagtcacaaccagagagaacaggattcacaaggccaaagctcccaggtaaccccctgaagccatagcgggtacctagagaagcttctgaaaagaaggaggaggggacagtggtttaaggtgcaaagttaggctattggaggcacagagtgaggcctggaagcagctgcgggggaggagctgctttgggcgtgccagctctttaaggaggggctgagcttggttggagaaggaagccagagcctaggctctgctccggccctttaagacgtggccaaggcagttggttcgtctgtgtaggtggaagactgactgggccgagttgctgtgattgctgaagtgaatccatttgtttagccacttggcggagctgtctttttgtgggcttttttttttaaccctaagaatttgggaaaaaataaatcacatccaaacaggtggccaaaggcaccatgtcttatttcttttggtattatattcatcgtgaagaaacgcatttattaagcacctgtcacccagtgtggtaataattgagcaaaaagaataatctttaaatttggatttgaaactgatggagattgccatggttt

SEQ ID NO: 9066 - DNA, 1793 bp, artificial
  synthetic oligonucleotide
aatgagctctgatcaccacagggtgtcactgccttacaagtcaaattttcctcaattggttgaggtgtatataggaattctcagaagacattcttgagagatcacaacaaaatgtatagatagcaatgcagccattgggagatgtggagatgctataaaatcacatagaacaaaaagtgaaaatttaatttacacactctaaacatcccctgaaatcctattcttcttccctctgttaacaatttgttgtatagccttccagatctttcctccttggagagagagagacagagaaggacaggcacaagatttagaaaacataaatgagatcctactctccgtgagcatgtgtgtgtgtggttgttcagtatcttttttaatttgataacatttcatttgccatcttttttgtctcattacatccagctttatctcattcttcttagcagctaatgcagctatttctgaatattgaaatgatcagtaattgatgtctttaatctttgaaatgtttgccttgatatagtccaaagctgtgattcagactggatttcattctgttgctcattatgtgaacactatacagttaattagcaaacacttgggagggttggtaggtggtgtgtagtaagttggaaaacagtttatgcaagccagattgccaccagaatttagaacagcataaaattaaatgccctaggtaatttacagggagtaaaggggaaaagaccgagagaaagagactgttagaataccaatgcatttttgtgtctgcattattgtttgtttctgattgtaaaataatacatgctcattgtagaagatgggaaacagaaaaatgtattaagaagaaagcaaacattaccctaatcctacaacccagacttatccacagttaatatttattgttgctcatatagcttatttcctttttcaaaatttttattatatgatacaacattatgattttaaagcatttaaaacagtacaaaagggtataaagtaaaaatgaaaagttctcttcccaccatccctggtcctcactttccacaaagtcattcactgttaacagtttctctcataatgtacatttaagtgtattgatattggctttattatgagtatacaaatgtatggtgtgtgatctatataccataatggggtcatactgcgttaatttttttatactactttttttccatttagctttctatcttgagcatacatatcctatatataattcaaatacaacccaaagattctgggcatggagctatttcaaaaagtttgacctgacactgccccccatgccattacatgcccttgagtttctaaccttacacaaaagacctgtagccttagctgagggccctttccaatgaatcacacattcatcctgtgtatatatggctctattttattttattttatttatttttttgagacaggtctcgctctctcctaggctggagtgcagtggcgcaatctcggctcactgcaagctccgcttcccgggttcacgccattctcctgcctcagcctcctgggtagctggaactacaggcgccctccacgacgcccagcttatttttttcatttttagtagagacggggtttcaccgtgttagccaggatgttctcaatatactgatctcatgatccgtccgcctctgcctctcaaagtgctgggattacaggcgtgagccaccgcaccggaccatatggctctattttagactgtttggtaggagatattagaggaacggatattataaagtgccaaagacctgagt

SEQ ID NO: 9067 - DNA, 3025 bp, artificial
  synthetic oligonucleotide
atattaattcttccatttctccatcgatggatataacatacctgtatatatatatttttcttatcttcagatttattaaagtatttgtgacctaatgactttgaaatgctgttaaatgttgaaagcagtggtgctttggtggatgcttggtagagggtgggggttggggaagaattttctgtgtggtttaacctagagttagaaatatatagataaatttgaaattatttcttctatttttcaagttctctttctcagcattgctacatctttattgctcttacttaatctgtaattaaattaggtaaatatgtcaatgtttgccactactattatgtgcctgtcaatttctacccatactcttccccaaaatacctttctgtagtgcatacttacaaaaatcatcagaaaattcaaaatcttatgaaaatagaaaataagaattattcataatttcagcaaacagtactaacagccattaacttatttgtgcatagccttccagatttttttacacatacggtttacatatacaacaaactgttcaaaaattgcttttaaaataaaaatatatttattgtatttttgatattggaacatatattcttatatagtttgtaactgtacagaaatatacaaaggcataattgaaaatactctgtgatttccctataactacagtttatttcatgtatacctttaaagacactctatattttcttgtatggtaatatgataatgtgctcaactaatctcatgtaaacagatagttaatatatttaaataacattttaaaatgctacaatgtatatacattttatacataaatatttttgcatcctcatccgattattaggcgaagtgtctaggttaggcatttctaaataaaggtggaaacattcaaaatgctgatatatattttcaaattgccctatggttgtaacaattcacacttcagctagcctgagagggcattttttagggtccctgtcaacaagaaggtttaccattatttttttccctgccaatatgataagccaaaagtagaattttattgttttaacttgatttctttttattagtagtgaaattaatcatccttttttaatgtctattggccatttgcactccttttgtaaaatgcacgctcctgctctgtcttcttcccttcccctactggaggtgttcctcttttctttttgctttgtcagagttctttattattcatttttcgtcttatacgtgggatctgttcgattcaggctttcacccttttactgccttacagattgctaatatacattctccattggtcttttaatgtcgtttacagaagctgactctctaccgcctccttctctccgtctcaccctctctgcctcgcctgctctgtactgttctgttctcttctctctctccctttgtttctctctctcccttttttcttttcagtgcagaagtttttaattttgaccgagccaaatctatcaatctaggcctggcgccgcgtcagcagagggggcggggaggcgagcgcggaactgggggaggggaaggggcggggatcagcaggcggagcggctgccagagttgctgggagtgcgcgcggtcggatcacaaggcggcggcggaggaggcccagagaccggagcgcggagacctcagccagcggcctacgcccaggcctttctccaccggaggaccagggaaccgcagtcttcatcacagaggtaccgtgctccgcgctccccgcctgacccggcccagcccgctgcggcggtgcctccttccttcctccttccctcgcgctctctctttcgcccgcccgcgccttccctgcccgcctgcgtcaccgcggccgccatggctgagaatggcgagagcagcggccccccgcgcccctcccgcggccctgctgcggcccaaggctcggctgctgccccggctgagcctaaaatcatcaaagtcacggtgaagactcccaaagagaaagaggagttcgcggtgcccgagaacagctcggttcagcagtttaaggaagcgatttcgaaacgcttcaaatcccaaaccgatcagctagtgctgatttttgccggaaaaatcttaaaagatcaagataccttgatccagcatggcatccatgatgggctgactgttcaccttgtcatcaaaagccagaaccgacctcagggccagtccacgcagcctagcaatgccgcgggaactaacactacctcggcgtcgactcccaggagtaactccacacctatttccacaaatagcaacccgtttgggttggggagcctgggaggacttgcaggccttagcagcctgggcttgagctcgaccaacttctctgagctccagagccagatgcagcagcagcttatggccagccctgagatgatgatccaaataatggaaaatccctttgttcagagcatgctttcgaatcccgatctgatgaggcagctcattatggctaatccacagatgcagcaattgattcagagaaacccagaaatcagtcacctgctcaacaacccagacataatgaggcagacactcgaaattgccaggaatccagccatgatgcaagagatgatgagaaatcaagacctggctcttagcaatctagaaagcatcccaggtggctataatgctttacggcgcatgtacactgacattcaagagccgatgctgaatgccgcacaagagcagtttgggggtaatccatttgcctccgtggggagtagttcctcctctggggaaggtacgcagccttcccgcacagaaaatcgcgatccactacccaatccatgggcaccaccgccagctacccagagttctgcaactaccagcacgaccacaagcactggtagtgggtctggcaatagttccagcaatgctactgggaacaccgttgctgccgctaattatgtcgccagcatctttagtaccccaggcatgcagagcctgctgcaacagataactgaaaacccccagctgattcagaatatgctgt

SEQ ID NO: 9068 - DNA, 685 bp, artificial
  synthetic oligonucleotide
atagaattaaggacctattctcatgccaccattttcccagaattctgttagaagacttaggggaaaagcagttttctgtaaatagaaaggagaagcatgattcagcagatatcagactgaagccacctcaaagagcaggcgtcatcaggtggtgcacatgcttgcataggctttacacactttgaccatgggtaaaaacccttggcaaaagctgctgtaaaccaacaagttcaaaagtttgggtaatgtcattttaaaaaggagttgtttgtcccagcatacaaggacaacatttatttgtccagtgggtatgaatcgaggcatatagctccagctgtattgaggtatctgagcacagatttgagctccctaaaacagcacttttggaatccatatttagaactgtgtagattagcaaacttaagataatttcaagaaagattctgtaattcattattaaaagcatggttgatgagcttgaaagaaagaagaaagatgattactcggccctagcatgtatttcacaagattgccaaactgaattttgttaggttagaataacaataatagctaacatactcattgctatgttcaatctcgtagtagctctgtaaggtagcacaattacaagcttccccagcttacagataaggaaataagctgaatgagactaagtaacttgagc

SEQ ID NO: 9069 - DNA, 726 bp, artificial
  synthetic oligonucleotide
gatttttttttcagattttgtagcaggaatatgctttaaaggaaactttatttttctccaaccaaagaactgcaataaaatagatttgaactattttatttaatgatggttattacattcctcttgccagtaattggtataggatgtgcatatgacctaatcagagcaaatgtgattggtgtagggacaggtagtgctactgggaaggatttccctactataaaaagaaatgtttgactaactataggtgatgagatcttgtaatcagagagtccaaaataatttatgttctaagtattatataacaatattgcctacattcttgtttttgatttatttaaatactcttaaagtgtgtgacttatgagagagaaagatttcacactgttttgtaggaacaatcttttagctcacttccttgcttgatgttgctaaagccatttggtgaccatgaagggagttgcttgaatggcaaagacagtttgaacgtggtaacaaaaggagtctttagtgaagtaatttatttactgaaataaccaatggtataattgaactgcctaaagattttttatgtgagaaaataaaaatatctttattgttgaatctggcttttcattccttacaggcaagaatactctcaccccaaaccacatcatttctaacaccatacctcagaattctatttggcaatttgactgagagagaagaggtttaaagttcagagag

SEQ ID NO: 9070 - DNA, 1749 bp, artificial
  synthetic oligonucleotide
aagctttaaaattctttcatctctgtgaagttctagtccataaacacagtcaattccataatattttaccagataaagaaagggatatataggcacctgattcagaacggtccctttacactgggtgatgggctcatctcccttcttctatccatgtgaaattctgcagcctaccatgtgtctgcaggactgagaggaagaccttcctcttggcttcattggagatgtctttttcttcctcatgtttgtagttccagtgtggtgacctatggcttccctggttggcagctttgcagctgcctttttgtgaaggagagtcttcatatttggaggggaaggagagaggccagggaaaaacattaaatgtatgagtttttttcttctatcatgaagtccctgtgcaccaggtacattgccacccatgttgttcatgtgtgtccagtagcaatgttagatatcaagacactcttggatgcctgcctacaatgtcttccttccaggcttgtttagctgcacaagagagatagagaacaggtaggtgtggtggccgtggtagttgagagcacagcaaaaggaagtgggctactttgcctattccctgaccctctgtcgccatcctatcacatctcccaacattctccattttttagctcccacctcatttttccatttctgtacatgcagtctccatgtcccctccccatggctctgtggtattcatcccccgtacattcccatccctcgcctcccgcctggtgctcacctctctttcctgtctcttcctggtaaactccattttccttctgggctccaaccacaaacctatttccctttctggccacctttgtataccatcctggtgctcttcaggtcctcatgcccccagccctcaaatcacccttcccagtctcctgcatttcttacgccagcacccacccgaattttcacgcctggcccccaccaacccccatcctccggttccgcagcccagggcccacctcccgcgccgcccacctcccgcactgccggagaggtggcagtgccacctcccgcgcccaaatcagacccctcactgttgcctctgctaggagcctgtggcgaaggaggatcagcaggccactaacagagtgagcgcttgcaaaagctaggagggtaggatctgtaggcgtggaaaacgtctagaagggttgtgaggcaggcgaaagggaaggcagcagcatccccagcactaggcttgttagccctctgccttcctgtcggtggcggcccttctgctacactggacttccaggagccgttgctgctgttgcaatctcctcgctcttttcctagcttagcttcctggtaggagggaggcctctgcttcctgccaaacgccgcgcagcacccccaccccagtgaatcctggaccaccgccctgggccctagagatgctcctgggctcctgccccccacgcccaaccgcaccttctcccaaatccacaggtaccaggtccaaagccccctctccctctcctgctaggttcaacgttttcattttatgtcccccgacccgccgtcccagactcctcacccctacctccaccttcaacccctcagcggccctgcctcatctgctttccatctttcaagatttccttttcccagtgcccttacggagttattctttatatacaaaaacctgcctttcttgtcattggagaggatttttggtaggacaagagaaatgcgctagtgcttagtgctcag

SEQ ID NO: 9071 - DNA, 578 bp, artificial
  synthetic oligonucleotide
ctctaccagtctgtgtgtagggtcttgtttatcctgagatgcccactactaacacaggaccctgaagcgcaaatgcaccattgacgtttagggaattaaggatgcagtgagcatgggctttcatgttttgagatttattaacatttatcctactttcttgagaaacccaagcaaatccatatttaaatatttaattttccagaagaatggacctaaacggataggtgaacccaagactgaaccatcctttacacttttcctctgttattaaatccctatgttttacgactgggatctttcacatttccaaggaaattgctattccagtgctggggaatgttgtactagatcacaataaaagatgacaggtttcccaatttgttttgcaaaatatcaaagctattgttcttaaacttaaaaatatcaataaacgtttggccaatataatttcataaacttgaattctaaagctaatacatcttctattaaaaggaacagcatttcaaaataccaaaaagaaaacaaagataaagctccatgtccaccatacagaggagaaacacaacttgttgcacact

SEQ ID NO: 9072 - DNA, 2742 bp, artificial
  synthetic oligonucleotide
tttcaagtgtcattgacgtggcatggatcagtacttttttctgagacagggttttgctctgtcacccaagctggagtgcagtggtgcaatcatagctcactgtaaccttgaactcctgggttcaagtgctcctactgtttcagcctcctgactggctaggactacaggcatgtgccaccacacccagctaattgtaattttgtagaggtgaggtctcactatgttgcccaggctagttttgaactcctggcctcaagtgatcctcctgtcttaactcccaaagtgttgggtacaggcgtgagacaccacacttgaccagtacttcgttcttttttacggctgaataatattccattgtatggaaatacattttgtttatacatttatcagttgatggacatttgattgtttctgttgtgactatgataaataatgctgctatggctatctatgtacaagcttttgtgtggacatgtgttttcatttttcttgggtatatactgcagtagagaagaaatgctgggtcacatgtttagcattttgtggaactgccaaactgttttctccacatccttgtcaacacctgttcttatcttttttatcctagtgggtatgaaatgacaccttgtggttttcatgcgcatttttctgatgactaatgatgctgaacagcttttcatgggtttattggccatttgtatatcttctttttaaaaatgtctgtcaggctgggcacggtggctcatgtctgtaatcccagcactttgggaggccgaggtgggcagactgcctgagctcaggagttcgcaaccagcctgggcaacacggtgaaaccccacctctgctgaaatacaaaaaattagccaggcatggcggtgtgcgctagtagtcccagctactcaagaggctgaggcagaactgcttaaacccaggaggcagaggttgcagtgagctgagatcgtgctactgcactccagcctgggtgacagagcaagactccatctcaaaaaaaaaaaaaaagagtctgttcaaatcctttgttttattttttgagagggagtctcactctgtcgcccaggctggagtacagtggcgtaatctcgactcactgcaacctccgcctcctgggttcaagtgattctcctgcctcagcctcccgagtagctgagagtacaggcgtatgccaccacacccggctaattttttttttgagacagtgtttcgctctgttgcccaggctggagtgcagtggcacgatctcagctcactgcaaccttcacctcccagggattctactgcctcagtctccccaataactgggattacaggcgtgtgccaccacgtttggctaatttttgcattttttgtagaacagggtttcaccatgttggtcaggctggtcttgaactcctgacctcaaatgatccacccgccttggcctcccaaagtgctgggattacaggcgtgaaccaccacgcctggccaatttttgtatttttagtagagacggggtttcaccatgttggccaggctggtcttgaactcctgacctcagatgatccacccgccttggcctcccaaagtgctgggattacaggcttgtgccaccgcgcctggccctctgctcagttttaattgggttgttttcttattgttgagttgtaaaagttctttaaatattctgtatatgcgagcctcttatcagatctatgtacaaatattttcctgtactccatgggtttttttctttattacttttttaatagaaatgaggtcttgctatgtttcccaggtgggtctcgaactcctgggctcaagcaatcctcccacctcggcctcccaaagtgctgggattacaggtgtgagccactgcattcagcttgtttttttaaagaaagggttttattgtcacccaggctcatggcccactgcagcctcaacctcctgggctcaagcaatcctccatcagcctcctgagtagctgagactacaggtgtgtgctaccacgcctggctaattttgatatttttttggtagagacagggtcttgctaagctgcccagggtggtttcaaactcctgggctcaagtgatccacctgccttggcctccctaagtgctgggattacaggcatgagctaccacacccaactgcctttttattttcttgatggtataatttatagcacaaaagtttctacattctgaggtagtccaatttatctgttttgtcacccgtgcttttggtgttgtatctaaaaaaccactgcctaacccaagatcacgatttactccttttccaagatttattcctatgctgtcttctgaaagtctaacagatttagttacgacatttaggtgtatgattccacacagacttctaaaagtctcacctatttggtagtgctttcccagggaaatatttatggcaccactaagaaacaaacaattaaactattgtgtttaaaacaaaatgtgcaatgtgtgctctttagcattctgatctaggctgagaacaatatttgaaatgagccagtgctctctctgtaggacaaataaatgctttcataaagacgtcacttttgaatggagtgcagtttatgacctatttacttatgaaccagcccaaaccgcttgcctccatagcgtgagggaaggaagaaagactctactgtgagaatcaggaaaaaaacccaatcactaatttggtctaaacaagggagcttagagttttctgtggctt

SEQ ID NO: 9073 - DNA, 661 bp, artificial
  synthetic oligonucleotide
tagtgtcaggacccagcataatacctgacatatagtagatgctcaataaatgaattaaatggaattgaattagtatattggctttacttattattttgtttgttttagtcccctcccccctttaatgattctttctttcttttttttttttttttattctcaattgttccatcacccaggctggagtgcagtggcacgatctcagctcactgcaacctccacctcctggcttcaagcaattcttgtgcctcagcctcccaagtaggtgagattacagggatgcgccaccatgcctggctaatttttgtatttttggtgaagacgagttttcaccatgttggccaggctggtctcaaacccctggccttaagtgatctgcccaacttagcctcccaaagtgctgggattacaggcatgagccactgcacccggcctgattattttcaaagaattgaagatagagtgcatcagaaaaaattctatattcattatctttactttctgttgctcagactatatgagcctcttggccaaataaaagccatttatggaactggtttgcagatgattctgaaaagaggctgagaggagagggattagggaggaaaaaaaatccttgtgggatagggtcagaattcaaagagaaaatggagaattaaag

SEQ ID NO: 9074 - DNA, 970 bp, artificial
  synthetic oligonucleotide
gagccaaaaggtaccctgtaatctctgccaatgttacaacaaacttaagtaagagccgaagtaggtcaagcatttaatcctaaaaatgttctccaaaggaagatgaagggctagaggtaacatagaactccaaatattatctttctgacaaggggctaccccgacgcggctaccaaccacaccccggatgagcaaggccaaaggaattttagggaacacccaacttcctcccttaaaagtgctgctttgcttttaatatcaaactcagtgctagaagtcgccaaagtgggggcgaggttctcccaaccaaaggccggcgggcttatgtccggtcggaggtacagtgggcgagcgccccttatcatagagcccaaatgcccatgcgtggcccacttcttccgccggggccagcccgaagctctaggggaagacgatggcaccccaggctaccgccctgccagccccttccacgccccgccacctaccgcagtgctgcccgcctcattgcgctaggctgccgtgcgcgcgatggagaaccgggccccgcgcgctagtcggcggagggaaactgaggcgataaaagacgcacgagtaccagaccgcgcccttgctgaggacagcccgggagccggacagcggtgtccgggggcgggaccgcggcgtccagggggcgtggccgcgctgtgccgggcggaccctacccgttcattggcgggaggctggagtccgcctctgcggagcttcccactcaatcagttgtgcgggtcgtgttgctacagcgaggaccggcctattctcggttgagtaaacgaaccacgcagcaacgccagggcgtgacgtcgagaagaggcccggctctgcctagtggagcttgtctcctttatccttgatccccgcgccttggctccgtctgttcttccccttggctgcacattggaatctcctgggcaactttccaaaatactgatac

SEQ ID NO: 9075 - DNA, 805 bp, artificial
  synthetic oligonucleotide
tactgtgagttctcaacattactaatggacattgaagagacagttttacaataaagttttgaaggcttaacactggaattaggagctattcagtatagcatcttcagggtcagggcattctctgaaaaaaacataggatcctacaagatagaaaaccctacttcactctcctctctatctaatttctactctttttttcttttcttttaaaattttattgcagtaagaacacttaatataaggtctaccctcttaacagatttttaagtacatgcaaaacaggcacaacgccatacagcagatctccagaacttattcatcttgaaactcttttttttttttttttttttttttttttttttttttttttgagacggagtctccctctgtcgcccaggctggagtgcagtggcgggatctcggctcactgcaagctccgcctcccgggttcacgccattctcctgcctcagcctcccaagtagctgggaccacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccactgcgcccggccgaaactctttacctgatgatttagcatctccatttcctcttccctcaacccccggcaaccaccattctattctctgcttcttacgagtttgacaattttagatacttcatataagtgcaataatgcggtaattatcttactacgaattgcttat

SEQ ID NO: 9076 - DNA, 669 bp, artificial
  synthetic oligonucleotide
ttctttcccaggagttgctagtattactatgatatcacaaatccatccatgaaccaatatgtatggtcaaggaatgggattaccctcagaatctcgggcctaagaaagagatctcacttctagagccacgggtgggatcagttttcccaaaagcaattgaaggaatggaatcaaaacctcaaggttgaagaaaagctgcacagaaatacacttgtgattactaggctggagaaagaagacctcagaggagaaatttttccctacaaggggaagccaccatccacactccatcctttctcattgctgttatggcaccataaggctgggtgttgtgcattctgaaagagaaggaatacgtgagggcatgacacttacgggcctgaagtcagaaatctttctttccttttcaacaaaatgagccactttttaagctgaacaattttagccaatggagatccacaggctagacagtgtcatttgtcaggagctgtagccataacagggctaagatcaacacatccatcacatcagacaattctacacgctggttatttggggaacatgagcacacaagaaaagagctgcccaacagaatggctgtcaaaggactcaagaactgtttacaacatagccaaggatagaggagaatacccttgaaacataactccc

SEQ ID NO: 9077 - DNA, 1986 bp, artificial
  synthetic oligonucleotide
ccctcaaggtaaacctcttgtcttatatggtagagagagacttaattggatgaagagatcatttagttgccctgcaaatcggcattaaaggacgagccagcagaggatctctgcatttggaattgcaccttagttcactttctatgttacattttcaacagggacactgaacaggggacctatataagacttcccaacagtatagaccaattgggtcacaaataaagaacacgtggaaagaatactggtactttaatgcagcatttctcaaatgtcagctgcatcagaattcttaagagggcttgcgaaaacccagattcctgggctacaccccagaaattctgatttaccaggtctgggatggtgcctaagaattttcatttctgacaagctcccaggttatgctgctgctgctgttctaggggccacattgcgagaaccactggtcaaatgtgtgtttcacattcctactacctatttctgatctaggtttataacatttgatttgaactgtttagcttagagacggaatgtccaccctctccaaaaaataaaaatagaaatatttgattaataaatgctgtcatttttttcccccacagttgcatgctgctgtcaccaagatccaggttccaaggcctggttttaattacacgtttgcccatatatgtatcctgaataatgataagacttgcatcgtggatgacatagtgcacgtcctggaagagctaaagaatgctcgggccaccaatcggaccaattttgctatcacatacccaatcactcacttaaaggacgggagggctgtgtacaatgggcaccagcttgggggcgtcactgtgcacagcaaagaccgggtgaaatctgcagaggccatccagctcacctactacctgcagtcaatcaacagtctcaatgacatggtggctgagaggtgggagtccagcttctgcgacactgtcagactgtttcagaaatccaacagcaaagtcaaaatgtacccttacacgtcctcctcactgagggaagatttccagaagaccagccgcgtatcagaacgttacctggtcaccagcctgattctggtggttaccatggccatcctgtgttgctctatgcaggactgcgtccgcagcaaaccctggctaggcctgctcggattggtgaccataagcctggccactctcactgcagccgggatcatcaatcttactggtgggaaatataattccaccttcctgggagtccctttcgtcatgctaggtaattactactcttctttcttctgtttccgcctgctggtggtgttgactaggttcctaaaaggccaggagtagccttctaacaactttgtttcatttaacagtatcttcattttgcccaaaagtcctgggacccactctataaagtgctggtaatcagcaaaaaacaacctaatctggtaaatgtgccagaagttcaaagtcctgggttctagcgctgactctccattgagcagccatgtggtgtctagcaggtattaatcttctccttgtcccagtgtcttaggttgggcttccccataagcagggccctgagaaaaagatttggatacaagtagtgtatttgggaggtgagcccaggaagcaccagtatgggagtgaggaagtggaagttgaaggcacttcagttgaaggcaggcagttgaaggtatgttaatgagcccaagatatatcacattctgccggttgctgtgggcacctgtggttcagccccacaggggacctttgggagaccttgtgaaacacacctcagagaggtcctcccccggggtgaggaatttgggctattttcccacagaccctttgtgattcattgagggctgctccccaggccagttaactgccagcacttcccagggaggtgctcctgcagcacactcctgcagccagagaaatccttcaggtgactttgtagttataagccttcagcaagctcaagaatggg

SEQ ID NO: 9078 - DNA, 1744 bp, artificial
  synthetic oligonucleotide
tctaactatgtctctaagcttttattccaaataaagtaaaagccaaacaaatgcctgcttcctttatcatcagccagaagaaaaataagagatcatgccatctcacagctctccattcctggcaggatgcaggtctaagtacttcttgaagagttacggtacattctcatcagcagtgtaccctagacccaacaagtgattagccttaagccttaatgaaaagactggactgtgtcccaaatgagggtgaagtgcagttgacagcatcaggccatctacactcgtgaacttgtttgggccacttggagaaatatttattgcatacctactgtgttcatcgtcataaaaatgtgcctaccatcaaaagattgagtatgaagagaagctcacaagatcctagctttattccctaacggttgagtgttgtgtgttcaaatatggctgtgtgaaaataatacaagacattggggagttggttttagaatggcttagtgttttgaggacactaggaaactcgaattccagaggctatgagaattattggacattttcttagtttgtgtttcagaagccaatcctgaaacaagaaatcaagtaaaggcagcttacttgggaggtgtagggcaaacagaacggagcagaggggagagaaagaaagaggaaggagcctaaaagggcatataattaagcaggccacttctgtgggcaactagagcacagtcacactgggggaagctctgggaaccagcttacaacacactcaccccaaagtgatcccacccatggggagggagctgggtatttataggccaagtcccatctgtcattggttgagggatgctcctaaggagtgttaattccccagcacttctggcctgccaagcagatggtgaagtgggctctgtgacaaagaagtgtgggtgctggcatttgaagtcgggcaggtgtgctctcaagagataagggctagaggatatgagcagggtgccaactgcatctgctgcagaggaacttaaagcaattggccaggaacttctctgcttgtatagtctatgactgcactttagaagtgtacatacagaaaattgaaaagccacacatcagctaaatctacatatctataaatctacagttgatagatggcacattaagacccaaacctgggaaatgcagcccaaatgtttaatcagtaccatggagctgaaagttgtcatcctgttctattacctggcttattgccttggctaagctgtccagatctataaaaaagtaaaggcataaaccttctgtctccttcaagctagtatgacccccacggttcagaccttcatttcgtcagtgaactagttgttacattggtgtcttattttgtctccctggttacactcttcatcctttccaatgtagctaccacactgcaggcagactgaacttcccaagacacacttctgatcatttcatccgctgataaaatctttgactggctcgcagttgcccacaggacaaagtctgtcttccaagttcaactaacaaggccttgtgtgattgggactttgcctgcccctctggctttcctctccgttttcctaccagcctgaattacttccatttcccctgacatcctttttgtgcctctgaaactttgcccatgccttagcttccacctgaaatactctctcaaccagttccacgccctgagccaaacctctgcccttaattaactcttcctcattcttgggtccta

SEQ ID NO: 9079 - DNA, 1717 bp, artificial
  synthetic oligonucleotide
taggtcgaaagataggaggagaggaaagagttgagtcatgtaattcattatgggagaaagaaagggtttcagtcaaactacaaatatttactgagtaactttgtttgccaggcatatagtagaggatgcagcagtgaagaaaccatgctcaggccttaccagagcctactggattcccatgaaaatggaatccatattttcatgggaatccagtaggctctgtctacttttcctatcctgattcaaatgggatgccagtatgacaactcctatgatttgtcatgaatgggaaaccaagtgccatcttcaaaatttcaggtcttaaatctggaggaggaagccaacatccttttggagccatgaatactgtccaaactccatctgttgctcagattggaatttcggtggaatcactggacagtatggctcagcagactcctgtaggtaatgctgctctatcctcagttgactcattcactctgttcacacaaaagatgttggacaacttacacaattttgcttcatcatttgctgtctctcaggcccagatgacaccaagcctatatgaaatgttcattctgcaaaatatgtttctgaaatggtacgaaaactttcaaagatgactagcacagaaccctctcttttggaaaacataatttgaataaaatagtttttaatggattctgaaatttgtcatgttttgaagataactgactccatttaaaagtatgaagtcaaagaatcatgaaacctaggtttaaaaacttcttagtgactgaagcttaattaaaatctttattaaaaattaaaaacattgaaaatggaaaaaaaatgctaaaccatctcaggatatttttaggtactcccttgactttttattgttgacttaactgggtgccgctgctcagagttgaaggaaatgaagatttaaaaagtagccattgaatttatcttcttagaactcattgttgagttttggttcagcgctaggatagaatctagactgtagtggtttgagaagtgagtgggaggtgaggaaataaagttagcaagcacaaatcactctttgaggtatagttggagacatcaaatgcaaagggtttattaaagaaggggagatgtggcagaaggtggaaaggacatggggttaatgaagccttttttaaaatatggaagagacatgaaaatattttaaaacccatgggaaagaattagtagagtttgaggacgtgggagaagaaggaatgaactgtactagaaagaaggaaaggaaagataaaacccagtgaaagcaattgaccttaaaaagagagagagccatgggccttgattttcacaggagggcgagaaggggagtaggtttaggtatttatatggtggcagcaagttggtaattcccatctggctggggtttgctctggaagatagaaaacaaggtcagcagctgaaaatgagtcttgtcaagtgctaaagaaagaacattctaatatctgtgagcttggtgaccaactgacaagggaatgagaagaggctaggtcctaatgtggaagcaatctcttttacagaatttgagtatgaaagcaaagggacagtctctccttcccttttatctcaagatgagcaaaagtatagagaagaaatttaagtggaagtttgttgagagagttcacatagggtatatttaaatttcagaagaagaatatggattataaagtaa

SEQ ID NO: 9080 - DNA, 6137 bp, artificial
  synthetic oligonucleotide
atagtggagcaaggattcaactcagtggctacagaaccaaaagcctcaacttctacattatattgcctatgtgtacaataaatgatcgacaaaggttgaaaggtagtgtgagtacaccgatacaggtgtttttgtttccttctttttcttgttcttactttccaaattgtctaaaattaatatgtattaattttaaatcagaaaaggtaacaatttattaacgtactggtgaaagctctgatcacaaagtcattggcccaaatgcaaacccaagtcgttggtggaggcaatgctccccagaacttctacaaaaagagaagaaaaatcggggggaggcaacacccttcctgcactcttacgtgtgggctctctttctctctcgcccctctctctcgcccctctctctctcccctctctttcgcctctctcttccccctctctctcctctctctttcctctctcctcactctcactctctctgctgctccaattcaatttagacaacactaacgggattgcctgcagtaaaaggtggcccaaggtccacacttagttggttctgtctccaaattgaaacatacaggttagaagctcctccaaatatacataaggacagttaggaatagagttgggaggactagaaacaaatgccttggtcccaaaggaaaggccttttctgtgtgggaggacaacactctcgccctggccagctgagcaatgcagtttctcccgctctaagattcagcccaggcactgagggagggcactctgttcttcagcccttgtgagggctgacattaaaaggccggaaattctagggacgagggcgaaccgaggttggaagggagccaatcggagggtcaaagacttcagaatgaaaacagcttcgccaaaatgttaaaggcacctaagcagacctgtcggctggttttccttctcttacttttatccctgcgctggcatcggggcacatgaaacagctctgttcattccctgtgcagcgaccgattttaggcctcctgagaagtgcccacccactagctgccgctggctcagtcgcaaagagctgggttcgcagtatttcccaccgccacccctcctccccgcccttccatctttccgtctgcccgggctgagagccacgcagggcatccaccctgtcatttagcacctcggctacgcaatggtgggtggtttcccaaagcgcgtgccctcgcagccactcgcgctcgcctcgccgcttgcaggggcacaagtcaatgaggcttttccctccgcgatcatggtgaatcagcaaagcgctgcagagcagcggcacctccacgagcagaaattaagatgctgggggaacggcacgagtggagtgtggcaggggaatttctagccccttccaatgtgtccctcccagggacggcgatactgggggaggggagtcagctggaagctgctggacttaggcgtcgcggggagcctctggaaacagagcagtgtagggaataacgaagatgagcacagaaagtggacgagaaatgggtggaaggatctagggagcacaagcagagcagggcaggtgcgcccccggggtgggcagcgcagcaggagcaggtgttgctgaggaaaggtaggaaggaagtccggtatgggggaagggaggagatcatcaaataaggaggatttcccaaaccgcgacttgctgtttccaacgtgcaagttcccaagttcagtttgagaagtgaagggccgctaggtgtaggggagtctggaatgggaacgttagggaaatgcctccccgaggcgcattctcctacccattctcctctttcttcccccccccccactccccttcctcttcctgtccctattcgtcttccttcagctttgattaatatgcatgtctatgctccgtagtgcgggccaccgcctcccgttcgacccctggcactgggagactgagctgtagcgaccaaaggcttgggatggggaggctgagcgctcagagcgcggagtctgaggacccctcgccgcgccctgtatcccacccccctggctggagagagcgcctcagtgacccagactccgagatcccgctcggtctgcgttgcagtggacagacccaggagcttggagcgcgaaatgaaacgcgctaaattgtacctgtgcgtggccgttcccgccgccgccgcaggtctatcccggggccgaagccggcgcccgccttctcggggaattctccggagggggagtgcgaggggaaccacggtgactgcctgctagctcacggctggcgcgcacacgcacacgcccaactttgccaagccgtcggcgccccgcgggctcccccgcgccccctgcggctcaacacgctcggagacctgtatctctcctgctctgagataaggttccctccactctcacaccttcgcatgtaggggaggagagggcggagtgaggcagagaagggggttaatgctactgactccctggccagcctttctcaaacactctacgcccgcaggggcgcccgcgccagccacgccgcaccaggtcccccagacctgctggtgacgacagagagaggaggaggaagagaaggcagggcgaagaaccgggagccggggagccccggagctcgggagcccgggagcccaggcgacggacagttccatcgactgaccgtcattatcagcacttttattactaaaggactgggtgggaggttggggggtgtgcaacagagctggccagccccaatccactctggagcgaccctaaattagagccacagagaaagattctccacggataccttttgagtggacgtgctccagacacacacccggaccccgtggtcccgccgaagctgcagtgttgggggtattttaaacggttcttatttggaaggaggcgtgatttccacgttcgagcgtcttcgctccccaccccctctcggcaccagccagtgcgcgccaccacctgagcctggcgagagccgggacgcacgcagtcttcagcctgctcctttaagcctctggagagactcggctctgagcgggtccgcccgacacccgccccctccccccactcctgagaactctttactttttgtttggaaaatcggggccatttctttatttatctctgggtcttcccggaggagggcagagaaggggagagcgagcttggcgggccggaccgggggaggggagcgaagggaggggaggggactgggtgtagcctggaattctccgtcctcgtgttcctgggcgggcgcgcagagtctcctggcgatagcgccgtcgccgctccccgcgccaccccgtcgttggccttgggggtcgggtgagtggggtcatgacgagccgcgggggctgccccgggccccgcccgcgctgagaggggacgcggccgcgcggcgcggagcccccctggcggggaggccgcggggggtggggagggcgcacgcggtagggcggagtgggggcggcgcagaggccgccaagctggggggctctccgggagggcgcggccgcgggcaggagggcgtgtctccggctcgaggggaccctcccgaggcgcggcgcgggactccccgatggtggtgccgcggctccgggagagctcagggtctcgccgccgccgccgtcgccgccgccgcgggcgccgctgccgccgccgccgccgccgccgccgccgccgcccgaacccgcgccgagcgtgcgcctcgccctcctcccgcgcccgctctgctctaggatgctgcggcaggttctgcacaggggcttgaggacgtgtttctcccggctcggccacttcattgccagtcaccctgtcttcttcgcctcggcgccggtgctcatctccatcctgctcggcgccagcttcagccgctaccaggtcgaggagagcgtggagcacctgctggcgccccagcacagcctggccaagatcgagcgcaacctcgttaacagcctcttcccggtcaaccgctccaagcaccgtctctactcggacctgcagacccccgggcgctacggccgggtcatcgtcacctccttccagaaagccaacatgctggaccagcatcacaccgacctgatcttaaaggtgagaggggacgggtgcgggcagactccgccagcgccgcggccgcggtcgggctggctctgcgctggggtcccggctgagagcgccacctctcctagcccaggcagctgccgcagggactctcctgcaccgcgcgccccagggcggccgactggagcctcccagcctcctggacaaggagcgtcggggtccgggtccggccctgcccgcgtcgcctctaccgccaccccgcagctgctgcaacagttggggcggcggcggccacagtgctgtggtcggtgcgcttgttttggtcgcagtgggcttgggggtggggaggctttggggtaactgggccagcaaggagcagaacgagagaagacattctggaaagtcctactacttgagaacaaaatactatgcttggaggggattccgagatacccctccctgtcctcagttttgtttctccctttttctggccccccggagtgtttggggaacggttgttggtgtgggatgttgggaaaggacaaaagaatgtgaggcgggatggtgatgaagatgcctcccacccacccagaaagaagtgtggtctctggcgaggacagggggctgccctgctgctctcttctccggagcgaggtagccatctctatcttctagggtatgaaattatgtttgtaattcgcagttccttcgtctttcacagtagctcctcaagaaatgccaaaactttgggaaaagagggaaccgatcaatccacttttatttgggtgcatctgagcatgggggtgaggggcagagcccgaagggtgagaacagaagccaggctgtgtgaccccgagaagagcacaggaaaccgagcagctggttagagggtgacactcgcagaaaccggttgtgccatcagcttgaggtgggaatttgatgtggaaagtgaggttaatggtggtaactttcaggaacttcctaagaaaagcagaggagtgaggactagagatggaaaagtggagacctcgggagagaaaagtaaaaataggtgagaatgttccatctgaatccctgatggggactgtggggcttgtttacttaaggttctcctttggggagggcagacaagaaccagtcccagctgggactctggtgcagagggatggaaggtgatcgttttgtgtgagtctctagtccagatctggtactagaggctggttagatttctagtctacttatcccaaggggagtctgccgggaaacctggggaactctttcctcttcttttcctctacaggtaatagtttatccctagagacaagctaattttcattattttcctatgtccgtttgttgacatgttatcaattagcaattagtaatgaggggaatctgactaggggctcaatggaattaggatcttcccacatggagtggctcatgatatttttaatggcacacatcacacatttactcatcacagaaccttaataacattaatcccgagatgtttgtttttctcatgattagacttccagcatcaaagtggttttcttttttctctcaatactttagtgactatattttgggacacagataaatactgctccaaaagctttcccacgaaaacacatagtagattcatcatgggcataaggaaactgtaatttaaccagttctgacagttggaaatgccccgtcttttgattgatgatctactaaatgatatttctctttttgtgttttttcaaggtgacgtttccattgcctttccccccccacccacaaaccatcacaccactgtgacaggcagtcaccagttacagtcactctcaaggttaatgagacatcaacaagcattatcagatctcttttcaactggattacttcttccctatttgattttgatcagttcaggacagaaaacagtgctataggagaaggttgagactggagagacggaggcttggtttgcctccatatctaaagggcaactttaaaggacaatggtcaaaaatcagtggattgttttaagaactgggatggtttttcatcttcta

SEQ ID NO: 9081 - DNA, 997 bp, artificial
  synthetic oligonucleotide
accctgcacaagacatttaatctccttaatcctcaatttcctctctttaaaatgggtttgacaatgcttaatagcccacagagtgattttgcaaattatataggctagacacttgaaagtgcctagggctaaccttggcacatgaaatgcataaaaatattcttttcccattttctatcattcctgtaaattttcagcacgattactccttaactgcaagagattatattttagagtcatttctaacatttctctttaaatgtctccctcctcatacaaacatcacaagggtataaaagtaatggacacaatttgaaatatgatcatattggattagtggcccaccaatttaaatttattttcatcttaattggcctggcttagaaaaagatgatcaactcctgtattatattactttatagaacctctttagctctaaaatgtttctaaaaccaacttacaagtgatggaagttggaaagggtaggggtagctaggttatatcagatctgtccctggtgctgaaagtgagcaatgtacctaaactctcctcatatagatgcagtagaggggaaactagcgcgacttaatgaaaatcctgaattgtgccttgtttgctattaagaaagtgacattactcaggcatctccagaatacagtgctcatcctctttgaccaagttaaaactttaggaccaccccaagggaagaaagagaaagtagacaccagcccagcccactgatggatgcaggctgatgcatgctgaaacacaattacgtgcccatccacttgagttatagattagtctttaaatgcatatacactttgctgctttcaatgtcccaagcgcctctaagtgttccttgtaaaatgtgtctgaaccagtatcccattcagcacagtttagcaaaaagatactcatttatagttagcaacattcctttgcatattaaaatatgcacatccaatttaaagggtttctcttaaataagcactcc

SEQ ID NO: 9082 - DNA, 346 bp, artificial
  synthetic oligonucleotide
agaaaatagcactacacgctttcactgcagcacagaccacagcccagaaataaattcaagctaaaagagtcatttagaaaactggatattctttcagggtattcacacaagaatatcataattatgtgttatatctgtagagtatctttatttctctagtgtgttcgctgtgttgtatttcaattaaatattaaccaatgaatctttcaggaaatataaaaagatgattccctaggtaaataactttagtttttaaaaaagaacacttctaaaaattattaatgcaatgcatcaaagtgagcatttgaaaactaaactcaggcagatgtcgactgcagcatttagc

SEQ ID NO: 9083 - DNA, 1894 bp, artificial
  synthetic oligonucleotide
aagtctgtggtaggagctatctgaactcagtgtaaacctattaaagaaatttacttacccctgaattgacctgttttgaacactgagccatattttcagggacagattaagaaacagattctagcctgaatatagaagacttttttcctttaaataaaatctatatgtggagcatagaacttttacagcctttatttgaagttccaacatgaagtgatattctgttgaacacttttcgggtagctatggcaacaatgattatcaccacatactaccaaccaaaataccacctgcatccacgtctattctagaccgttaattaacaagaaaagcccagttcaaattcccagttggtaaatttggcagaaaacttttttcaaaatgttgggaaatctatttagctttggcttctgtgtttgcttcacagagttttgttgttgttgttgttatctttcagaacaacttaagtctgactctctctcttcctgctcacaccagaaccacccacacacactgttaagtttcgggagaaatagaggtttcggcatttccttttctaaggagttaatcagtaataagatctccaggggccccccagagtactcctttcaaacaattatccatgtacatgagaatttcaggcttgtttttagtttctctgtaggaaggaggggagatagaaggggaacagaaacaggaggtaaagactgaagagaaaggaagctagaaaaagaaaacatagaaggaaaacgagcgaagaaacgtagaaaagaaagaaaatgagcccaggatcaaaaaagaagagaacaatttatttcaatctgtgaggaagaaggcaaaggggaaaacatgcagaatccatggaaagcagaaacaggcttcacacaggcttacaatggaagattctgcaattgactaattgcaggaactgctccagttcgtcactgctccctatttcaatgccctctatcttgtaactttgaagtgcccacccactccaactttggactcagccacgaacttgctttggccaatgggatattagcaaatgtgatgcaaccagatgcttgacaagtgcttgtgagagtagacttgcttgctctcgccctttaccactgctatgagaacatgcttggagaatgaaagacacattctgagctgagctgaggtgctcctatcttcccagccaacgccatctcagatcagctgacagctagcatacccagagatgtgtgagcccagccagtatcaggaaagttgcctgtgtcaactagcagctgagtgcagacacaggcgtgagccctgcccagatcagctaaataaatgcacattgttgtaagccacctaggaggtttgcgatgcagcattactgtggcaatacataaccaatataagtatataccctgataatcaaggagctcattctatccccattatattaatgatttctaccacgtaatcttgtaactaagtatcaaaactccataggaaaatacaatgtagaataatcttaaaataaatacagtcaatgcaaatttttggacatgataggtgttattaaccaacaaagtaaaaaaacccaggatattccccaaggtaaggtcattgagattctaaaaccacagaaaacttggaaaaaagccagccaatcctactttaggataaattcaatttaggtaattacaaggacacagcaaactttgtccacagtcactaacactgcagcaagtaacggactaaaaagtttgcaaattctcaggtgccctatcaattgcagctgaagagctataacaataaaagcgttttctccagctgtgggcctgagggtaaacagggtaggtgatccctgatgaatctgtgctgccaactgcaagaacagagggtaacagctgct

SEQ ID NO: 9084 - DNA, 1074 bp, artificial
  synthetic oligonucleotide
agaatattgtggaagttcccaaggccattttaaatcttcttgaaccacaattgaagaaaacctcaaaatatttaacttcatcttgtgttcctgaaaaatagatggaaaatacttccttctttgtgtagttgttttaatttaggaaaacccttgtgtaaatatcatcatgccttgtagcaccgagcattcttcatgaagtgtatttcaaatacatggagtttaaaatatgaaattagtttgacctcgccttcttataaaaggaatagttcaaactgtcattatttgcagatgacatgatcaaccacaccaaaaaatctaccaaaatcacagacaaacccagaactaataagaaagttcagtgaggttactagatacatcaacttttaaaacaaacagcattcttctgtatcaagaacaaccaactagaaaatataaacatataccattaacgagagcatcaagttctataaaatatctagaaattaacttcattcaaaatacacgagactgctatagaaaatttttaattcaatgaaagaacacaaaagaaaaacaataaatgagaatttcatacttttgaaaggatgacttaatattttaaatatgttgattttccccaaattgatctataaattcaatgcaattctaataaatattccagcgggatttattttgatgaacttgataaacttcttctaaaatttgcctagaagtctaaagctctacaaatagctaagttgactttgaaaaagaagatcataaagtaagaaactgctttatcaggtattaaaacatattaaaagtcataataaaaaagacagaatggtcttggtgtaagaatgaacaagaacaccagtggagcagaaggatgaatcataatagaactatgtaggactatgtccctaatatacaataaagatggcaccatacacaaatcaaaaaatgaatcatttagtgtacagtgtgggaaaatcctttttgacaaaaattaaactgaatttctatataacatctcacaaaagttggactccaagtggattaaagacctaaatataaaaagtaaaattaaaaagt

SEQ ID NO: 9085 - DNA, 319 bp, artificial
  synthetic oligonucleotide
ttttgtattcagtgcctgacacagaggctttcaaaaaatagtccacatataaatgaatgaatagccaatatcccactaaaatctccaaacacggcgtccaacaagcttttcaacctcagcatattaacaaccaaattcatcatctcctccgccctaagctgtccgctcttttgtttgacttcatacttcagtgaatggtattttcattgtttttatctcactgatttatgctgaaagtttctataacacgcaaattatgtattccttaatgatttggtagaaatttcatgcaaactatatggatctggtggctacttta

SEQ ID NO: 9086 - DNA, 272 bp, artificial
  synthetic oligonucleotide
tgaccacaaatcagaacatctgggttctagtataaactctgctattgatctgtaactccaagtatgccatttactttccctagaccatttttttaatcttgaaattaaaagtaactataccaatctttttatttggatgaagaaattaactacttcttgaataatagtgactaccctgattttttttttctccctctgaatcaactaatttttcccctggatatctgaagacctgtgattacttaaaaattatttctttattcttaagcaca

SEQ ID NO: 9087 - DNA, 907 bp, artificial
  synthetic oligonucleotide
tcttgtcttctttccgctttcgcctgctactgtttatatttcagacccctcaaatacctgctccatgaattcattccaacttttacagccatattcactgggagacacagagtgaagttgtttactcttatccagtaccagagatccctagacattttatactctttggctctttgtttaggacttactttttaacgcattagactggaaagcctgtgagatcatggattgtcttttttactagtacaattctagcctggcacatagtaggtgcttaatacaatttttggtgaataattgattgattgattaatgaataaatgattaatgttgggttattagtttttcaaactctaaagctattgattcattttaagtagtaattcataatttttacttttacttaactagatagatgtaataccttattaagactcatatttaattcacatgtgtacttgcagttacacaaaaaaatatttttacatttcttacagaaatattcaattatagtaaagtgtaatttcatctgttccagctcctatggaaaaaaaaaagtgacacttttaactacaatataatttatattcaaaagtataataaccaacaacatttcagctaagcagggaaaaataatactagtagaccttacaaaagctattcgaatacctaaaacttaatctgtcctcttagtggcaaatgcttttctttccttgtatacaggaacatgctcacaccatcacaaacttagagatacactttggcaggaatctgcctgtcttttgggtaaacagacattccaattagttagtagctagatttgagctccttatcatgtgacctgtgtgtgacagccattatgcacgatgacttcagcttcttcagtcttgagctgtagcaagaaagg

SEQ ID NO: 9088 - DNA, 3195 bp, artificial
  synthetic oligonucleotide
agcactagagaaacccgcatggtaaactgaaagcttaaaatgagagaattacaatcactgagtaatcagacttttcacaagtcctttttaaaatattagtctagccgggcgcagtggctcacgcctgtaatcccagcactttgggaggccaaggcgggtagatcacgaggtcaggagttcaagaccagcctggccaagaaggtgaaacccggtatctactaaaaaatacaacaaattaaccaggtgcagtggcaggcgcccgtaatcccagctactcgggaggctgaggcaggagaatcgattgaactcggagggcagaggttgcagtgagctgagatcgtgccactacactccagcctgacgacagagtgagactccgtctcaaaaaaaaataaaataaaataaaataaaatattagtctaaatggtttggttggatatctgctcacgtggcatttagtaaactacagaaccatgacaacaataaaagaaaagtaagaaatgatctgaagaaagactgcagtgaagcttcatactgctggctgggggaagggatacgaatatttggggcatgcaagataagcaaaagaaactgccagtgtaacaagtcataaatccaggctcaatttataacttctaaaatctgaatttttctgggaataaaattatgaagtgccacattagccatatttagggtggcagacactggtggtttacctacccaacagctacgcccaccacctccctcttatgtcccttcctacttgctggcataacccacttcctgttatagaggttacaaaagccagacattcactttcctagcctgccttacagataaagcatgggtatgtgacaggaaagtggcctacggcactgacaggaaagtctgcttggcagttttagagaaagatctctctcccttacaaacagagacatgtgaggtccttcctgcttttgtacagttgtgtgaagatatgaggctgtgacagtcatttttagacaatgtagaaataaatttgaagaagaatactagcatgctaagtatgaccacatggagatttggaaagcagctggatcacataactgtgctgctgaattaaactctatgtggcagctatggaggtgtgcagctcatctccattcaagaaaaagcttgctgatcagctgtgtggagtgcagttagctgacagcccccaactgcagacaatccttggcagcatctgagccaaggctagccttttccaggaagtctcaaccaatagctgagcacagtgagacactggggcccagtcatttctgcccaacactggactcttctatgggccatatttgcagcagagctccccgttaggctcaccctgatttctcagagcctcagtgcagttttaggctcttcctacccagtcctcctctctttaccttctactttcacaggtatcagatctgagctgcagtcagaaggatttccctgacctcttgatacttttcctctttatctttcataggtgttacccccagtaaatattggacccaagcaatatacccaggaatcccctatctatgaactttgtattatataaagcaacagatatctttattgcttaagtcattattagttattatattactggcagcccaaagtatcctaactgataaattggaaaaatagccataaaataccttgtgtggaggctgtgaattttccatcattgagaagagggtccaatgaggtatactttatttggatgagagttgactataataagcaaattaaactcttctcttggatgtttatttaatggggacactgaaaacacaggattctatagggaattactataattttataaaaattggaagcatatcaaacaagcccagcttttgaacagtcagcagcaattagaggaagaagtgagaaacaagcagagtagaaaacttgagctgcagtcatgaagagacccaatatcaaggtcatctgatccaatagcgttaacagcattcacacttggctgcacctggaatacatcactggctctgacagatttgaaatgtagccaaccggagaaattcttgcaatcaacagcctagaggggctcagggtgaacaattctacctaatggagatatatagcccaaagcaataggaatcttctcatgaacacaaggaaaattttttaaaaaaccttttcatatagaagaggaatatggagacaggaattgatgggccatgtttgttttcccacctaagcctgaaaatccaattaaaaaaatagaagagcaagtatttctacaagaatattgtgaaagtcagcaaaaacatttctctccctccctcctcctttcctgcaacccaagtgtccttccctttaaaaaaaaaaaaaggtaattcagaatttcttggtgtattgattggataaaaatctataatgaaaagatgaaaggaggactggtcttctctccttatgctgactcttccatttcactttccaattgctgctaaagctgttcagtgccattcaaattcagaaaactaccacaatcttcaattctgtgtgctcctcacacagcacatagacaataccaaaagcccgtcattgttttcacatttcatgtaaatgtcagtcccctcttcagataccctctcctactgcaaaattctgtttctgttttcttctagctcttccaatggggtaaaatgtctgcgatgatgtttacccagcttaaataaagtctatccaatcttcctaagcttgcaatatgtggcgaacttttggcagtaagtataccaatgtgttctggggtcctaattaaaatttcaattggaacccatttctcatattcagcaaaatccctctgaagtccaaactaactgactttaggcttatgccctgtgagaacctatatgccattttacataaatgttttaattttctctgcaatcaataaatgtggctttgtcatatcccttcccaggcatttctgtttttgttctctttgtaggcccttcctgtaacacacacgctattttatagtgccttcccatcaagtaccatatgacatttcattctaatttaactctgctgtctcacagataagagaatgttaaatgatggtaactaaaggggataagtgttttctacttctggaaaagggtctcctccttacccacccttctacaacacatacacaagtgt

SEQ ID NO: 9089 - DNA, 435 bp, artificial
  synthetic oligonucleotide
taaatttctacattagtatctgtctctttgtgtaggtttatagaggatattactcatttggaaataatatatactgtaatagtcattcagccgtggccagtaatcgtttcaaatctactttggtctattagttctagcctttttgttcctatcaagtagtattataaaccccaaacaccacgcactcatagtcctacatcctacatccccttttttcttggaatgttcagttatctcctcttgtcattaagattttataacttagctggaattctttacttttctcttaactctagtgctcaccttgtctattgatactgtgcttttaagaggacatctgtaccacctgtttcgtgaaagagggtcattcttacaggtccattcttccttttttcttgatatgcatctggaataaaagcatgataaaagctaggg

SEQ ID NO: 9090 - DNA, 1030 bp, artificial
  synthetic oligonucleotide
ctatcagccaaggagaatccattgtatttataagaaaaacaatacagagattcttagtgtcagttacagacagtgttagtaagctgattatagaaacatatctctttaatcaaaccactggataaattttaaaattataatttattactggggacaacagtagttctgagtgaatcaggaatagagcacagggacagagagtgaggagagtaggatccaacaactactgtgactactccatcccaggcactttaaataatttagcaccaaaacattccatgataaatatgtacccatgtcaatccttagtacatgtgaataggatttgtgtgcgtgtgtgtgtcccattttctaagccattttccaagcctaatttattttaatttgactgtaacatatttgtaccattttcttctttataaaaaatacagtattggtcctatttgatgctttaatacactaaccagtctaaggtaccacaaagtcaggagtatttcttaaaccgctcctcaaattctgctctcatttcaatgctctatattaaaatttagaatgctcagatatatttccgaggactgcataaactacttccttattctgtctaaccataaccacctctactacatacgcatcctgctcctatatgtaacttctgagtcagtcaaggtagtatgacaaaaccacggatctatattgttcctcagtattcaagatgctaaataggctcattcctgtatctgttgtatctaagcctttactccatgacatagagtttacatattttttccttcccacatctttgtctccacatattttaacaactgaaatcccacctccgtaataaagcattcccaaaactttatagcccaacttcatctctctcttctctaagatcctatagtacttactgtatgcattatatattttaattttatattgcttgtatactattttccaaatagcatatgtgtgtatgacttgccttttcccagtatggttcttaagttgctggatcattctgcttgtgtat

SEQ ID NO: 9091 - DNA, 138 bp, artificial
  synthetic oligonucleotide
agagtaggggttggcaaactacagcctgtttttgtatgtcccatgagctaagagtggtttctatattttaaaatggattttgaaaagtacaaaaaataatatattatgacaagtaaaaattatatgaaatttaaacgt

SEQ ID NO: 9092 - DNA, 685 bp, artificial
  synthetic oligonucleotide
cttaacctcatctatttgaattccctagtgtcagttattgcttggggaacaaaggaaatggaatggcttcttatatttatttcattttttttctcccgtgggagacttctgagagggagctttggcctattcagaagtatacagtattcacagacgtgtacgaggtctgccccctgacatttaatctttaaaattattcctcgtagccaactctagtcaactctggaaatttctttatatttaaaatgaggctaactcattcttgggatctggtgtttccagatgttcaagtgttgctattcttcgattgactcagtctctgccattgaagtttcagcaggagctgacattgctttcccatgccttctcataactcattacagtcttgggaaagtcactcctggaacatccccaaagtctggagcgctggaatctgaaaaggtacacagcagcagccatccacctgcactccaaccttccatgttatcagatctgtcgtcgtgttgaaaagtcgtattgtgatatggagctcaactgttgtcctcatcttgtacaaagagggagagaggcctgaggagccttgggttatagtttccagtgaccagctctgtgagcttgaacaaacagcttttctctgtctctcagtctgtaaaatgaagtggtttgatgtttgatcaaattctat

SEQ ID NO: 9093 - DNA, 1683 bp, artificial
  synthetic oligonucleotide
ctttgggactgagttgtccaatagtgatgcccaaagagtgagcccttgacattccctatgcatctcagcacactttctggcacccctagcattcataaatatgaatacaatgttgagtaaagaaaagacaaccatgttgagatgcaggtgctgagtagtctgttagacccagacgcgagctaaaggacttgggtcctcacaccacagatggaagtatacaactatattcctttgcaaaacctaggatgaaatcagctaacaaatgatactcccctggccacagggattagtttacatgtgatctttttagctcagtggtcaaagtttttgtggagtggttgaaggtagctttctgtcagatgtaaacaaagaaacatgtgattttgattgttactggaaatcaccctttgactcagcctgaaaaagaggacaggcagacctgaaacatttaccttaaatttaggagagaagtagagccacaggcgtgatcaaactgtatctgaaactgacactatctatggtcttctcagttacacaagccaccaaattctccttagtgttttagcctgtttaggtaagaatttatttctcttaccagaaggcatccttatggatccatttagatattataggaatgtgaatactagaatttattctttaaaaatgatttaatataaattttgctttaactataatctagctcaataaactgtgctctcaggctccattttatagatttgtctagagttgatgttaagtatggctgagaattctgagcaccattaggaattgagcagaggataaaatccaggggtcttcctttttacaacaaataagtgttagtctcgctctgtcacccaagatggagtgcagtggcgcgatcttggctcaccgccagctccgcctcacaggttcacaccattctcctgccccggtctcccaagtagctgggattacaggcacccgccaccacgcccggctaattttttgtatttttagtagagacggggtttcaccgtgttagccaggatggtcttgatctcctgacctcgtaatccgtccacctcggcctcccaaagtcctgggattacaggcgtgagccaccgcgtttggcctattgtgtatttttaatgtatgcagcatgatgttatgagatatagatagtcaaatgattactatagtaaagcaaattaacatacccatcatctcacgtttacccattatttttgtctgtgtgaggcaagactgctacaatctactcagcaaaaattctgattataatacactatcattagctatagtcctcatgttacaggggccttcttaaagtggaggttcagtataagtaccatagaagaggatgtggtcttgcaatcacatttcacaaaactaattggccacattccaatttgaataaacaaattagaataaacaattccacctggcttagatacctattttagttgggcaactggctgttctcttggcatgtagcagtgagcattcaacagctggtgctccctcacccatggggcctttcttttcagaagataattatttcagagactgacaaagaactgagatctgagctgggatcattaagtgccaagaatgtaccacagtcttagcgtatcactattttaaataatgatgggagtttataaaatgaaagtattttctctt

SEQ ID NO: 9094 - DNA, 645 bp, artificial
  synthetic oligonucleotide
tattgtggtataggaagcaaatccaaaccttagtggctttaaataacaaccttttaattatttctcacaattctgtgggttggatgattctaccggtttctcctgggatctctcaagtcatatggcaactggggctggaataaccaatatgactgaactcatatatttggcatcttggcttggatggttacactcagcagagaccctaggactttagggtctctccttactcaacctctctatgtggtatcttcagcaggttaacaaaactccttatgtagtattttagggctgccaaaagtgtaaaacccaagaatctaggtcttcttaaagctgaaagcctgagctgcacaggtcacttccattgcattttactggctacaaaggaataattaagctagcctagattcactgtgggagaggactacacaaaagatgggttatggggaggcaggactgactggaggccatcttgggagaccagttaccaagtgacaaattccttttatagtttcatcttccacatttcttttcagtgtattcttcactccaagtatacaaaaccaaggattgtgtgtgtgtgtgtgtgtgtgtgtgtgtatgtgtgtgcgtgtgtgtgtgttacgaggtgaggtgggagagaaa

SEQ ID NO: 9095 - DNA, 7618 bp, artificial
  synthetic oligonucleotide
catcgagagattctgttgtacagccagaattgagaactactagaacagacaatcgtaagtctcaccctaaaagatatgagaagtctttcctagtgagtcaacaatcaatacaaaacgaaggaagaggccgggtgtggtggctcacgcctgtaatcccagcactttgggaggctgaggcaggtggatcacttgaggccaggagttcgagaccagcctgggcaacatggtgaaaccccacctctacttaaaatacaaaaattagccaggcatggtggcacatgcctgtactcccaactactcaggaggttgaggcatgagaatcacttgagcccgggaggcagaggttgcagtgagccaaaattgcaccactgcacttcagcctgggcacgacagggtaagattccatctgggggaaaaaaaaaaaaaaagaaagaaagaaaaaaaaggaaggaagaaaaaagggacaaataactcattagaaacaggggcccattgtaaacatgttatgagttggtgagcccaatgcaagaaatattccccagtgctaaggataaaaagaaataaactgaataaaatatataataaaaagagatgttaaggctgcagtgaaccatgtttgcaccactgcactccagcctaggtgacaaagcgagactctgtctcaaaaaaaaaaaaaaaaaaaaaaagaccaagaaaatagcaattatgcaaattaaaaacacatgcacacaatacaagacacattttgtgaggataaggaaaattgtgttactttctagacttaatcttcttatttgggcataattatactgactttttttgcttagggtgagaggagacactcataattggaaagaaagagtggaaaaattgaacatttaaaaactgcagtctatttcttctacaagatgtatactttgaatttctctctgttttaacctttactgaagggcaaattaaatcagggctgatttagattcaaagagtttgttaactgacgcctgcctcagggaatgacatcataattattaccagcaaatattgagtaagccctcacgggggactctgtggcactctgctagttcttcgtctctcggaaagtgcaccttcactgcagtgcctagaaaaacataatctcagctgaaattccaaataaatacctcactcctcagattctttccaccgtttctatttgcactgatgatagagccaatgttgttaaaacagcgtgagactgaacattttacccatgagccgagttccacaagctgtctgtaccggctggtgcatcattcccgtaagaagagtgaaattattaaacatcacagagaggtttacaagatttttctgaactatcaaaggtcatgtgtgttttcttggagacttcaagagagaagtggggtaggtacataaaatatctgagacattgagcaggtttatgtctgtgcaaaagtggctccctgttttcctttcttaggcatgactgtcaaaggagcacaagcatttctctgtgctgtggctaggggaaaggaaatgtatgtttaagacttggaacatgggagatttatgggatgttaatgtgtcaagtcttagtaacctctcaagaaggccacttgtgaagtcagactgtcatcagtcacagaaaccaatgcatctgtcttcggagaaattcctcagaaatgtcttccagaaagattatgaaagatgaagcatctcaatacagtgaaaaggtattctataaatgtgaatttttgctgcttctggcaagttctgagcattccctcaactgagaaatgacaaaatgatacatgcatagaatctattgaagaaaatactgaaaccgattaaaggcagctatacaaggatcaattgcatatttgtgaaacttacccatcaaaatgtggctatacaaagtgcatttaaaacacactcacacaatagcatgatacagacttgcactcagctaaaattagataatgcttcctaacgtcaacgcagaaaagcaacctgactattgtagaatatgaaagtgctttaatgatgacatcacaggcaagtccatacatatgtgaatgcaaaaggatataacaaaatgttcagtctaatggtaactggggatctgggacattggcatgttttgcatgtcaggcataatcaatatttaaggttgggacatgttttcttcttgtacggacatagtaaatgaaatagatatctcagctcatatgggctgctttcactgaatccaacaacctatgaccaacaattttataaacaacagaataaaaacccagagaaagtagagagcaaatctgctgctgctgaccatctgttgcttgatcagattcctttaacatcagcaggaagttgtcattttgacagtcactgacatttccccattaagcctaatgtgcataataggcctgaacaatatatatctgcatggcatatgagaaaaataggcacatagaccaatgggacagaatagacaacccagaaataaacccaaatacctacagacaactgttcttccacaaagcaaacaaaaacataaagtgggtaaaggacgctctattcaacacatggtgctgggataattggcaagacacatgtagaagaatgaaactggatcctcatctctcaccttatataaaaatcaactcaagatgggtcaaagacttaaatctgagacctgaaaccattaagattctagaagataacattgggaaaacccttctagacattggcttaggcaaagacttcgtgaccaagaacccaaaagcaaatgcaacaaaaacaaagataaatagatgagacttaattaaactcaaaagcttctgtgcagcaaaagaaacaatcagcaggctgggcacagtggctcacacctgtaatcccagcactttgggaggcaaaggcaggcggatcacctcaagtcaggagtttgagaccagcctggccaacatggcaaaaacccctctctactaaaaatacaaaaattagccaggcatgatggtgggcacctgtaatcccagctactcgggaagctgaggcaggagaatcgcttgaaccacggaggtagagggggcagtgagccaagattgcaccattgcagtccagcctgggcgacagagcaagactctgtctcaaacaaacaaaaaatcaacagagtaaacaacccacagagtcggagaaaatcttctcaatctatatctccaacaaaggactaatatctagactctacaaggaactcaaacaaatcagcaagaaaaaaccaatcccatcaaaaggtgggctaaggacatgaacagacaaatctcaaaacaagatatacaaatggccaacaaacatatgaaaaaaatgttcaacacaactaatgatcagggaaatgcaaatcaaaaccacaatatgataccaccttactcccacaagaatggccataatcaaaaaaatcaaaaagtgatagacgttggcagggatatagtgaaaaggaaacacttttacaccggtggtgggaatgtaaactagtacaaccactgtggaaaaccgtgtggagattccttaaagaactaaaagtagatctaccatttgatccagcaatcccactactgggtatctacccagaggaaaagaagtcattatacaaaaaagatacttgcacatgcatgtttataacagcacaatttgcaattgcaaaaatatggaaccagcccaaatgcctatcaatcaatgagtggataaagaaattgtggtatgtatatataccatgggacactactcagctataagaaggaagaaaataatggcatttgcagcaacgtgaatggaattggagactatcattctaagtgaagtcactcaggaatgcaaaaccaaacatcgttatgttctcactcaagtgggagctaagctatgaggatgcaaaggcatagaatgatacaatgaaatttgaggatgtgtgggaaagtgtgggaggagagtgagagataaaagactacacgttgggtacagtgtacactgctcaggtgatgggtgcaccaaaatctcagaaatcaccactaaagaacttattcatgagaccaaacaccacctgtcacccgtgcccccccccaaaaaaaatatatatatatagaaagaaagaaggaaagaagggagggagggagggagggaaggagaaagaaagaaaggaaagaaagaaaagaaagaaagaaaaagaaagaaagaaagaaagaaagagcaagaaagaaagaaaagaaagaaaagaaaaaggcatttataaagggagaatcaagattaggaactaaaatgacgacaaaaatttgaacagccctcgcactgtgtgtcctattttccctccaatctatatagcagtccgtattagtcaccacttgagctctagtgtttaaggtccagttaattctctctgactcacttagagaaggaagtgttagttcatgcagcatatcattacatgatagaaaaaggtagtaatgtatgaactaaaaggactatgatggcgatatttaatttcctttgtccattcattctacaaaatgtttagtacctactgtgtgttacattgaggtctcattgctgaatacacagtgttaacaaactactattctcacagggagtacagtccagtagggagacagctgttaaaggcatggtcccccaaatatactaagaattacaaattgtgatgagctttatgtaggaaaagagcatgatgtgatgagtgggatcaacaagaggtcataagtcagattgcaaggtctgggaaggcctctttcaggaatatttaaactgaaacctgaaggaaaattgaaaaatttgccagggaaagagtgcttgtcaaagctgtgctgaggcttgctcaactctgtcacagctaccctctcgtgaatggctaaactctttctattggtgagatctaccactgcaaggtcaagttgtgacaactgagtctcctagcatatatttgtttttactacttggtgcctctgtttattgaatcacactgtgctgcatgctgctgggagaatactatgatgtcttcctgaagataaaaatgctgacttagagcagtggcttccaaatctattagagagcaagatgatactgcaatatgtatgcatatttagttttaatctaaaagataattaatctttattaatatttatgaattggcatagtatgtgtagacaatttgtaaataaatctacgtcatctggggatatgtcgatatttttactgataggtgtgcacaatcaagtttggagatcacttgcttaaagtaagcaaaggatagccagggatcactgcacagagtaagcagagcccaaactctccaatcccactctcacattttcattagggcatctctttcatagcctagcttagattcctctctcgtaaccagagaaactaccttctctgataacactgattcatcctcagatttttcatatccctgacagcttatagcactccctgtctgattcaaatattttgctatgttagtaatactgccttatattgctttctggtgttttcatctgcagtgatcctgtctttcaaagaagatctaagttgttctggtgctagattgaaatccagctcacttttatctgtccgtagtgctgagaaaataaaaggtactcggtgagcacttctggactacatctcctaggaccgtgccattcaaagtgtgaccaaaagtccagcagcatcagcatcacttggaagcttgttaaagcacatcaaaatttgcactgttctccctctctttcttccacaattctcccatttctcctaaaggcccatcatattaaaccagtgcctcttaaactttaatgtgcatgaattatctggggggaatcctgttaaaatgaagattctgattcagtaggtctagacgagacccaagattctgtattttaataagttcccaggttattctggtgattgtgaatggtgcttacacctttagatttcaggctctaaaactatgctgcctgatatggtagccctagccacatggagggattgagcacatgacacacgggatttcaaagactaagtgtggaagaaagaatataaaatatctcattaataagtttaaatattgattatatgttgcatggataatattttgaatacattgggttaaataaaacatagtatcacatttaatttcatctgtttctttttacattgttaatcgaagctactagaaaatctaaaattatatatgtggtcacattatatttttattggacaatgtggctgtagacactcctctggtactcttaaatacgaatatatgaaggtagtgttatctattgagaatctattgagaattctttgagcatgaatctcaaattcatgctgctaaagttgcaccagtttagggatagctgaaaaaaactgtaattatacatcacaaaaatatccttagaaagattttctttctcatggaagtatatacactataaatacaacttctattactcaaaatattgagatttttgtcaacatttcagatttctgtgtgtatatgtgattcataatgtaggcctcctcctacatggatgaatatacatataagcattagattagtcatctgtaattaacttcttgacaaatatggataatgggtgagaaagaatgctattatatccaaagtgtaacgtaattgttccatagttcttgatattatgctctattttttcagtcttttttctgcttgcatttcagttttagaagtttctattgacatatcatcaaactcactgatttttttcttggctgtgtccagtctactgatgagcccatcaaaggcattatttatttatattacagtgtttttgatttctagtatttttaaattttttcttagaatgtccatctctgtttatattactcaagtgttcttgaatgtggtctactttttccattggagtcctttcatgttaatcatagttattaaaccctcgattttccttatgggtaggtgtaggaacagcagtggctccagagttgctaaagagagggtcatctgatcagaagagaatgggtagagacttattttaaaattgtattagcattgcaagcccattggtttttacttgtattggagctggatgaaatagtgggtaaaataagacataaaatatgaataggaggcagctaggcagggaagggggaagagtatttgctaagtacatgttttgattatctattaccatataacaaacctcacctccccaatattccgtggtacaaaacaacactcttctatttacagttatggattctatgggtcaggaattggggcagggcattatagggagaatgttatatttttctaaaatgtctgggttttcatcaggaaagactcaactggcttaagaactggtggctggaatcatctggtagattcttgccttacatatctgtgatgactcaatggctgggctcagcaggactgttgaatagagatcttacaaatggcttcttcatgtggcttgtacttcccagagaaaagtgactggggttccaagagagaacatccaagagagagcatcccaagaaagagcattcagtgagtgatcatttc

SEQ ID NO: 9096 - DNA, 1614 bp, artificial
  synthetic oligonucleotide
aagcattaatgctcaccaagtcctccacatccggttcactaaatgggaggcttctatggttctgattggatgtttagagggtgtggctgacagagtattgtataccaaggcaggctaatactttgcagatgttttggttgcattggcagatacacttgaaagtgggaatgttatgaactttctggtcaggttttagaacctcatttgccttgagggcccaagacttctttgggatttcttgggcaaggattaggcttattattttgtcgaacaaagaaaaagccaaactccatactcgttcttatgtctatatttctacttctaagtgtctttgttcatttaagtcaagtctatctttagatctgtagaattttatgtaaaaggctttggagttcttcttccccagtgagcatggtttgtagatgatgacacaggagttctgaggttaaatgatccaatcaagttccatcccctagttaattagtgacagtgacaagacagaactgggacccctgattagttttgttatctagtttattttaatttacttagcattttagtcacactgacccttccttgtgaattttaaacgtcttggaggtagaaacatacttgcaaagtgcatactggctttattgtgatgagtgttcttcattagctatggaatggtgagagtgcccacactcactacactgcaaattccagattgatttaatcgaggattgggaacttcacagaagagagggggctgcagctatagaaagaagagcaggtgcaggggaccacagcagagcagcctttgatacccctgatcccgagacacgtttggtcctgctagccttggagtgcttccttttgtgctgtccctgagtcttttataactggctaatgtgaccatccaggaagaatttccaaaaacaacgcatatccttaacaggaaacagtgacaagtatctgagcccttcctggatcttgaatcaaactcaaggtcagcaggctgcatcctcaacatgaagagaaagcagattcagggtccaggccatatagcattgtggtaaagcacatagagttggaggctagactctctgagtttgtttctcatctgccactcagacactgagaaacctggagaaagttatttttaacctttcagcacctcagtttccccatctacaaaatgaagataataatagtatctactaagaaggttgttaggagaactaaacaggtcaatattgtaaagtacttcaaacagtacagaatgacgcttagcataacgtaagggccatataaatgttagctattattatcatatttccatcttgtccagcatctcatttccttaacaggctctactcagggaagatgctcatatttgaataaataattagctttgggaatggatatgtaaataaaagtgcaagttatgaagttgattaatgttttcttccattgtggatatatctccaattttgtttccgaacaaatacataaatcaagtacaataaatatatttctcgattccacttacgtgaggtttctaaaatagtccaactcatagaagcagagagtagaatgcttaataccagggatgggggaagggaaaatggggag

SEQ ID NO: 9097 - DNA, 698 bp, artificial
  synthetic oligonucleotide
ttttaaggtacaataagtgtatagtgcatttcgtttggatgccttttcatttttaggcagccgcagaagcaccaaaatatatcagaattccagtactatgatagatttaagtttgcaatgttaaaaagcattactaaatcatttggaaagatatggccaaagtaattgtatctgtaggctccaagctagtggggacaatgttacttgttaatgcttttttttttttttttacagaatcgttcaaatcacataatgtaccacactactcttaagtagcattattttatagcactgtttaaatggcgtcatttacatgaagtgtgttctactttgctcatgctcctaaattaaatattcaggactgaataaactttattataattcttcatttcatggtagagtttgatcctgttcttatgtggttttttttgtttattaggttttaaactacagtttgaatgccatggaggaatttggataatctattaatgagaggcattgttacagttacagacttggacttgcttgggttgcattattgtgtgataagggtttttcctctaacttgaaattaaaaactactaattctttcctatttcttttcttggtaaacagtctaaacttgggacattttagcacgaagttaacagtaaagactactagatgactttgtattggagaaaagtaatgacatatga

SEQ ID NO: 9098 - DNA, 600 bp, artificial
  synthetic oligonucleotide
atttacttaatcattttgggctttagttgtctccctgtaaacagattaaaagaatgccaaccttctttctagcaatattctgctacagttttatacagaacctgttgatgtgcaagaattatatgacatatgctttgacatatcgtttttcagggtcaatggtgcaattagtaactttgaagaattccagaaagcttttaactgtccacccaattccacgatgaacagaggcatggactcctgccgactctggtagctgggacgctggtttatggcatcctgagacagttgcacagtgccagcggaggctgcactgagccttcatcgcccattgctttaggcctggagactttcatttttagtgcattttcattatttgggtaggtgacctgcttggatctagacagcatctgttcaaagttgtagggcttataaagtggaatataagaatgaactaagtatgtttctttagaaaatcaaaccaacaaaaataaatccctaggctacttttgttaaaatgctatctgctaaattgttgctattgtccattttagggtgttggccacagttatgtggtacatagcatttcaatctatagct

SEQ ID NO: 9099 - DNA, 646 bp, artificial
  synthetic oligonucleotide
ctacatgggtgtaaacaacagggagtggtagggactgtagaaaactagtaattacacacaccacttgaaggaattccaattcaatagtttgttaagccattgtgttgggcaagcaaaacagttttctgggaagattcagcccattgggttggacttagtctgtggatagccaacttttcagcattccatttatctattgctgtgtgataaacctcccccaaatttagagtactgaaacaacagtcattatttttctctctcatggttctgggggtcactaggctcagctgcatggttctcgtttgtggtttttttttttttttttggacacagagtctcactctgtcaccaggctggagtacattggcgtgatctcggctcactgcaacctccgtctcccaggttcaagcgattctcctgcctcagcctcctgagtagctgagattacaggtgcccgccaccacgctgagctaatttttgtagttttagtacagacagcatttcaccatgttggccaggctggtttcgaactcctgacttcaggtgatctgcccacctcagcctcccaaagtgctgggattacaggcatgagccactgcacctgaccatttgtggtctttcatgtagttacagtcagatagtggct

SEQ ID NO: 9100 - DNA, 448 bp, artificial
  synthetic oligonucleotide
gattattattattattgcttatatctgtaatgtataagtaagtgccccaggtagatactcatgtccatggagggcaggtgaaggttccaacgaaggccagggaatgaagggattgtcaccatgggcctagttgtgactgtgatggtcaggacatattggttttaaaatgtggtgatgataataacagtagcagttagctttcactgaggtttaactagctgtctggtattcttttaagtgctttcagtgtgtgaactcacttatcctcacaatgaccctgttactgctgttagtgccctcattttccagatgaggaaacaggctcagagagttgaagtaaattctctggagtcatatagcttgaaaatggcttaggtagggttcaagcccagacaatctacatggaaaccagtgttccattcccttgcttatctctgaaggcacttga

SEQ ID NO: 9101 - DNA, 5485 bp, artificial
  synthetic oligonucleotide
caatggaaaagagcatgattggagggagattttactctgattcttgtcaaaatgataacttggacaaatataaacgtagagaacaacagtagaaaaaacatagatggaaaagtcaccttagatgttatgtacacatacaacttcatttaaaaataaggacaaaaattggccaggcgcggtggctcacacctgtaatcccagcactttgggaggctgaggtgggcagatcacttgaggccaggagttcaagaccaacctggccaacatggtgaaaccccgtctctacttaaaaaaaatacaaaatttagctgggcgtggtggctggcacctgtaatcccagcgacttgggaagctgaggcaggagaatcgcttgaacccaggaggtggaggttgcagtgagccaaggtcgcaccactgcactccagcctgggtgacatagcgagactctgtcttaaaaaataaataaataaaaataaagccaaatcccaaatctctttcacacagtttatccctcaaccaccagtttataaaaagcaacttgtgttctgcgtattcttgtgagatttcaatacaacgtacacatcatgagaagtctgacagcattttatttgcagactatggtgatgttttttcattgatgatcgtgtttaatcaccactcgtgtagcattacagggctacttgaggaaaagtcttcttgggttcccataattgccatattggtcaggatatgccagttgctataaccagcacctctaaacactcattggctaaattgtaccctctgctcatggaacagtctgaacatgggtgtccctgtaagagagctttcttctaaatagtgacttaggaagccagactcctttcatcttatggctctgccctcccttggatgtttggcatcctctctattcagctggaggatggagaaacagagagggtggaggattgtataggttttggtgggaaggcctagaagtggggtatgtcacttctacccataatccataagccagaactcagtcttgtgactcatctagctgtaggggagactgggaaatatagtttagctatatacccagaaggaaaaggagttggagtttccctagacatgcctttatcaaagagcctatctcattttcttgaaatgaccacttttctctcaatggcaaatacttccctgctccctacctctatgacactgtgagcacctcatggcaggcactcttttttaatttttaatttttgtgggcacaggacatattttgatacaggaatgtaatgcataataatcacatcaaggtaaatggggtatctatcccctcaagcatttgtcctttgtgttacaagcaatccaattatactgttttatttatttaaaaatgtacaattacactatttttgactatagttacctgttgtgctagcaactactaggttttattcattctttctatttttttgtacccattaaccatccctccttccctccttcccctctgctatccttcccaacctccagtaaccacccttctattctctatctctatgaattcaattattttaattgttagctcccacagataagtgagaacatgtgaagtttgtctttctgtgccaggttatttcacttaacattatgatctccagttccactcatgtttctggaaatgacaggatctcattcttttttatggctgaatggtcctccgttgtgtatatgtaccacatttttaaaaatccatttatctgttgatggacacttaggttgcttctggcaggctgtcttgtgattgcttttttaagtgttgtgacctagcacagtgcttctcatgtagtagacactttaaaaattctagaagttaaccagataccccatcaccaccacaaggaggtgacatatgaatggaaccccaaaggataaagaggaattttctaggtagggaagaatagagaaaaggggatggtaagcatcttcagtggtggaaccaatgtgaacttgggtgttgcctgcaaggcagggggctagagagctgagaggccagcttgggctcaggatatgtagaggaaaagcatcagatgaatgttctgaggatccccccacctcctacctttcccttggaggcaccattgaagaaaaagccagccaagccttctcacattgggcatctctgctgtgcctctgtttcgagaatctgcctataaaaatcatatacaggtaatggtgatgttaaccaccactatggttaacatctttgatctttacaacaattctatgcgttgttcccactttacagatgaggaagctgaggttaagtgacttggccaagatcacacctctaagaggaaacagagctgagattctaaatggggtcaccctcatttctatgtcttgtctctttttttccataaatgtcttggtgtgaaaagagatacttttcagatgcttcactgctcattttggagatgctagcgtattgtaccctcagctagttagatattgctagctttggcaattttcctgcaatgttcagcagttcaaagccatcctgtgttggtgtcagctgttcatttcttattttttatttttatttttatttcaataattttgggggaacaggtggtgtttggttgcatggaaaaattctttagtggtgatttctgagattttggtgtacccatcacctgagcagtgtacattgtacccaatatgtagtcttttattgcttaccccctcccactctccccctgagtccccaaagtccattatatcattcttatgcctttgcattctcgtagcttacctcctgcttataagtgagaacatgcgatatatgtttttccattcctgagttacttcacttagaataatcatcttcagctctatccaggctgctgcgaatgccattatttccttcctgtttatggctgagtagtattccatggtgtatatataccacattttctttatccattcgttggttgatgggcatttatgttggttccatatttttgcgattgcaaattgtgctgctgctataaacatgcatgagctagtatcttttttgtataatgacttcttttcctctgggtagatacccagtagtggtattgctggatcaaacggtagttctatttagttctttaaggaatctccatactgttttccatagtggttgtactagtttacattcccaccagcagtgtaaaagtgttcccttttcaccacatccatgccaacatctgttatttttttgatttttgattatggccattctcacaggagtgaggtggtatctcattgtggtttggcacttccctgataattagtgatgttgagcatttttcatatgtttgttggccctttgtatatcttcttttgagaattgtctattcatgtcttttgcccactttttgatgggattgtttgtttttttctttcagctgctcatttctcaattgctgcttctcccttcttatattactcccactgccagtctaggggattaggcctctttctctgactgagtggctgtggggacagtggcactgactctttggtaggtggtgcatggtacagaattagagcaatgagatcctccagtggtggtggtgccaaaccacaccagcccttgcagtccaagggggtaggtggccagggagggacccttggaggaatgagctggaggctgcctgtggggaacaagagctggtgtttgaggtggaaaggggggtggggtaaggaggtagtgatgatccctcatgttatgtgcatctcttcctaactacatgttcggtgatctcatgttgatagtttcaattcaactatgggggattttgacaccatggaaattggcaaatgtaacaaatcatttttctttttcttgacaaggcagttggcaacctttactagcacatcactgggtgaggggcactatagacttctctccctttctgtccccctcaattctcctcctcactcctgactcgaggctgcctcagacacttcccatctacttttatctgaggagtaagagtgggaggaggagaggccaaggaaggttggcatcaggaggagctgacgtgatttcctcttgcaggccagggctggatccatggagatcatctgcgccaggactgttttcttttgttgttgttgttgttttgttttttagcagactggcctagagcaaacccttggagttttgtcaaggaccctgtaagtattcctgtctttagttttattttcatataaagcaagtacaatgtacattaaagtaagatgattcttgttgcatgttcccaaaggatgacctggaaaatgtgctgttatgtggacctctcctgggggccagctcttctgagagtgatctagggtcttgctagccaaagaatggcctacagatgagcagcagagacattactggggagtttgtcagaaatgcagactctcgggctctgccccagacctactgaatcagaggctgaaattgaataagatccccaggggactcatatatacattcaagtttaagaagcactgatgtgggatttaggaagtcctagttgagctgtgtgtgcagaacgatgcggagatggagttttcctagaccagctgttttcaaacctgacacgcctcagaatcccctggagggtttgctaaaatacagtctgctggccccccaccccacagattctgattcagcaggtctggcggtaaggcctaggaattttctaacaagttctcagatgacgctgaagctgctggctcagggacacactttcagaatcactgccttacataagcctctaggcagcctgtaggaagatctctggctttgagaacctttaagaagagcctctgtggctcacttcagatagtatgaccaagacgagcaaatgcaagttctggaatctgaaaacccagatgttagtcctggatttgacacattcttggaagtaccttgacctcttacctttgttttcttcacctgaaaataaggataataataataatcacctcacagcactgttagaaatatcaaagaaggtattttatgatctcttaaatgtgatacaaatgtaagctgccactacaatttgagtatcccttatccaaaatacttgggattggaagtgtttctgattttggatttattcagattttggaatatttgcattataattaccaattgagcatcccaaatctaaaaattaaaagaatcttccaagtcagaggctttaggaaatgatttcatgttgctctctttgtggtgggtgctcttttgagatgctttgcctttctctgtttgatttattgccacttggggaaattaccatatggctgaaaatgtgtttttttgggaaaaaaggatattatgtgttattttcaaggactgttgctgactgtgatttttgctttttgatatatctgagcattaggtgacagtgattcagtcattatggttatatctgttcctggcgtg

SEQ ID NO: 9102 - DNA, 1018 bp, artificial
  synthetic oligonucleotide
aaataatttcagtttattacaagataccattaaaaatgaagtctatgtaatgggatattttataatatattcaaaaaggactcgtacgtagaatatagaaagcacttctacaaatcaataacaaaaaggtagattgctctataaatatgtgatatagacttgaataagtattttaccatagaggatgttaattttcttgcttggggttagtgattggaagggagcacaaggggcttttggggttccagtaataatgctggttacttgagcgtgttaactttgtgaacattcttcacattatgatctgtgtacttttctgtatgttgtattatttgtgtacttttctgtactttcattggaaaaatttacataaaaaaagaaaatgctttgctgtccaggatgaagaatgtgagcagaatatttttggaggttaacactgattgcaaaatatgtcttcccatttagaattgcctctactatagaagcagaggaaatgttgagagcatggggctttgcaaggtggctatagcaggtgcagtttgtgaaatagtcctacacacagcctggcagtgtcttaggttagcataagtcctttggccaacaatatcctgagaagcaagcaggagaacaaacacagttatggaggaagcactagaaacaagcttgattacttgacagttttgtatagggcgaattctgcctgtaatcctgtttaagtcaccacttactgatccccgttatcatgtgcccaggcaccaagatgggggctttctgtgtattaaaaattttaaatcctcagcacaatcctgggaagcatgtactattattatttgactttacagataaagaaactggggcttagagggattaaataactcgctcgaattccagctagcaagttgcagcaagctgcaactggaacccatgtctgtgtgattccaaagcacccccttcccacatgtctattatgttgcctttaaaaaaaagttatttgatggagcatagtgagaagaaaaat

SEQ ID NO: 9103 - DNA, 3613 bp, artificial
  synthetic oligonucleotide
ttggaacacagccacatccattcgcttatgcattattaatggctgcttttgcactccaatggtacagtcgaatagttgcaatggaaactggatggcccaaaaagcctaaaatatttactctttgacctttatagacagtttgccaatccctgatgcctagtataaagtaaagctttgaatgtatgtattggattcaattagaactgtcttattagttgatagctccttggtagcttctttgaatttcttagatagttaataaagttaagaaataccagaacaggctgagcgtggtggctaacacctgtaatcccagcactttggaagaacaaggcgggtggatcaccttcaggtcagaatttgagaccagcctggccaacatggtgaaacctcgtctctaccaaaaatacaaaaaaaattagccacgcatggtggaaatcccagctcctcaggaggctgaggcaggagaactgcttgaacccaggaggcggaggttgcagtgagctgagattgcaccactgcactccagtctgggcgacagagtgagacttcatctcaggaaaaaaaaaaaaaaaaaaaacagaacggtgttgaaataatagcaatgataatgggtgtaattttcttatgccttgcttgggtggtaatgcctccagtatttcccctgaaaacgtacactttttttgtttgtttgttttagatagttattcttttttgtgttctgttgttcctagtttgcaaaaagctgctgctcaagaaaaatgcctctttgccatttatcaagagactcagatggagtatctcttttaacttatcttgatttacccatgctgaactaaacttataattttgaaataaatcctgcctattaatggtttgtattttttaagacattaccagaattgaagaagctagcattttgtttcacacatttgtctctatatttatgattcatattggtttgtgattgttttgtgtgctaggtttgtcgaattctgttattaagattgtgctggccttgtcaaacaaagtgggaggcttcctatatgtgtttctatgctctgggaaagacataattcaataaatcccaagttactctatgacaagcactgtaaaggccaaattcacaaactgacattagggttcttgcttcatatgtcaagaaggagagcaaatggtggaaaaggatctcttaaaattagtattttttaacaaaaataggtaaaatataaaatagctggacgcagtggctcttgcctgtaatcccaccactttgggaggctgaggcaggtggattgcttgaggtcaggagttcaagaccagcctggccaatgtggcgaaaccctgtttttcctaaaaatacaaaaatcagctgggtgtggtggcaggtgcctgtaatcccagctacttaggaggctgaggcaggagaatcgcttgaacccaagaggcggaggttgcattgagccaagatggtgccagtgcactccagtctgagtgacagagtaaaattctatctcaaaaaaaacaaaaaacaaccgcataaaatatctattagatttaaaaactttttattttgagataattcaaactttgataagttgaacaaatagcacaaggaacttctatgtaccctttacccagattccctgattattaccatttactacatttgttctattatatatatactttcattttccatctgtaaatatatatatagtgtatcatcctctacatatatacttatatacttttatacacatgggcagatagtatatgataaaataatatatctataaatgtagagataaatatcgatataaatacagatacatagatttttttctgaactctgcaagtatgttacagatgattagatattcttaaagtgtatagaggttttcaaatgtcaaatgtgctaaaaatcttatttcttttcctgaaacactgaatctttaaattctatctatatcttttaatatattctatatctatctatttatgtgtctgtcagtctagctacctagtcatccaactatctattcatttatcattctatccaggtaatacaggctcatcgtagaccaaccacaaataaacagcaaaagaagcatacttcaccacccagcaataacaactttttaaatgcaaatataggtataaaattatacatatcttctaagggatcatataatacattctatttaattaatttatttacttatttatttatgacagagccttgccctgttgcccaggctggaagtgcagtagcacgatttcagctcactgcaacctctgccttttgggttcaagtgtttctcatgcctcagcctcccaagtagctgggattacacgcatgcgccaccatggccagatcatttttatatttttaatagagacagggtttcgccatgtttgccaggctagtctcaaattcctggtcacaggtgatccgcctgcctcagcctccccaagtgctgggattacaggtgtgagctaccgtactcagccggatatactataatttacttaatcaatgcctgtgttatttaggttattttttatgttttcttcattgtaagccacttggaacatgagtttagaaacatcaagagctggatttgaatcctgattccctttcatttaccctctatatcactttgggccaattactgatctcacctagttcagttttcttatctttaaaatggagataagaatatacatatcagagtatgcaaaggcatacagagtggtgtaatagaccttggactcaaaggggggagggtgggagaagggtgaggaataaaagaactacaggttgtgtacaaaatacactacttggtgacaggtacactaaaatctcagacctcaccattatccagttaacctacataaccaaaaactacttgtaccctaaaagctattgaaataaaaaatatatatattttgaaaaaaggggaaaaaaaggaatacccatatcatagggattttgtgaagattaaaggagatgatttatataaattacccagtccagttcctggcacatagcaggccttccgtaaatatttgtcctttgttcctcgctttgtttcaaagatagttctaagattcatgaagtaatgtctatcaaatgctttaagttttattctggtattatcctttgtgtaaatatcatgtgctttcaaaaatattgaatactgtcaagatatttttgctcactcttgataaaaagagagaacatcccaaaataaaacccaatactaccaatcgaaagaataccattttcttaaggctgatagaaaacacacagatacggctgtccaatttgtgaaataaaatggacttgacagacctggctgatgaaaaattgccctctactgaagtgagcaacctggctttgtgaatttttttctttaaatggcatataagactcagattccgacttgggaaataaaattacttcctattctctccaagaagtgagattttttaaaaagccgaatataatcatatgtttgtcttaagatccacattctataaaccccccaaatttgtcttcatgtgaccatgaagaagacacagcatgcattgcttatgaatgagcaga

SEQ ID NO: 9104 - DNA, 2850 bp, artificial
  synthetic oligonucleotide
ggaaatgctctcccttgcagtgggaatgacaaggcagggcagtgaaataattagcaacacatttaagttatgctataacttagtgcattgagttttaagaagtagtcattgtggctggtactctgtaaacatgcccacatggcttcccttagtgcatgtttgcatgaaaagagcttgggtgtcatttctgtgttggtgttgtgtttttcttctgtagttaatttttcttgtctggttgctcttctctgtgaacatcagaaaccattctatgaaaaagtcctgtaaatttttcacgccactgtctctgttctgtcacccaggcaggagtgcaatggcaagatctcagctcactgcagcctctgcctcctgggctcaagcaattctcctgcctcagcctcccgagtagctgggactacaggcacgcaccactgcacctggctaatttttttttatttttatttttatttttttattttttgagatggagtcttgctcttgtcacccagactggagtgcagtggcgcgatctcggctcactgcaacctccgcctcctgtgttcaagtgattctcctgcctcagcctcctgagtagctgggattacaggcatgcgccaccacgcccggctaatttttgtgtttttagtagagacggggtttcatcatgttgctcaggctggtctcgaactcctgaccttgtgatctgcccgccttggcctcctaaagtgctgggattacaggtgtgagccaccgtgcccggtgtatttttagcagagacggagtttcgccattttgcccaggctggtctccagtgatcctccagcctcagcctcccaaaatgctgggagtacaggcgtgaaacaccacgcctggcccctgtctgtattttgcagccatacctcatggaggcctgagattggctgcaggcactttagtgttaggaaagctgtgtgggagctgggcaccagccacctcactgtgcagtgacagtgcctacacaccgcagccactcagatacttggtagtctatgatagatggggacaggtagagaagaccactccttgcagcccctttacctgatgcgtgttgcatctgagcccgtgcctggtgggcagcttgtggtggaggaggaggagaaaccaactactttttttttttttttttgcataagaatgtatgtattagttttctattgctgtacagtaagttaccacaaatttagtcacctgacacataatcacagtttatgtggattaataatctgagaatggctcagctgggtccatttttattttatttatttattttgagacagaatctctttatgtcacccaggctggagtgcagtggcaccgtctcggctcactgcaacctccacctcctgagttcaagcaattctcctgcctcaccctcccaagtagccagggctacaggcgcctgccaccacacccggctagtttttttgtgtttagtagggacggggtttcaccgtgttgggcaggctggtctcgaactcctgacctcaaaccttggcttcccaaagtgctgggattacaggtgtgagccaccgtgcccggccttctttttcaaataatggctttttttcctctgggtatatacccagtaatgggactgctggatgcaatggtaattctacttctagttctttaaggaatctccatgctgttttccatagtggttgtactagttgatattcccaccagcagtgcagaagtgtttcctttcaccacatccacgccaacatctattatttctttgactttttaattgtagtcatttttgcaggagtaaggtggtatctgattgtggttttaatttgcattttcctgacaactagtgatgttgagcattttttcatgtttgttggctgtttatcttttgagaattgtctgttgcccatgtcctttgcccactttttgatgggaatatttgttttttttttttttcttgctgatttatttgagttccttgtagattctggatattagccctttgtcagatgcatagtttgtaaatattttctcccactctatgggttatctgtttgatgattatttctttggctgtgcagaagctttttagtttaattaggtcctatttatttatttttgtttttgttgcatttgcttttgggttcttggtcatgaattctttgcctaagccaatgcctagaagagtttttctgatgttatcgttatcttctagaatttttatggtttcaggttttagatttaagtctttgatccaccttaagttggttttttgtataaggtgagagatgaggatccagtttctttcttctacgtgtggcttgccagtggagaaaccaacttctgagtcttctccgttgccttggcaaccttgccgtaagtgggattctgaaggctcagcgtgttagtttgggatttttggggaacagctttattgagatatgattcatatgctatataactcctttatcgaacatgtacaattcagtggctttcaggatatttgcggttgcgtgaccatcatgacaatcaactttagaacattttcatcacctcaaaaacaaaccctgtgccccttagccatcacccttattcctccccgcattcttcccagcctctggcaaccactaatctgctttacatctctatgagtttgccttttctgttttgttttttgaggtaaagttttgctcttgttgcccaggctggagtgcaattgcgccatctcggctcaccgcaacctccgcctctcgggttcaagcgattttcctgcctcagcctcccaagtagctgggattacaagcatgtgccatcacacacggctaaggatttgccttttct

SEQ ID NO: 9105 - DNA, 5881 bp, artificial
  synthetic oligonucleotide
atgaggtctgggcgcgggaatcgtttacaccccgaatcggggagctatcaaaagacagccggccgggcgcggtggctcacgcctgtaatcctagcactttgggaggccgaggcgggcggatcacgaggtcaggagttcgagaccagcctagccaacatggtgaaaccccgtctcttctaaaaatacaaaaattagccgggcgtggtggcacgcgcctgtaatcccagctactcgggaggctgaggcaggacaatcgcttgaacctgggaggcggaggttgcagtgagccaagatcgcgccattgcactccagcctgggcgacagagcaagaccctgtctcaaaaaaaaaaaaaaaaaaaaaaaaaaaaaaaaaaaaaaacccgaccagaagagagaggcctgctaaagtcggaactgtgtgcaggaaatttgaaggggaaggataatttgcaggcttcttttctcggggtgcctctgtcgtggggggtgggagtcgcgggaaggatagaactgccctttctttttctggtggcttttaaacctgtgactgccgcagacttgaatctgcacttcccataggttccacttggagtgtctcgctcataccttgcttttcccactgttttcctcgaattggatagagcaggcttttctcttaccatttttaacactgttcctttctttctgaatttctgagtactcactttgcattttctcccgcaaatttaaaggatctccgaaggcacaagatctagtgaagactgaggatttggagcaacacctgggtttgagtctggcttcttcctgatgggctctgcgtgtggccttgggtttatgttaacctttctgagccttccctgtccattaaaaagaaaaaaaaaagtgtacacctcttcgggcttttactcttaagggggtagctgtggagcacactgtagggtttttaagcaatgtcagtgtatttaggtggtctgaagtgacttagagaaaacaaagcatgttaattttagttcccacatttcttaggtgaggatggtagggcatggagactgctagagatgaaatggtgcttgagtggtggagctgaagagccaaggtttcattaataaccctgccagccttagggctgaatggttaatgaaagctctagcatactgaatttagcggtgaggagaaatagtgtattagggtcacccagctagtaaggggtgagtctgggaagtgtccctgttgtgagcaccttgtgaacactcacctgtatttatcgtccatggattttcttaacttttttttttttttttttttttaattctgagatggagtctcactctgtcgcccaggttggagtgcagtggtgcgatctcggctcactgcaacttccatctcctgggttcaaacaattcttgtgtctcagcctaccaagtagccgggattacagactcgagccaccacgcccagctaattttttttgttgttgtttaaagtagagacagggtttcaccacgttggccaggctggtctcaaactcctggcctcaagcgatccgcctgcctcagcctcccaaagggctgggattacaggcatgagccaccgtgccggtgtgtccatgggttttcttttatgctttaaggagggtgatctcagcatggagcccaaagactctggcacttccctttgtccttaaacctccttggccaaatttagatttagtctcttgaagtgctggttcacaataggatgtttttgttgttttgttaaagtgggaaaagagcgaatgaagaaaaagtgagagaattttaacacttggggctgacactgtccaggagaaccatggatgtatcgtgtgggagggaggaggagaaactgacgtttttgaagttggaaaggtgtggaagtggcatcttaatttagttgtgcaaagaggaagtaaaaagattgacgataaagacgtgtatagatcagaatagaacgttcttaagagggaaagatgaaacataagctgttaatattttaattcccagtctgttcttaaagatgagaaagctttgatggcaaggcgaacattctagaaagaactattacgtgtgtgtgggggggtggggaatgtgtgtatgtatgcatctgtcagaccttgagtcattacaagtgttctgggcgtaagaactccgattcatattgcattctcttccatcactttatttggggtgaagcacatcgtcctgtcagtatccacatttgaaaaataaagagatcctggctagattgggatctaagttcacttagtttttagtaaggggaacttggtgaaaaatcgacttgtgaggtctccagaaacacttaattgataatgagtcaaaaggcattactcttggcatgtgaatattggatgtgactcaagggtgagtcaaatgcctgtggagcctggattcatgttcttttccccgtttgtcagtaatcctttctaatgttccagttccatgatgtgattttagtggaattaaacttgaaccacttagttatgatgttgttactgtgttgggaacgcagcagccaccagaccaccaagagcaactgtaggttgggcttggtggtgctggtttagtgttgtggctgatgaggtgtaacccaggaaatttttatttttgcttttaaaaaaacaactcatctgtggtcatcttgtaagtgaagtattggactataaggactcttgagcccgaaaaacattttgtgacttagcctgaggctaacaggaataaacttgtcccatgttcagatagtttaggcatatctgagttggtggaggaaatgtgatctgttcctagccctatgtgctaggcaggatgcctgggtatccagagagtgagtgagaggcccggcgcgatgccgcatgcctgtaattccagcactctgggaggcgaagcgcttgagcccaagagttcaagaccagcctgggcaacatgggaaaaacctgtctctacaaaaaaaaaaaaaaaaaaaaaaagaaaaaaaattagccaggtgtggtgagttttctgcacctgtagtcccagctagttgggaggctgaggcgggaggatcccctgagcccaggaagtggagactgcactccagcctggacagtggcgtgaaactctctcaaaaacaaaacaagggccaggcgtagtggctcatgcctgtaatcccagcactttgggaggctgaggtgggcagatcacctgaggacgggagtttgagatcagcctggccaacatgatgaaaccctatctctactaaaaatacaaaaatcagccgggtgttggtggcctgtgtctgtagtcccagctactctggaggctgaggcaagagaatggcttgaacgagggaggtggaggttacgctgagcccagattgtgccactgcactccagcctgggcgacagagagactgtgtgtcaaaaaagcaaaacccgcacacaaaaacagtggtgagtgagctgctgtaacctcttcttgccatgttggagtggaaggtctctaacaggccagccagctctgaaaaggtctagcaatcctatgtccatttttttcccctgggctgggcgtatcttttgaaggcagacctccaccagggtctgtatcctggagacagctctggtacatggtagatatttggtacacgctgattaaatagaccaagtttatgttatggtaaaggtggaatgctggttcatgtccattaggggaaagtgagatgctcatttaccttgtagaattatgaggatggtccagaattcagaaacgtggcagatactgttaggtctgtcatttggaccattgctatatgatttgtgcagggacacaaggagatttgtgtcgctcaaattcacaaattctataaccttgtttaataatttaagaacagaaggctacttgggaattacgggcttagcggagaaggtttggggcagggggttcttttgtacccttgaccctcatcagggaagcctgtgcacctcttctcagagtaagaattttagatgcgtgaaataacccaatcttcaaaatacaaaacccccaccgtgtggtatggtaacatgtgctttgcttcccgtccccccccccaccccctacagtctcgctctgtcgcccagagctggagtgcaatggcacgatctcagtgtaacctctgcctcccaggttcaagctattctcctgtctcagcctccagagtagctgggattacaggcacgcggcaccacacccggctaatttttgtatttttggtagagatggggtttcgccatgttggccaggctggtctcgaactcctgacctcatgatccacccgcattggcctctcaaagtgctgggattacaggtgtgagccaccgcgcccagctcatgtgcttctttattaacacatcaaataacaagatgtggcagcaaggctagtaagtttcataagtagagctgagcaaaattgatatttaacaaattgttaggcaaggagaaaaacctgattttttgtgacaatgaccaggtgtagttgacagtgtgtgattttttggcctccaagcataactgaagaaagtgctaaatttctattagtgaaaataagtctgtgtgtttttttccattcaagttcacaggccccctgaattgtatccattggccccttgggcatccatggaccccaggttgagacccccaggctggggagggggaggactgagacagcccgttccttttagggggtgtaggtttccacccaaggccaatgctggaggcacatgtccctagttattcttcaaaaacaaaagcggctctttgaactatttgaaaacataaaagttgtacttagtaattgccacaggggctaagtgccctgagtgctttgtgcattaattttaggtaaatcctcaaaataaccctaggtaggtcttgttatccccattttaaagacaaataaataggcctaatcttgaggttttttactttttgagtggcagagctggaattcaaagccatgtttgtttgattggaaggctggttctgcttccacgattctgaagcctcttagtttaaggcggtgattctcaatgtgggtgcttccctccgtgggtgacatctggcaatttctggagacagttttggttgtcacaactggggagatgctactagcatctagtacgtcctgcagcgcacaggacaactcccctgcggcattgacagcccaaaatgtccatagtgcccaggcagagaaaccctggtttaaattcatactagaccatttcagtaatttggatgacagatcatcagcaaaatttccctggtccttcttggaagtgtcagttatgcccacaaattgttaggcagggaaggaggatgggccctgtctttctctaaggttggcactgggctctgttaggagcttggtcattgcttcctactgaactgagcctgtggtttgaggtgaccttccctccctgatttcctgaaccatcgctctttttaaccagctcccacgctcccctgtatttgagctgccttctggtggaagcatgtcttctttgtgtgttttaaatagctataactgtctaaataataaaacctaaacaatgtagttcagattgcatctagctttctcaagagtagagaaagcttccttcctcccgctccttcagcattattatcctgtcccactacactttaatcccccattgtgataacaccgcaggcacagacgctgttgctttaacaatgcagcctttcggggctgatgactgggagtggggaatgcatgcttgggccctactctacacggactgaatcacagttggtggaggggggtgagttcctggattttgcatttttaatcatctgcctcacagtaattctgttgc

SEQ ID NO: 9106 - DNA, 488 bp, artificial
  synthetic oligonucleotide
aaagaacactaagttcacattactcttcctggtattttaaatgtcttttctatctttgaaaagctgacctggaacacagagaagggaattttttttttccttttaaagattcctatggaggattgttctggaatccatcagaatgttctaatacctagcctctaatttgtcataataaggcatgacacattacaatgtagattgataaaactggtttggaaagcaatttatccacactcatcaacctcaaaaatgttcatgcccaatgcctgtagtcccagcaacttggaagcctgaggcaggaggatcgcttgagcccaggaggttgaggctgcagtgagccatgattgtgccactgcactccagcctgggtgacagagcaagatcccatctcttaaaaaaaagaaaaaagttaaaaagagtccacgcccttttaggcagtaattctttttttggaaatttattctaaagttctaaagtaataatcc

SEQ ID NO: 9107 - DNA, 965 bp, artificial
  synthetic oligonucleotide
agagaacaggatagtgcaggatataaggtgggagatacaggtagggtctaggttatgaagtttatgttttacctgtaggtagcaagtctgtacaaaatggaccaaagtcattagagtgaagatgtggagatcatttaagagcagtaatttattttagaagtgataaagatataaaattagtggcaaggagaatgaaggggatggattcaagtaagcttttggagtggaattctcagacattggtgattaattaaatgtgaggctggagggagaaggaaaagtttaggatgactctcaggttacacaattggttcttgttcaacaagaaagagggtaagagagaaagaagccagttggagaaaatatgatcactggcttatctgcctgctagaattagaatggcaaaacgttgtttagagaagaaattatttcttctctttgccactcagtttattcatagtactcacaaaaatgtcagctctattaggagatccgtgctttggaaccattaagaagtcagctgccctctggagcccaccatgcatattcatgtataagtttaagaatgttatgaatcctgactttgacatgagctcttgtagcttaagtaacatactttctgtttactctataattcctgacagccttgttcagtattaattctccaaaccatggcactctgtgttgttgaaagtattctgtattcagtattctggtacatctgataccctgtgtgaatcatggcagagacagatgggcaatcgtgtactgttgccagcaaataagacctaccatctgttggtattatcacacattcaaattcttactttatctcactcactagtacatgcagaaaataataaagagaaggaagaaatatcctattggaccaagcttactgatttatttgaaataaaggtaaggtaagcaggatattttgtgatatagagggtatgtatgacagt

SEQ ID NO: 9108 - DNA, 1949 bp, artificial
  synthetic oligonucleotide
tcaggggtggcatggtctagatttctttttgttaaaaatttagccccaaatggattagagctaaatgtaaacaatcagatcatcagagttagcagaaaatgcaatagcagatcaaagcatacaaagtggaaagaaggatataataaagataagaacagaaatcagtgaaatagaaaatatacaatagagaaaatcagcaaagccaaaagttggttctttgaaaatattaattgggccgggcgcagtggttcacacctgtaatcccagcactttgggaggctgaggcaggtggattgcttgaggccaggagttcgagaccagcctggccaacatggtgaaaccctgtctctactaaaaatacaaaaattagccgggcatggtggcgcacgtggtcccagctactcgggaggctaaggcacaagaatccttgaacttgggaggcagaggttgcagagagccaagatcacaccactgcactgcagcctgtgtgacacagcaagaccctatctcaaataaataaataaataaataaataaataaataaataaataaatagaaaatattaattgataaacccctaccatgactgatgaagaaaaaagaaacgtaagtaattaaaaatgagaattgaggccaggcacagtggcccatgcctgtaatcccagcactttaggaggccgagatgggcggattgcttcagcccaggagttcgaaaccagcctgggtaacatggcgaaaccccatctctacaaaaaatataaaacttagccaggcgtggtggtatgggtctgtggtcccagctacttgggaggctgagttgggaggatcacctgagctctgggaggtgaaggctgcagtgagctgtgaccgtgccactgcactccaacttgggtgacacagtgggaccctgtctcaaaaacaaaaattggaattgaaaagaggacattactacagattctataggcattaaaaacatagtaagactattaagaaaattctatgcctataaatttgacagttttagtgaaataaacaagttccttgaaaagcacaacttaccaaagttagaaaacatggcagattatctccactatacaatggtagcttttaataattaaaacaatagaaaaaagaaattattattaaattataccatgttaatatttaagctcattttatcacaaagtaaagctgaaatacgatgcagacaatagaagaggtagatgaaaaaggatggatgtctataacgtcaaaagggctttcataacgatataaggacaagatcaaaacaatattatgtaaatgagcaagtgcatgagaggaaacaaacttttttattgggaatgatattcagattctttagttatcagagaattataaattataaaactgcttaaactagtgctcatgctgcagtcaaatatttgaagttcatgtaggaaaaagaagcagagttactgaaattttttagccattattttaaagctatgaaatgtggctgcttagtgaatttgctagtccatgaattgagagaaattgtaaattaacatgatttttttcccttttgacaggttcaattttggaatggtgtttggcgtaattgccatgtttagctcattttttctccttggaaaaacgctgatgcagactttggcacaaatgatggctgactctccctcttcttattcttcctcctcttcttcctcttcctcctcttcttcctcttcctcttcttcatcttcttcctcttcctcgcttcacaatgaacaggtgttacaagttgtggtaagtatcgtcttttcgctttaaataactatcgaaatagagatgcaagataccacttatgatctagtgtaactcctatccataatataaatatgaaaataaattaaaagtctcataattttcaaattacctgcttacacaaaaaaattaataagaatacagca

SEQ ID NO: 9109 - DNA, 4361 bp, artificial
  synthetic oligonucleotide
atggattgttactaatccccttcctgggcacctgttgcagactacatggtgatcctacttttctgattgaaagggattacacccattttctacagatggacttcaataggcttaattaataattagtcttaaaatgaaccttctctggagggagaagacaatacaacccacaatcttccaccctttgtgaagttggaagtcatgtgagattgaactgcaaagtcagtgcctgccctacctatctcacagaactgttatgaagttcgaaagagagaatggacatggaaggatttcggaattcttaaaatcaagagcaagggtttgttaatattattgctactattatcccctagttaaaagatgtgattttgcgtatgttataaaacttccaaataaacctgtttcctcattgcctggcctgtatgatgccccttaagcagccatttcacaaagtctccaggctgccatgttctctggcacctgtatttactagtgactgcctacctattattgcaacatagacataatttgattatcaaattaaataatgtcagatagagggagaaaacacctctgcaaggtaatcatagctggaaattaaatgtgaatggggcataacccaggacagggtgtcatagagaagacacccagggcacttctggacattgagatcgacatagctctcattttattttctggaccagactccaatagtacatagcctatgcacaaaagattactagaaaggtgaaatgtctatttttggccataaagcccattcaaaatgctcaggaaaatgctgtataaagtccattgtttgacttttctttgagagtagggcaatggcagctcaactctccaagtatttcttaagctgattctcttcagagaaaaatcaaattacaaacgagatgcatttgctagttaaaaattagggtgagaggagggaaattccttgaagtctccaaaacaaaatgaaaatgctaaagtgaaatgtttgtaattttgctgtcttgagacaaaggccttggaaacatgagctgctgcaggttttgaaaactggaactgcaatgcctcctccaggagaaagaggacagttgcaggttagaaatcatctcatgaactggctcaagctcaaaggattcaggtgattgagaaagagatcctcccagatgtttgcaagtgcttcaatgagctcatattagtcacagataagataattaatggattttaattttcagtgagctttcttcatattcgctggggaaatgtgcagagctaatcttcagacagtatttcacttaaaaaccaaccaaccaatcaactcctagccttggaagcaaggggcagagggcagaaggtatgggcagactgtgaggacagcgaagggaatgaagacttcctggaagctgctgtgtaccaggagcaccatctgagtcaattcactgtctttatggtgccttctcaagacttacattattattcctatttatagatgtggctcagagtggtcaggaagttgcccaaggtcactgaattactacgtgccagagctgcaagtggaggacgggtgtgtcccactctttccagcacatcaagtgtccagtggctgctgtaaggtgggcaaatgtgcgcagaaagcctgtccatgccacctgacacagccacagcccactctgctatgatcgccccacttcttctcgcagaactcagattcccaacccttctcagcagtcagtaccaatgaaacagacacaacactcaaaatgaaaactgtttgtctttcctataaagtaggaacacaaaactggaaaataggacactgggattttagactggtattgaccttgattccattgctcctgggactcactgctaatagataggggatcttaaattaagttcattctaatggtaacattttgtagtttgtaatagctcccatggtatgcagaactttagatatacacactatgtgattcagtgcttctcagccctggaactatcggtgcctgttgtgggaactgtcctgtgtgttgtagggtgtttagtaccatccctggtctcaagcccctgaatgccaagagtacccaccctgaggtgtgacaatcaaaaatgtcttcaaacattgctaaatattcctcagggtggacagcagaattgcctctgggagttaggtatttttctcatttttcagatgaagaaactgaggcagagcaattatataaaatcacaagacaagggaatagcaaagccagggtataaacctatacttgaatcacttctcttccacatttctttcagtgggataactgttttccaacatcctgtctagactctttctttgtcacctgtattcaaaggccgtgccttctcatttcttcttcattcctgctgcaaccactatgtgctaatatcccctctcacatccttacccaactagactgtgagtcccttgagggatgttgtcttgtatcacctatttctaacatagtagtgcctgaaacagtcagtgaatagatgttcatttcataaatgagtgaatttatccaagcactttaatccttcccactcaaatccaattcatgctgtcaacttgcattatgaagaagaaggttaatttggccaaggtaaattccaactagcccatgtacaaaatgatcaggcaatgaaaacagtctgaatagatggatgattgaacactcagaatttaataaacctgttggggtagttttcaggaattaattgctgcctctgaaactaaaatgcagccatgattcttatcatctgtatccaaaattgggggatcaggtaagagctaggcagtaaaatatgtattacttgttaaggattctattacatcggtgacaggtggaaggaagtgccactatcttctagggtggaaggaagtgccactgtccttcctatagaaggcatccaatgactttctggcaataggacacgcttgctttcggctgtttatccagcagtccagatgaattgttctgagcaacctttgtgccacctgcctggacaaaagagactccaatctgtcgactgcttaatagaaatttccctcagtgagaagccaattgactgaccctgcctcggattaaaccagccacccccttgccatctgcataaagtcctagactagagggtgtggaatgatcagttcacaggcagggagcagtggtaagggagtacaagttaaatttgcaagtcttgatttgctcctcgtgattccttctccttctcaaatgccacagcatgtgcagggagttaaaatgagcagcattgtcacgatgcagccaaccctgattagacagcctggaattcacttccccagttttctgcgtgggctgcacacagcgtgagagggaatgagcgaaaaggcttcacgggtcggagactgctgcaccatgaatgacacagactcctgacaagcccttgctcatctccggagcaaaggcaggtgggctctgcagcggtctggtattgctctgctgcagttttgtcagcactgggcaaagtccatgtcatccccagcactgccataatcggagtttttctgtctcctctcctctcctttcccctcctctcccttcccctcctttctctctctctctctctctctctctctctctctctctctctctctctctctctctctcatactttctctgatgtttatgggcattaactcttcctttttgtcaaaatccttaaaaagagcaaattatttgtgcttccatgcaatgttttgcccattaaaccgtgaaccagggtagatgctctggcatatttgaatccctaatgcctgatatactcagcacctggtgcatcttttgtgtttagtaaatgctgactagctaaaagaatgaatatgtgaatgaataaacaaatgagcaaacaaaggaacacatcaaccaacatgccagggttatgtttcagtgttcgtctttgtgacagtgacagtttctgcagtctctttagcctttgcttgctttgcactgacccaacatggtgaaatattatttgcaaagactatagctaaaagaacattttttaagaatgcagtgggtgatagtgattaaaaggactggctgtttagtgtgacagatgatggtttgcacctcacctctgtgacttacaatctgggtgacctcggtcaagttgcataagctctcttagccttcactctcccataaacaaaatgagcattgtagtaataccccatgcagtcagcacaaggaatgaatgaaataatgcatgtgaggtgcaaaatatggtaccaggcatatcacaagcatataataaatgggaatgttcatgatgacaataaaaatgatgacattgat

SEQ ID NO: 9110 - DNA, 3071 bp, artificial
  synthetic oligonucleotide
gctcatgtgggagtggagaaacagctgatggtggcagtaccagttttgagcacctactacgtgccaggaactccaccaactgattacacagctaccttgttcagcctacaaaataaacctgattcttctttgcagaaggagccaggcatgaggtggcagatgaagcaggagccattgcaggtgtcctcctgcagatcaccctgtccctcagcttcccccactcccgggtcccggtagaattcaagaaggcccaacatgcctggaaacaggaatgcactgatggataacgtcagatatagtccatcccagagtacaaagtccccagacggccagagtctccatccttggctttgtgggactcagcatgtgctcgggatgctggcatgataccagaatacaaaaattcgggaatccagatacctgagctccctgctctgtgtcagggcttgaatttagaaatgagaaacaatgggaagggatccagagctaaaattgcccactctgtaaagcactcttgtttgtcagggtgttggaatgcaagtgtattgggctgtctccagggccacgctgctttgctgcctagacaacagctgtcagctattctcctgtgccctgttctcctgtatggggacatttgtgagaatgatggggaaggtatggcaaccagctgaaaagtcattctctagctaccccacgtaacttttatacccagaccaaaaatgacatggaagcaaaacctctagtttacatttgggaagggcacatcttggctggtgtggggatgatacaccaaatatctcccttgtgtcaccctaagtccagactgaggaacatgtgatgtttacgccttgctgtgacccatttatagctgtgtaactcatagttgccgtggccccacttacatcatgtgggaaatggagtccactcaacacttgtctgcattttgtcctttaaccagacactcaggggcagtgcaatgattacttcctcctatgtggtgctaaatcatagagccataaacacagtgacactcgaaagtacttgagagaaggcagtggctcatggtctggttccatatgcaatggccaaccatgcacccagagcaaactggttaaagctctggagttccttagagggcatcagaaataagacaaacgcctggcatttgtaaagtcttctagagtttacagagcacattcacacatattgtcccttttactcatcaggaccacaccctaaggaaggtggtgcaagctacaactaaggcttgtaaggaacaacacacacccaagctcagagaggcgctcagcctagaattgcacccaaacaactccaaacccaaaactctttcttttttcccaaacagatacttgtaaagtcagagaaacaaaactctaagtaaaaattaggaacattttttcctaaattgtgaaacatccaccaaagttgcctttgcaactcatgaagccttcggtggttaaaatgaaaattgaaatccttctaacaataattatataaaaacggaagaagaggaagacataaagaccagaacatttgccttggtcaaatcctgcacctgaaatccagattaaagtagcgttaagtgcaggaccgggataattcgagtgaccataaggaaaaggcaaattgcatatccaggttgaatctcattaaaatattttttattaatcctattgtattgagagtttgttatattggatatcaactcagagttaggggctggcaactgagatacatttgtttggtgagatcttggtggggaaaggggcatcatcaaagaccagtcaccacaggcagctccagattttgtgggaaatttctcttcatccatcagaacccagtcctccctgtctctaaaggggccaccgacttcattggagaaatattgacccaagatttccctaccaaggcagagttcaataacatctagaagtagacaaagtgataaataagtcaaggagactgctgtcttaaccaagaggttctcagcttttccaaagatgacaacatctttctatattgtttatgccttggcattcaaggcatagagacaatggtgattgtatcagaagtaccaagaatcctcctacaactgtccagcaatgatctgtggcagccaggggttctggagcaaccaaatggaaaactaatttttttggcatttaactaacagaacatgtgaaacaaatgtaggcctccctgccttcttcccataatgcatacctggaaagcacattgtcatagtgatcaccttaaagctgattgattgattgttttcacagtcacaatgatggtaatgagtggtccaaagactcagtagtcagataaaaggatggcctttgatgtattatgaggcaaagatatgactataaggctttataatcttttaaaatagtaaaactttttcaaagacgaatggaactagagttttggtattgctcctcattttagaaattaggaaattcagatccagaggggttgagtcacttgtccaggatcacacagctagctatcggctgatccaggatgaggtttggagctctttctgctacactaaattcttttgcaaaacttgtaaaattagcatacatgtattagtctgttctcacactgctaataaagacatactcaagactgtgtaatttataaagaaaaagaggtttgatggactcacagttccacatggctggggaggcctcacaatcatggtggaaggcaaaggaggagcaaagtcatgtcttacatggcatcaagcaagcaagagagagcatgtgcaggggaactcccctttatcaaaccatgagatctcatgagacttattcactatcacgagaacaacatgagaaagacccgcccccatgattcgattatctcccactgggtccctcccatgacacatgtgaattatgggagctacaattcaagatttgggtagggacacaaccaaaccatatcaataagtaatctgtacacattgacagtacattagaggcacacattaacaactgatacacagaaatatacctgtagtgtaccaaaaagtttactta

SEQ ID NO: 9111 - DNA, 1734 bp, artificial
  synthetic oligonucleotide
tgcatcaggccccccgaggaagagtctgttgtcctaaaaatctgattttcagaccatagcaagtgatttcagcttatttaccgggatcaaaatttggcaaataaccatgatgtttgaggaccagagactattacataatcatccttcagtggagacaatgaggtcacatgtttacccatctaatcgatgatcagggacatgtttcattgcagataatgtgctcactggcccacaacttaattactgagtgtctgaatcaacaaagctttcagatgtaggtcttgcctaatggtgcatctgttaaagatcattgcctcagtttggcctctaaaagaaaggtctgggggatacaacaggccattgccagtgctgttctcaatgacctctcattgaaaaacatgccagttcccacggtttattttctagccagcaatagacattattgtgtatatgcagggccaagtagaaccaatgattccagggtgacagatattggtaaatcctctggtgaaagcatgctctccgaggaaattaatgccacacaacagagagggggtggctcccctcccaggctaggaaagaaaatgtgtcaataaaagtctggggaaataagcaagcaataagcaaagtaggaccaaaatgttgggtgtattggttggggtccttgcagtagaccaggatctaactacagagtttggagtccaatggtgtcttttgaagggtcatttctcctggttaattcttccttctgaattccctaccctatgtgtgtgattttcctggattccaaatagagctcctaccctcctgctcctgggccatcactatcacaaccatgatgcctagcaatgaattcaaaatttgggaaaaagaaaagtttggagtttttgtttgtttgttttttcaagatttaaagagccttggccaggcacagtggctgacgcctataatcccagcactttgggaggtcgaggcgggtggatcacttgaggtcaggagtttgagaccaacctggctaatgtggggaaactctgtctctactaaaattacaaaaattagctgggcgtgctggtgcgtgcctgtagtcctagctactcaggaggctgaggcacaagaattacttgaacccgggaggcagaggtttcagtgagccgagatcacaccactgcactccagcctaggagcctgggtgacagagtgagactccatctgaaaaaaaaaaaattaaggagtcttggtccatgcactattattatatcactggaggcagctatgctatctcctgtttcctcatctgcaaatttaaataaatgcaacatgccattttaaggaaattataacaaagttggatccaccagatgattttagaatgctaagcgaaggcctaatttccaatactaagcagaaatcccatgccctcatgggtgtctggccttctacaagttgagatgtctcctttggcttcttctgatgctcctcttctcccactgaatgcaggaaaactcacctccatcagagtgaggagggtaaggattgcctgagatcaagaatctgtgtgttgtcagggccaaaagacacagtatgaaacaaagcaaaacaaaatcataaatcaagaacaaagccttccctgttttttgtttttgtttttgtttttcctaaaccttgccatcagctataaagcagcatggattgcgtgggtggattggatgttggtgtgttccaaatacttcagaa

SEQ ID NO: 9112 - DNA, 3263 bp, artificial
  synthetic oligonucleotide
cggtgattgtacacatcgaaggccaccacgttctgggtgagctcccactcctcctcctcctcctcttcctccaactcttcctcttcttcctcgggctctggggcggcgacctggcccctagctgccctctgcggggccgcgacctcctcaatcaccacctcccgtgccctgcgcccccccaccaacaagatgcgggtctgggggctccggatgctggtctgctcgccctgcatgagcggctggcgggagggcgtcgtgtggtagttgagggcctggatgatgaggcccttgacccgggcgggcagcacgaggccagagcccgagtacacgcgccgcagtacgtcggcgggaaccaggccaaagcggacacgctccagcaactctgtacagtgtgccaggcgctcagttgtgggctcctgccgcaaccaagctaacgccaggcccagtagccgggcctcgggcacccgcgccacgtcgggggcacccagtacagccctcagcgatgtagggttgagctccaggagtcccgcggggcccgcgccccgcgccagcagctcctgcaagtggctcacgatgcagcgctcggccgcgtccagcgtgtgagccaggccaaagcgcgctgccacgttggcggcgaagcagcagttctctggagccagctggcgctccaagtagcgcccacagagccccagggcctcagtgacctgcaggtagctggcggcctccagagtgtcctctacagtgtccatggaaagcgacagccaggcagtgtagatgaagtccagcaggcgctgcaggccggctgccgatggcacgtgcaggtggatcacgcgcgcccgggattcctgggtgtggctcttgaacagggccctgaagtagtcactggagcacgccaggagcgacctgtgcgccgggaattcgctgccctcggtctccagtgtcacgtcgcacaggaagccctcggcgcgcagggcctggtagccggtgagcagcgcgccgccatgagctttgcagtaagacaggaagtaactcattctacccagggctggaagcagcctggtgggaccagaggcctgctgggcagggccggaggcatcccggggcacaacactcccgggacccccgcgtaagccacagagcccctagcaggggcccatttctgcctgctcagtttaaagcccagggctccttcatccagacctgcagatcgcccagtgcccctctcagagcaaatccagtctggaaacggttttcggaggcccctagtaacggagggcgcggaatttggaggcttcccgggagtgtggggcttggtttccacgactgccgaggcttccagcgcgttgcccgaagtcccctccccggcccaatgtggagagcccacacctgcacgccaggggcggcggtggctgcacaccatcacctggaagaaccgagttgccggtggactccgggggtgctggatgtccgacggcgcagatgcggcgtcccgggagtgcagggcgaggactctgacctctccggggtggacgaggaggacgggttctgcgggcacccgcgaaggccggggacaactggtcacggggcagtgggggggtgagcttgttccgcgcggaggatcaactcaaagcctaggggattagggaggggagggcgcaggtcagagcggcgggtcagaggcgtgattgggcgccgcacataacatgccggtagctcacagcgacaggaatagcgcgccgcctcggcctcccgggcgcgccccgccccgtgccctgactgctggccgcgaaccgagggcacgggcgcgggtgaagcggcccgggccaagggcttgactccagtgaccctactggccaccagtgtcaccagagggtcccaggaacccggttggggttgcgggagccggagttcactggagaggcacgagtcgccggagcccctcgacccggtagtgtcggcggaggggcgtccggctgggcaggaggagtgtagacctcccggtgtccctgtgtctgggaaagaagccctggctcaactttctgctttgaagaggccctaattaatccagcgggagcgaggattaagctgcgactttgcgcgctgacacccagtaggccgctgcgcgctgaagaggcactggcgggaaccacgcccgggcgaatcccaagctccccgccagcggcgctaggtaacgtgtccctcacctggactcacccttgagagattctgggcctactctgagcccttcctgaggcagctcgcgtctcccaggctggctcgtttcacctttgttcccacgcccgttcccagacctcacctgagttttcccttcctattcttggaccctgccccgacccatccctttgcagcatgaacaaggaaactgtggttgacttggattttctgccactcattgtacacttcctttggggaaaaaaaaaaaaagtcattccttccaatttctctccccgattttccacgctctgatctaattactggctgctacatcctcgatgttatcccgggataatgagccgtacggttgcaagctcggtaaagctggaatttcgtagggcccttcctcataaagttattttttacaagaaacgccccagcatggaaatgactaaaaccagcctgatcttgagactttaggaaagcatctctccatctccatcctgttcttaaataactaaatgattaatataactggtctttttctttctttctatttattttatttatttatttatttatttatttatttatttatttatttattttttgccaatttggagacttcttttgctttcatctgggattgatttttctattttctagtgcaacccctctggcagccttttttaggtgagccttttgagggcatctgtaataactcgtatttctgacagctggggttgtatttcatagggaaaaacagttcaaggaaggataaaattatgtcatttcctacctggcatgccattagtacttacaaggtctccaattagaagtaattctttaaatgcataaaagtattagtaaaatgattttgctgtcaaagatgaaactgcattatgacttaaattagccaaattataaagtgcaggcaggggctccagttgggcttccttaaactccagaggctaaaaatactccaatttgaattcctaatgttagagctaaagctgggttgggagggcaggtgctggatttgtggggatttgggggttttagcattaaaattattgattcacaagtaa

SEQ ID NO: 9113 - DNA, 1725 bp, artificial
  synthetic oligonucleotide
atttaatttggtactcatttagcttcaattacattctttcacctccctccctaccaaagttccttaggtttaaaggaagtttaagagttttataataaacaccacaatgttacctgctcatgaaagttggttttttgtttgtttgttttgtttgttttactttggtttgttctggttttaatagttattccttcccctagggtgggttagctaaacaaaactgatattctttataactcgcattcattcttagaagggtaagtaagcacgtggatattgccaacactagatgtctatgagttgtatttttttattatgtaataataaatataatcatgtttgatattttgttcacctgattaaaaagtgtattggttctagatttaacccaagagagagattttttaaaatataagtctataggaagaaagcatataaaaattgatattgagacagaaaacaagaaactggctagagaatatcttaactactacacaactattacatgttagtttggtgctatagtgtttccactttctccctgtatatgaatttaccaattaatgatattttggaaaatagaaatcttgacaactagcattaataattgaattcagataatatattctttaagatctctaagcaagtttaactttttctgtggcttttctttttcatacatctatataactgttcagaaggcaaagcctttattgactaccactgatttttcagtttgaggccatctatcctagagagtaagttttctgcagatatgtggcaaattaattctggttatctgtagttcctagtgctgttgtggcttttatgggtgttttcctgggaaggaatatgatgaaaatcagcatatcagacatagcatgccatcattgtgatctgtaagtgctatatctaatgttgattacatttagaacttctgttaagtaattataatctaaaatttttttattccttttagttacatctacaaagtccagttttatttttaaaacacttcaatctatagcaataaggattggcctttctatgtatccccttttagtagttataagggaaaggaagtcccctaagcatgatttttagagtgaaaaattatgaactaatacaacattgtattaaactagaagtcagaacacccagatacaaataacttacataaaatataactatgagagtgatcttgaagagatgggagagtaaatttaaccaccttggccttgatctagtcatgtaggtgagggagatgaggagatcatctttaaagctccttctggctcttagtctgtggttctaaaaagaaaaaagcctgactttttttctctaatttccactgaaatcattgggagaaataaccttgtaaaataagtcaaaacaatgctaattaatgggctttatgaaatcttgattttttaaggaaggtatagccctggacaggtcctttattgttttcatttgaaagaggtagatctgggaacttaaaatgctaagaaccagattcagttaaacagtttaggagagagctagaagagaaaagaaatgaatgcccatcacttgccaggtatttttctcacacctctatagagtagatattaattttctcattttgcaaatgagaaaataaaattgcacatattcaccagtttgctctgtatcacatatagacaataaataacagaggcagggtttaagtccaggtaaatctag

SEQ ID NO: 9114 - DNA, 736 bp, artificial
  synthetic oligonucleotide
catttactagttgtgtgaccttagataagtcacttaatctttctctaccttatgcttctcctctgtaaaatgagaataataatagtgcctatctcataatagttgtgaagattaaattacctgatacaggtaaagcatttagaatagtaactggcacatagtgagccctcagtaaaccttagcagttgttattactagctcttgattgtgaatattctaagtagatactgtactcagaatcttagattcttttgaaaataaactgacatgttatctttgcctaaagtattccttttttgttttagatgtagtgaagataccttgtaagaaccaaagaacttaaataattaagaactttaaaaagagagaaatttggtagaaagcaaacattatatttcctgaatttaattttcttccaatcatttctttcaaatctttccttaaaataagtcctgaatatttttatcagtatggaaatttcagaacaatttatttcatattattgataaactcattttaggctactatattttgggacttttcaaaagctgttactagtaatcacaattttccttttccctttataggtcaccatttgctgctgtgacagactattcagttacaagaaataatgtcatacaactctgcctggagttaacaacaattgtgcaacaggtattagctgacaaactttccttctgttaatttattagcaacttcatattccaacaatggg

SEQ ID NO: 9115 - DNA, 6151 bp, artificial
  synthetic oligonucleotide
aagttttagctgagtcatttgtagttaagaataagaatgaaggcaatgaagatttcatccttttattttaggatttcccccaaatcaagaatatttgaagtaaaaagccacttatgttctgaacaaattaaatgaagtaattaatgcccattgtattgtcaaaatcaaaggcaaatgctatgttttgtaggggaaacctcagggagaaggaattagggcaaatatttaaagccttggtaaaatctgctagatagtataactccacacctacattttgtttcagtcgttactagttcttagatttatttttttaaataatctcaggtgattagaccaaatgaattccttactttaacataaataagaggagaacatatatgactgaattctgatctagggtcttcctcaaaatctttctctgggatcttgttttcccatcttctttggcactggtcttttcatgagacacacatctgttttatttttactgcatcttggtctttgacatttgttttgatattccactcattaagcaagcaatatctcactttgaaccttgcttgtcctgcaagtccagcctcaaggtgcagtttggtgtgtcactcaaatttagtcattttctacattctcagagttgctgtttaggttctggtcaggaacactcagggtgactctcacacttttttgtagttacttctgatgagacatattctgttaacgctcaatgggctttccatcactcatactgttcgttttgtaacactgatacaactctttttactagttttaaaagttcacgttctggaatcaccttaacttggtgcatcattacatcagacaaattacctttttaagccttattcattaatttatccaacatttattgcattatgtgtaataggtttggagataggaagtgaatgtgataggtagggttttcttatctgtaatatgtggctaatgatgagctgttttggaggataaaacatatgtaacgtacttagcaccatgctcaataaatattcattgttattattagcggtattattttgataaaattacttttagcatctccctataactgcagccccacaatgtatccattacatttaaaatatatatatatacacacatatatatacacatatatatacatatatacacatatatacacatatatacacatatatacatatatacacatatatacacatatatatacacatatatacatatatacacatatatacatatatacacatatatacatatatacatatatacacatatatacatatatacacacatatatacacatatatacatatatacacacatatatacatatatacacatatatacacatatatacatatatacacatatatacacatatacatatacatatatacacacatatatacacactatatatacatatatacacatatatacatatatatacacacacatatatatacacacacacacacacatatatatatatatatatataaagctactccttcaattactgacactgaaaacggtcttttctagaaacattgatgtaatgttcttagactctactggaatgtaagcactccaaaatacaatacctttcacacctggtcagccaagaaaaaattgtaagtcacaaccacgatctggattgtgaaagtaaggtgttgtatctgtgtcctctgaatgtaggcttgtctagataattttctaaatgtctttccaaaattctgcatatacttctaagtttggatagttagaaaaataaagaagcctaaatacaggccatcttaaattttacttgttcgctatcactagcattgaaatcagcagttaaaaacgtcacaatattttaactactgtggtttcagctgtttgtgtgtgtgtgtgtgggggggaagggtgtcgtcaactcatgccggttaaagaacgtgacatttctgcatcttataaaattggactagagaaaatgggttaccataggaactggcaaaacctattgacattactggaatgcttatttaaaaagtttcttttacttaatggacctatttaagaatgatagagaaaacgcctataacggtggcagagagttagcatctacactctaggaatatttgtcttttaaagtgaagcctcattaggcaaactgtattttactaaccgttgcatagtagcctgtgtatggtttttgaagaaaatgagttttgaaaaatcatgtctacaatttgtcactcattttaaatcccattgttgcccttcggttcttattaatatataagaatatcaaacacaaaatgacttctctaaaataggtactttagaggagttggcccaaaacctgaaacagagccctttaaaatggtacttggggcagaacctgtctcaggatcaccacaaccagcagctggcaggtgacagcctcaacgcctgacttcccaggacccgctcatcacccggggaagatccgacagcactagccctcctgcctcatcatcgctgcgcttctggcaggcggagccccgttctcgtccacggcagtccacacctccgtctctgcaggcgtacgcgggtctcgggaatcacctccggagcccactcagcagcggggagggcgagggcgaaagcgagagccaggaaagcccgggctctcgctgtaagccccgcgctcagtggtgtccccctcccctcggtggtggggccgcggatacctcctcagccgcctcagctgtcggagttcaactggtgggcggcccgtcccgccgtggccgccaccgccgggtcccctcagaggcctcacaaagccatgctccagccgcccgcacctgattgaccgaccccgggctctggctctgcctcgcgccgccaccgcctccgccgccgcgcacgcgcacttcgcgcgcctctgttcccggacggcccccagagcgggaacgccaggctgcgagctgctggcacctgtctgcctgccagacagaccctgggctccggcctcgtgccggcacgcgcacgcgcacgcgcctcgcgcgcctgccgtcggccctgggggcgggaccgcgcggcagcgagcgggcggggggctcgtggcgcgcgcgccccgcacccgagggctgcggagagatattttgggtggcaggaggcccctcgtcatttccgccgggcagctagtcgtgctcggggcttcactcccgcgcgtgaggcgagcgggcaagttggctgagggcgtgcggcagaggctgcttccctcggcgacgcgacccctcagcaactcaagctatgaactgaagctccctagggacggagaccggagcggagcggcggaggcagcagcagcagcagcagcagcagcagcagcagcagccgccgccgccgccgccttagcgggaactgagcagacccggcgcggagccacgactcctgcacgtttacctccctgtcgccgttcctgccggcggttggctaaaagacgttacagccgcgagacccgacacacaaaagccgctttctccgcgccgcccgcccagggaggctgcggccagcaagggaccccacctgagagcagctcgggctgctgagttcgttttgtgtctgagctctgcgctctgcacggaaccgaccccgtacccatggctctgataatggaaccggtgagcaaatggtctccgagtcaagtagtggactggatgaaaggtaatgcccgctgcggggagggtgaggcggcactggggcgcggggcaccagtgcgaggttaggagggggcgcccgccgcgccagagcccgccaccgcggcttccactggcggatcgtcgtacgcgtcggggcgggggtcctccaggactggcaggggcctggggtccccggtctccttttgtctccagctagaggggcgcggagcggccagagagctagagggcagcgggcgccaccccgttggaggcaggaagtcgggaggcagaataccggcgcatcttgcgtactcccctctccccttactgcccccgggccaggaggacgtggcgacccttatctcccagctcagggtggactcccccaggacctgctcccctggtcgccctttcctggcccctttgttcctgggaaagctgacgccccctcggcggccgcccttgccaggtgccttccccagcgccaactctcccaagcaacttttagcccacataatggggtcaggacgcggccgcccccattcggagcctggcatccccccacacccagatttggctgaggatgcccagggtgggggtatgtgctactttgagggtgaggacatcatgcttcccctgggacagcatccttgctgctgtctctgggctgcctccagcgcatcccctcgcatcctttgccttctctgctttctccctttcaagccagtcgaggttttggacctcacggctttttattaagggctcaacgccagatgtaaggtgatgcgcattcaggtaccttcacatttcttccatcttgaaggttcccccttttgtccctggcgatttataataaccacagttatagacactcaccctcctaatcgcaaacgtgagctttttttctgatccctgggctttcctgtctcactacctccctctgttgtctgagttaaggggcttgtagaggactcccccacccaccaaccccttggatcctcaggcccaactcttccctaagattttgggaattgaagaggggatggatgggatggaatggaataaaggatgcgtggccacacttgggaaatgttagcgctttgctcgaggtcatacctgagcaaactctaggtagatcagtcagggaccaaaggcttattatcgctgaaaatgcccgttcctacgatgaaggagccccttcttgggcttacttaacagtcagactttctaagctccagataatttagaacgaaaggtgaggtgattgggagggattgagagtgacagggagaaactgattttttttgctcattcttttccccagcctttttggccgcttgcttattcttgtggatttttctttattttgctttccttttattcccttacttgcccctttattcctcatttactttgcttttcttttctaatatgtggaaactgctttgtaactgctaagcagtacaaatgtgagtgaattgaattaaacctaatacattatttatcgactgcacccctgtgtgcagtgcattgtgctaaggtgccatgggggatataaagatgactaagacaaagtcctgcagtggctcatctttgctgctgctttttctctttatgtatttgctattgaaattccaatatcttagattcccaccaattatcctcactctccaccttctccgtttctcagtgatggaagaaagagccagagtatatacaggaagcaacaatgcttaaaaccccgttctttgaatttgtctaaaaggttactttagtttgagtctgttgctgaaatattaaaagacaagctatcttggctccatgggagtctgattaccttcatagactacctttcgcaaattcccatgatgcctgtagtgagtgctgcatactcagtctccacctcccaccctcccagttatattcttgcagtttcccctctctccatagtttaggtccactgaagcaagtagaatatatgatgcacctattctgacacacattattagttgtccagtacaccagtcctttaaaaatctttccagcctaaaatgtggcttctttgaagttaggttaacattgttagctgtgatttgaaaattttttttaaatgtaagtcgaataccttgttttcatacctgttggtgacgcattttagagctatttgaaaagatcaattgggtagccaagatagtttgtgtatcgtgtatacatatgactggaagagaatgaatgatataattacctgtatatttcaaatcccagactacttactgctgaaatttccttaatattcatatatatttgatttgagatattatcagaaaatgagattttaaaaaatagttggatgaaacaaacatttcctcaacttgtaacttacactgttaccttaatttttctctctttgcccttttccccaaataaagttaaacaaaggacattttaaaaatatttttcatcct

SEQ ID NO: 9116 - DNA, 417 bp, artificial
  synthetic oligonucleotide
agcttggtaattatgccttcatataggatttttgcaaaattatttgcctggaaagcaagaaaatgctgtaaaattttcattatcaaccagtttctatttcttctatcagattgcaaatctcataaaaattggattaatttataattgaatgatatgggacattttgtctaatgagaaaagatgtgctgcttcatacaagcttagaaataatatattgttctgaaaatacggtttctgacttaggagacatattgtgaattttcatgaagtcagggagagaggaaaagttgtcataaaacgtgatccattagaatttccagggatcagactatactttcctactaacaaccctttttaaatatggatgtcgtgtattttcatattatatgtacaattcttgtgcttcttacctatgaa

SEQ ID NO: 9117 - DNA, 122 bp, artificial
  synthetic oligonucleotide
tctacaacaattaagtttgaattcctctgcccgacttactgagccctttagaattaagcctaaaattaatgacttgacattgcttcccaccaagacatcctgacttctctaatcaggctgtt

SEQ ID NO: 9118 - DNA, 1585 bp, artificial
  synthetic oligonucleotide
cattttcccatttcctcttggatatcatgctccttttctccatcatggcagatcaggcaacttattcctctctctctgcttacatgttcttactaaattgccttatataaatcatttacaccttagacatactaaaattaaaacaatatataacgtctttacttgatgtgaattgaaaacgtcttgtccactgccaaatgtattttaaaaatcaatccaaggatatgggaaatatgtggaagtggagtgctcttcccccacccttgaaacaatctataattactcagccaccaacacagaaggccaggtcttgtttagaaacattagagatttgtataagaatgaggttgtgaatatactctaaggatgctcataagcccaggactggtctgactgcatcagcatcatgggggtgtttacaaaatacaaatccctgggatccacccctagagattattattttgagggtctggggaaggtagagagaaaggaataaagggagaggagggaggaagaaagagaagaagaaaagaaagtgagcaaataattgtgatgatatggtttggctctgtgtccccacctaaatttcatgttgaattgtaattcccagtgttaggacagggacctggttggaggtgattggatcatgggggtggaattcccccttgctgttctcgtgatagtgagttctcatgaggtctggttgtttaaaagagtgtagcacttccccctttgttctctctctcccgctttgccatgtgaagaaggtgcttgcttccccctccaccatgatctaagtttcctgaggtctccccaaccctgcttcctatacagctggtggaactgtgagtcaattaaacctcttttcttcataaattacctcgtctcaggtggtttttatagcaatgtgagaatggactaatacatgtgataaacttcaggttcaatgtttagtaatgatgtctgagtcaagcttatgagaattcctcctgcacagtatgttataaaagtttttccgctcacatacaatgctgtaacaagcattcctacttgggtgtgggagggcagtaatgatgacagaggggtatgataatcatcctgcttcatagaaagcaaagtgtagtctttccccaagtcagttatcattacaagtccaggtttcatatataaaaccaagaatttataacattaacataacatttaaataaggctctgagcatttgagcatagattttaatcttcattctcttccaaattgatatttgttgaggtttctctggaacctcatgtcagatttactagttatggcgcttttgttattgtacttcccagatactcttagaaacatttagagccttgtgcaaagttttctaatgggaatcaaggaaactctttgccataatagggctgagacttcaggccttgtgggcttcagcccttttcccatcttcagctctctcttgcctaatctggtggtcctgtacagaagtacatgaagatattcaactagaatattctagttagagacctgccatgatcaaaggtgtgtttgtctatgtgaagcacatgctatcttgtctctgat

SEQ ID NO: 9119 - DNA, 1138 bp, artificial
  synthetic oligonucleotide
taaaaagggaaagtaaaaacatgtagacacctttcctgcctctgaactctggtgtaccaaaaggtgatggtggagctactgcaaccattttataatcttgatgggagctaccatacagaactttaagaatctgggtccattgaacaattgaaataataaatcatggacccaacttccctccagatagtttatcatgtgaaataataaatgccctgtggcttaagtcattttaagttcagttttctgttacttgcagcccaaaacattctaatgtatgtgacaacatagcacataactctgaaaactggtgctgattaagccattctatctgtgcttatatgccaccataatattaataatttttagttttcttccatttttcaaaatggccttaggaaaatctctaagtttaggcttaaaatggataggctaataaataaatgagaatttacagacttttaagatggaaagaacaaattgtgttttttctctctctttctctgtctctgtctttctctctcatcagcttgtcattctttttctctgcccaaacccctccttttccatttcccacacaagattttaggtccacttcctggctgcttcgtctaccagagccctctcttccatcagagactgatttgcctagacccctgatagttgcagcaaatatagcctgggcaacataaatagtggttgtagcagcagtagctgctgcagatgctttctaggaaatacaataaagaatcaagattggctattgggaaagctgaagggacattaaagcatgactcaaccaaagttatatgtaacatctgtgctttctctatgaaaaagtcatttttgctaacaaaatttcagaggctaaaatttcagttaaaaaaaaaatcaagtacaaacaggactcaaaagaggctgtttgagacttctgattctttcaaacttgtccttaggggaacaagtcatttggtaaaaaagatatttataattgagtaattccttaacatcatcagatttatatcaagaagccttcactgaatgcctagtgttagctcatccctgtgctaggtggttgtcgtggacatagacgataagaaagaattgttctcttctctcaggaagctcagacttggtcctg

SEQ ID NO: 9120 - DNA, 1849 bp, artificial
  synthetic oligonucleotide
ccataattttacttatttgaacatatataatcttttcaccatcatagcagccatttcaaatcatctccttttagagctggtaaaggccttcaggttcatttagcataaacttgttatttcacagttgaggaatcaaaggtccagtgaggttaaatgtcttgcctaaaaaactcggcacatcagcatcttattagttctgaactttgcatttttgagtaagttataagcaatgtgtggaataccatccacttgtaaaatgaataaactttccttaacaattttaacttcctggaaagaattttttcaacagagcaataaaatgacatcagtgaaatcaatcgtgttgtcttgataggtcataaaaccttgggcagtgaccactgagtgagagacaggactagctggatttcctaggctgactaagaatcactaagcctagctgggaaggtgaccgcatccacctttaaacacggggcttgcaacttagctcccacctgaccaatcaggtaggaaagagagctcactaaaatgctaattaggctaaaacaggaggtaaagaaatagccaatcatctattgcctgagagcacagcggaagggacaatgatcaggatataaacccaggcattggagcaggcaatggctaccctttttgggtcccctccctttgtatgggagctctgtcgtcactctattaaatcttgcaactgcactctcttctgatccgtgtttgttacggctcgagctgagctttcgctcgctgtccaccactgctgtttgccgccattgtagacccgctgctgacttccatccctcaggatctgccagggtgtctgctgggctccttatccaaggaggtgcccattgccactgctgattgggctaaaggcttgccattgttcctgcacggctaagtgcccgggttcgtcctaatccagctgaacactagtcactgggttccacggttctcttccgtgacccacggcttctaacagagcttaacactcaccacatggcccaagattccatttgttggaatctgtgaggccaagaaccccaggtcgagaacacgaggcttgccacaatcttggaagcggcccgccaccatcttgggagctctgggagcaaggacccccggtaacatgaggaaacaagataatgcagtggggggagagtggtggtgactaagctgtgctgtccaacacagctgctactagttacatgtggatatcataatatttaagttaattaaaagtaaataaaactaaaaatccatttcctcagtcctactagtcacatttcatatgttcaatagccatgtgcgactagtagctatggtattaggcagcatagaatatttagataaagtatctccatcatcccagaaagtgctattggacggcattagaaggtctgtttgaatctccactcaactgccaatttttttggaggcttctaaactgggaagcttcgtctttcttgagataggtgccaatcctgacaccagggagatctctcagggaatggacagaggctttccagagtaacaatctactcagctcctaagctgcacaacaacccctgacaaaagaattagactcagtagctcatgctcctggctcatctcactcttgccttgttttgggagtgatggtgcaggggaaagcatgaaagagggaggggccagaatttagcatatcgcaaatagtctgaaccttgcttaactttttacttgtctacagtcttcttacccccaactccccaatgtcttcatcttcactagacagcagagacatggccttgatgaagtccaatcactttctgcttctttggggcaggaggaagtaatt

SEQ ID NO: 9121 - DNA, 7934 bp, artificial
  synthetic oligonucleotide
atctggcttcatcactctctttctttaaaaccttaaatatctcttcactgcctatacaataaagttcaggcttcttagtgtggcatacaaagtcccctatgacctagcctctgcctatcatataagtgtcgggcatcttttatttcatactatatccttaaataaaaccaaatagcttgtagacacatatacaatacatacaatctatgcttttcaccaatactttgataatgctgattcccctgtctacaatattttccccatctttctttgcttcagggtctctcctctcccatactaccctaaaaatgccccagatattattatttaccattatattgaaattccctatttaaatacctttctaccactagagtgtaagctctttaaaaacagggatttcatcctcagcagctagtacagtgcttagagggaactgaggctccaacttcataaggaggtcattattgaatagccagttctctgatagctgtttagttatttctaatcagtgactattgtagttgggaggaaccttctgggtcattcagccttccctcacagccaagataacacacaattaaatatggtagaccattccaaccaacagttcttatttcagtacatatggtgccttccaatgacagtagaaattaatatcattagtttcttagaaagcaatttagtgacatgtatgaatatttacatgtgtttatatttctattgtattttttacatttttattccttaaatgtttatgtttttattcttagcaatgtctgtctcagaaatctcttgtcagaaaactatccaaaaatatggggaaaaattattacatagtaattgtcattagaaaaatactcatataataaggaacattagaaatagacaacagcaggggagttattaagtaaattatgatgcattcataaaatagaaatcgaagagtggagcaagatggccaaatagaaggctctaccaagtgtcgcccatgcaagaacaccaaatttaacaactatctacatgaaaaagtaccttcataagaaccaaaaatcaggtgagcactcatagtgcctagatttaactttatatcactgaaagaggcactgaagaggataggaaagacagtcttgaatcactgatttcacctgtcccccatcccctggcagtagctgtgtggcatggagaaagaatatttgtgtttgggagaggcagagagcagtaattgtaagactttgcattgaactcagtgttaccctgtcacaactaaaagtaaaaccatgctaaactcagatgatgcctgcccatggagggagcgtatagactagcccaaactagagtggaatcacacatcccagcagtcagaacttgagttccagcaagacttcccaccatgggacaaagtgttcttaaatgtgaaaggcagtctaggccacaaggagtgcaactcctaggtgagtcttagcgctgagctgagcttggaaccactggaattgaggggcatataacctactgagacaccagctggggaggataagggagtgcatgtaccacccctccccaaccccaggctgcatagcttgtgactcaaaaagaaaccccttccttccacttgatgagaggagagagaagagaggattttgtcttgtatcttgaaagccagctcagccatagtaggatagagcattagtaaaagtcatgaggcccccattccaggtcccagctcctggacaacattcccagacacatcctgggccagaagggaacccactatcttgaaaggaaggacccagttgtggcaggaccaatcatctgctgactaaagagatgtttggccttgaataaccaccagcaatacccaggtagtaagccatgagccttgggtgagactctgagacgtgctgagttcaggtgagactcagcacattcccagatatggtggctatggtgagatactccctctgcatgagaaaagcagagggaaaagtaaaggaaacttttcttgcaccttaggtaacaatttgacttacagtgaggtagagtactgagcaagatctgggggttcccaattctaggccttggcacctgaacagaatttctggacctgccctgggccagagggtagcccactgccctgaagggtgaggcccgggcctggcagcattcaccacaaactgattgaagagcccttgggcctcaagttaacatcagcagtagcctggcagtacttcctgtgggcctgtggtggtggtggtggtggtggccatgggttgaggttcctctgtttataaaaaggggagagaatagttggaaggactgtgtctcatggtttgagtgccctgtcagccacagtagaatagaacaccaggtagatttctaaggttttttattccagctccacccagggcctgagggaacttgcttcctggaaaggaaggacacaattatggctggcttcacaatctgctaattgtagactcttaagggccttgagtgaacataggtgataggcaggtagtggttgaagcaggccttgggtggggcctaatgctgtggtgccttcaggtctaacccagtgcagtcccagtcttggtgttctctccccctccttccagctccaggcagcttagcacaaagagagagagaatctgtatgtctggaagaaagtaaggaaagggaacaaaagtctctccctggtaatccaggtaaatcttctggatcttatccaagaccatcaaggtggtccctatatgagtctgcaagaagcacagtattactggactagtagtgctccctaatgcagatacagcttagatcacaataccaaagtccttttgaatatctggaaagccttcccaagaagaatgggtacaaataagcccagactgcaaagaataaaataaatacctaactcttcaattcacagacatcgaagaacatccacacccatcaagatcattcaggaaaacatgacatcactaaatgaactaaatagagcaccagggaccaatcctggagaaacagagatatatgacctttcagacaaagaattcaaaatacctgttttgatgaaactcaaagaaattcaagataatgcaaagaaggaattcagaattctatcagataaatttaacaaagagtttgaaataattaaaaagaatcaaacagaaatttcagagtggaaaaatgcaatgatgaagaatgcatcagagtcttctaatagcagaattcatcaagcagaagaaagaaatagcatgaagacaggctatttgaaaatatacagtcagaggaggcaaaagtaaaaagaattttaaaaaaaggcttgccagcaaagtctagcaaatagtctcaaaagggcaaatctaagagttattggccttaaagaggaggtagagaaagatataggagtagaaagtttattcaaagggataataatgagaactttccaaacctaggaaacatattgatatccaagtacaagaaggttatagaacagcaagcagatttaatccaaagaagactacctcaaggcatttaataatcaaactttcaaaggtcaaggataaagaaaggatcctaaaagcagtaagaggaaagaaacaaattacacacaaagagttccactacctctggcagcagactcttcagcagaatccttaccaaccaggggagagtggtatggaatatttaaagtgctgaagggaaaaaaagcctattaccctacagtagtatatccagtgaacatatccttcaaacataaaggagaaatagagactttcccagacaagttaaagcaaaagggagtacttcaatcagaaagaaaagtatgttaatgagcaataagaattcatctaaaggtatacaacccactggtaatagtaagtacacagaaaaacacagaatattatggcatcgtaactgtggtgtgtaaactactcttatcttaagtagaaacactgaaagatgaaccaatcaaaaataactacaagaaatatttaaggcatagacagtacaataagatataaagagaaacaacaaaatactaaaaagcagagggagaaagttagagtgtagagtttttattggttttctttttgcttatttgtttatgcagtgttattattagcttaaaataatgggtgataagatagtatttgcaagcttcatggtaagcacaaatcaaaaaacacagaacagatacacagaaaacaaaaaggaagtaattaaatcataccaccagagaaagtttccttcaataaaatgaagacagaaaggaaggaaagaaggaagagaagagcacaaaacaaccagaacacaaataacaaaatggcaggagtaagtccttacttatcagcaataacattgaacataaatagacaaaactctccaattaaaagacagagtggctaacccaatgatctgttgcctacaagaaaaccacttcacctagaaagacacagactgaaaacaaagacatagaaaaagatattccatgccaatggaaattaaataaaagcaaagaagagtttggaagttccttaaaaaactaaaaatagagctaccatattatccatcaatctcactgctggatatatacccaaaagaaaggaaatcggtatatcaaagagatacctgcactcccatgtttattgtggcactattcacaatagccaagatttggaagcaatctaagtgtgcatcaacagatgaatggataaataaaatgtacgtatatacaatgggtactattcagccataaaatagaatgacatcctgtcatctgcaaaaacttggatggaactggaggtcataatgttaagtgaaataagccaagcacagaaagacaaatttcacatgttctctcttatatgtgggagctaaaaattaaagtgacctcatggagatagagagtagaatgatggttcccaaaggttgggaagggtagtggaaggggagtgtggatagttaatgtgtacaaaaaagtagatagaatgaataagacctactatttacaaccacaagagggtaactataatcaataataatttagttgtacatttaaaaataaccaaaagagtatataatttaattgaggtgatggatacccatttaccctgatgtgattattatgcattgcatgcctgtgtcaaaatatctcatgctcatgtaacccagaaatatatatgtatatatatacatatataaaacacatatatacacacacacacatctactatgtactcacaaaaatttttttaaaaaagtttaaaaagtataatagaagttaaattttgtcactttaaatgaaaagtcacaatataaaatcatctattctatataatgttaattatacaaaaaatgtttaggaaaaaaaaatcactgagaagaaatggttgttgattgtggatgctatatattctcattttactttctaaatttttctagtaagcatggatgattcttataataagaaaaattatgggttttatttttctttgttatttgttttaagttctgttattattgttgttttaaggaactattaccgttgtcttaaggagtaagaaaaaagataaactcagttaacttcaggcagagtagatcagattcaacaaacatgaacagagtttttactaaaagttgagactaggctacaaatatagatgaaactagtgaggcctctaccaggacacgtagatgtagaaaatactcagaagagcaggaactggtttatttaataacctcattctcctcacgtgcttccagcacctcacctgtgtttccatgatttctctcttaagcatagcccagcacacccaatatagtccatcgcttaagcccagtgcagtttgtgtgttccattccttattccctttttgcccacgcctttgtcaatcttgtctcacagcaattcagagtacaccagctctatgccttctgcctcaaactttattttacaaatgggaacactgaggtacttggaattcaagtgacactgtcaaggtttcacaatgaattagtaacacacctaggaatagaactcaggccttatggctcccgtgaccacacattctagtgttctccaactcagtttgctaaagggacagcttctttcttaagcttttcagaataagagcccttaattcaaagcaagtttttttaaaaaaagaagaagaaaggtagaatctccaggaactaatgaaaacagaaacttgtttagggactttgagaactacttgcaccctgaagttattcccagaggacaggttggagaaacaaacaagagtcaattactattttgactccaattatgtggttaaaaaaataataatagaaaccattcccgcctttcatcccttgaatactgttgactaaaggaggagctgattagagctgttagtctggaatgctgagcagctctgggcaagaaccgtgcgttccaagctgaccctgtcccaccaggaaaaacagggtgaaaacagtcattgatcacacattcccaactctttgcttcaccctgacaaacagagtatgtttactaagattgctataaaaggtatttatctaattagagactgtttcccccttttattagtaagcaattagaccacactttagtacattaaggaggttttgtgaatccaactgcaagcatataaattctgttattgtgtaattgtatattgggcataaaaccacagattttcttctactttggcttgaccattttttaaaagcaatttagggttttcaaagctaatgcttatgtggtgagtgttttttaaaagcctagggtaatacatataatttagccattctttggttttaaatccaaaccagaaaatgacacaaattccatacaaacatgtatcaactatttattctgtccttcttcatctcaaagcctggggataattcttttgttaagtacaatggtagcatagtatcactctttagcatagaaaccataaactttatctagccaaataattccacaaacccctgaattaaacctctgtagctcatgtgcatatgactggattcatcttaattacattatggccaggcacggtggctcacccctgtaatcccagcactttgggaggccgaggtggacagatcacgaggtcaggagctcgagaccagcctgaccaacatggagaaaccccatctctactaaaaaaaaatacaaaaaattagccgggcatggtggcacatgcctgtaatcccagctactcgggaggctgaggcaggagaatcacttgaactcgagacgcagagtttgtggtgagccaagatcatgccattgcaccgcagcctgggcaacaagagtgaaattcattctcaaaataaataaataaataaataacatcatgtttgcaagacaggagtggggaagaaatggaaagatcatatcactttgactatcagcttattaggttaaatatatcaggttagatagagccatatgacattaccaatatttgactatttcttacttacaaatatggtaatttcctatggttcaattgctatatatgttgcaccaagttttcacaaggacaccataaatgccaaaataaaaaccattgactcacactcttaataaacaactttttcatttataaaagtatccaaagactttgtaaattacattggtaacatattttactactagatgcccttgagaccttaggcaaaacactaggcttttgggaccttgtttccttctctgacagaggagagggttgaactagaactaaaaaaaaaaaaaaattaaatttccataaaaggcatcactaatcaaaattaggacacagtgtagataacaatgccattatgttaaggaagctgagatctatgtcattatggaaatatttcatagtattgcatttttatatgctctaagaaacctttaaaggcactgaattaga

SEQ ID NO: 9122 - DNA, 336 bp, artificial
  synthetic oligonucleotide
aggacatcatgcgaagctacaatcttacaatatgaggcttcctgtgagtgacaaggccattggaagtcaggaatacctcatggtaaacaaatctctgaccatgcttttctctaaatcaattgttcccaaccctagctgcatatgggacagctctaaaatattaatgcctggatcacaccaccagtgactctgatgtcattggtctggggtgtggcctaagcataaggatttctaaaatcttcccaggtgattctaacctgctgtcaaggtcaagaaacactgcaaagtattgtggagtaatgacttttggatgcctgactcttgctcataccttat

SEQ ID NO: 9123 - DNA, 1622 bp, artificial
  synthetic oligonucleotide
ctggaattgttttcttataaagagttgtttattgaaagtttcacaaaaggccatttttttttaactttgagttgggacttcaaaaatcatgagtgatcacaaacacacacacaatttcaaatctaggttattcattgcagagggctgctcagggagggaaatatcctgtcacatccaaaagatttggcatactcccggttgctaagagtgtcactaccaattactttgcttgtaaggcggcttctctacagattcaggaagcaggtgaggtctgtgatgggctcctcaactcctctttccttagagcctcatctaaagcttcccagagttctcttaaggcagccctacttttctgacattccttggttaccatgtggccaccatgtggcctcctacccgagtttgactttgctgatccgtatcctgaatgtctcattctcagctacccaaccaccgacctcaaattttctgtgtgatgacatttttattagcacagaagtcagcatacagtggcagactttggtaagaagatggtacgggcaggagatgtgaccacaaaagcaacataggctccagagatgtgggagaacttcagtgagaggtacatttatacaggcagaggcaagattcagaaataaggtcaagggaaaatggtcatgaacaaggatgaaagcaacagtaattcatagagcaggcttaaatgtcatcatggtttgggaccatggtaggatcaatagacaagatagtcggaggactgaacaaaaagcagaagtcagcaatgaagccaagcctcagacagtagcaatagaaatgacattaattcaggtctcagtcacttccttcagttaccatcagctcagcatcttccctttgaggtggccccccaagttcttaaaggatccagggttttagtgtcagtcagagttcaatcagaaaagcagaatcattgggagatatttctccctatctctatcactatctctttccctattactatctctatctctagctatatctatgtatttacaactatagatagctctattaaggaatttattattggaatttgaccttctgcaatttgtggaagtagattaaacagcccatatgaggctgttgctgatgaatctaatgctggagcccaaattctcaggacttgcagccaggaagggaagacaaacataaagtagaggaaacaaagataaactggaacttgcaaagctgagctggaacacatgaagatgaactagaaccatgttggtctctcaccataaactttatgcctccatctttgatgatgaagctttcctgcagaagttagcacctttcatctcagagataaacacctaatttttgagggaattggagaagctgtaagaggcaagagattgagcagttatggcccagatgctgcctcacactagggtgaggcagcagatgggagtgaacctgtgtgagctgaaatagcaccttatgccctataccgataattcaagagtaagaagaagatggttctgcttcatttatatcatcatctcttgcatcatatgcaaaacatctcttgtggcccacactaacccagaaatacacagggaaggaaactctggagaaatattgtacta

SEQ ID NO: 9124 - DNA, 695 bp, artificial
  synthetic oligonucleotide
ctcatttttaaatcagggctttttcctcctcttcctatgtttgactgcaagagacagtactttttgactcttcagagtatggagaatagctttagatagtaagtatttttaaattgtaataacaacaatacataagaaaattaatggaattcattttaagtctgtacattaaacatagaggttataaactagtcagatatgtgtgggaggatttttttctagtatgtaccaattcagagagaacacttaaaacacttattgcttataatttacaaaaggttttttttgctctaatgttacagttaagcccactctgaaaacagtatccaccacgctactaaacatgacaggtttttacaatcttaattagctagagaatgccctttttgaaatgaggttaattccagctattaatttaccccctggagaacaaatctgccaaacatgcttattacctgttcctgtgaacaagcagttcatccactagcatcctcaacactctctctgccagcctttggcctcctctctcccagtgatccagatgtgtctgatggtggagaaggttttttgctaagcgaggtttctttattactctttgatttttaaaaaataaacaggtttatgaaaatataattctaaatccacatgttttaactatttaaactatgcactaaatggctttagtgtactcatgt

SEQ ID NO: 9125 - DNA, 702 bp, artificial
  synthetic oligonucleotide
agacaccttttccaatccccataaatcaaagtttaaaatccttgcaaaaaacaccatatgctgatctcctcaagcaacctaaggagccagctcttgaaaaataaagccaacattggttaagccaagaagcattgctgttaaatgcaaatgccaaaaattgatttataagataatcaaaagctgaagatcacagtatcatggtcatgtgaaattttcttatatgtaaaatgagaaaattgaaaaagataaatgtagaactctgaatacatggaataaaaagttgtgtgcaattgcctcagaataattttttctttcactgaaattgaaatatattttatgtatagttaacttttgatatttctggactataaatatttgctatagtattttatagttaattggtgtttgtccttcctatttgatggttttaattaagaaactttggctttttttagtaactaatagatgcataatgtctatattgatttaactttcagtaagagatttgggagttagtctatatgactgtaagacagaaatgctttaaggtaaaattccaaagcagtgttttccaatgcactgagattctcaaatctaagttagtgaagatcacgagatgtgttggattaaaacaatgtgtctgtataaagcaatggaaagaatattgttcaagaagataaacacattgaccaagtgctttgg

SEQ ID NO: 9126 - DNA, 420 bp, artificial
  synthetic oligonucleotide
aagcatattcttaataaacacacaattgttttgtacaagaaagaagcttgcagaaataagattattagagaacaaggggtggatattctagatttgaattttaaaaatcagctaatgcactatttgataagtagatggccttctgaccaagtctatgtctttgagtcagcttgaagaatgcgaacactcccaggacatgtgaggaagtgtacaagtttgaatgacaggattttagtggacacatggctcctcatgcattcattcattgggtggtgatgaaagaactggtaattctgagatggtgtaagcagttgtcatgaacttgaaatcttatctcttgaagactgattcaaagaagttaatagagcatctccgaactaatactcttggtaagttggcaatgagatgtttttgtgttgc

SEQ ID NO: 9127 - DNA, 1376 bp, artificial
  synthetic oligonucleotide
aatgtgtttagactctaccgcaaagtcagtgaagaaccatttaaactttttgagcaagggattagtgttgtcctttaggcagattctcttttgctataatgtattggaggagggtaagaatggcagctcgaagagttcttttttttctcagaaacaggaaaaaagagaagttgagacataaagagggtttgaagtagagagaagggaaattgggatgctgtgtttgaagggattgacctttagtttcaaggtataattgaaacttgaagtaaggggaaacagggtaggattgaagatttgtgagggtgctttagaacctctcatttgagcagaaaataaaagggcttctatagagcagttaaggcttccctaacactagatagcataaattgtggtgaatccaactgacaaagcgttgagccttttggtagtacagttttcccacactgggaaagtgggaaaaccagaaaacacagagataaaagggataaagcattatacatatgggggttttgcacctaagatatgctgaattaaagttgttgactaaaaattggggggctgggtgcagtggctcacgcctgtaatcccagcactttgagatgccaaggagggcagatcaagaggtccagagatcgagaccatcctggctaacatggtgaaaccccgtcactactaaaaatacaaaaacaaattagccgggtgtggtggcatgtgcctgtagtcccagctactcaggaggctgaggcaggagaatcgcttgaacccgggaggtggaggttgcattgagccgagatcgtgccactgcactccagcacgggcaatagagtgacactatgtcaaaaaaaaaaaaaattgggtgacaaggcagaagaattggaaaggacgagaggcttgaaagtagtcatgaagagagtaaagctcaggctgattatgtgtgagaatgtaggaaagggaattgtagagccagaggagggaatttgagagtttgggttcttagagtctttgagaagtgaaaatttcagaagtatagtgaatgagtaaaatgcaatggagatggaggtcattggggtttagggaatcagtgtaatagagaccaggataatagaagggtcatcaagaatggtgacctcactgaggagagtataaagcaaagggccagagaagaaatatagtgaagcttaatttagataaaaagtctttactgagacaaaagacacaatcaaattgaatgtcctcatttgtgactattcatctatctccctgctctaccccaccctgctctcacctttcattgccagattacagatcctttatgaacaaaaatttactcttcagcaagttcttttaaaataataggaaagcctgtttgctat

SEQ ID NO: 9128 - DNA, 1888 bp, artificial
  synthetic oligonucleotide
tgtgctttgtcactctttcctttcaccatgaggaggatattttatgggcaactttctatttccagaaaaatgacagatgcatgaagcagaggtaaactgaactgatagcagagcaccaagcccagcagaacccatccaagatcagcagagcccagaacacatgtagatatgtgagccagaagtaaatgcttatgtttgcatgcaactgagattttgtagttgttgtttatgtaacaatagctaatgaattggattaggctcctatttctgctataatgaattaccacaaacttagtggcttaaaacaacacaagtttattctcttatagttttggagatcagaagttttagatgaatcttatagaagtaaaataaagatgttagtaggtctgactcctggaggctccagggaataatctcttctttgtctctcccagtttctagaggctgctagaattccttgattcatggctgcctcacttcaaattctgctgctgccttcacatcctcctctcttatctctaacattctgtctaggactcttatgattacactggactcacctggataatccatgttaatctccccatctccagatgcttagcttaatcacatctacaaagtcccttttactaggtaaggtaacattcacaggttctgggggttaagacatagacatttttgggtaccattctttagcccactacactgacatagatggagaacaaagcatattttcaccatttcaaatggtgaacatttcaccactgcaccatttggaatggtgaaaatatgctgcaaagacattggggttaactggtgggtgctcaaggtcactaatgatgaatggctagccttcctctgccactaactaatttttttggtcctttttcaattgtcattcttactgacatttatccacaacactcaacattattgatgctgatattgttccttgtcacctaggatgctacactgtcctgatttcttcattttagtgaattaacagcaccactaatcagagtagggagccatggggcctctcattttaaagaaggggaaaacaccaatggtagttagaaataaaataagacggtacatttagtggggaatgtgttttggttagtaaatcattgaagacaaacaaaccaaagacagaaaaacagagttaaggtcccagtggaagctgaaactgtatatgctcaaccccagatgccttgttgctcatcacttttcagtaataccatcacattaattttttttttaaatacaaataataaaaacaattagaagtaaaaccatcattggtctggaaggagtgggatatacatttggtggaatctatgatggttttgatgtggagattgatacacttagcattgtgcttgaggaaaattagtttggtagcctcgggtaggatgaattgaactggggagaaactagaagaaaggaggctagaaagaacattagtccagtggaaaattgatgaggaggatctgaaccaagggcatagcagtggaaaaggaagaatagggatggttgttttaggaactgagtaataactctatagtttcaagcttgggtgagtgttggttgcctgtaatagatatagaaaactcaagaagaggggctgggctgggtaggtgttgggggtgatgaagattacaatacatgatttttttggttcttaatggtgaatttaaggtgcttttaggatatgcattttctctctagatcatacattacttgagtctggttattagtctcattaatttttgtactctcaatgtctaacagagtaactggcatttgttaggctctcaataaatatttattgaaggatggaaggaaggtgggagaggaggagaaaagaggtgactgcctgttt

SEQ ID NO: 9129 - DNA, 5495 bp, artificial
  synthetic oligonucleotide
aggagattttgtaccctctctcgttgtcagcaaatgttaaatttaatctaaaaccctcaactttggtttaaacacaagttttgttcgtttgttcccagtttacaaacagaataactggtcactgtaaattgtattagtcctctaggtacacgagttgtttcttctgttttgggggtctcctctctttatactactggccatctattcactcagttggtatatatatatatatgtatgtatgagttgcacacatcttcatttccaggcttccttccttccactctccatcccctccctcttcccttccctttccttcccttccctcctctcctctcctcttttctttctttctctttctttctttctttccttctttctttttctttctctttctctctttcccttcctccctccctcccttccttccttccttccttccttccttcctcccttccttccttccttccttccttcctctctctctctttcttttattagagatggggtctttctctgttgcccaggctggagtgcagtggcataattatggctcacagcaacctcgaactcctgggctcaagcaatcctcctgtctctgcctcctgagtagtgggattacaggcacacaccaccatgcctggcttttgcttttagtattattttcctctcctgaccataggcaatttttattttaacattctaccaacatgttaatctaaaaactgagcttggatgactcatatgcagtttttctcccttctcagattcataagactagagtgatggctttttctcgtttcccttgtgcttatattgatatccaggtactaaagattcttccattttcccctttttccatttcctcaccaactctgtagtcagtgctgaagtccagaggttgtttgcactcaggagatagctcctggctgtctccaagcttcccatttccctaccacatttcccatagcaggagaaaaagtatacgttcttctggaatcctggctcctattattatgaacctgctatatttctgaattgccacacagaagtaagactttaaaaggcaagattactcaacttctccacaccaacaaaataaactggctcaatctttgagttcaataattaaccaaatatttattgatcacctctgttgttctaggctttgttctaagtgctaaggagcagcttgatgatgaagagctactgtcctagttcccatgtactcatttgttccaccattagagcctatgcaaatgccattgcctacaccagaaatgaccttcctccttcctcctccctcctcctcctacctgagagattatgtcactcatcccccaaattaattttcttcctgaagtttttcatgaactggctgtgtggcttactttattccagccatagctggcccctatttttttttttttgagatggactcttgctctgtctcccaggctggagtgcagtggcgcgatctcggctcactgcaacctccgcctcccgggttcaagcgattctcctacctcagcatcctgagtagctgggattacaggcgcacgtgccaccacaccaagctaatttttgtatttttattagagatggggtttcaccatgttggccaggctggtcttgaactcctgacctcaggtgatctgcccacctcggctcccaaagtgctgggattacaggcgtgagccactgcatccagccaagctggcccctattcttaaaatgtctgtgtagccattcttagtaatatgtatgtgttgtgaatacacatggcttcagttatggttagccctctgtatccattggttctgcatctgtggattcaacaaaattctggtcaaaaatacttgaaatcaaaccaatgaaaaataataataaagaaaatgtgcagaggtgcaaggaggaactggtaccattccttctgaaactattccaatcaatagaaaaagagggaatcctccctaactcattttatgaggccagcatcattctgataccaaagccaggcagagacacaacacaaaaagagaattttagaccaatatccttgatgaatattgatgcaaaaatcctcaataaaatactggcaaactgaatccagcagcacatcaaaaagcttatccaccatgatcaagtgggcttcatccctgggatgcaaggctggttcaatatacacaaatcaataaatgtaatccagcatataaacagagccaaagacaaaaaccacatgattatctcaatagatgcagaaaaggcctttgacaaaattcaacaacatttcatgctaaaaactctcaataaattaggtattgatgggacatatttcaatataataagagctatctatgacaaacccacagccaatatcatactgaatgggcaaaaaactagaagcattccctttgaaaactggcacaagacagggatgccctctctcaccactcctattcaacatagtgttggaagttctggccagggcaatcaggcaggagaaggaaataaagggtattcaattaggaaaagaggaactcaaattgtccctgtttgcagatgacatgattgtatatctagaaaaccccattgtctcagcccaaaatctccttaagctgataagcaacttcagcaaagtctcaggatacaaaatcaatgtacaaaaatcacaagcattcctataaaccaacaacggacaaacagagagccaaatcatgagtgaactcccattcacaattgcttcaaagagaataaaatacctagcaatccaacttacaagggatgtgaaggacctcttcaaggagaactacaaaccactgctcaaggaaataaaagaggatgcaaacaaatggaagaacattccatgctcatgggtaggaagaatcaatatcgtgaaaatggccatactgcccaaggtaatttacagattcaatgccatccccatcaagctaccaatgcctttcttcacagaattggaaaaaactactttaaagttcatacggaaccaaaaaagagcccgcatcgccaagtcaatccgaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctagaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaacgttagacctaaaaccataaaaaccctagaagaaaacctaggcattaccactcaggacataggcatgggcaaggacttcatgtctaaaacaccaaaagcaatggcaacaaaagacaaagttgacaaatgggatccaattaaactaaagagcttctgcacagcaaaagaaactaccatcagagtgaacaggcaacctataaaatgggagaaaattgtcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacacgaaaaaatgctcaccatcactggccatcagagaaatgcaaatcaaaaccacaatgagataccatctcacaccagttagaatggcaatcattcaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatgcccaaaggactctaaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattctcagtaaactatcgcaagaacaaaaaaccaaacaccacatattctcactcataggtgggaattgaacaatgagatcacatgaacacaggaaggggaacatcacactctggggcctgttgtggggtggggggaggggggagggatagcattgggagatatacctaatgctagatgacgagttagtgggtgcagcacaccagcatggcacatgtatatgtatgtaactaacctgcacaatgtgcacatgaaccctaaaacttaaagtataataataataaaataaacaaataaaaaaaagaaaaaaaaagaaaatgtggtacatgtatgccatggcatactacacagccataataaagaacaaactcatatcctttgcaacaacatgaatgcagctggaagccattatctgaagtgagttaaagccagaaaaggaaacaaaatgctgcatcttctcacttgtatgtggcagctaaatattgggtattcgtggatatgaagatggcaacaatagacactggaggctgatagaatggggagggagggaggttaagtgctgaaaacctaccttttgggtactattctcagtactggggtgataggatcattcatatctcaaacctcagcatcacgcaatatacccacattacaaagctgcacatgtgccccctgaatctaacataaacgttgaaaaaagaaagaaaaataataatacagcaataaaaaataatacgaatgaaaaacaatacagtataacaactacttacatggcatttataatgtattagatattacaagtcatctagaggtgatttagaggatacagggggatgtgagcaggctatatgcaaataagacaccattttagattatggacttgagcatctgaggattttggttatctgcaggggtcctggaaagccatcccccatggatagcaaaggacaactgtatttgtctgttctcctcgactacgagttcaactgttaggagggaggacagttgcctaatatgtcataataataatgaacccttcacctttttgagattgaattgtctgactatatctgtcaggtctagttgggaggcagaaatcacattagctgttttaacagagagaacttgatataataaattgttagtctggtattggagatccagaaaggcaaaatggggacacaggtatttcagaggttgtaactgctgcaagttgctctacccctaggactggggaacacgggaaagaagttgaaatggttaaaagttaataacttggaaga

SEQ ID NO: 9130 - DNA, 1051 bp, artificial
  synthetic oligonucleotide
aatgtgtttcttcatcttcctgattagctgcctgtctctgatcctgtgcttcctaacgaggaccaccccaggatgtggctcttttgttgcagttcctcagtgttttctggacttctttgtttcatcgtaagcaggctccttttctgtctcttataatttccttcagcttttgctgacaaccacactttcttttaattaaagatattttcccctgatgcagtgcaagagttctcactgccttgcttggtctaagcctctcctagtgtcattttatctcactcatttccttagacacaaacgtatgtcatgtagtggaaagaatatgtgctttggattcagatggacctggatcagaatcccaggagcctcactttctactgatgtgatcttgggcaatttctttaacttctctgagtctcagtttacttatttgtaaaatagggagggatattacaaatatggcataaaacacgatgagttaatgtccctttccctttataacccagagttttagaaactgaccctgaacttgggctagatgaggagggcctctccttttcttgagagctattggccctgttgcttttgtcttgcttgttttccttctctcaatggccatcagcagagtgcagctcactttctctgttggagttcatattaccagctttctgacattaatcttagctgcatcactcagttgtctttattcccccgtccagttctgctaacagaattacttcaggcatttcctaatctttgtgcgtaatcagtaactctagacataagcagcactaactctccaaatgagacatgcactacccaagtagtacttcaagtcttgtggaaggagagagaacatgtttgtattctacaaccagataggccatgatggttctaattggccctcctgagtgttcttgccaggtaatgttcttcagagtactgcgaaattacagtctaattgaatttcccctctgatccatttacagatttttataaatgcagtctggacagatcaatgttaatagctgctggtgctttgaagctagac

SEQ ID NO: 9131 - DNA, 1644 bp, artificial
  synthetic oligonucleotide
aaatacatgaaacacactcccttagtctaacattccaggaaacccatatccattacagggatggaaaatactgggccaaaagactccagctgtgttttcatttcttccatgcccacagtgagtaggtggtggccttctttcctgttgagtctgaatttggtctcagcattcttctccacacagcattctaagtagttgttactgattaatcttctgccttcctacagtctactctcaatatggtaggcagaatgagccattaatgtgtaaggcaaatcactgtcctccgctgttcaatgtccccacccgaatcctttacctcaaatgacctggtttccccactttctgattttatttgtctcttagtactctgattcactgtgtcagctgtgctggcatccttgttccttgaacacactgggaatcctttggacttacagcctttgcactggctatcttttaccagaacattctctgtaaatatagctttataggtaactcccttatcttaagggtttgctcaaatcttaccttaatcaatgaggcttaccatgaccaccaattggaaccctcctgtgatagcagaataatgtccccccaagggattatccccccggattataccccacagggggcattatactggattatctgggtaggtcggatgtaatcacaagtgttcttataagagggggacaggaaggacagagccagagaagatgtgacaaggaaacagatcagagagcagagagattggaggatgctgccttgctgctagtcttgaataaagaggaaaaggtcatgagccaaggagtgtaggtgtcctctagaaactgaaagaggcaaggaaatgaatctgccctaaagcctccagaagaaatgccagtcctgtccaaatcttgatttcagcacttctgacttcctaactataacacagtttgtgttgttttaagccactatttgtagtagtttgttatagtagcaagaagaactacatcctccctcctagacttttcttttttcatttcacttaccagcctctattttaccagttaacatgcttatcatgtctattgttttattgtttctctgctgccttgccctttgcccaccactataatgtaagccccatgaggacaaacattttcatatattttgttcattgctgaaaacctgcacttaatttgttgaattaactaattggttagtcaattctgaatctatttcgacactataaaattacttctcactgtgttaaaaatgaatccttttatttggcccctggttctttttctgtctccctctgtcactctctgtgtctccatctctttctctttctctgtttctgtctgtctgtttctctgtctgtctcatatacacacactctctttccctgtcagggtgggtccaactcaggttataggtcttccatgaagccctctcttgactcaacagtccacatttaactttgcactttctgaattcctagagcatctcttttcattatcctccagttttgcacttatattctcttactttttgtatcagctaggtttctgtcaggaaacagaaaccatacagtaattagaacacagagagtttaatataaagaattattaactaataacatgggattagctacta

SEQ ID NO: 9132 - DNA, 703 bp, artificial
  synthetic oligonucleotide
aaacccccttttcaatcagggtatctaaagtagaaacttcataggagagtgtaaaaagctcccctccccaaaacaattcttatgtctgaaaatattaatcaataggagattaaagggaagagagtgaaggaaaagcagtggggatgatggtgacctttggtgggggtagtaacaggaaagagcaagacagcagcttttgagatactggtaatattatctttcttgatctgtgtgctggtaatgtagacgtgttcagtttatgaaaatttatcatcctgtgcacgtgttatcagtacacgtttctccatgtatgtttcaacaaaaagctaaaacaaacaagtgaacaaacaaacaaaaacccaaacacgtggtttgtgaaagtggtccaggtagaaccaggtatccagaagacatggtgagggtcagagtgggataatttcacttgaaagagagagaggacacattaaagggacctggcccaaccagcagccagtgtctggaggaaagtttaagagggctggatggcagatggtgatggcagctaatggtaagaagaaggatagtgaatcaggatgctagaattcaaagagaattgaaacagaaagctgacacaggagctaagtgtgtatagatcacagaatattgctaaaaggagttcagcaggaattaacatagatctgggcagcagaggaagtgggggtgg

SEQ ID NO: 9133 - DNA, 2188 bp, artificial
  synthetic oligonucleotide
ggacctgaaattcagatatgcccagaggaaggggatctctcattccaactttaatatctattgccttgcactgattgtcataggagccaaggccgtatgtgaacaagggactcaaatagtgtcctcaaagtggaatggaatggggtagggaatagggcttctgagagagacagagagacttcacctaaaaggaagaagaggcctgctgtgattcattcatttattcaacggatatttattgagaatcttctatgtttcaagtacagttctatatgctggaaatgcatcagtgaatgaaagcaacagaaatccttgcactcatagagtttgtattctagtggaggaagactggcaattaaaataataaaaagtaaattttaataaacatgggagtaaagatatctctttgatatgttgacttcctttcttttgggtatttacccagcagtaagattgctggaccatatggtagctctatttttagttttttgaggaacttcccaaattgctctccatagttgctgtactaatttacattcccatcaacagtgtataagggttcccttttctccacattcttgccatcattcacagtagccaagatttggaagcaacctaagtgctcattgacagagggatggataaagaaaatatggtacatatatacaatggagtaccattcagccataaaaaagaatgatatccagccatttgcaacaacatggatggaactggaggccattatgttaaatgaaattagccagaaacagaaagacaaacatagcatattctcacttatttgtggatgctaaaaatgaaaacaattgaactcatgatgatagagcacagaaggatgcttactagaggcttggaagtgttggaggggcagggaggaagtgaggatagttaatggttgcaaagcatagttagaataaatatataatatttgatagcacaactaggtgactaaagtcaacaataatttattgtatatttaaaaaataattaaaagagtataattggattgtttgtaacacaaaggataaatacttgacggcatggataccccaattactctggtgtgattattacgcattgcatgcctatatcaaaacatctcatgtaactcagaaatatagacacatactatatacccacaaaatttaaaaataaaaaattaaagtaaattttagattattttagaagaagatgttaagggctagcatagaataatataagggggattagcagtacaggcgaagagggggatggtgttaacttatgaatgaggtggcatgttagtttgctcaggctgccataacaaaatggcacagagttggtgccttgaacaacagacttttatattctcacaggtctgtaggctagaaatctatgatcaagtgccagcaaactcagtttctgataagggctctcttcctggcttgcagatggctgccttctcgcagtgtccctgtgaaaaagctctggtgtctcctcctcttcttataagagcactagccctattggatttaggtaccacccttattacttcacttaattattattacctccttagaggccctatctccacatacagtcacattggggattagggcttcaacatctgaattttgaggggacacgatttagtatataacagatggtttgagtagatatcctttacaaggtgacacttcagcaaaaacatgaagtaagcaagttatccatgtagatatctgaaggaagagaattccaggaagagggaatggccagtacaactgtcctggagggaaactggtctatcctggccaaagtgttcaagaaatagtaaagacatcagtgtggctgaagtgaaggcagccaagggagttgcaggagatgagattggacaggtaaaggtggcccacgtcctgtacagccttctaggacattgtgagaattttttgccttctggagtgggagacatggaaagccaaactcagcaacaatatctaatgggtggatgaggagcagtgattttaggaataggtggcatggtgacctacttgacagtgtcctgatccaagcacccttgtggcctgatgttgaatgaatgactgaagtatatgctaggaagaataaaacattatgattactggtcaaaacaaaaatgaaaacaaaaacagtcattaaactatgtaattagttg

SEQ ID NO: 9134 - DNA, 638 bp, artificial
  synthetic oligonucleotide
gtagggggtgatgctccaaaccagagctttccaaacttaatgtgcatatgacttacctgggggatcttgcgaaactgcaggtctggtttcagtgggtccagggcagggccccctagcctgcagttctgacaagcttgcaggcgcggctgaagttgctggtgggtggagtgcattttgggtagcaaggccagatcagcattctgaaacttggctgcacgtcagaatcttctggggagttttaccaatcctgaaatccaggctgtaccccggaccaattacatgagactctgggggtgggacccagacataagtagtttttgaagcttcccaggtgattccactttgaggccacatttgaggataagtgctccaaagcagaggctctcgaccctagctgctgattagaataatcaaaggagactttaaacacaccaatgcctgcctctacccaagatcaatgaaatctgaatctcaggtggtaagggttaggcgtttggatttttaaaaaagcagcctgaatgtttctggcatgcagccaggtttaagaactactgctctgctaatcagtgtttgtaacttcatgtggatgaagtctcctctgtgtgaggtttggtgggaggagagggagaggcaagaag

SEQ ID NO: 9135 - DNA, 1739 bp, artificial
  synthetic oligonucleotide
atgtaaatgggatacttatggtagccataaatacaaagaatgaaataaagtaatgagatggaatgagatgagcaagtttagaagaagtggagtctcggtctagcagaagaacagaaagaaggctagtgtggccagatacatgttcagttggggtagaattttatgagatgagtttagggagatagataattttcagtgatgctaaggagtttggatttgtttaaaaaaaagggaagtcatgagagagttttaaacaggacaataacatctgatttatagtttaaaaattactctgacattctgagtgaaaaatagtgtggaaaagagaaagagtggaaaagggaaatctgctaggaggtactgatggcgagagaggataatgctgcaggtccgatggaatcagtgttgatggagataaatggatacttttcagatatttttgagatagagttggaaggacttgctgctggattggttttaggggttgatggagagaaagaaaacttgagcaatactagggtttggcttgaccaactaggtgactgacggtgtcatctacagagatgataaagacaggtggataaatgggttttgtggagggagggaagtatgagttttgtttctgtccacagtagtaatttagaggatcttttagccagcagcctaccaagaagagatgtcatgtcagcagaagatatagtttgggagtcattagactgtcaatggtatttaaaactatagcactgcatgagcccatcagggtaagacagagaagtcgattcctgagcttacaaacacttagagatcagttggaaaaggaggaactagctagggaaagtgtgatgtcactgaaaacatgagacgaaattatcttaagaaagagtgatcatctgtattgagcgcagctgacaggacattaagtttgaagacagagaggtggccactggatctgtcaagatggaggttattggtaaactcggtaagagtgatttcagtggttttgtcaggagagaagccacattctggaagagtgaatgggagaggaagaaatgaaaaaatcaaatataaacaccatttttggccttcccacccttaatgctgttactctgttgaagtttactagaatatcttgggataatccttgggggtggatgattatagagaaggaagggtttatattcccaatttgagcaatatttgtcataaaatatgaattatccttatcaatcatatttctattaggggctctcattaccttatctttagggtgatgactgaatcttgtctttaaccctctgtcttctccctttactttcctaactttccccagtcatcccttgaataaagtatttttgtcatattcactcttctgtgctctgtacttcttataactactcttgatttcttttaactattccattttcttctcctttcataaacctaaatgaaattttctttcttgtggttgagtttctgttaccttttgtctgatatttttcttcttaggttttgtgcagggtttcctttgctaggtaatttttctatgcccattgtattgctcaaataagtcacattttcccaaacaagaacacaatgctggagtaagtagccatttgtggaacagactgtaggtggttgctaaaactagggcgactattatgtttgattactaccctttcagtcaactcttgccatcatggtcagtgataaattacaccttaagactagaacagaactgt

SEQ ID NO: 9136 - DNA, 905 bp, artificial
  synthetic oligonucleotide
gaaataatgagctaattagatggctgggcacataccaagccatcattatatgagaacacttcactactattaatatttatcgttaccactaaaacatccaacctataaaactgctcaaagagttatttaaccccagataactatgcaatatttagctctcttagtcatatgtttactaacgtaggaacttcagtgttgcaaaatctcgaatgaagaaattgaaggaggatttttcagagatatgatccttggaaaatgacctcatctgggtctccaaaaattggaatttggggacttttagatcatctagtctctgcagcctaaacgaacaatgggagaaatttgttatgggcagggtacagatttccatagtgtagtgtggtgctcgcaggtggaaagtgctggtgtgcaaaggtgggaggaggagtgggggctccaccgttctggtggtagcagccccacagtcattcccatgtctccttcaaagtttgtgtcgcccagctggacacagaaaagacagaattattggaaaaatatggtgaaagccaataccaataccagttaaactgagtctagaggatggtgtgcgaagcaacttaattgaacatgtgagcccaggggtgggtggttctctccttttttagttctcgggccatatgcatttgtagcagatgctcttggtgccctgcctgcagcccccagaactcactttacttgctgcaggatgctttgtgggaatgtctgtgactctctgtctgaggttttttttctaactggggaatatggtccgtccatactcagctgtccccaaagcagctctcaaccaatgaccggcatgggagtgggtggagaaatagctcagtttcctcccatcctggttaggttaactctgggttatgttctat

SEQ ID NO: 9137 - DNA, 1003 bp, artificial
  synthetic oligonucleotide
ctttccattctgccatcgttgggctatggctttcatcttgaaggctgcaagatggctgcttcacctctaggcttcatgcccacattccagggaggaagaaggtaaagggtaaaagggaaggtgaagctggtttgcttccttctgtcaggagggcaatagctattgggaagctttacccagtggatatctgtttacatttcattggacaaaactgggtcacatggacactaagctataagggactctgggaggtattttttttctttttaaaattcatttttaattgacaaataaaaattatatatacttatatacaacaggatatatatacttatatacaacagaatatatatatatatatatatatatatatatatatatatatagtagaatggctaaattgagataattaacatatgcattaccgcacatacttttttttgtggtgagaatactgaaaatctattatcttagggatttccaagaatacaacgcattgttactatataggcaccatgttgtacaatagatctcttgaacttatttctaactgaaattttgtatcctttgaccaacatctccccaacctttccccctatcagcccctggtaactaccattctactctctgctgctgggagtttaacttttttagattgtacatatccgcaagattatgtggtatttatctttctgtgcctggcttatgtcacttagcataacatcctccaggttcatccatgtcatcgagaatgacagaattttcttctttttaaaggctgaatagtattccattgtgcatatataccatattttctttatccattcatctactgatgaacacttaggttgattcaatatcttggctattgggaatagtgctgcaataaacacgggagtgcagatatctctttgatatacagatttcatttcctttgggtatatacccacagcagtgggattgccagaccatatggtagttctatttttagcttttttgagga

SEQ ID NO: 9138 - DNA, 1015 bp, artificial
  synthetic oligonucleotide
tagggctggagatggtcctttagggtgggtgaactttgcaaaaggagagaaaggctaagtgtgtccagtagctctgtggtttgaccccaggatctaatttacatttcttcttgattttgttcttatcctgttactattctgtctattcctgtagaacagtctgctgactgcttagcaaaatccacattctcctcttctttctgggctagactacattccccagcctcctttgaaatcatgtgagactgtggctgatttctatccaatgaaatgggtggaaatctgtgaattatctattgctgcataactgattaccctgaaacttggtggtttaaagcaacaaacatctattatctcatagtttgagggccaggcattcaggagcatattaattaggtcagtctggctcagagtctcttataaagctgcagttgaggtgtgggctggaactacagtcatctgcagacttgctaaaggctgaaggccccactcctaagatggcccactcacatggttgttggtgggtgggaggccttatgggtctctccatgggattgcttgaatgtcctcatgatatggcaactggcttcccttagagcaagtgattcaagagactaagactcagccttggaagtcacacactgtcatttctgcaatatcttatctgttatacaggtcagccccatttgctgtgggagggggactatatgtgatcatgaataccaggaggcaggattcactggggccatcttgaaagctggctaccataggatgtgccatctgctatttcatgcttgggccataaaaacctctcatgtgctccttcaatctcctttcctgttctagctggctgaaatgcaatgattcccagggaaacttggaacccatgtgttgaaggtggtagcacttccatcagcctgggtcctgaatgcctgcaggagaatatccttttgatccatgtacctgccgaggactggtaagtgagcaagagataagcttctactgtttttgagtc

SEQ ID NO: 9139 - DNA, 644 bp, artificial
  synthetic oligonucleotide
ggacatatcaatgcagaaccagaaaacatacacacatatgtatatgtgtgtgtctaatgacttcatatcgatatattcaatttgctttaacattacaattttaaattaatttctttgactttataattcttttactctgaaaatcttgattcttaacataattacttgttttatttatattaaaaatagtttttgaataagaataccactattacatataacagtaacattactgaataacttaaaatttctttatgactctctggcctgagatgaaattaccctctttcaccaatttccttaaagctaagaactgagtcttgattagatattagaaactctgtaaatgttacttgaatgaatagtttgagttctggttcctaaatatttcatgtgacagaacaaaaatgtgttgggaacataggatgagttatgaagtgaattctttaaagttcatttgggaagtaatcagtagctatctgaaattcataagcctgttttcctaaaattttcatttcttatttcgaatatattgaaccaatttaagaagatggcttatacagagtcctgagtttggactgaattctctttaatagtactagattggaactttttccttcctcttctctattcttattgaaaga

SEQ ID NO: 9140 - DNA, 2818 bp, artificial
  synthetic oligonucleotide
tgcatattaatcattattcatggtggtggggggctgtgtgaaagcaagggttgataattcatgcactatacttcccactcctttcttctttctgtctccctgccctttctttattataacctgtggcacatatgtggtacactgaatgctaggtaaaggttagtggttgctaatatattaaaagaaaaagggaaaatgaaagcttactgtttctctctgcttgtgagaaaagcacacgaatacactatgtggtgtagtcatgtggctaagcctagacctcaaaataataatcaaaggccttaacatattaaattgataactctaaatatattaactgtggtcttcacaacacccctctaagagaagtatctctggttcatgggtgatgaaactgaggcccagagaggttgattaacttgccaaagcccatgtctatttggtggcacacatgagattaaaatccatgtcagtctgacttgaaagggctgcttctcaatttgcatgtgagcttgttatggcatgtgggcatgttgatggatttgtgggatatatcttaatatcacagtgaaataatagagctggtggctaatttagtgtttttaccaataccactatcaccacctccatcactgagcgtgtggatctgttggatgaactcttgaataaatcaaaatggaaaggggaaatatctaggagggaaaagtgatttgagggttcactggggtgtaagattacaaaaatcatgagagttatagagtatctaatggagtttttagtaaaaagcatgggacagcatttaattgtgcattttagaggaacaagcttctgaaatgtgagaccaattggctacaaagtagagactcaatgccacaagatccttaaagtgatctgagtgtctgaaaaataaaaacagaatgaaaagccaactagactctaaaaaacaaaagacagaagcctggggattaccccatttccccctgtctcttgaagaaaactagagaatgtagttttgatagttttgttttaaattcttgtaggggagtaatatttagatggtaacccctgcatgatccatccacaggaattcatttacttctctttcttgcaccattcaggcagcagtgaaacctttctctacagattgctcccaaggtagggtagttatagcaggaaaatagaaagaaatgacttttcacagcttttgagcttctaaataaatttttaaggttttgagctttactggcatagttttaacactatcagagccaaaatttctgctataaaccagtagttctcaatcctctccttgcattagaatcacctgaggatgttgtaaagcctaacagtgtctggactccacctgcaaagactcagttttaattgatttttggtggacattcacatatatatatatatatacttcccagaggatgcattgtgcaactagggtggagagccagtatcttaaacacttgtttccaaactttgttgcacattagaattgcctggcagcttttaaaatccccagtggcaaggctacacctgtaccaaatccccaatgccaaggttgttcccagaccaattaagttagaatgtgtgggaggtgagagctaggtgccttaaacaatatatttgggaaatatttctgatgagagttgtactttgacatttccagaggctggcaagtgagaggaaggtagaaaggagagagagagagagtagcttagacattggtgtgtccttaagaaggggctcagtgacccccgcacaactccctgtcccggtcaagttaagatgttggcacaggcagtgatgtgctggcaaatgtttaaaagatggttcttcaaggggaaaaaaaatcccctaatttgcagttcgtcaatttttggtgtaaatactcccactatggccagtttcaagttaccagtgtgacatcattgattgtgaagttggaaagagatgcacacaatttgctctaggaagcccgtatgagctggctccagcatgctactgggtatgagcatgataaacccctcagataggtttggggatctgagggtagagagaatcttgtgctttatttttgggcatggacagaaaagggatgaaaaagtctaagttctccccacaatgtatcatctagagtggaagtgggggcacatctaggagagtctaggtaggaagggcatgagaccaactctcaagtctcttgttgctttccagtggtatcagagaagatccagatttttctgtacccctgggagcattatggaagtggctaggcataggttgggagaattcaaggggccttgaggttagaatgagaaagtcatgaagagttgtggacgattggctacagatgcaaatgttggagggtaacaacaaggataaaagccaatagcagctgagaatcagatgctgcctcttgatggcatgatgctactaacctctatgacccttagagaagtgacagaaaggtctgaggaaacagaagagatggtggctgttattcattgcactaattagaggttattacagggactgcagccagaatctctctctccctctctcttttgttattcctggtagaagccaaaatttcgtcttgttagagctattgaaataatgcagtaggatatttttcttctttcttgtttcgggaagaaagaactggcaatattttgcaaattcactttgaaaaagaacagcatgtcccaagttcactgaggcgaccttcctgaaggttaatataagtaggacaagatggaacaccttataaaagtgcacatgcaaacataccgcttaggataggggtgtc

SEQ ID NO: 9141 - DNA, 1246 bp, artificial
  synthetic oligonucleotide
atgtctgaatggatggaagtgttcaagagcccgtgcaatggaatgcttggtaccttggagaattggattaatttgagacttgtcacctggaaacaggactgtctggttcaccttgggatcacctttggccacggataatcaaactgttgaggggaaagagtggattacgaaacctcagtgcagccaaagtgccatggggccaccagaggtgacctagttggtccccaggtgatcacatttgagatttattctttacagcaaccctcataatggaacagggctgcagaccagcctaaccacacacagaacaaagggctgacagacttgtgaacaaagggctgacagacttgtgaaggggttatggcgccccctgggggacactgaaatgttcctcttgtagacctaactttccggtctggggtcaagttcaacttgtattgattgagtaacctgtaagacatcaccacttcagtaatcctcttcaaaggtttcagaataaagtatttgcaattttattgggagcaactcaattcaggggaagctgaagaggaatacatgtgatgtgtaagttctcacaagatgggagggggaatcttttccggtttattttgtattgtttctggtagaaaggctctacatgattgggtaatttctaatatttactttgttaatgaaggtgataggataagatgacaactccatctgcaaagttctgcaggcaaaatgcctctccaaaatggttgtgagccttttgtgtcttgcttgctcagggtgtaaaatgagcgattctcaacccaaatcagtaccactctcccagtgagcagttggaagtgtgtgggagcatttttgattgtcagagtgactggggtacaggggggtggtgcactacttccatttgctgagatggaggagggagagaaaacttctagtatgaaggagagttgtcctatcctaaatgccaatagggtccttgttgagaaatactttaccccccgtcaggtgatctggagacagttatgtgcaattcatattcagaaggtttaactacacaaacaaaatatgtcaagcaagtgaaagcagatttaaggagcgtattcagaaagaagtgtagttaagcctgtttttggacatttagagagcatgatcactttgcccaaaaccgaaaaggagcactggccttaagtggaatacggaggtggaggaatttgttttccaggctccccagcatttctttcttcatcctctt

SEQ ID NO: 9142 - DNA, 1709 bp, artificial
  synthetic oligonucleotide
atacttattttatgggattcctttttaggattacatgaggtaatgtgtattaagttgttagtactgtatgtggcattattaagtgggcaaataatgtcatttttttttttactattcatactcttgttactatcagaccctcataatttcctttctcttctccagctctttcttcatccagggatgactttcatcttagcttcatcacttaaaatcttactcatttgtttttaatgtaacttggacaaattattttagcgctctcagcctttgtttcttcatctataaaatagataaagtcatatatacctcataggccttttctatgggataaatgagattatatgaaagctctatggcaaattgcaaagtatcttgcaagctttctctataagcattctttgactattttctgactacttatcttcactttgatatcccctgaaaatgatatcctcataggatttttgtactttatttttggtatttgtcatatcacagccttgctataatttgccttgttatttatatacatatatagattgaatacttcttaaagttaagattgatgtctacagctgatgcagtacaaggcagcaaagtaagtttgcttaattgaattgaaacccaaatttataatacagctttagttgctttggtcgataacatgggtttgcaaattttatttgcacatttctttaccccaggaaagggatctccaaaggtgggatttcagccttcactgaataggctattagtatagaacagtgctattccaagggtggtttccagaccagcagcagtagcatcagcaactgggtgcctgttagagctgcagaaccttggggtccacaccagtcctactgaatcatattctccggggctgggtaggaatctgtgttttaacaacctgctaaattcttatgcatgctaaagtatcagaagcattggcatagacagtatgcatgaagaaaattttaattttcttcatttggcattttatagaggagtgcctatttgtaacagtcgtctgtttgatcaaaggcaatttattttagcaaaatgtaccatgttttcaaataagcaaaatttcttagaatttaacagaatttcctctagttcctcaacgtatgagtagtaatttttattggtttatcatatctatggcaaattttaatttcaaaaagacagagaaaaaagactaagaggtaaaagggcaccgactggtacttattaatcaagtctataaaattgtgacttgtttttgcaagaatgtgagactgttgatcgtatccttcttagaagggctatcccagactgttaaatggaaaaaaataaaaacatcttaagtgctctctttttacactttgaaggccttatccttccatactgaaaaatggggattctatattgcaaagagtaatgggtcatggctggaacctgttataaatgtcgtcttcctggctgtgggaataaacacttcagagcttagatagtaattattgtcacatgaaaagcagggaggcatattataacttctcaactgtcagaaagccctcttcttgcaaatggcagcacttcacagggacttttacactgtaccgtttataattttcatggctgacctgttattttaaaataccaacaggaagattaagaatgttgacaggaaagcagtaccaaccaatgccctttggtcctcctaaact

SEQ ID NO: 9143 - DNA, 1880 bp, artificial
  synthetic oligonucleotide
ttatgttagtttaaggcagttgaaggccttgtgcaatgttttttctttttgctacatatgatctcctctattaagtaaatagcttaaattgtattcgggttaccttggaatacgtagtatagtagcattttacctgtcgactgaaaacaatttgcagaggaaagctgatctaatgctacctccttgcttaatttgtggcttcttacagaatatagggtaaactcattttcttatatccatgtctctccactacctgtccccaggaaacctctccaatcctatcattaccaaccatttgctattatgaaaatgatctctgagtatgctttattaatttctgcctccctctctccctcttccttcctccctccctccctcattctctctttcctccccgtccatctctttcctttttccctccctccctctctactggcctctttctagtgcatactcattaagcacctacagtatggtggactttacacttagcatggtaggaaagatgaaatcgacaatgcagcccccagcactgcaggggatgtggacagaagcaacagtacttacagtatctataatggtgaatgaattacccaactttgcttgaggaggtcagagaagttttcagagaaatgatgacttgtaagctgagttttgaaggataattggggctcaccaggtagacaaagccaatacatttatggttcacagaagcaatggtacaaatggaagagcagaggcaagaaacaccacatctgtgctacctcccttctcccttccctctctgccttccttgcacacatatttagcgggtgatcatgtggcaagcatcgccctaggtctccagagacaacactagacaagaaggacaatattcctgtcctggggaaacttatctgctagttgtgaaatgacacatgatttgctgagactaacagctcctatatccctaaacacttcaaaaaatgtttgggacgtgttgcattctgaatgctgcctcctggagtttcacggtgcacaatttcacagtcgaggccctgggaagtccttcatcaagaaatctgttatcttcatttactgtggttctcaagtgcatttaaccaggggaactttgttttaagtagcaattaataccacacaaagccagttttctaaaggagtcactgcaggaaatgtttgagtgttcgtttcttccaatctcattgcctattgtatcagttgcgtgttttcataataatgctgcataaaaacagccacagaacctccgtggcatacaacgataagaactcagtgcttgcacccctggggaggttggttaggtggctctgctgaccttggctgagcttgatcctatgtctggggtctggctggctattatagctgggacaactgggatgaattggctgcgccctgcttgcctgggcatacacctgggcatattttcctggtggtgactgaggcataaaaaggctagtgaaactatgtaagcaatttttcagatccctgctttgtgaagaattttagcttcctaatgtccaaagcaagctacatggctgagtccagaattaaagtggccggggatggggcactgcaaagtttcatggcaaagagtgaagatacagagaacagggaggaattggggccactttagtacttgaccgcatctacctaagaccccgactcaggtatcacctcttccatgaagccttttctgactttctcagacccatatccatttctttatctgagacttcccactgcacgtccagtaccttactgccaagttaggagctctcttaaactcccagcttgcttcacattggctcccctacatagatgacaaattcctcgagggtagagaccatattttttctgtgtgt

SEQ ID NO: 9144 - DNA, 266 bp, artificial
  synthetic oligonucleotide
tcttgtaattaggcctatggtaggacatgtgtgtggttccaggggcagggagttccggaagctgaatagcaagttctgccagggaagggactgatattatttatccccaacacaatcctagtgcctggaacatagcaggtactgagtaaatggtggaataaatccactgctgcctcctgccatcaggggtcccagcctgggttggaggaggaacaggggagggcattacattgtataaacaaagacttcgaggggaatttacccca

SEQ ID NO: 9145 - DNA, 4539 bp, artificial
  synthetic oligonucleotide
caaaactgacatcctctatcataatcactgaaaacaatgaagtgttcagtaatgggtcacagttacttgacagttgacatgtaacaatacctgtcctctcctcagatcttcacttaggggaaagaaaaaaacctgaaaggtggtaaaaataaaacaggaaaaggaaaagaaacaataaaacattttttttcaaaatcaatgattatactttaatagagcattttccctatagataaaataagaaacctatataatattgatatagtagaaatactataaaatctatgtactatactatagaatactacataatctttgaggttaaaaatggctgcacattcactaaacatgatctcccacacaaaggcctcattttctataataaaatacttatatagttgattttttaaatatttttcagtgcatcatgggtacctgttatttaaaggaagtcgaggtagctattttcatacaacacattgtttaatacacattgtatacaacacattatattgtggctattttatataacacatttctataaaacaaaaataacctccataattttatcattttgaaaacttcatatttagatttactatcatttatacctactctattgcagtggagaaaaaagtatcactctaggtcaggcttatgatccactaaatgctgtctctgacagcactggcaaagaatttgtacaacagaagagccataattcctacctatccatcctctaaacagtcaaatattcaaaagcatattagcatctttaagtaactcactaaagagttcacctagaccagttaggaagctagtttgttttttatcttgtaccaacccttactttgcttacatagtacttcctttattatcctaaatttgcttctttaaacatttggcctagttctagcctatcatgttctgacccacgtttgagtttaaccacaagggtttttttgttttgaacaccatgagattcgtgtgaggtcttaaagcaggaaggccagtgtaaaggaactgaagaaactgcctgtgtttttactgaggcactgaggtctttttaaattgttcatattttaatgagattaaaatgataaaaaacagataagattcataatcatcctattcctgactttcatgattcattcagcagatatttattaagtccacaatatgtcagggccaggcattgtgctgaatgctgaggattcagagagggggggaaaaatgtctgctttcaagaattcacagtgtactagggatgagaccataaatgtaaactcctacacagaccaatcctgaaatcttttaacctggagagaaatattttgatgtattcactcaagtaaatgactctaaaaaaaactatgttactctggtaaaatacaattatctgataggaacctactgggggaggaaacggtataatagtgaaaatattagacctctgagtggaacttttcaacctttccctcactgtcttcaatatttccaaattgtatcagaagtaatttacttgaaatagctgaacaagcaaaggaaattaaatatctaaaggcaatttgttagaatttaattttaataaatcttggcaacactggctctgtttgacatactttatgccaggatagcaagaaaattctttgaaaacagcaaattgtggaatcctatctgtcaagttctggaaaacatgatagtaactgaaataacaaggctttaccaaatgagacctcttataatactctatttgtttctggaaaatagatgacctctaactactggcttatttataccccgaatttttccacaaaagatttggaacagctaccctgatataaaacgaagcacatgaattgtatccacctggctttgaattatggctctgccatttactatttatcatctttgtaccttttaaattctgagatttggtttcctaatctataacaatggggaccataatcctaccctgctgggtcacaggaaggataaaatgaaatagtaatgtagcacagtacctggcatacagttggtgctaaataaatatgttttgtccttccttatccaaatgcattccagatagaaaaaggataaggtggaattctaaacgatattgttttcctatcacactgatacatgccaagcagaaatgtggactgatcttgagttgcaattgttaatgtttgtatgtaaaagtcaggctcaaagcaaatttaatttctttccacaagttcagtactttgcgaacattttattaaccttttagctatattatttaatgcaaaaaattttctggggaaaaatatgacgagctcttgcatactgtttttcacactacccatctaaaggattattaaacatcataaatttggctttttaataaaatatttatagtattagtctggttaacaattttaaataaagttcttgtgattctgccagtcttaaaaacatgatttcctttctttctttccttttctttcaacatatatcaatgtcttttccattgaagagcagcatttagttcaggttttacaagtatgatccaagtcgcaaaatactaagcaccaatcataagcactattacaactctgcgtgcgttaaggagaacaagcaaaattgttatacagcagcggaggtgactgggggaaaaagtgaaaagcgatttgaactgatcccccgccctctccattataccggagaatgcaagtgtcccgcatctcaagattaaactgagcctcggttttactgacgtaaccagtaaccctatctacttctcacactgcggaggccggcagggcagcggctgccgccaagcacaccactcatcagagcctgccccgttccacccccgcgtttcagtcatgctttccagaaatggggtcactcactcagtaactattacacacacgcagcctatcatcctgtaatcccctaaagtccgctgcggggagagaaggcagcaaaaagtcaagaaggaagaatcacagacgcgccaccatcaggaattgattttccactccggagaggagcggtgataccttggaacgggtcttgtctggattattttcgcagaccccgagttgttctgggataggggcggttcaggaaagctcggtgtagtgatgcgcccggggaaattctgttttgccctgtttgggtatattgtttgggttttgggcactaggatgggtgactcagggacggtcaccagatcccgggcgaggaaaaccagaaagccttttacggcggccgctgatctccttgaatatcaccctctcacctccatggacaggaaactcaagttaaactcacagggacgggggtctagctctgcgacctcagaaacggagggggtaggggaccttaggcttccgctttcttctttgcagcagcagaaaccgctgcggcagacgagggggaggcaaaaccctgcaccccctacccgaaacccccacaggtcgccgccgcccgtgccccgcgcgccggtctccccgcagcagcccctccctcggctggactcgagagtccctgctccccggtgaacccgatccctacccctccctcatctcccaaagtcgccaaggtccgggaaagcccccgacccggctgggccaaacttcccaactccccgccggcccccgctccgcctcccgcttcccccacgcaaagttgattaaaattggcttcttgcaaagccccagcgcccactccaaaccccacgcgccaccacactggcagccccccgagcgagggaaggaggtgagggtgaggatggaaggaacagacagaccggccaatagacccaccccaacaacccaaaccaaaaccctgagcccgggggaaagacgcgagcgggatcagaacgggccgagtggccagctccggggagcgaagcgagccggcgggggcgcgaggaggagatgcgccggccccggccgccctgctgcactcacctcagcgctgtcggacgggctctccacagccatcttctgccacgggtccgccagctgcgccagcggcatcttcccccccggcccgccgccttcaccgcctcctccctccccgcccgccccacggccggccccgctccgtcgccgcccgagccccacggcagcggcggcggcggcggcggcggcggcagcggcagcggcagcggcagcagcagcagcagcggcggcggccccagagagggctcgacgccgacgccgaccgcccgaaagccgcgcgcctggccagagacgcccgcgcgctgagcgagagcctcgcgcctccgctgggcaccgggtctcgcccctttcttcctctcctccttccgccgccgggactacggctccgccccccccgccggttcccgcgcccgctcccagcagaacagcgaccgccgcgcgctcccccacttccgctcacaacatggcgcctaagcgatacctgtctctcaaagcgaggctcggccgccgccaccaccgccgcgcgcacccaggggctgggctagtggaagacacgcccccggccgctgcgctccgctcctcc

SEQ ID NO: 9146 - DNA, 665 bp, artificial
  synthetic oligonucleotide
aaccctaagaacatgagtcaggtataattattcctattttatagttgaggaaaccaaggctcagcaaagttaattactgaatggcagaagcaggattcaaacccagatctttttagctccgtaattcattcttctatatttcataagctcctcaaacaaaacaatttatatggaagaagaaaaaaacctcacaagaataaaaaatgtaaaataatatgacggaaaccattccaaaagtaataatgtaagaaatgtaaagtttaaagtgtttaattatacaaggaagtggcttgctggatattagatgtcattaaagaattactgatgttttatgagtgatgatagtaaggtccttatgaattttaaaagtctatcttttaagaagtataaatgcaaatgtttatcggagggtggttaggggaatgagaagaggaaacagaaatggaacaagattggccatgagtttgataatccttgaggctgggttatgggaatatgttggttcattacactactctctccagtctggtatgtgtttgaaatgtttgataatcataactttaataatcaggttatattttttaaaaagtaaaccaacaactatttactactttaaagagaaacccaaaccaaacagataagtataaaaaaaaaataaaacaagc

SEQ ID NO: 9147 - DNA, 1614 bp, artificial
  synthetic oligonucleotide
tgggcagggcaggcttcctggaagaagcagtgccttagcaaaatcttatatgtgtggtagttagccaggtaaagaaaatagatggtgttggcaactgagggaactataaattcagacataacagcatggaaaatgaggcatgcgcaagaaatttacatactagaacacagagcatcaggtgtatgagaaagggtgtgtgagaagtctgaaaactacagaggaaggcagggtcttaagcggctggggactttagactgtaggcagggaagttaaatgggtagttatgagtgttagatctcttttctagtaatgtggaagatactttggggtagtctggagagtgagactagtcaatattgaatatgaactaatagtaatattaacactgaacatttaggtaagtgttcaagtaagtgcagatattaaaagcaataatatcgtaagtacttttcttcttaaagcaaaagtagaaaaaaataactgtacaaacatatctttattgataaatgaaattatgccatatacacatataaattgttttcaaatctactttttaaacttaccatgttgaattttgttttgttttgtttttgtttttgagacagggtcttgctctgctgcgctggctggagtgcagtggtgcgataactgctcactgaggtcttgacctgccgggctgaagcaatcctcccacctcagcctccagagtagctgcgactataggcatgagccaccatgtcaggctaatttttaaatattctttagagacagggtctccctatgttgcccaggctggtcttgaactcctgggctcaagcaatcctcctgcctcagcctcccaaagtactgggattacaggtgtgagccactgtgctcggcctggctaattaaaaaaaaatttttttttgtagagatggagatctcactgtgttgacctggctggtcttgaactcctggcctcaagtgatcctcctgccttggcctcccaaactgctgggattacaggcgtgggccactgtgcccagcctatgatgagttctttgtctaccacatgatttttgaaaatacactactttcaatgtgagttagacaactgattcaaatgatccatattaaagaatctacttacatcctttagagtgataatgtttggatgctgtccataacgaagaagaatttcaatttcttctgttgggtctctcttgcttttatcaataatctaaaaggcaaatgtttatcacaaaacctcatcaactatacagttataaacattaattgtttatagctacagaccttgggtattacctcatgtaaatagtgtataaataagccatttatcagtcagttttattcaactacctggccagattgtttaatcagaaagccagtcttgatatagatggcaaggctgtaaattctaactcatgagtcgcattcccaccatgcctctccaatctaagtttgtaagtttgtagtaagtttaggacttaaccaaaaactcaaaaagcctcgagaaaaggtaccaagaacacagttaacatatcttttcttctatccttgaggccttaaacatttgggaactcagtcaacttctaaccccccatcaatacagat

SEQ ID NO: 9148 - DNA, 5484 bp, artificial
  synthetic oligonucleotide
aatgtgttctaggcagagagaacagcaagggcaaaggccctgagtggaagcatgcttggtatattcaggaaacagcaagaagccaggtgcagtggcttccacctgtaatcccagtgactcaggaggctgagatgggaagatcgagcttgaggccagtagttcgagaccagcccaggcaacatagcgagacccacccccccatctctaaaataataaacacacgacagtaaaaaaagccaggcatggtagttcacatctgtagtcccagctacttgggaggctgaggcaggaggatccttagagcccaggagtttgaggatgcaatgagctatgatcgtgccactgcatttcagcctgggcaacagagtgagaccccatgaaagaaagaaggaaaggaggaaggagggaaggacataaatgaaggaaaggaaagaaggaaggaaggaagaaaagaaaggtcagtgtggctagaatgcattgagccaagggaagaatttgaagagatgagattggagaagtaaggaggccagatcacttgaatcttcagtaggtttttttttttttttttttttttttttttgagacagagtctcgctctgttgcccaggctggagtgcagtggcgcgatcttggctcactgcaacctccgccccctaggttcaagtgattcacctgcctcagcctcccttagtagctgggactacaggtgtgcgctaccgtgcctggctaatttttgtatttttagtagagacggggtttcgccatgttggccaggctgttctcgaactgctgacctcaagtgatccacccgctttggcctcccaaagggctgggattacaggcatgagccactgcgcccggcctttcagtaggtttttaaatagatcattttggtttctgtgttaagaacagactgtagggggcaagggtggaaatggaaaccacacgggaggctactgtaacagtccgaacgaaagacagttgtggcttggactagggtataaagtttctttttaggatggtgagaatgttctaaaattacattataataatggttgcacaactctgtaagtactatactaaaagacattaaattgctgggtgcggtggctcacacctgtaatcccagcactctgggaggccgaggcgggtggatcacaaggtcaggagttcgagaccagcctggccaatatggtgaaaccccgtctctactaaaaaatacaaaaattagccgtacgtggtggtgtgcacctgtagtcccagctacttgggaggctgaggagggagaatcactggaacccatgagctgagatcgtgccactgcattccaggctgggcaagagtgagacactgtctcaaaaaaaataaaaacaaaacaaaacagtaaattgtacacttttttttttgagacagagtttcattcttgtctcctaggctagagtgcaatggcgtaatctcagctcactgcaacctctgcctcccagattcaagtgattctcctgcgtcagcctcatgagtaggtgggattataggctcctgccaccatgcccggctaatttttgtatttttagtagagacggggtttcgccatgttggccgggctggtcttgaactcctgacctcaggtgatccacctgcctcggcctcccaaagtgctgggattacaggcatgagccaccatgcccggcctagattgtacactttaaatggtgaactgtatggcgtgtaaactatatctcaataaaactattaaagaaataggagacggatcaaatgacaaatggtactgagggtttagctgaggttagaaaatataaatttgcagtggtatcagtttgcataattatatggttttcgaaaccaccattgcaaaattgtaactgagacaatgagatctgacctaaccaactccaactccatcttgtttctttttttttttttttgagacggagtctcactctgtcgcccaggctggagcgcagtggtgagatctcggctcactgcaagctccgcctcccgggttcacgccattctcctgcctcagcctcctgagtagctgggactacaggtgcccgccaccatgcccggctaattttttgtatttttagtggagacgaggtttcaccatgttagccaggatggtctatgatttcctgacctcgtgatccgcccacctcggcctcccaaagtgctgggattacaggcgtgagccaccgtgcctggccaactccatcttgtttctaacctccaagctgtccttgttcattcctgggtgtaggctggactaactttaggagaaatttagtttacagtttaaaacaaaaatgataacagccctttcccaaaatgaatccccttcttgcctggggactagactgcctttgtgggactaacaaattagccaaaagattagaaattatggtttaggagtcatgcagctggaggctacaagattctgactctctccaaattgctcctggggataacatcgctatcataaagcctaagatcagtgcttgatatattttgcagaccctgcacttgatggatcagttggcaccacccagatcaataaactggctaatatgagcttgtggcccccacccaggaactgactcattgcaagaggacagcttcaatcccctatgatttcatctctgacctggccaatcagcattcttgactcaccgccccccgaccccccaccaaattatcctttaaaactctgattcctgaatgcttagggagactgatttgagtaataataaaactccagtctcctatacagctggctctgcatgaattactctttctctactgcaattctcctgtcttgataaattggctctgtctccacagagcaaggtgaatccactgggtggttacatttcttccatacaatagctgactgcatacaatcattaaccaaaatgatccaggattggagttttttttttttttttttttttttgctcagtgggtgcagaataagggaaaaatataaggaagttgcgggtgcttctaagagagaagttcagattatcaactatggggccatgaggttcagtctggataaaaaaggaaataaagactggggactgtgggggaaaaccccagaggtataaaattcaaattccttaatatgatttattatgcctttgatgatctggctcctgcttatctcttgagcctcacattatttcttcttctcttactttttaagttctagtcatacagaacttttgagtgcctctaattccgaatttctatacattctattctacccttctcccttgcccttttaggtctcagattaataattgtttccttagaaggtctgctctaatccctaggcaaccctgctacatattcctacagcatcctgcacttcctttacctagcttttttttagtgtgtcaattttatgaattcagggtacattaatataaagctgcagaagcctgaccatggccaatactgctactctgtgtcagtctgtctgagaagccaggtgtttctataatcatggtaggcagactaatgaacttcaaagatgtccatgtccaaatccctggaatccgtgaattatgttatctcacatggcaacagggaataaaagttgcagatgcaattaatgttgctaatctgttgaccttgagatggagagattatcctagattacgtgcgtaggtgaaatctaatcacacgagtccttaaaagtggaagaggcagaagaggaggggcaaaaagatgcatatggagaggacttgacccactgttgctggttttgaagatgaaggaatgggccataagtcaaggaatggaggcagcctttagaaactggaagaggcaaggaaacaattcttccctagggcctctggaaaggaacgtagcagccttgctgacaccttgattttagctcagtgagacctgtattggacttctgatctccagaagtgtaagataacaaatttgtgttgttttaagccactaaattgtagtaatttgttacaaaaatggtagaaagcaaatacagttaacattcctaccttgcctcagcataatgccaagtagaccttgaaggtcgccatcttatctcgagtacctaaatccaagtggatagcccctgaaccagctgttatgggctgaattgttaccttccccaaatccttatgttgaagtcccaacccccagtacctgagaatgtaacagtatttgaagataaagtctttaaagaggtgattgaattaaaatgaggctgttagagtggggctctaatgcaacatgactggtgtccttataaaaaaaggaacaccaaggctgcacacgcacagaggaccaaccatgtgaagaggcagcaagagggcggccaactataagccaaagagagaggtctctgaagaacccaaccctacaagcaccctggtcttggacttccagcctccagaactgtgagaaaataaattctgattaagtcactcaatgtgtggtatttcataatatggaactactaagaaatgtcagctgggcaagaaaaggctaacttcaggcctatataacccattccctctctactaggaatcaatgaactcaatcaaatttcctctaaaatgtgctgatattaccagagagaaaatgtaaagtccttatctctaaaatgcttttagcaagatatacttggtctttatagatggtttattgtaaaacttgggatttgtggattcatgaggcatgactggctggagaatgagggctcatttaaactgcataatgaagtataaaaaggagatgttgcaaaatcaaatgactccctttgtttgaacaaggtctccacatacaacgctcagaaagaaacttgtcctttttgaatccaaagtgcaccgagagagaaaagggccatttttggagctggactctctaacattttggacttctctaaaaaaagaatatttcttctgtgtctggtgatcatcccatatcctttgattcattaaaagtttggtattgggtaagatctatgatttatgtgtttgacttgacaaaccctttgaatgaaacaagattatgcatggaaaaattattttgcacttcttaaatattcctgttttatgttctatcaatctagtttcaaaaatatactttggatagaattttacattataaaggattacatgatgaaaataatctgataaaagggacaaacatgcattgatttgaaactttattatataaattttcatttcttttaaagattacaaaacctgttctatgacaggaatacaagcaatattgttccaggattattcatggatacatctgaagagcttagattacacattaatagtatgatttgaaaacttcccagattagactcttaagtaaaacaatttaaagtatttagtgatatttgatcctttacaagcattttataattatggcagcaatgccaagcatctgatgcgatttaaccaccaacaaaaggta

SEQ ID NO: 9149 - DNA, 2322 bp, artificial
  synthetic oligonucleotide
aaaaaaaaaaaaaaaaaccccttaagttccttcaaataaaatccaagatacactgaaaacccaatcataccgcccctccccacctctcatgagtacaacagaacatcgaaacaaactattatttaagctctcaaccaaataaaaatgcaaactgaaacaacctctccttttcagtgttttattatacaaggtcgcctctgccacggagggtcgttctggtgggtagtttccaggttcttccctagcagatgcagcttgagtgtttcaagcaaaaaggataaaaacaaaagcacacatttcaaaggtagttataacgttatcctgtgacagttaatgaattctgcctttaaaatagcataatgaaaaatacaaactggaaatgatttaagctatctcctcctcctaagaatgatgcaactgaaggcccagtcagaaaatactacctcgccccctcaaccccagtgaaaaagcgtgttttaagaagatttctcttgatttctttccttttcttggcccatcgtatataaaatactcccatcttcactatgtgataattcatcgaattatagttttgtgtggttttttaaatgcatattagactgcaataaaaaatgttttaaaaatagcctgccttattaactaaaaataaaaaagttgttgtcaggaaaaacagcatgaaatcggtttccatgctgcttacacccccgcactacctgcaaccactttacagaacgttagcatcagacctgcttatctaaaatcctgccaaatgtcctcacagtctcctccgctgcctcgctggcttctgggcagccagggaccagccctccatggctcccagcatcggcagcctcgagggctgagagccttgtttgccccgctgcctcgattgagggccgcggcccggccacctgagcagcgttcccaagacagggagcgcatccgggcgggaggagcacccggtccggggcagacgcctggccgcccgggcgaatctgcctctgccaatgggtgacacgccgattttgccccctggaaacgccaagaggcgcgaagctgggccaccttcgccgcgggctgcagcggcgctcgcgcgcgtttcccagaacgcagagagagcgcgcgcggaggccggggcaaccccagaaccccgctcggtttatcctaacgacccccatgccggctgctcctcgaggacggggactggacccgcagcaccccctcaggcacctccatcccaaacacacctgccgcccaccctaagccaccccccatgtgtacccactcacccaggtcgccccaagaaagaaccccgccactcgcacagagaggggtgcggcccttggatgcacgtccggacgatcctgggccagggaaagggcgtttatctcagctctgcgccgtgccccttccccccacgctcgaggacctttgccctgggccgccgggcccgcccccccacaggaacccgaagccctcgggcgcccgccacactctggggataataccttgaggccggtagttgggctgagaggtccgcaccgcgcccggttctgcgatcttccctgggagagaggttccccgcgcagtcccctcaggccgggatcccgtcccggagccgccgccgccgcgctccatcgggatgcgccggccgcacaggcgcactgccaagcccgccgcgccgcaccgaacccgcgcgcgtccgcatgcgcacgcgtcctcacgcagcacgcgcgcagggcgtgcacgtgcgataagcgcaccggttaccacgcacagcgcacgcaaggcgtgcacgtgcgataggcgcaccgcttccacgcacagcgcacgcagggcgtgcacgtgcgataggcgcaccggttctcacgcggcgcgcgcttgtagcgtgtgcatgcaatgtgcacaacagtcctcacacagcgcgtacgggcgtgcacgcgtccttacacgctgctgtacacagtgcacacacagaaggcgtgcgtacgcacacagttcttcatacgatgcttacatgcaacatgcacacacaacgtgcacacccagcgtaaatgcatcttctcacagtagcagatacacactcaaagcgtgtgtagatgtagggtgcagtttctcagacaccgtgcacacacatcctcactcaatgtgtgaacacagagcacataacgcgcacacacgtgctcactcagcacgcacacgcttacactcactgggtgtctgcatgcaaactcagcaatgcagccttgggaacaatttctggctaggcccccaggtgggtgccagttgggccagtgacatctgtgcagacgccagaggacc

SEQ ID NO: 9150 - DNA, 455 bp, artificial
  synthetic oligonucleotide
aaagaagaggccaagaaactaacctgtggccaggtcctatagctagttagtggccaagccagtaggtgatcagattaagtgggaaattcttaactgagatgaaagggctcactatggacaatttgtgcaaacagttagagaagagagacaccaatgtcacaggagtaaactccaaataaaaagttacaccaggagggtttaaacaactggaagtggtgtaggccacagaaaggctcttggtccccacatttatggagacttagaagttctgtgaaaaggatgccaaggggttgtccgctctctacacggtgggggggggagcgggtagcaagaggagacatgtttctatcaacataaagagcttcctgacccaggaggtgaagggtacccctccagccccagagaatgttgagcggagatccagtgcctgtcctggaaaaagtgaacacccatct

SEQ ID NO: 9151 - DNA, 1301 bp, artificial
  synthetic oligonucleotide
agaaaaatgctaaaaaggctgcctggcgaggagcctaaagaggccttcctgatttctacctgcagtttgtaatttgttccaggaaaaaaaaaaaaaaaaaaaaaggcaatcacctaataggtagttcgaaaagcacctgagtaggaaaatatttacggggtaggtttctctcccatttctttccctcgagacctaccaacaggacagtcctgacagcgactggcccagtttcccaatacaacccagagaagcacaggagatgcgccaattttcaggagacgcttctaaaaagacaagttttactttacaatgcaggataatgagcagccttcactactcattctcgacgttaacagaggaagatgccgctgcgcggcaggagcgcctcaccaggacaaagcggggtacgggggggtcctcggttcaggccccgcaggcgacgcgtccagggccgcctcgaggacaagggcaccgtccccggacaccgccttcccggcccccgccctcttaacagatgcagggaaccgcggggaccgcaacctgcccgacgacggcggaggatcagggtcgcggcagcaggtgcccgggtcgccgtgcctgtcgagggacctcaggggcgccgggcagctgtcccctggaaacccgcgccgggtcgccgcgcccaagggaaggcgctgaccgagggacctacggggcgcagaggagctgtcccaacagaacccgagtcggaccgccgcatcctccccgctgccccatccgccaccccgagaaccgcccctcctgggtggcggacacgccctccctgcgggcccaggcctcctcgccccgcctccccccgagccgctcacccggccgggaagcccccgccgccgccgccgccgccgccgccgccgccgccgccgccgccgccgccggcccctcgggcctcgcccctcactctgccgccgcctcccacagcagcgacaccccagccacctctgccgggccgcgggacccggaaccacttccttccggaaccgcctcgccccgcccccaccccggccccgcccactgctcgcggcctcgcactgggcccgttctccagccgacccctatcctctactctcccggcgagggtgccccgcccgggcttctcggaccagagcgctgcgccccctgccggccgttcccactgcggccgctctgtccagggcgcctgcgccctctgccacccgcccgccgggtccggctagagcgcctgcgccctctgccgccctctcgccggaaaggaggggacctaatgggcgttccaggtccaggga

SEQ ID NO: 9152 - DNA, 1032 bp, artificial
  synthetic oligonucleotide
ttttataagtacctaacacaatataaagttgccatactacctgtgtgcatgcatttctttcttaccataagtggaatgctaaatatgtttggaaaacctgacctatagagattgtacacagtacaagacaggccatctacccaaatttattacctgcttagcaatgaatcaagtgcacttgccccccttatcatgaactcacttaaggaaaaggctgccctctcttttaaagatatggacaagaaaactgaatgtactaagatttttcacatccagtcatgaaaaaccaagttcttatcaaccttcacattttaattttgaaagctctgtctttgtaagcacagaacagtgctttaaacactgtttaaacagaggtgctatccaaggctataagtctcaaacaaaattaaaataatgctctcacaaactggcaagtaacttatttaagcagaaagagcaacaacattttattttattacaaataaacatttcacaaaaatgtaattgggaatgtatatgtactgttaagcagaacacagaaaacataaagaaataaggtattggggcctaaaaatttcatttaaaaatcccatccatttgctcttacacatagtaggtatgcaatacatatcaactgaactaaaagtaaacactctataagatgtgcttgcaaaatgtgtaatgctgtagtagtaaagtacaattttcaaatatgagattttgtttgtcagatttttaaaaagcctttaaaaatatgatatgcacaagcttgccctgagggaaaaataagatggactatagattacaaaatctttacatattttccacaatagcattttgaaattggaaaagagcaaatagttgtggaaaaaaactgaatgaacatattactaaaaattcagtgcactcacaactacctgatggaatatttgaagcaccttgtctcttgccttcttataatatgaaatgtatgaattatataggccttgatcttcagaaacttaagaaaacttcgagttataagccaaaatg

SEQ ID NO: 9153 - DNA, 1984 bp, artificial
  synthetic oligonucleotide
gccaatgaactaaatcatcttatgggccaaagcaaaacaagagtgagctaagtgttctgtccccagcagaggaggaggatttcatgcccctcattcattcattcaacaaatatttaggtcctgctctgtgccacacaccaaaagtgctgagcaaactatgcaacactgtgctgtccctatggtcacagagcttacagtagaggagataactgttacgcacaaatatgtaatactgctacgaaaaaaaaaggtgttgtatgagaaaatggaacaggaaccaatttagactacaggtgggagagaagggcactgtgaaaaaagtgacatttaagccaaggggacaacagatcaccactacttagaaaaggaaaaccttttttggcaaatgaccacaaatgggattttaactttgcctgtcaacaacggactgggttaaacctcctcttttccaatccttcaggctttctgaacatcctgactagtgtactggaatcctattacctgaacacagaaaggtctcactttattatgatttattattatctgcagccttcctatgcctggcctaggaacatccaaaaataatctgccagaggctgaaaaacagaagctggctgtcagcaagaacattacctgggtagaccaaacatttaatagcccaagtaatcataagtgccttgccaataaagtggcagcttctctgggcagcaaggtggttccaatgctccggggtctaaatcaaatgggacccagggggttcaaaggttagttggctacttcgaactgatgtttactcagtaaatcaaagaccggatcaccatttccaggtcccagaccctgaagacttaaaggacagtatgggaagtggccttttagcatcacggagcagagagctcgccaggctggaggaaggcagcagcgaaagggtcggggccgggaggaaggggggcgcaaggagaggagcgtcaggtgctctggaccccgggactgcgagccagaccaggaactggggcgtttcccgccccaccccccaacccctgtcaacccccagcaaaggcaacccagccccctccaagaccccgaggttccagcttcccccgagacaggaccaggaagacaccagcagccccgcgcagggccggagcccaccaggtccgggtgcccgtgtccgcagcgcagaggagggcgcgctcgggtgcaaaaatggccaagacaaaactctccccgcccacccgaaaaaccaaccacaccccctgcatccctcagcccgagccgcccggggccagcccccgtgatcgtctgctcaggcccccgcgggttcccgtcggcgccgcgcgcgggctcggcgggcacacgggcgcaagtgggagtgaatgggggtgcgcgaggcaggcgagggcgcccaccgcggtgtcccccgtccggaccctgcccccggggcgccctcccgggctccgcggttctgggactggcgcgccgccctcaaggctgaagtggacgcccggacgcgggcggcccccactcacccattggcgtcgagccgggccgggccgccgaggcagcgtgaaagttggcggaggcgggcgtgggggttggggcgccgggatcggggcgctgggatccaggcgcgagggtccggacgcggcggcggctgggccggcttcttcctcagtggcggcggcggcggctcagcgccgcccgctgctgcctctgctgctgctgccgctgctgccccggggcgactcctgctgctgctgttgcatcgcggcccaatgcgcccggctgcgccgggtttcctgctccccgcgagtggaaattgcgaaaaaaaaaaaaaaaaaaaaaaaaaaaaaaaaaaaaaaaaaaaaaaaaacagcgccgcccagcccagcgcccggcagccgcggccgcgccgcccgctctcccctcctcctcagcgctgccgcgaggctcctgcagctccgcctgccggggacgcgcggccgcc

SEQ ID NO: 9154 - DNA, 1546 bp, artificial
  synthetic oligonucleotide
cctccgcaaaaggactgtggcaaacagaagactgatggatgaaattgtcactcatgagaaagacctcaaaaatatgctttgttttttaggattacttcaacatttgaatcccgacaatcacaaagtatcagaaaacaaagtcctctcttcagcaaattcaccagttctgacaacttaacacttaaaatatatccacagccatgtgattggcaaaaatgcgatggtatgatatggcagaaactgatcattctctctagtacccattatccccttcctcttttaaaaaatacagatgcttctcaactaaccacagggctacatctgcataaacccatcgtgagttgaaaatatcctaagttgtaaatgcacttttgacttaggatattttcaactcacgatgggtttatggggacatgatgaggaatgtgctgaatgcatgtcatttttccaccactgtaaaatcagaaaaccattcaatcaacccattataagtcagggactgtctgtagaacccatcccttcccctacggtagacagaataatgctccccaatccccacaaagtatgtccatgccctaattccccgaacctgtgaatatgccacctaaagtggctaaagggacttcacagatttgattaaggatcttgacatgaggacagtatcctggattaactggctgatcccagtgtaatcacacggatctttaaaagatggaagagccggaaaaggaaatgagatgaagggaggaggggtcagggtgatgtgaggaagaggccagaagccaaggcatgcagttgacctctagaagctgcaaaaggtaaggaaaggaatcctcccctagagcctccagaaggcactcagccctgcccacccattctggacttctgatttcacaaactagaatacaataaattatgctgtttgcagccattacatttgtggtaatttattacagcaggaataggaaattaatactcctctgccttcagattttgctgggcacatggttacacagctggagcctgtttcctcagactcacctgcagctgggtgtgagactgtagctaagttctttgcaatggggtgtgggtggaagtgatgtaagcagtttccatgtcatgtccttaacgaagagaagctactccccgtctacttccctctgccatgggctgaaaggtggacacagtgctggtgagccagctccgaccatgtccacaagagagaaggaatctgagcaaagcaattcactcaccctgaccagtccagtggtcaggaggcagtagcctgagaaggaaacagctatgctgtcttggggtctctgtgatggcagtttagcctatatcccaatatatctgggataccaaatattggcgagaacagggagtagcagagatgtttacactctaggaacacatattttgaaaatcaattaggcattctcttctaaagctgaatattcatatactctctccttccatgaatatgttatcttcttcattcattagtttgttcattcactcagttcttgagaacatatactggcac

SEQ ID NO: 9155 - DNA, 1013 bp, artificial
  synthetic oligonucleotide
ttataatcaattcctagaaatggaattactgatacagtagatataaaactatacacaaatatttctatacaaagataattattgcagctttattttcaagggcaaaaaaagatgggaaacaatgtctgccatgaagtggctagttaaatagattgtggtatattcttacaatgagatttaaaatgttctcagaagagatataatacttttggggaagtgctcataatatattaagtggacaagggatcaatatagcagatacaatgtaccagtatgtctaagtctaatatagagaatgccttggggatcttgctaaactgcagattctgcatttctaacaggctccaggtgatgggattgtccttctccatattttacaatcagaaatgttttcttaagttttaaataaaactttaggccaagcatggtggctcatgtctgcaatctcagcactttgggaggccaaggtgggaggatcgcttaagtacaagagttctagaccagcctaggcaacatagtgaaacccgtctaaacaacaacaacaacaaattagccaagcatagtggcatgcacctgtggtcccagctgctcagaaggctgaggtgggaggatcacttgagcccaggaggtcgagactgcagtgagccatgattgtaccactgtactctagtctgggtgacagagtgggactcggtcacaaaaaaaaaaaaacaactcatatgaaacatccagaaaaggcagatctagagagacagcagacagcaggcagtgaagctgggagtgggaatgggaattaacaataaatgggcatgaaggatgtggatgttattggggtgatgaaaatgttctaaagcattttatgatgatggttgcataactgggtatgtttactaaaaaccattgagctatattcttgaaatgggtgaattacatgatatttaaaatgtgcctcaataaagttactttctgaaggatttttttaaatgaccaggcagattttttaaactatcaca

SEQ ID NO: 9156 - DNA, 1263 bp, artificial
  synthetic oligonucleotide
ctcagtacaatgaactatttatctggcctgacaaggccaatcaatctacccccgctgtttattataaggggtagcagaatactggtagtcttgactggtgggggagggccagaggcagccctgggcctggtacacaatgcttcccttcagctggaaatttatgttacgcccaggtgacccaggaggtcagggtgaagcctcggacagaatgaagatgatttgttatagacttcatatttacagaatgcctccatgtactcaggtcccacaaccaccggcagattccacatataaaatgcctcagaatgaaaggttggccataaccaggctgcaggtccaaggcagaaagctttcaaaatggaatgtaaggcagtaagccatccctctgcattccaatttttggtgaatgaaaaattccataggggaactcagaggccagattttcagtggtgaagagataatcatctgaaaaattctattccttcgttgatttaaagttctcaggtaattttactaaactcatccaaatagttacctcaattccttaccttaattaattccttatcttgttaaattaattaattactttaaatctcttactgacttgacaaaaaccatggctggccaaagaggccttgccgctggtcaacatgcgtgcaattgccgtgcccgcggacccaagaggcaggtggaggaatgggagggctccttctcattggtttgaaagtgcagaaagaacacacactgaactctacctcaccaaatccaatgaatgcaggtctcaggagtttgagagcttacttgcaagaatgcaggaggcacttttgggcaagactgtagttttacagcaaagggcacttaattcttaaaatgggaaatcccctgctttggtaggatgaatttaacaaaacgagaaaagaaagaaaatcctatagctgctaaccaacatgggcctccagccaatatttgatctgaataattcaaaaagggaaatgtaacccagggcagctggaggcagtagaggaagagacagaaaggaagagaggcacaaagctatgatcaatgggcagtttactggacaaattcttatcctgtctaaattttatgaaagattagctgttcttcctccccatggttatataaacttgccttctttttttctggttaatggaaccctttgctaatctagttcctgtgcctgctttcaaacagctctctatttctctttaaggaagtaataagcccactaaaagctggcagcca

SEQ ID NO: 9157 - DNA, 1267 bp, artificial
  synthetic oligonucleotide
actaagatccaactcaggccttgtgaaaataagcaccatatacaatggtgcaatgtgattgaacccaaagctatcctcagagcctagtgtactgtgtggagcttgcacagttccagcattctatactgtgtgaattataaactcctctgcaacatgagcaaacttcagtgggcaccgattatacggactctgacttttacaaaggtacttaaggattcatgtcagcaatgcaaaaaaaaaaaaaaaaaaaaaagaagtcagacttggccaggcacagtggctcacgcctgtaatcccagcactttgggaggccgaggctgggggatgacttgaggtcaggagttcaagaccagcctgaccaacatggcgaaatcccgtctctactaaaaatacaaaaattggccgggcatggtggcaggtgcctgtagtcccagctactcaggaggctgaggcaggagaatggcttgaacccgggaggcgaaagttgcagtgagccgagatcatgccactgtactccagcctaggggatagagcgagactctgcctccaagaaaaaaaaaaaaaaaaaaaaaaaaagacttatatgtgccttatgcagagagtttggaactctgaatgcattattcccatagaagcaaagttataaatggtgattaagttcccagactgacccacaatgcagctaaaataagtcatatctgcaatattatcaacaactaaaaactgaaaaataatgagaataaaagacatttttatttatcaaaaatacttatgctcagtgacataccaagcgggggcagtctgtgcccaggcaagaagggggctgcctgtagagaattcacaaacaataatgaaacaacaatgaagccaaaaagttagttggctttttactttcgccacctgctgacaattgaaaacaacattggtaataaaatattgctcctttgaggaaaaatgggttcaacaaaaagtgaagaagaagtagataagggtacttggagctattaggcaggagattttggcatacatacctacagggatttcagtgtgattctttattttgtccaaattaatatctatatctagagtcatgcctatgggagtccttttttttttttaatcctcattaacaataatcctggtccataggggtatcacagatagaacaaggatcaggacacagattatatgagttcaaagagcaattcttaggcgaaaaagcaaaagggctaaaaaaatccataagtaatgtgagaagccgtgggtc

SEQ ID NO: 9158 - DNA, 1494 bp, artificial
  synthetic oligonucleotide
agaattatcctaaacgtccttcaatcagggaactggttaattaagccataggtgtatctccacacaaactagcaaagagaagcatagctctaaatgaactgatacggcaagatttccaagattctcgtcaacttaatacaaaaattgcaatatagcctgaacagtatgatcccatctgtgtttttaaaaaatgccaagatgtatgtaccactatgtgtttgaaattgacatctttatgatcaaatgactatctgcatctgcttatggttcctcctaatatctacacagagatctgtagggatgaccatgaaccaagtctcttccaggaagtatgactcagggaagggatttgatgtgactctttacaccatgacttgactctgttaattttttacactaaacatgtattatttttatagtaagtctaagaaaagttaggatgagtctaaaagaaaaggtcaaactagaaaatgttttaaaagagcagagaggtgtaaacaacccaatagcacaaaagctgccctactgagcagatgattgtgtggggatcagaaaaacaacaaatcagtcccctcttggtggggtggggaataagcatcatccagaaaagggcagattattaagcagatgtcccccgccgaccccaccaaacaaacaggttagtaatgcacgtcctatctatttattcgaagcagataaagacttttctctttatttaaacaaatcccactttccttgtaaatacaggaaaggtgcaaaggtgtatttttttaaaagagggggttatatctcacccagacttcattttccaaactgatccatacctttcctccccctctcagagggcagaaagtgagtgtcatgaaaagtgtaaacttagaagttataaatctagaaagtgtcagtctaaaaatcctgaggcgaaaaaaaatgaatgaagattcatttgcagaatagagaaagagcagagaaaaatagagaaagtagggaaaaataaatccacattaatctccccaacaataatttttgtcagcatttaaatattgtattcagcacttaattgtctttacctcaaagggctttattataaaattttctatatattacgtatatctctttttgcaagacgaaacttcccggcaggcaggaattcggtttttctaatggtctgccgcagagatcagcaaactattactgtaaagggccagagagtcaatgtttcaggctttgtgagccatatggcctctgtagcaactactcaactctgccattgtagtggtgaaaacaaccatagaccacacataaatgaatgggtgtgcctgtgtgccaataaaacttgacttacaaaaacagccagtgccaggtttggcccatgggccatcgtttgctgacttctggtttataggaagaagtgttaagagtccaaatcagaaaccagggaatatttttttaaaaaggaagaacaagagacatggctaaggttgaatcatcagc

SEQ ID NO: 9159 - DNA, 1723 bp, artificial
  synthetic oligonucleotide
atttttttttcaggagtaactaaatgaaaattgtaatactgttcctttctcttacttgggaaaggtgttttgagaatttttaaaacgctaaaaaaatgttaagacagcttttaaagcttttttaaaattgaagtataatttacataaatgcagaacttaacaatacaagctgattagttttgacaaacgcccattgtagccaacacctctattaacataaaaagcatttccatcactccagaaagttccctgtgccccttcctagtcaatccacctccaagcaatcattaatctgatttctatcacctttgattcattttacttcttctagaacttcatataaatgtgctgagacataatttaactttttaaatatcgctgaaaataatacaaattatttctggtaaacatgtttttctatcagtagaactggtgaaaaaaaaatatatctttaaggggggcatttcctgaaggcataaacacctacactattttcaatctcagaggatgtgggaaagctggctatgccaaatataaacaagcattatctaggtcctaaatggctggaccaatattttcccctaattcttgtgtagttcattgtatgattacctctttctggctgggccagaacattccattcacatagggaagctgattttcattccctcccctcactcttctgagaacaaggctattctacatgagaggcggccctcgaagagaaatctgtagagtaattggaagggaagtcatttaagaaaacatatacaatttctatttaagacttaggccaactgcccaacaagacagagcaacatccatgatttttcatcagagtggaaagggtttctggtagagctttcggaaacttccttcagcagtgcttgataatcctgtccttcaaaaacagccacaggtccccaaattcctaagtgagtccaatactaaggtctttctatcattccaattaaaaaatatgaacaaatggtaacacaagccagcaagataacctttctgatgaatcaagatcctcaagttttctcccattgctatttccaggtgagaaaatggttatggggatatgttcacctgggaaacctccagattaggaatctttaaacaggcgctcctttgaaagttcagtgtggccagcactataactttgatctcaaccccatttcattgcatccaccagcacctgctttctatactctacacctaaagtattaggggaggtctgcattaggggaggtcccaaagtttcacaggtcctcccctaatgcagagcaaggctctactaacaccatgtcctccttcctccagcacctaacacaaataccactcaccatctgcatcttcagttgaaacctcacctattctacaaagcatcttcttcaccctctgtgactactcctatttttaaattcctctctcgttcgtcaatgccatcatttgccactctggtaacatcttgggttgatagttaccttagctgtgtatatcttgccctccctcactagactgagcatgtttcaagggacaggttctgttcaatcaatccccaaatctcaataaacacagtttctctcagagtgtaagcactgaaatatttgataaatcccacagctatgcaaatctattataaatacctttaaacttgcaaatatgctacttttatatgattgcagcctgttttgcatgctgatgattcaaatctaat

SEQ ID NO: 9160 - DNA, 1472 bp, artificial
  synthetic oligonucleotide
gcaatagcaacccttcccacccaccttgttgcctccccacccagtcagtaccacatactgtacctccaatctctatgactcatgtcaattagcaattagcaatgaaagtaacatttcctaaagggaaactgtaaagctaaaagccatttaaacaaatgagcaattaaagaaaccacacaaaattataactgccaaagaattcaatctttttggatggcttcacaaggaataaatgcatgcagacatgtttctctaggaaagcattaaaccaaacttgacattaagacggtttcactagcaagacgatcatgtttgttaaagagggaaaggaagccgtcctcccagaggccagaatcccccaaacctacagcccttcttctctcctttaaacaccagtgttttcccaaagctgaatccctttccaaagaagaacactggggacatgacactcttcctttgatcttctgtggcatgtgtttggaagtcataaaatagttattagcaagacaacatggacacttacctccccagattcttttttcccaaggctctgcccacaatcatgttcctaaaaggaagagcctatttgtgtctagttaatttctgggtgtattcttcctttgatggtcagtatatcaattatgccatcaaagggcaggattcaaagaatattttatggaatactaaactctgtcattaacctgtctctgaaagcctctagatgtgtagaatagctcctgaacatttactacataactcctgatcataaccatgcccttgaaatgaaagtacgccatcaaatgttgttctctattagccaattgtgcattatcttcctacaggtaaggtggcctcctagtccataagaatgatacaccaaatacttgctcacataaaatctcataaaatgtggaagtcattcaaataaggaagtctcagtgcaggaagaaactgttaaatgaaaacagacaaaatatagaaaggtcattataaactgctaacacgtttcagaatcaaatccttaaaacaatggttttgtttgttgttgttgtcattttccataaaatggtatttttaagccaaaagggtgggggaggaggaaggtccccagtgtacattttaattaactgaaaaccagcatttgtgagcaaaaacacaggaccgaatggggaacagcccacaacaagggggtcggctgcaattcacaggaaggattagagtgtgtaaacatcaagaaccctcccccattagctatccatctatccatttgtgtgtttatctgttcattgtttttgcaaatatccctgctggagatataattttggagtctaaatattgtgtcatttcccccttaacatgttctcattttgccgtatggattctttctatgtgataaatgacttgtatattcctttctggcttggaaagagccattcaagggtgaaataaagaaaccattagtggaaagaaac

SEQ ID NO: 9161 - DNA, 1447 bp, artificial
  synthetic oligonucleotide
cacaagcagatcccaaccagaattggattagcacaaaacagtatcttcattcatccagtccacaaatatttactgagggccaactatcatttgacaactattttcataaactgtaaatggtgactaacacagacaaggtcccaaattatggcacttactttctagtggctgacatttaagacttggtgatatgaaacaaacagctaacacagatatagcaaaattcaattgtacttcttgcagtttgaaatttgccataataaaaaattaaagaggccaggcatggtggctcatgcctgtaatcccagcactttggaaggctgagggaggtggatcaccggaggtcaggagttcaagaccagcctggccaacatggtgaaaccccgtctctactaaaaatacaaaaatcagccgggcgtggtggcccacacctataatcccagctactcgggaggctgaggcagaagaattgcttgaacccgggaggcagaggttgcagtgagccaagatcatgccactgcactccagcctgggtgacagagcaagaccctgcctcaaataaataaataaataaataaataaataaatagaaataaccctggaaaatgtactgtcatttataggtactctttctactctaataacaataaggacaacaataataataactaacgttaatcaagtgattactatgtgccaggcacttctctaaccattacatgttacttaatcctcacaacaaccctctggggtagattctcttgttactctaattttacagatgaggaatcaaaagcactgagtggttaagtaacttgtcccaggaagaggcagagttgaagtctgaacctgggctatctgtcctccatgtttaataaccactatacttttttttttttttttccagagtctcgctctgtcgcccaggctggagtacagtggcgcaatctcagctcattgcaacctccacctcccgggttcaagcgattctcctgcctcaggcttccaagtagctgggactacaggcgcatgctaccatgcccagctaattttttgaatttttagtagagactgggtttcacagtgttagccaggatggtctccatttcctgaactcatgatccacctgccttggctgggattataggcgtgagccaccacacccggccaaccactatactcttaacacaatttgaaaaccttctgggaatatgattcttggtgacaatctggctgcaactaaatatttcttagaaaatacgctaggctgagtgttttagaaagttcacatcaaacatatataaaacagaaagcagcacccaacatgacaaagaataatcctgtaatactggttcactgtttctgtttccctttccctaccaactcccctcctccttccttactttttccagatcaggaaacaaaactgagacactctgaggagaga

SEQ ID NO: 9162 - DNA, 2447 bp, artificial
  synthetic oligonucleotide
cgcacacataaaatagtagttatttttatgacatactgctggaggccaaaggttgttgaaggccatcagcccagaggggtgattccggccagctaaggcccttcccatccaccctggagagctgaagaaatcaccaccctaccctcacagcacataggtgaggaaatgctacagaagtaacctttgagttcagatgtcattaagaaatgaggggaaaaaacaaaaacaaaaacaaaaaaaccttaaaccaaatctcagtccctagtaagagaacaggacttccacaggtgttcagtgtcacgaaggcaggaatcaggaaggcccatggggattttcatagaagacaaccaagggcagaagccctaaaggcctctgtgtgctcagcctgttttcctcttagaaaaagatgtttctagggctaggcgcagtggctcacgtctgtaatctaagcactttgggaggccaaggtgggtggatcacaaggtcaggagttcatgaccagcctgaccaacatggtgaatccccgtctctactaaaaatacaaaaattagccgggcgtggtggcacacacatgtaatcccagctactcagaaggctgaggtaggagaatcgcttgaacccaggaggtggaggttgcagtgagccgagattttgccactgtactccagcctgggtgacagactgcgagactctgtctcaaaaaaaaaaaaaaaaaaaaaaaaacagtttctatctggagcctcttcagagaacagcacccaacagatgctgccatgctggcccaactccagggtgaccattcatatttggtacttcctagagttgtggaacatggctatatagtttgtatacaaaaaaataccagaattatttattgatttcataatttcctttgcaacatatgcaatctaaagtcttctaaaaaatgtttatgctttagccttttttctaattgtggaatgaaagaatttctactcccataagtccacttcaagggtcagtaattggccgggtgcagtggttcacgcctgtaatcccagcactttgggaggctgaggtgagcggatcacttgagtctaggagtttgagaccaacctggacaacatggcaaaaccccatctctacaaaaaattagccagatgtggtggtatgcctgtagtcccacctacttgggaagctgaggtaggaggatcacctgagcccagaaggtcaaggctgcagtgagctgcgatcacaccaccacactccagcctgggtgacaagagtgagaccctgtcttaaaaaacgaacaaaaaaaaaaaaaatcgggcaggagcggtgactcacgcctgtaatcccagcactttgggaggccgaggagggcagatcacctgaggtcaggagtttgagaccagcctggccaacatggcaaaaccccatccctactaaaaatacaaaaattatctggatgtggtagcgggcacctgtaatcccagctactcgggaggccgaggcaggagaattgcttgaacccaggaggcggagattgcagtaagccaagatcgtgccactgcactccagcctgggcaacagagccagactctgtctcaaaacaaaacaaaacgaaacaaaacaaaaaccaaaaaacagtaatcatgtgaaaaggagatccttatatagacaggaccttcccaatgtcctcgtaagatggctttaagtattccaagagacgttaactatatataagggcatgtgaacaagtcatacacaaaatccaaattattaagctagcacttttacatttttttcctgtccatttaaatataatcaagtatgtggttgggtgcagtggctcacacctgaaatcccaacaccttgggaggccaaggtgggcagatcacttgagctcaggagtttgagactagcctggccaacataaaccccagctccactaaaaatacaaaaattagccgggtgtggtggcgcatgcctataatcccagctatttgaaaagctgaggcatgagaatcacttgaacccaggaggcagaagttgcagtgagccgagatggtgccactgtactccagcctgggcgacagagtgagactttgtctcaaaaaaaataaataaatacaattaaaaaaatataaatagatataatcaagaatgtaaacttatgtaacaacattttcacagaaacttctcattttgtgggaaagttgctagggaccttgctaggtcatttacattgagatgaccgcttaatcggaaatcttaaaagctgtttctaatggcaccttcagctcatccatagcacattgctgaatatatagtctactcctccaggatgagcatcctatagctgagtttttaccttcatttatggtttagagaactgcattgactctgcatccaaatacatgcttttcttccattaaaaggatggtagctatgagagaaaatcattt

SEQ ID NO: 9163 - DNA, 1765 bp, artificial
  synthetic oligonucleotide
ttggtggctcctgaggttcttctgaccctaggatgttacaaacattatcaatgataacagaaaaacttatgaaggaagctgggagtagaatttctttgaccctaactcttggaattaggtttcttcaaaactcaacttgaaactcacctttaagaaactgactatgatgaatgccttatcttttctctaatgctcagtacagtgttaatttgcaattaatgatattcaattcaataaacatctattaaatgcaaaatatatttaagctctgtaagcaccaaaccttaaacatgcagatgcagagaacatgatctctaaccccagggagcttagagatgtatgggaaagacagacatacaatattacgcaaggtcctttgggtaacagggatcaaatgagtgctctagtaccaaaagaggagagaaccattaacagtttttgcaataatctgaaatctttacatgtgtgaatggtttgcttagctgaggactggtcttccttccacattcatttcaggtcatctgatacagaactatgcccacaaaaggcattcaaaaaaaaactatctttttttgcagggagacagagtcacactctcattgtctaggctggagtgcagtggcatgatctcggctcactgcagccttgacttcttgggttcaagagatcctcccacatcagcctcctgagtagcttggactacaggcacatgccaccatgcctggctaatttttcatatttttagtagagatggggtttcgccgtgctgcccaggctggtcttgaactcctgggctcaagggatccatctgcctcggcctcccaaagtgctgggattacaggtgcgagctaccacacctgggctcaaactttctaaacagtgtaaatccatgcttcatcttagtcttatgcaaataataacccaagaaccttttttgcttcacatgtgagaaaaacaatatagaaaatgttaatgagcaaaagcccatccagaataactttggttttttttgtggtttttttgtttgtttttgtttttgcttttgttttgagacgcagtctcactctgtcgcccaggctggagtgcagtggcgtgatctcggctcactgcaacctccgcctccctggttcaagcaattctcctgcctcagcctcccaagtagctgggattacaggcatgtactgccacacccggctaatttttatatttttagtagagacagggtttcaccatgttggccaggctggtctcgaattcctggactcaggtgattcgcccaccttggcctcccaaagtgctgggattataggtgtgagccaccgagcccggcccagaataactttagatcccatacacccctacgggagaaaatggtacataatgacattgtatgtctcatatttccccttggtgatgactggcttggatggcccatctatattctgcttcttaaggaaaacactaacagtgctactcattgcataattcaaagaagagaagggaagcatgaagggagaacacaatatgtctaattgttctgattggtacaagaataaacacaaggtccatggatgagataagtacagtcaaaagagaaaactgccagtgtgatttagtgctactagcagaagtagaaaaaaaaaaaaaaaaaaaaaacaagaaaaatagccaaagaaaagagtctgctataagacagaaagtgggcacagggtcaggatgcctggagtgggatagagatttacagagaagcaaggcatttttttcc

SEQ ID NO: 9164 - DNA, 1664 bp, artificial
  synthetic oligonucleotide
cttaggcatcaatatagtcacaggaaatcaccgggtgggggtggagaatgtgtataaataaatgtcaattatcaaactttacaaataaggggccactgaatgttgtgttctaccaaaaaaagggggtttcataggaatctggatcccattttgtagccattttaaaacagggcctggaattacctgatactcctcccagtaagaggtgaggtctacatccccttgccaggaatgtgggtgggcctgtgactgcttcaatcagtggcaggaatgataccacataacttccaaagctgagtcataaaagtccctgtagtttatgctttatttgctggaatactgaacttccatgtaagaagtcaactaccctggagaggccacatacagatgctccagcctatagccccagctgagcccagccttccaggcacccttgccaaggggagccagacacgtgagggaaacattcatcttcaaagtggatcctccagcttcagctagttcagtattcccagctgaggtcccagatatgacggagcagagacaagccagcccagccatggtctgttcttgacccacagaatccatgaacataagaaggctgttgttttatgccaccaaatttggggtccttcaagtattacattttttcaaatgtaccacttagcacttagcctttacccacatggactgcagctgctcccttacctggggtttcctcattggtgccagtggcctcaggcatgtaagagcacttgagaaatagctaaagcacaaaccagtcaaaagtactcctcttatgtatggactgggctgagttcttaacaaactctttacatgaccagttccaaagatgggtgcttggtactagaaatctcaattacacaacctcagagaacaaaagaagttaaaaaaaatatccaccaaacacatcctttacttaattcctcttaatgactcactacaaattaatcaccacatctcatttctgtcaatttcatatctgatttttttttggtaaaataatcaaacgcaaggaaagttgacgagggagaaaatatgaatatctatctccccattacaaagcagttcccacgatcattcaggcaggataaatgagcagtaatctataaacattaaatgccatcctgctttgccccacagagacccatcataaactttggtaaaattgttttaaaagggtaagaatttgcctaccatgctacaatctactcacctaacaataatgaagtcggtatcattcctagagacacagaaagaactgacaatcctattatactgaagaatccaatcttagctacattctagactgcctgagccttggactcctcaactaatctccacggtctctgatcaattaccaaggcctacagggaaaggggtcttcagagaaaagtaaataaatagcttgcttcaatttcagcacaataaaatatatgggcagaaccactaggtggcaaaatgaaactgctcaatgcaaacaaggatgggggcggagcaaaagatgtaattaacatcccatttcaggacttaatctctaataattctcaactatgccaaagggaatgggaaaggaatttggggtcaagtttttcctcttaacttggtgggccaaaagaacttaaaaatcacttcttaataag

SEQ ID NO: 9165 - DNA, 1061 bp, artificial
  synthetic oligonucleotide
taatctctgggataagattataggtagatttttccttccttttaaagtttacttttattttattttcttgagatggagtctcactctgtcacccaggctggagtgcagtggcgtaatcttggctcactgcaacctctgcctcctgggtttcagcaactctcctgtctcagcctcctgagtaagtgggattacaggtgcgtgccaccacatcaggctaatttttgtatttttagtagagacagggtttcaccatgttggccaggatggtcttgaattcctgaccgcaagtgatctggccaccttggcctcccaaagtgctaggattacaggcgtgagccaccatgcccggcctaaagtttactcttaataatagcaactagaggcttatctaattcaggcagctcatgttctctctcctttctctccaatagtattaccaaggtaaaagctgagattgcctggatcctgcctcacaaactctcctttaagaaccacccaggcagtaggtggcccacgaggtcatctctcccgggaactggtttgcaggccaggggtggagttatgaaccctagacttaaaaatccaggccaggtgtgctacatctaaacctgctgttcatcacccgtgtgaccttggccgggttacttaacctctctggaacttgagtgcttcatcaacaaaatgactggtgggctagcttcaacaggatcacctccgagaggcgttctatctagagctcctgttccataatttcaacatcagagaaatgttggagtctggggtgggcttggagtggagatggtcctgtgagttgtggcaaattctgggacatttcatcatctcctttgactccaaatttcatgtctctggccaatgttgtgaattccttcccttcccacttgacttgagcaaatgtaactcacccttttagcactcagagatccatctctcttcctcgtgtttcctgcaacacacccctgtatcgcaacccttatcacagcacttcatatttatatatgtacccagtaatcttccccacttattcttcagaatgggatttt

SEQ ID NO: 9166 - DNA, 1834 bp, artificial
  synthetic oligonucleotide
ccttcttattaatctaggcttaacgcttagccaccataccatgcctgaatcctttcattttgagattttattcaaaaagccagttccctccattacaacctagggttcatgagctgccaatcaaagcttgctctttgagtcctataaacataaagaacttcagctagggtcagaggccccaggctggggaatcatgactggtgcatttcctccatcatttcccccagtggcctttgaggaatacgcccatatccactaagcctccacttgcctatgaaaaatccacaggtgctaactgaagaagagtaaataggaattcaatgtacacatccaagtagggatgaatgggaatgaagagaatataatatttatactttaaagcacaaatatatccttttgttttaagtctgcaaatgaaatcacttcatataaaatgccaaacttcaagtcattgtgccgtaagcttcctgcaggcagtgaccatgtgcttttcattccagttgtatctttggtacctggcacagtgccgagcccataggggatagatgtctataaagagttgttgaatgaatgaacaactgtgtagtctgaaggcagtgaagatgatatatcctcaccacatcccccaaatacatacgaactctcaggcatgggatgtatggaccaaaggtgggacaagagatggtaatttaaacctttctgtaattctggaagtcacaaggctctctagaccttgaaaagttgggaagaatttggaaggaagacaaaaatgatgaaggatttacagagaagatagaggaggtaggattgaaaaacaaaatatagagatactaagagccaactaaacaggtcgtgggtataagaggggtgttggggtggggtgtgaagaggtgagagggagaagggaaagaaggtggtgttgacagagacgtctgtataacaataaaaaaagtcagctacttttaaaagtgtttcacccaaaaaggtgtcaatgcagttaggtttttcatactaagaggaaaaataggatgactcaaaccatacttccagactctagatatgagagaagaggttccaaggaagtgacattctttttcttctaaatgatgacaccttaggtgggatcagtgatgacatgaaaataggaagtgtcctgggaaacctgcaaaaggttaattccttggtttatctgggtagaggttataaggacttagactcactggaacaaggcaatgtgctatatggaaataaagagagagagagagagagagaaatcgaacttatacacaaacacaacttgtggaaggtgagcttggaggggacagaacaacctgtggcaaaagcaaaccatacatttccttttgacccacttccagaaaatttttacccaagtcaataattttagagcagcatcaagatttttctgcagtggcattcatttgagtgttgtttataatgaggaactggaaacaacataaatgcccaataacgatacattggctaaacgctcacatactcataggttagaaaaatgggcagccatgaaatgtgatgtcagggaagaatgtgtcatgactggggagaaaggcacacaacagaagaggagaaaagcaagtttcacaacgatgcgtactacgtaatcctattggtgaagaaataattttatatatacaaataatttttttttaaaaagctaaggctgtataacaaaaagttaacggttctttgcactggggagcaggattacagataactttcttctttatacattttgtagttcaaatttggtacaataaacgtgtaataggtttgcaataaaaagtcattcaaaaca

SEQ ID NO: 9167 - DNA, 2161 bp, artificial
  synthetic oligonucleotide
aatttgaacatcaaagaatccaatctgcattcttagatcattaggtcgtggggaatctctggaatcttcaagtttaacgcagaaatgcttataactgtcaaggggtacagggatgttttacgctgctcttgggaacctggcactcctgaccccaagcacactgaacccgaggctgctgaaaaggcaatatatccagggatgggaatggagggtatgaggtttccttccttatacactcccttcccttaattatgcccccacccaggaagaccaaggtgtttgggctccttaaatactcggagggaaataacagcctcaagtagcaaggatgagcacataggttaagaggaaggcagggggaggaagggaggaagagaaaggaagagacatttatttgtaatactatcaatgatcagtaatgtgattttttgtttttgcatcacttcttcggtattatcaactctcattctttgtggctgtgcaaatctattaatgtttagtagtttcactattaaactcaggaaagagacaaagcagcttttgagaaacacatccaacatcttcaggggccattaagggaccaccccctccacccctacccctgaacagtctcgcaatacagtaggcccctcattttcagctaaggatgagaaaacagttacatagtctaaggctgaactgttcatgtactacaaagataaagcggacaggcaaacatcagtttccttgggaaagaaaaagcaactccataaatgcaagaaagttccagtggctacacttcaacatgaccctcctcccattctcttggacctgaggaaggggttacaagtgagcaaggcaaatgacattatgtgaatacagtttaaacgataacacacacgggtaacccagtgcaggaaataatacaactttccctcccttgttttcatttgcattttacttttatttatttttgctttaataatgcatattctgttcacgcaaaaggtgcaaaggacagaaagcaggggtttaacttggctgatgaaaaatcaagcaggatgacatttctagtttcatgaacaacctaaaactaggagaaatagaaaagtcacagctggtaccacagagcacgcccaacttcacagctgtctcctcttaggacctttggctagggtgagagaagctttgaagacagtggcctctagtggacttggataagtggcagattttttttttttaatttttaatttttttgaatcatggtagctgcatcacaaaagctccaatcaagagggtggtaaaaagaaggcacagatcattgcaaataccagattttctctttctctttttgtaaatataccgtcatatataagctaaaatttctcttagggtggtggggtttgctggcagggaaagggacaggttgaacctacaattgcatatgtaatagaatcctaatggggggacaaagagcgaggcagctcttagcctgaagcaaaagaaaaggacactcgcttctgactacgtgtagtacaaacactagggaagtctgtgacaaaacacgattaaaaaatcataaaattataaagcttgtaaacgaataatctgaaattacattttattaatggaaaatatcatcaaaatagtaccactatggactaaactgcctgagttttcatttcgcattgagatctcagagtagaaaagcctttagcacaattttgctctgtgtaagtcacaacgagtgccagccccaggactaaaccctggggaagattctcctcttggatggaatttgtgttgtgctatcaagacttttgtgctaatctttcaaacagggacattttgaggcaaacctttaatcttttggcacaagattattttggctggggcagaaaatttgagtctcggactcaggatgaataatgtgacatttcattgatcaagtattcattttgattgtagagctttctttatgtcgttcacttccatctagaaagagaaaaataagaatggaacaaagtcataatgaatcggctggttttatagaagctgaaagattatcaacccggtcgactgaaagaaaacaatcaatctgacaattttaaaggtgacatgacatctgaatagacaatcaacagcaatgccagaagtgacatcaacacagaacaggcacaca

SEQ ID NO: 9168 - DNA, 9268 bp, artificial
  synthetic oligonucleotide
cttctgagatgaggaaagagttctgtaacttcactgtcccacctgggagttacttgtgcctacggagcatgcatttattcgtttatttagagacagggtctcgatctgtcacccaggctggagtgcagtggcataaacacaggtcaccgcagcatcgacctcccgggcttaagtgatcctcctgcctccacctcccaggtagctgggaccacaggcacatgggtgccaccacatcctgctttttttttttttttttttttgctcaggttggtcttgaactcctgtactcaagcaatcctcccgccttggccttccaaagggctgggattacaggcgtgagccactgcacctggcctatcaagcgccttaaatgccactagtgcaactaaggatcttaccatttttaccgtattctaatcagtttaactgtcaagagccacctgtggctagtggctaccaaattggacagagtggttttagaatttttacaaagaagccaaagtgagagctctgtatcttttttggtggaaacatcaaaaagcagtgagtgatggaggacgaatccaggagacagtggaggtgctcatctgtttagcccaggaacccacttactgtgtatgtactttctcaaacctctgaaagcaattctaatgcactgagaaatgatttactcaagaccaggacaaggttaaccaaagggagctcgtggtacagcccaacattctaggccacccaggccagagtgagccaaggtgacgtgtctgttgtgtggctccagaattgaaagcctgagatttgacgtctgcatcttcacagtcgacctgttagaagggccccccgtacacacacactccgccccagggaaagcaaaagccaccgcacacaaatctttcagaggtggcaccagcaggaaggagagtgttgtgcctcatggcaaaaggaacatttaaccgttcagagaagagtctgttcaaactccaattttggagcagaatgaatacaagttgagaaaacggagtggttctaggtgaagtggactcctgaacgacttttctaaaaagatgttgtgctgaagagtatactcagtgtggtcagaaatgtcaggagagtgctttcaatgggtccagctgccacttgtttaaacaagcctgactccccccctaccccgcccttccagctggggagaatttgctctgcaagaaaaacagatctgcgctgcctccagcagaggctgaatcctaatcatcctagcttactattacagcaaagcaacttcccatatcctatctcatcagcttttaggtttagggtaggcactgttaactccctttgaccagaaactgaggcacaaggactcccaggtaattactgtctcacatataatgcttctgaacgtcacccaggtgacagaggtttgtcaccaaaggtgctgtaagggaaaaaacgtcaagcaacaattcattccacaccgagagaaactcttgccaatccaaagtacgcttcttaaggctggattctcaggcacatttattatagtgagtttagagacctagagtcccactccagcaaaggtgccccctaacccgtgaatgctgtgcattatgggataaaatatacgtcacagggtggtggctcacactccaccgtcagtgttttggggacgagaattgaagtgtgcaaaagaacactgggtatttctaagtagaggcaacacacacacacgtaagacaccgatttccactcctggctgcaaaatggaatcgcctgggaagcatgacacttctaaggcctcgggtgcttatgtcattggtctggggtccgatctgggcacccagagttttaaaagctccccaggtgattctaatatgtagcctgcgttgggacccacggccgtaagagaccttccaggaatgagaaagcaaaagttggataacttgggagaaggggggcttggtagggtctgggttacaggctgtttcttgggttatctgatgtttaagatgcctgaagaatcaaagagtctaaatgcccgtggcctctattttcttatctgtaaaagggcacaatgttaaagactctaccctcccccaaaggcaggacggtcctgttggacggatcagggggtgagaggataggaggggggctaaggggagggggatgagaggaaggggactaggggaaggggaggtggactaaggggagggagactaaggggagaggggactaaggggaggggggcctgcgggaggggggactgggggagggggataaggggagggggataaggggagggggactagagacgagggggactgggggaggggagggggactagggggaggggagggggacgagggggaggggagggggacgagggggaggggagggggacgagggggagggggacgggggagaagggcgagggggcggggcgggtgccctggctcgtgtgagggtaggtgaactgggactgaggtggggacgaagccgctctcacctgcgtcgtagaaggcgtcgagcacggccgtctccccgaagtccagctccccgaagggcacggaggtgaggtgagcgccctcggcctcgcaggcccgcagcaggcactgccgcgccccagcctccgggccgccggccgcgccgccctgggagctctcactgcgcacgtatactgcccgcagagcccgccgcggcccgcccccactctcgccctcgccgctgccgcctgccgcgccctccgccgccccgtcgggctccgccggcccggccgcgccctccacccccggcggcggcgggcactgaggggactcgctcgccgccccgagggccccggccggagcattcccaccgccgctctccatgtgcccgcctgcgcgcccttcccctgggcgagtggccagcggctgcgatccgctaggaggcacaagttacagcagccgcgcaggcggtcccggcacctgctcctgaagcgcgggacgctacgggaatcgagggaacggagcgcaccggggaccccgcggcgggccgaagacggcagtacccctaggctgcagcctgacgctcaggccccaaggcccccagcgccctttgaaggccggagagaaagaggcgggggctggggacgtcagggcgagcgaggggcggggagggggccggggagggcggcggggcaggagcggggagggtgccccctgctgccccctccaggcagcgcccgcccgcagccgggagacgccgaacacgggaacaggaattggggttgtttttttttttgttttgttttttgttttttgttttggccatccctctagcctgaccaccattaggagctccaatttcttttttctcaaaacaacttgaagcattcgagcagggtaaaaactctttcaaagcatcggttggatggaaatgttctattcccaactcaatacagacgtattaatagttttcacccggcattgggatgaacggatgcttcatccctggttgccaagcgcacggccccccgtgagccctgtgccggaggcgagctcgtcctggctttcgccgtgaccttgacaaggcacagggaggcaccagcaacaaattttgtctggaagatagactccaagtacgctgcctgcctgacctttgaaaatgccgtgaactcaaaggggccctcactcggatcttaggcacttcacgaatttggacacaaatattaaaagaaaatagtgttaccactgagggtaataccattattcttattttttatcttttttgagacaaagtctgtcgctatcgcccaggctggagtgcagtggcgcgatctctgctctaggctcactacaacctctgcttctcggggctcaagcgatcctcccacctcagccttcagagtagctgggattacaggcacgcacctcaccatgtccggctaatttttttttttttttttttttttttgtatttttagtagagacggggtttcactatgttggccaggctgctgtcgaattcccgagttcaagcgacccgcccgcctcagcctctccaagtgctaggattacaggcgtgagccaccgcacctgggtcattgttttctaaaagatagaatgcaccggacgctgtcacagacttggaggtttttcttttttcaattgcaatattatttttaaactttatttttaattgacaaataattgtatatatttatggaatacaatctgttgtttttcatttaagttcaggggtatatgtgcaggtttgttacacaggtaaacttgtgtcattggggtgtgttgtatagattatttcatcacccaggcattaaggctagtacccattagttatttttcctgatcctctccttcctcccacccttcaccctctgataggccacagtgtgtgttgttcccctccatgtgtccatgtgttctcatcatttagctcccacttatgagtaagaacatggggcatttggttttctgtttctgcatttgtttgctaagaataatggcctccagctccatccatgttcctgcaaaggacatgatctcattcttttttatggctgcatagtattccatggtgtgtatgtaccacattttctttattcaatctaccattgatgagcatttagattgatttcatgtcttggctattgtgaatagtgctgcaatgaacatacacatgtatgtgtcaacagagtgaacaaacaacctacagaatgggagaaaatttttgcaaactatgcatctgacaaaggtctaatatccagcatctataaataacttaaatttacaagaaaacaacaaacagccccattaaaaagtgggcaaaggacatgaacagacactcttcaaaagaagacatacatgtggccaacaatcatatgaaagaaaagcctcaacatcactgatcattagagaaatgcaaatcaaaaccacaactagataccatctcacaccagtcagaatggctattattaaaaagtcaaaaaataacagatggtggcgaggctgtggaggaaaagaaacatttatacactgttagtgggagtggaaattagttcaaccattgtggaagacagtgtggcaattcctcaaagaccttataatggaaataacattccacccagcaatcccgttactgggcttatacccaaaggttttctcttttttaataacagctttattgagctatcattcacataccatacaattcacccatttagagggtacgattcaatgaaagtttttagtatatccacagcgttgtgcagctatggccataatgagttatacaacattttcatcaccccacgccccagtgcaaaaatcaatcagtacccattagaaaccactctccctccttcccaacatccccagctctaggtaaccataagtctaccatctctgtagatttgcctattctggacatttcatacaaatggaatcatgcaatgtgtggacataggtttttgagcatataccggagcaggatttctgggtcacatgctaactctacagttttttttagaaaacgtttttatagagatggggtctcactatcttgttcaagctggtctcgaactcctggctcctacctcggcctcccaaagcactgggattacaagtgtgagccaccacaccaggcttacctctgtgtttaacctttggagaaatttccacggttttccaaagtggctgcaccgttttccattctcaccaaccagcagtgttccaatttccctgcatcttcaccaacacttgttattgtttttggattatgaccatcctagcaggtgtgaaattgtacttcatgatggttttgatttctatttccctgatggataatgacactgggcatcttgtcatgtgttaattattggccatttgtataacaacttctgagtgatgtctattcaaatcctttgcccattttttaattgagtatttgtctttttattattgagttgtaagaatcctctacatattgtggatagaagttccttatcagatatgtgatttgcaaatatcttcttccattctgtgagctgtctttttactttcttgagggtgtccttggcagcacatcacaagccattttgacacgtgcaggataggacttataaaacatttcagcttctttgcatgcttcagtactaatacagtccacctcccacccccaaagaaagcagaaactatctgtataaatccatgaagaaatcctgccctcgttccagccctggcggaaatcacaagcagcttccatgtgcatcctcgtctgtggtcaacgaatggaaaatgggttctgaggaaatctgtgagaacacacagaccaggctgggaagcaggaaagctcagaaaaactctccacaccttgttctaagacattttttgtatgatgctataaaaggacacatgtattctttgtaacgttgtaatgcataataatagtaattttcctaatatgcctgttcatctggaattattccagggactgccacagccttcagaagggcaaagatgcccacttaaaatcccttgccagcatcttgctgttgtccccatcacaatcttcccgaattcctctcagctctcactggggccctgctgatggagtgagacccacgggagctgtgaattctggcttgaataagagcttcctctaaatacaaaccctgctgagtaaatgctgagagcgcagcatttacccagctaacgagcaccttccctgaagttgggacacacagcccaccttctcattgtgtgtagcaatttgcacacctgaagcatgccctggccccttcccccaatgtccttcctacctccccccagccccactgagaagaaaattgcaaaatgctggattcgtttcttctgtttaattgaacaactgtcttgttcttacctttgccttgccccttattaagtacatgccctggaaacaactttgtcctaatgtagaggtatcatggaaagttcttccatatatttaattttttttttttttttttttttttgaggcagggtcttgctttgtcacccaggcaggagtgcagtggcgcgatcacagctcattgcagcctcaacctcctgtgctcaaacaatcctcctaccacatttttttattttttttgtagagatgatgtctcactatgttgcacagactggtctccaaatcctgggctcaagcaatcctcctgccttggcctctcaaagtgttgggattacagacatgagccaccatgcctgacctcttccatatatttagaggaaatccctttgtgagtgctacccactattttttttttttttttcagacagggccttgctctgttgcccaggctggagtgcagtggtgtgatcatggcttactgcagccttgaccttctggtctgggctcaagcaatcctcccgcctcagcctcccaagtacctggggtcacaggtgtatgccaccatacctggctaattgtttctgtagagatgggttcttgccatgttggccaggctggtctcaaactctcgggctcaagcaatcctcccacctccgcctcccatagtgccgggattacagttgtgaggtactgtgcctggccacacccactggttccaatttaattattcttccacatggcaactgtccaagaattctccttaagtcttctcttttgcaggtgataccccacctcccaggcccttcgatcatttctccatggcatcatttccagactactctccaccctgatgaccctctcctagaggattccatatttgtctctattgttgttttgtgtatgtaaaaaacttttttaattaaaatgttttcttttgagataattgtagattcacatgcaattataagaaataaaacagagacatctagtgtacccttgatccagtttgtcccaatgttaacatcttgttgtatactaccataaccgagacattgaccttgatacaatcaaaatacaaaagagggccgggcacagtggctcacacctgtaatcctagcactttgggaggctgagatgggcgcatcacctgaggtcaggagttcaagaccagcccggccaacatggtgaaaccccatctctactaaaagtataaaaattagccaggcgtggtggcacgtgcctgtagtcccagctactcaaggggctgaggcatgagaattgcttgaacccggaagacagaggttgcagtgagctgagatcatgccactgcactccagtctgggtgatggagtgagactgtgtctcaaaaaaaaaaatatatatatatatatatgtgtgtgtgtgtgtgtgtgtgtgtgtgtgtgtgtgtacacacaaggattggttctgtcaccctttgatagccacacccatcacccttctcaacccccatccctaactgctggcaagcactcatctcttcttccccacttgccccctgcgacggagtcttgctctgtcgcccaggctggagtgtactggcgcgatctcggctcactgcaagctccacctcccgggttctagcaattctcctgcctcagcctcccgagtagctaggattacaggtgcctgctaccacatctggctaatttttgtatttttagtagagatggagtttcaccatgttggccaggctggtctcaaactcctgatctcaagtgatccgcccgccttgacctcccaaagtgctgggattacaggcgcccagccacataacatttttgaagtgacaaaattatagaaatgaaaaaaagggccgggggcattggctcatgcctgtaagcccagcactttgggaggccgaggtgggcgaatcactaggtcaggagttcaagaccagcctggccaacatggtgaaaccctgtctctactaaaaatacaaaaattagctgggtgtggtggcacacacctgtagtcccagctacttggggggctgaggcagaagaattgcttgaacccgggaggtggaggttgcagtgagctgagatcgtgccactgcactccagcctgggcaacagagcaagactccatctcaaacaaacaaaaagttatgtaaatggaatcatacaatatgtaacattttgaaattcttttttcattcagcatcattccttgggattcatccaagttgttgcatgtatccatagtccattccatttatcgctgagtactattccatggcatggatataccacagtttctttaaccattcaccatttgaaggacatcttggttgtttccagtttttgcctattataaataaagctgctataaactttcatgtaccagt

SEQ ID NO: 9169 - DNA, 2374 bp, artificial
  synthetic oligonucleotide
cctgttaggtaaagtaaggaatgatttgattaaaattaccctatgaactgtggaagaaatgcagtaagaattttttttaatcctctttcttcttcaaagtgctgggaatgtaacctcacttagaacttgctgatggatttttaatgttatttttgttatgacatatcacacatctgaagaatatatttagcttatatatgaggcataaagtataatgcaacgaaaaaccatgtaccttctgtgcagcccaagtcagagggttacctgcactcagggtcccatgtgcccctccctgatcacatctcctccctcctgcccagagagcatttctgtccggatctatgtatttgtcagttccacgcacgtgtgtgtgcgctatagaatgaacgtttgtgtcccctcaaggttcatgtgttgaaacctatcccccaatatgatggtacctgaagatgaggcctttgggaggtgattaggtcatgaggatggaggcctcataaattggattagtgcacttataaaagagactccggggagctgctttccccctttcatcattccaggacacagggagaaggtcctgtctgtgaactagaaagcaggtcctcaccagacaatgagtctgccgccaccttgatgttggacttcctagtctccataattatgagaaataaatttctggctgggtgcagtggctcatgcctgtagtcctagcaccttgggaggccaaggcaggtggaccacctgaggtcaggagttcgagaccagcctgtccaacatagtgaaaccccgtctctactaaaaatacaaaaattagttgggcgtggtggcaggtgcctgtaatcccagctactcgggaggctaaggcaggagaatcgcttgtacctgggaggcagaggttgcagtgaactcagatcgtgccactgcactccagcctgggcaacagagtgagactctgtctctaaataaataaataaatttctgttgtttagaagccatgcccaggcattatgttacagcagtccaaacagactaagacaatacgtacaggcatgtataggcattatacacacacacacacacacacacacacacacacacacacacacacatacatacaaaaattccttaacagtatattgctcagttttgcatgtctttgaacttcatataaatggtattgcattgtatgtattcttcagcttgctattttttggtggcattcaaccaatttgtgcgtttagctccagttcatacgttttcgcttctgtatagaattctgttgtgacagatttttattcatttcctatttcacactgctgcaataaacagtcctgtcatagctcctggctcacatgtctaccatcaacttaacaacatataacgtgccctggctgggcgcagtggctcatgcctgtaatcccaacactttagttggccgaggtgggcagaatgcttgagctcagcagttcaagaccagcctggacaacatggcgaaaccccatctctataaaaaatacaaaaaattagccgggtgtggtggtgcgtgcctgtagtcccagttattcaggaggctaaggtgggtggatggctggagactgggaggtcgaggttgcagtgagctgtgatcatgccactgctctccagcctaagtgacagagtaagaccttgtctcataaactaaaaaaaaaaaaaaaataaaatgcaccctggagttgcaccctgtaatagagacctattcaaaacagaggagcaacttattacatgaataatgagcatgtttaaattacgcttagtagtatggggcaccgttttaaaactcaaaacattctagaggatgtaagagttccaagtttgatgggagcttccttaccatgtgcagtggagatataggaatgtagtgtccaaactcatgctcgcactgctgtgacttctagaaagtcactcaaaatcccgatgggacacaacagaggccagttgaacaagggcgtgaagaaacatgaaggcaggcaggcagcatatcagcaccagacaccgctagctctgtagagaggcgctgggaacctgaggccaagtgccactaagccccagagtgggccctttattctcttatttatggattgcctgctgtatggcaggattctgatgggtgccagggatagaagtgtcaacagggcataatcactttcctcaaaagaaaaaaccaactacaatacaatgtgggtaaccagaaggaaggggatggttaggatcaccatgagggcagccaaaataagggaaacagtgaacagagcacccccaggagggcacataatccacacctgagcggagggcaatcacagaatgcctggaggaagggatactgtccatgacctga

SEQ ID NO: 9170 - DNA, 9063 bp, artificial
  synthetic oligonucleotide
ttactggaaatctgagtccattagtgacttcatttgttgcctcaaaaattatatctaaccagaagttcagccgctcttgcctgggcgagtgttcaataatggttttcttgaagcgccgaattagtaacaagttctgaactaatgatcgcaggtacctggaaaaatcacaaacagcaatatattggattcctaaagaaactgaattcaattcaagtccctttaaaagaagctttccaaaagcttttattcacttaaattcatattatgtcatgagtgcttcataaacgactgctcagcagccacaaaactaattaagaaaacacgagcagtaggcaaagtaagtccatccaacaaaataacacaacgtggctttttaccaacattgtgctaaccccaattttagtacctactgcctaaaatgtggagattggaaagcatgtggtaactgttttaaataacaagggcaggcacagctgactcttgaacaacacaggtatgaactgcgcagctccacttatacatggattttttttcccaatagatacattggaaaatgttctggagacgtgcgacaatttgaaaaactttgcagataaactgtgaagcctagaaatataaaaaaaaaaattagaaaaagctaggtatgccatgaacacataaaatatatgtaggtactggtccattttatcatttactacccaacatatatacaaatctcttacaaaaagttaaaatgtaccaaaacttacacacacacttacagactgtatatggcaccattcccagtcaagaaaaatataaacaaatgtaaagatgtggtattatatcaaaactgcataaaattaactgtagtgcatactgcactactgtaagaatttcatagccacctcctgttgctattgtggtgagctcctgttgtaagtatctgcttaaaactccaccatgtggccaggtgcggtggctcacacctgtaatcccagcactttgggaggcctaggtgggcagatgacctgaggtcaggagtccaagaccagcctggccaacatggtgaaatcctgtctctactaaaaatacaaaaattagcaggatgcggtggcaggcgtctatagtcccaactacttgggaggctgaggcagaaggaatgcttgaagctgagagacggaggttgcagtgagctgagattgtgccactgcactccagcctgggcaacagagcgagactctgtctcaaaaacaaacaaccaaaaaaaaaaaacttccaccgtgtgagactgatcatttttgcatgagaagttcgtctctccagtaaattgcagatcatagtaaaaagtgatcactcacggttctcgtgcattcttcattgtatttagtgtgacaccataaacaatgaataacaccatgggacccatagagagtgccactagtgatactggaaatgctcccaagaagccgagaaaagtcatgacattaccagaaaaagttgaattgcttgatatgtattgcagattgagttctgcagttacggctgctgccatttcaagataaatgaagccagcctaaaaatcgtaggagaaacagaaaaggaaattcatgaagccgtcactgcagttgtcagtggttgcgaaaatcctgcactttttgcaaaatataaaatacaaaatattgtttatgttattggtaaggcttccagtcaacagtaggctattcgtagttaagtttttggtgaattttcaactgagcccctaactcccacattgttcaagggtcagctgtagttcaaagttcaaagcaattacaaaatgacaaaatttcaaactcattttctttttaattaaacatgttattttgaggtaattttagatttacatgaagtgctaagaaccaatacagagagaacccatatatctttgaccaggtttactccaatggtagcatcttacaaaactatagtacagtttttggtagagccaagatggctgaatacgaacaactccagtcgacagcccccagcatgagcgatgcagaagacgggtgatttctgcatttccaactgaggtaccaggtacatctcactggggagtgttggaaagtgggtgcaggacagggggtgcagcgcaccaagcgtgagctaaagcagggcgaggcactgcctcacccgggaagcacaaggggtcagggaattccctttcctagtcaaagcaaggggtgacagacggcacctggaaaatcgggtcgctcccaccctaatactgcgcttttccaatggtcttagcaaatggcacaccaggagattatatcccgcgcctggctcagagggtcctacgcccagagcctcactcattgctagcacagcagtctgagatcaaactgcaaggcggcagtgaggctgggggaggggcgcccaccactgccgaggcttgagtaggtaaacaaagcctccgggaagctcgaactgggtggagcccacctcagctcaaggaggcctgcctgcctctctagactccacctctgggggcagggcacagccagacaaaaggcatcagaatcctctgcagacttaaatgtcccggtctgacagctttgaagagagtagtggttctcccagcacgcagctcgagatctgagaatggacagactgcctcctcaagtgggtccctgacccccaagtagcctaactgggaggcaccccccagtaggggcagactgacacctcacacggctgggtactcctctgagacaaaacttccagaggaatgatcaggcaacaacatctgctgttcaccaatatccgctgttctgcagcctctgctgctgatacccaggcaaacagggtctggagtggacctccagcaaactccaacagacctgcagctgagggtcctgagtgttagaaggaaaactaacaaacagaaaggacatccacaccaaaaccccatctgtacgtcaccttcatcaaagaccaaaggtagataaaaccacaaagatggggaagaaacagagcagaaaaactggaaactctaaaaatcagagcacctctcctcctccaaaggaacgcagctcctcaccagcaatggaacaaagctggacggagaatgactttgacgagttaagagaagaagacttcagacaatcaaactactccgagctaaaggaggaagttcgaacccatggcaaagaagttaaaaaccttgaaaaaaaattagacaaacggctaactagaataaccaatgcagagaagtccttaaaggacctgatggagctgaaaaccaaggcacaagaactatgtgatgaatgcacaagcctcggtagccgattcgatcaactggaagaaagggtatcagtgatggaagatcaaatgaatgaaatgaagtgagaagtttagagaaaaaaagaataaaaataaacgaacaaagccaccaagaaatatgggactatgtgaaaagaccaaatctacatctgattggtgtacctgaaagtgacagagagaatggaaccaagctggaaaacactctgcaggacagtatctaggagaacttccccaaactagcaaggcaggccaacattcaaattcaggaaatacagagaacaccacaaagatactcctcgagaagagcaactccaagacacataattgtcagattcaccaaagttgaaatgaaggaaaaaatgttaagggaagccagagagagaggtcaggttacccacaaagggaagcccatcagactaacagctgatctctctgcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagacattttctcaccaccaggcctgccctaaaagagctcctgaaggaagcactaaacatggaaaggaacaaccagtaccagccactgcaaaaacatgccaaattgtaaagaccatcaaggctaggaagaaactgcatcaactaatgagcaaaataaccagctaacatcataatgacagaatcaaattcacacataacaattttaaccttaaatataaatgggctaaatgccccaattaaaagacacagactggcaaattggataaagagtcaagacccatcagtgtgctgtattcaggaaacccatctcacgtgcagagacacacataggctcaaaataaacggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggaacacccacattcataaagcaagtccttagagacctacaaagagacttagactcccacacaataataatgggagactttaacaccccactgtcaacattagacagatccacgagacagaaagttaacaaggatatccaggaattgaactcagctctgcaccaagcagacctaatagacatctacagaactctccaccccaaatcaacagaatatacattcttctcagcaccacactgcacttatttcaaaattgaccacatagttggaagtaaagcactccttagcaaatgtgaaagaacagaaattataacaaactctctctcagaccacagtgcaatcaaactagtactcatgattaagaaactcactcaaaaccgctcaactacatggaaactgaacaacctactcctgaatgactactgggtacataacgaaatgaaggcagaaataaagatgttctttgaaaccaatgagaaaaaagacacaacataccagaatctctgggacacattcaaagtagtgtgtagagggaaatttatagcactaaatgcccacaagagaaagcaggaagatccaaaattgacaccctaacatcacaattacaagaactagagaagcaagagcaaacacattcaaaagctagcagaaggcaagaaataactaagatcagagcagaactgaaggaaatagagacacaaaaaacccttcaaaaaaatcaatgaatccaggagctggttttttgaaaagatcaacaaaattgatagactgctagcaagactaataaagaaaagagagaagaatcaaacagatgcaataaaaaatgataaaggggatatcaccactgatcccacagaaatacaaactaccatcagagaatactacaaacacctctacgcaaataaactagaaaatctagaagaaatggataaattcctcgacacatacaccctcccaagactaaaccaggaagaagttgaatctctgaatagaccaataacaggctctgaaattgaggcaataatagcttaccaaccaaaaaaagtccaggaccagatgaattcacagccgaattctaccagaggtacaatgaggagctggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacatcaatgcaaaaatcctcaataaagtactggcaaacggaatccagcagcatatcaaaagcttatccaccatgatcaagtgggcttcatccctgggatgcaaggctggttcaacacatgcaaatcaataaatgtaatccagcatataaacagaaccaaagagaaaaaccacatgattatctcaatagatgcagaaaaggcctttgacaaaattcaacaacgcttcatgctaaaaactctcaatacattaggtattgatgggacgtatctcaaaataataagaggtatctatgacaaacccacagccaatatcatactgaatgggcaaaaactggaagcattccctttgaaaactggcacaagacagggatgccctctctcaccgctcctattcaacatagtgttggaagttctggccagggtaatcaggcaggagaaggaaataaagggtattcaattaggaaaagaggaagtcaaattgtccctgtttgcagatgacatgattggatatctagaaaaccccatcgtctcgcccaaaatctcaagctgataagcaacttcagcaaagtctcaggatacaaaatcaatgtgcaaaaatcacaagcattcttatacaccactaacagacaaacagagagccaaatcatgagtgaactcccattcacaattgcttcaaagagaataaaatacctaggaatccaacttacaagggatgtgaaggacctcttcaaggagaactacaaaccactgctcaacgaaataaaagaggatacaaggaaacggaagaactttccatgctcctgggtaggaagaatcaatatcgtgaaaatggccatactgcccaaggtaatttatagattcaatgccatccccatcaagctaccaatgactttcttcatggaattggaaaaaactactttaaagttcatatggaaccaaaaaagagcctgcattgccaagacaatcctaagccaaaagaacaaagctggaggcatcacactacctgacttcaaactatactacaaggctacggtaaccaaaacagcatgctactggtaccaaaacagagatatagaccaatggaacagaacagagccctcagaaataatgccgcatagctacaactatctgatctgtgacaaacctgacaaaaacaagcaatggggaaaggagtccctatttaataaatggtgctgggaaaactggctagccatatggagaaagctgaaactggatcccttccttacaccttatgcaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacatgcaacctacagaatgggagaaaatttttgcaatctactcatctgacaaatggctaatatccagaatctacaataaactccaacaaatttacaagaaaaaaacaaacaatcccatcaaaaagtgggcaaagaatatgaacagacacttctcaaaaaaagacatttatgcagccaaaagacacatgaaaaaatgatcatcactggccatcagaaaaatgcaaaccaaaactacaatgagataccatctcacaccagttagaatggcgatcattaaaaagtcaggaaacaacaggtgctggagaggatgtggagaaataggaacacttttacactgttggtgggactgtaaactaattcaaccattgtagaagtcagtgtggcaattcctcagacatctagaactagtaataccatttgacccagccatcccattactgggtatatacccaaaggattataaatcatgctgctataaagactcatgcacaggtatgtttatagtggcactattcacaatagcaaacacttggaaccaagccaaatgtccaacaacgatagactgaattaagaaaatgtggcacatatacaccatggaatactatacagccataaaaaaggacgagttcatgtcctttgtagggacatggatgaagctggaaaccatcattctcagcaaactatcacaaggacaaaaaaccaaacaccacatgttctcactcataggtgggaattgaacaatgagaacacatggacacaggaaggggaacaccacacaccggggcctgttatggggtgggggcgggggagggttagcattaggagatatatctaatgttaaatgatgagttaatgggtgcagcacaccaacatggcacatgtatagatatgtaagtaacctgcacgttgtgcacatgtaccctaaaacttaaagtataataagaaaaaaagaaaaaaaagaaaaaaaaagaactatagtactgtatcacaaccgggatgttgtcactgatacaaggcaagttagagaaatttccatccccacagggaccccttgtgttgccttcccaccatcacgcctacctccctcccatcccaccccctcccttacttctggcaatcactagtcaaactcactgtcttttattttttgaaatattagaatctgactaggtagattttgatgttatgacatcttgactctgaccacacctttgctcttttcaggcaaactgaactttttggaatatagttgccaggcagtggtggtcacaacctctttggtactaaacggaatggttcaactgaaagcatcatagtattattttgctctttaaggataaaagctggagctatcctgggaagataggccagctagactccaaccgacttgcttgggcactcagcaggcctgtgttgtcccaactccacacattcaaaagaaagatctggccctggactggctattgggagatcacctctaagcccttgggatatactgccagctaagagcatctctgtttatctgggaccttgggccatcccagatagtctatgctaacgatatgattcatcttcggggccctgggccacactgtatcagttcgacctctagagaggttggagctgaggtattaatatcagctgcatgaagactccatgcccacatgacccatccccaataaaaaccctggacattaaggctcaatgagctttactggttggcaagatttcatgcatgttgtcacacatttttgctgggagaattaagcactattcacatgactccactgggaaaggacaactggaagcttgcacgtggtctctcctggactctaccctatgtacctttctgcctttgctgattttaatctgtatcctttcattgtaataaaccataactaagagtgtaacagcttttctgagttctgt

SEQ ID NO: 9171 - DNA, 661 bp, artificial
  synthetic oligonucleotide
agaacattccatattatgagtaagtggaaacattaaagtgcataaaacattatcatcatttgcattaaaatagtaactccattttctcctatgttcttaccttattccctttatggaagaggctgtaaaattccattcgtgcatctgtttctgcaagttatcaaagacagaagtcaatagtttgagttttttaaagcaaatgattttttttgtttcattctatggtcaatcatttctgctattttacctgcagtggtgatttttttacgggttacagcaatacaccttgtataacatggaacaccagaaacattttcttatgtattataaaaattcatttgtatctctaatccagtttaaatgatgtaaatttgaaataatctaagtttcagatagaaataataagcatagaataaacacacagtgagtggcttttcatcttctgtcaacatagtaggcaaactctaaaacaagcatgggactagcccacctaagttgagtgacttgcaaaaatgttgggagaggcaagactgcgacagacacctttcagcattcatcagtcttccttttctccctgaacatagagctgaactacaattcccagcctcccttgcagctagagagatatacagtggagttttggccaatgggatgtgagcag

SEQ ID NO: 9172 - DNA, 2709 bp, artificial
  synthetic oligonucleotide
ttctcagaagccggtgagacctcccgggcgggccgggatggggcgcgagtggggctgaggcggggccggagggcagggcgggccaggccgggccacccagagcggggtggaaggcgccaggggagccggggagcctttacttcgcctccgcgccctgcattccgttcctggcctcgggagaagcggcacggaccgggatcacgccaaggtccgtgtgaacttcccccttctcgacacccacctcccgcccccgggcccagctgtgcgccaggcgaagtcggtgtgctcaagaggtgcctgttgggttacaggacacggaaagggtggcctcggcctccttcgagtctccaattgaccccactcatttcggatcttctaacttaatttctcttgaccgagaggctttgtaatagcgtagaatctggagacagggtggcttcgttcaaacagcaccctcaccattgactagccctgtgaccttgagcaagtttttaaacgtcccggggacccggtttcctaaaatgtttgctcgaagtggagttaatctctaaatggagataagagttatctctgaaatgttatcagttaactctaaaatggagataataagagtccccacctcttggggttgtcttgaggattcaacgagtgacacgtgtggaaacgattccaaatagcacctggcacataatcgataacatgtgtgttgaatagtgttatttattgagtctccagttcggtatacatttcttgaacacctgtgctcagttctgaggcgggttcacagaaggtcagcctcttcagaaacaaacttcctcctcttccctctccctcaacatctgagcttttcttggcagtgagttcaggagcgccgaagcagaactcagaggacgctgccctcccctccccttacctacacattcttagggtacaagtagctaaagcaaagagcaacgatgcttgaggggtggggggtagagtttagcactatttcatggcctcagcatttagaggtgcctaacacctgagctagcattctgacccccctaggcacagtgaggtcgtgttaattggtgtaactgcaggcctcgggattctggtatttcccccaggacttgataccgctctacttagtacaggcagagattgtcaaaaggtaagaggtatgcccctctaggaatcctgttgcctaaaataatgacaaaactgccgggtgcggtggctcaggcctgtaatcccagcattttgggaggctgaggcaggtggatcacctgaggtcagaagttcgagatcagcctggccaacatggtgaaaccccgtctctactaaaaatacaaaattagccggtcgtggtggcgggctcctgtaatcccagctactcgggaggctgaggcgggagaatagcctgaacccgggaggcggagtttgcagtgagcggagatcgtgccattgcactacggcctgggcgacaagagcaagactccgtattttaaaaaaaaaaaaaaaaaaaaaaaaaaaaaagcgttccctttagggatatctgtgggtagagggctgtaccggtagttacgggctcagaaacatccttcctttaggcacctgatgtaggttttcttcttcttctgcaagtcaggttcattgtttcctgtatcagtttgcagggtccccccccccccgccaccttacagtaggaagaaaattgagttccagatatgaagtcacctttgaaagtgcccaggtatctttccacttggtggtgtaaactcttcagataattagaagttttctgtgtcactcaacttgtcatggactaattaggaaccattcctgaagcttttaaggatagaactaaaagtttcacttttatttttttaaagggtggaataataaactaacgtgttgactctttgtattttgtaattcttcatacttatggatgtctttttacttaactataagtaacaaaatagatcaacgttttagttttttatattatacatgtaaaaagacattttgcatataagcctttcacaaaaatcttgacagtaaacaataagcagtggctcacccaaattaggcagacttactgcactagactcctaccatctgtgtgatactccatgaagggagggagaaggggagggagaagggtaggcagctggtctgatggctgtgacacaagataatccccttaacctcccaagacgctgtgtgttttttccttttttattctccctggtttactttcgttttgtttgagacagggtctctgtgtcacccaggctggagtgcagtagcaggacagctcactgcagccttagcctgctgggctcaagcgatcctcctgccttagcctcctgagtagctgggaacacaggcatgtgccaccaccacacccagccaattaaaaaaattttttttttactagagacatggtcttgctacgttgcccagtctggtctccatctccaggctcaagcagtcctcccacctcggcctcccaaagtgctgggattactctcactctcttaaaaccaggcaggtagggagatttatctcaggcttaaagattgccattgtctcatcaaagagtgtttggtgtgaaactttgaaatgaatatcaagattgtgtttttatttttgaataaggtttatagttttcatagttcttatttcatggaagaagattgaatgcatttaaaatgttat

SEQ ID NO: 9173 - DNA, 1606 bp, artificial
  synthetic oligonucleotide
tttgttatatttcatttccattgttatgtcattgtgttttatggtcgtgtaaaaacatttatatggttccaaagttaaaatgacccctagccataatcctttcaccagctgctgcttagtacctcaaagacatttgcaaagatttgttgacttttatgacacatgtatatgattgtcctactctaattcatctgctgggggatgggtgtttcttactggaaaaccggagacatgtcaaggagcatgatttgccttaaagctcagcttgatcgaatacttgtagggtgattcgctaacgaaaggtaaaaaggcatatttcagggtctctaatcaaaattgccctgcttcacccagatacgttttttttgttttgttttttagagagatggggtctcgccctgtcacccaggccgccatgcagcgatgccgccatagcttactgcagcctcaaactcctaggctcaagcaatcctccctcgtcagcatccctagtagctgggactacaggcatgcaacaccataccagactaattattttattttttgtacagacgagtatcactttgtggcccaggctggcctcaaactcctggcctcaagtgatcctcctgccttggtctcccaaagtgctgggattacaatttcccccaagattaacgagccctcctttcttaagactttctcttcccgccttttgcaaatctttctttctctccggcctcctctcctgatacaagagtcttttgtgaatgttctagcgcgttactatagcctatagttattatagcctatagttaatgactataacattactataacgttactatagcctatagttaatgactattaaccacaatcatcacctgtcaccacttgacacagcatctcacagtgtccctcaccttcaaagttgcttccaactctgctttcaaatatctgaaaacagctgggcgcggtggctcacacctgtaatcccagcactttgggaggccaaggtgggcagatcacctgaggtcaggagtttgagaccagcctggccaacatggtgaaaccccgtctctactaaaaaaatacaaaattagtcgggcatggtggtgctcgcccgttttcccagctactcgggaggctgaatgaggagtatcacttgaacctgggagtcagatgttgcagtgagccaagatgtcaccactgtactccatcctgggcaacagagtgagaatctgtctcaaaaaaaaaaaaaaaaaaaagaggccgggcgcagtgtctcatgcctataatcccagcactttgggaggctgagacgggcggatcacgaggtcaggagatcaagaccatactgtctaacatggtgaaaccctgtctctacgaaaaatacaaaaaaaattaaccgggcgtggtggcgggcacctgtagtcccagctactcgggaggctgaggcaggagaatggcgtgaacctgggaggcggagcttgcagtgagttgaaattgcaccactacactccagcctgggcgacagagcgagactctgtctcaaaaaaataaataaataaaatatatatatatacacgtatgtgtgtatatatatgtatatatatgaagaacaaga

SEQ ID NO: 9174 - DNA, 564 bp, artificial; identical to SEQ ID NO: 6896
  synthetic oligonucleotide

SEQ ID NO: 9175 - DNA, 1230 bp, artificial
  synthetic oligonucleotide
gtaaaagcactttacattggttccttgtttaataaataggtttaataagttaataagtttaagattattctaaagaaaaaaatttagccaattctattgaatttctgttatatttctcttccttgctccaaaacacaattaccatttctgagtttcttttcacactgcagtttaaattttgggtggtaaaggctgaagttagccatgaatggaaagttttagtcccggatttccaaagagcacctgaaagttgaatcatggagggaaaaatcaccaatcatgagatgtctagaatgggcaaatctatagaaataaaagtagattcgtggttgcctagagctgggggagaagggtggggagtgactgccaaagggtatggggtttcttttggagggatgaaaatgttattaaattgtagtgatggttgcacaactctgtgactatcctaaaaaatattaaattgtggctggggacaatggctcatggctgtaatcacagcactatgggaggccgaggcagggtggtcgcttgagcctaggagtttgagaccagcctgggcaacaacgtgagaccctgtctctacaacaaatacaaaaattagccagatgcggtggcatgtacctgtagtcccagacactcaggaggctgagatggcaggatcaattgaacccaggagtttgaggctacaatgagctatgattgtgccactgcactccagcctaggcaacagagtgagaccctgtctcaaaacaaacaaaaacaccattgaattgtatgtactttaaacgggtgaattttaagtgaattgtatgtcaaagctgttttttaaaaaaaggatgaatgtgactagcttaaagcaaagcttcaaacaagtgtcagaaacactcccctgtgctagctaactctctctctctctctctctcacacacacacacacacacacacaaacacacacacacacacacacacacacacacacgcgcctttcctgccccccactccccactatatcaactccatccccagccctgtaaaagcaggacagacctaggctggcctgaatggaaagaacaggctctcttcagcaagggagactgaacacaccagaaaaggaaaattgagtcattattgcttccatttgtgagaaaatcattgttttccagattcaccacgcacatttttcaaacgttgaaagcaagtctgttactcccctcagaaacctgagcgata

SEQ ID NO: 9176 - DNA, 793 bp, artificial
  synthetic oligonucleotide
ataagatcatcttccatattctctattaaagaaaacagattgtatatatcacacttcagaatgatttcaccttttaaaatgtaagggttaaaatgaaagatttgggcccccaaaggaactagtttcaattttccagaaaattatgaatgcaaatttcctcattccctaagtcaggaattgctgtgatgcaaatatgccttcacgtgatgtgaactacgttcatcaggcagcttgtccatcaacagtttctaagagtctttgggactcagaagttgcttatttcatgcatctgaatctctacaaaactgttttggaaaagctttggccttagctcagctttccaatgacttgtcagggcagaggtgaatgtaatcatcttcttagaacacaagtagatttcctagaaaaagagcagcaaggaacaccatgaacagaattgcctcatgctcttgagacatctgttcaccacccaggccacttgagaaaagaaatgaaaatgcacatccagaaagcgaagactgaagaaaaggcacaattaccagggcctgaaagtgctgtctttggtgggggccactttaaagttcaccacaaaccgtggtgaaaaagaaagggggcttccctcgttatcattgcagtgttacgggatgtaggaagtctacgtcaacttctttgcatccttatcagtgctttctacatttgataaccttcagtgaggtgtctgaagagccaatctgcctgggaaaggattcttttaaagtggaccttacccctggatacacgttggaatcacttt

SEQ ID NO: 9177 - DNA, 811 bp, artificial
  synthetic oligonucleotide
tgaactggaagcttcgggttgtcaaaactttctgtgaacaaatgcaatcaaaacccaaagctccccatttgaaaggcctatgaaaatgggttaattagggtctagaaaatcctgtgtgaagagtactcaaaacatctaagagtttgatagtggatgatttcttctcttaaatcttgccaggttaatagggggtgagtttggggctgaaagtaagaatttggagtgtgcagacttttaaagttctcctggttagtgtcatccctggaaagctttctttgggaacatttttggagactacagcatgggcagcttcacagctgtctaaccagtgcgatgacacagggccttgtgctcagaaaagccctgtctacagtttaatgctcaattgttattgtactgaaattcttgataattttttcttcgcatttgtgttttgtaagtgaagcccgatgggatgggacaatggagcaagagctggggggagcttagagcctggcccaccttggggtcaccttctgctgctccccacctctcccaatgggtttttggccaccccttctcctccacccattggagccccagccctacctggctgcctcctctctgccctgtgactgacctctgccaccatctacctggggcagtgcccaggtagcattgtggggagggggtagagtgctgtgggtagggtggggtagggagctgggggaaagagttggagacccatgttgtaccaggcataggtgccagaaatgtccgggtgccacctggagcctctggtcaggcatagccacagttgtccctgctctgg

SEQ ID NO: 9178 - DNA, 453 bp, artificial
  synthetic oligonucleotide
ctgaagcttctgctccaaaatgatacacattatttctgtctacatgtattgactaaagcaaggtacacggccactcctgagttccacagggcaaggaagtccaaccctcccatgaggagggtcactggaatgtttggcaaaaaggaatataatctactccagtccccaagaaggatatcctagtggaatttattttctcaacaggactgtatggtgccttttattctcctacttcctaggtgtacccaatgtataataaatgccaatcaagcttgtccaatctgctcacacatgtatgagcagccttgcaccgccctcttctttgggtttgctatgtgccattgtactcacttcaagaaaagataaggggcaacttgactgatgctgggcaggcaggcatccaggaatgagaaaaatgagatcccaggtgttccttcttctagttctataaaa

SEQ ID NO: 9179 - DNA, 1621 bp, artificial
  synthetic oligonucleotide
cgctattagacatgctctaagcaggaaacctgcttcatcttgacctttgttggatttatatagaataactgtatattcatttttgaaggaaagaacgaagctatttatgaaaggctggaaatataaaaaattaaatctaacattaaatttcataatttctcactgaacttcctcttttctaacatgccattaattgtaagatggaccattacttaataatggagttccaagcaagaaagaaaccctacagagttgtgctgtccaatatggtagccactagccacaggtagctacttacgttcaaattaattaacattcaaaattcacttccttagtctcactagctacatggcaagtgcttggaactccatgttctattatagaacatttctactgtcacacaaagttctgctggacagcactgctgtggttttgatgaaaaaggagtgagcagaaagttttcagggtagccgcggtttgcaaaagcagtggcgagcaaattgctttggagaaaataaattgtaacggattgtgcatgggagtagtagctggatgtttacttcctccaagagaaggaagtaaaaattagaattgcataaagaaggagccctacaaaaatagacgtgtcaatataaaatagcaattataataatttttattaagagcttgctattgtcaagcactgtgctaagtgctttacagattatctgtgattacaaccctatgaagtaagaactatttttactgatgagaaaattgacagtcaaagattcaagttgttcaaaaacggactgaggaggtggcagcaaggatttgaagccagtttccaagcctcattctccttctcttataccagcagttctcaactggagattgggaaggtggaggtgggggtcaagaggtgctttcatcatcatcaggcctgactgggaaaccaggaacactccctcttcccaggaaaccttttcccaaagcccttcttcatcccacctccagcctgtctcccacaatgccctctgtagccgttctcagcctacaaccgcaaggctgaggccagagtgggcatcaggtgaagactgttgtagacccctagggttagaaactctaagtggaatgtaaagccagggaatgtaaaaggacaaacaactctccaggtgattctcatacacatgctccagttgaaaaaaccaggctgggcacagtggagcaggcctgtaatcccagcaccttgggaggccaagatgggagggtcatttgagcccagaagtttgagaccagcctgggcaacatggcgacaccccatctctacaaaatatacaaaaatcagccaggcatggtggcacacacctgtggtcccagctactttgggaggctgaggtgggaggatcacttgagcccaggagttcaaggctacagtgaactgtgaccatgccactgtactccagcctgggctacagagtgagaccctgtctcaaaaaaaaagaagacaaagaaaaaattgtgctacctggaaggcagttaaatatttagttggatgaaaataattgttgtaaatatggttactgaatcaaatgcaaaattcaaaaccaaatcttggaaaaaaacacataatgaatacaat

SEQ ID NO: 9180 - DNA, 1615 bp, artificial
  synthetic oligonucleotide
gatttgaatctcagctctaccactaactggctgtgtgaacttgggtaagtgccttaatctctctgtgccttaatttccacatctgtaaaataagatagcaataatacttatctcacagaacctagaccactgaaagtgttctataagtgagttcctagtattgttatttttattttcttctttttttgaggcagggtctcactctgtcgtccaggctggaaagcatgggtgacctcctgggctcaagtgattctcccttccaagtagctgggactacaggcacgcgccaccacacccagctgattttttacttttgcagagacaggggttcgccacattgctcaggcaggtcttgaactcctagactcaagtgaccctcctgcctcggcctccaaagtgctggaattataggtgtgcatcactgtacccggccgggatccttttcacagttacaagtatgacaggaagttatagcatggtgacagcactgcacccttggaactttatattagagttctctatgtctcactttccccattgaattctaaggccctccagggccgacttacctttaccaactgcgaagagctggactctgtcccttgcactcagtaggtgctcaatgactatctactggtttaatgaaaatgcgttcacccagatttgggtcagctcccaggccactccaattgggtgtgaaagtaacaggagccgccccttgcctcccagaccagatcctgaggggctgcgagggactgtggtcaaaggaaagggaccaatgaaaatgaagaaaacgctgcctcgctaagaggtgccacgttttcgttccgggctttacatttattccctctcatgaaggccagctggggtttggcttttctacttccatgatgtaaacgtattttcaagcattggttacttggcttgggagttcactgggtggacctcagcactgaaaaatctgttctgggagctgttagcactttctcactcccttcccccttaataaactaactgcaagagaaccaaaaaggtcagttttaaggtccacaaaggcaagcaacttacagtttccctaagaaagtcagttctcttttcttggggttaaattgtcattgacctgttatggaattttctagaaattcctcaaatttcttcaattttgagttgtgtggtcctgaagagaaaatatgtcatgctggttttcatgttgaatggcttccaacgtgaagtcctggcaagtttctcttctcagttgaaccccagcaggactttgaattaattctagtaaatgatggagatggatggcttgctcattgccaacttcactggagtaagttatggcaagttgacttaatatgtttttctttcctaccttgggtatcacatgcctggctaataccttcattactgtaatttccagtcttctgcaatctcattagagaagtgttttaaaaatataattccataaaaggtatgcagaaatgctaattgcaagttcctcaaagaaatgtgtattatggagtagaattaaagggggcatggattcaaaactgggattaaatacatgcaagaatgtaatctgtgcgtatagggtggcctgttattgaagatg

SEQ ID NO: 9181 - DNA, 922 bp, artificial
  synthetic oligonucleotide
gtttgggcactcttataacctgtggtttttgtttgtttgtttcctgggcctgtgctgaggaaacaaaaatctagaataggactttgataagccacaattatcttaatatatacatgcccatggtagaacgtgactcaggtggtgagttggtacccagagcaatgtaacactaataagaagctatctctgcttagtcacactaccgttaaaaatttcaatcctacctacttggaaatggcatgtaagaattccagtggctaagaaaacatgaatcatgagggttggggaaagaaaaattggatttgttaatgtgatattgaaaatctactatgtgtgtggttgtcttacacattttttgataccaaattatgtctagggatttagatcccaggacaagtatttaaatgtatttttttatttaacctctaagaaattgggagccagtgtgaagctgcaattcaagtccctatttcttttctttctttctttttgttttgagatagagtctcattctgtctcccaggatggagtgcagcagtgccatctcggctccctgcaacctctgcctcccgggttgaagcgattctcatgcctcagcttcccaagtggctgggattacaggggtacaccaccacacccagctactttttatatttttagtagagatggggtttcgccatgttgcccaggctgatctccagctcctgacctcaagcaatccacccacctcggcctcccaaagtgctgggattacaggtgagagccactgtacccagcccaagcccctatttctgatctctgccctcattgcaaacgtgcattaattcacccaaacagaaagacacttattcatctataaaattatattataacatacatatctaagttttccaaagagtgcatttgagctgctgaacccctt

SEQ ID NO: 9182 - DNA, 6685 bp, artificial
  synthetic oligonucleotide
caacaaacatgtattttatgcatatggtatcagtgaggatagcctaggttattctgcagtaacaaacaaccctcaaaatctcagtggttagtataaacaaaggtgttttgtttgtttgtttttgttttgttttgtttgagatggagtctcactctgtcacccaggctggagtgcagtgacgtactctgtaacttctggctctgggttcaacaattctcctgcctcagcctcccgagtagctgggattacaggtgtgtaccaccacacctggctaatttttgtatttttagtagagaccgggtttcaccctgttggccagtctggtctcaaactcctgacctcaagtgatctgcctacctcgacctcccaaagtgcagggattacaggcatgagccaccgcgcttggccaaaaacattaatttttttactcacactacatgtgcatcataggttagaagggggtgtttacttattgcagtcaatcagggatccaggatgactgagtagccaccttctcaaacattgctggttgccgagctagagggaaaagagagctctggaccacaagtatttaaatgctgtagcctagaagtggtgtacaacgcttctgcacccaactcatcagctggaactgtgcaaatagttgcacccagacacagagggccaggaaatgcagccctagaagggcctgcgaagtgaagagttggaaatacttggtgaacagcaccgatgactaccacacctactacatgccagacccggggcagatgaagatgggcaagatgcagtcccagccctatagtcccccctcacaatcaaaccagagaagtctctggtgatgcaattctacctccatggtataggctttggtggatctaggtgagaaaccaatcactgccaacttgagtgaagtcactgtgtgatacagcattttttttctggaacattgtgttagttgcaatggtggtgaacctattgcacaacggatgagataaataaatcacacactgtctcgtgggaggcaaaaaggccctctcttgggaaaacactgaatgaagacagttggacatgttgtcattctcttcaatgaaagttacaaatggcagtttaatgaaaaatgaaaccagaccttggcctcaaccaagatgaggaaggtgggaccagccctttttgagaatgtgttccaagttaggaagagctggtggccctgtgccaacacaaataacccgaaaatccggaggaaactaaaggcagcacagtcaatctgcacgctgggattagtttgtgaaactcaccaccaccctgcctggcagtgagtgagcccagggcttgggggttggagtagggagttgagggaggagggcaagcacatgtggctctttagtagtgagaagagacaactctcagggccaggtcacatctagctcagtccaaatttgaacagcaatggccctttttgtttcttggaggagtccatgaactcctggccgtgcgattttaaaccaaatctcttgcttttcctgtctctgaaaccacagggcacatttcaggagaaaattctggacagacacatccctatagcaccctagtttgccttctctatccgttttcccctagaggaagatacttcgagactatgcaaatatcctgtttctcctccaaccttctcccactaattttagcatccatcggtagatcatgcatgcaacaattattcctgtggtgttctaaaggcgattttctatttccctcattccttctatgtgaattcattggaatccttctatagggaagaattctctcccatttatttattcaattatttatttatgtcaatatgaattcatggacaaggagtttagtctttgggttagaatccaatgttgttattattgactttattgtcagtgtcccagcttcagtcattgcaagctctttcaggctggctcctgtgtctccattctttcttgagcactttcttactttctggcaccataatatgctccaggctcatttgtatattaccctattgtttttttcatttcacctaagaatatgcctcattttaagtccccttcctttttttttcttcttttagccttctttctttttctctttcctctttctttctcctttctttctttctctttctttcttttctttctttcttctttctttctttctttccttctctctctttctttcttttttttttttttgatggagtctcattcttttgcccaggttggagtgcaatggcgtgatcttggctcactgcaacctctgccttctgggttcaagtgattctcctgtctcagcctctcgagtagctgggacgacaggcgcatgccactacgcctggctaatttttgtatttttagtagagatggggtttcaccatgctgcccaggctggtctcaaactcctgacctcaagtgatccgccttcctcggccacccaaagcgtcggaattacaggcatgagccaccgtgcccagcccccatttgtatgtttttaaccaattctccaatcaaggacccactgcataaagtaatgctccattttatttgtactaagttgcttttctcaagttgtaacagttatgctacctggatctagagttttggaatttgggggaaaaatgcctgttaacttaattacatccgtcatcatattaaaatatttttgttatgcccattggcttcatacttccttagtttcatctgtcgttacaacatttttggctataaggatcagaaaccacaaatccactggtttaaatcataaggaaatatattgttcagggaacaggaaggccagaggcatagtgcaaagattctggctcctttttgctgtggtcctttcagctctgccctcgccctggttttcctcatggtcatatgctggcagtcagtggcaaagaaggcaacacaataccttggctgtgtgcatcaagagggataagagaaggggcaggagggggaaaaaagaaaacacctctccaactgtggagtaaataactttcctttcagtctgattgggccaaagtaggtcacatgaccacctctggaccaattacagatgccaggggaaggccagaaatggattggcttaagcctgggttcaggaaccaataattatcaaggggaatgtgattaccatgatccgtgaagaccggtggttctccaatgtcaggctgcatcagaatcaccaggaaggcttgttaaaatacagattgctgggccggccccagcctcagagtttctaattcagtagtcttgggtgatgtttgggaatttacatacctgattgtacatttctttcttttcttttttttttttttgagacggagtttcgcctttgtcacccaggctggagtgcaattgcgccatctgggcttactgcaacctctgcctcccagcttcaagcaattctcctgcctcagcctcctgagaagccgggattacaggcatgcgccaccaggcctggctaattttgtatttttagtagagatggggtttcaccacgttggccaggctggtcttgaactcctgacctcaggtgatccgcccgcctcagcctcccaaggtgctgagattacaggcgtgagccacctcgcctggcctcatttctaacaaattccctagtgatgctgatgttgttagtctgggaactacccttagagactaattctgcagctggggatgggatcagtggaccctgagtcacatgggctgcatggaggtgggatgcagggaggaatgggttcagggtagaccactgttatggtctgaatgtttgtgtcccataaaaattttttatgttgaaacctaatcatcaatgtgatagtattagggagtggggccttttagaagtgattaggtcatgaggccagagccctcatgaatgggattagtgcccttaaagaagagacccaagagaactagccatgtgaggacacagctagaaggtgccatctatgaaccagcaggccctccctacacacggaatctgctgacaccttgattttgaatttcccagcctccagaactgtgagcaatgagttcttgttgttgatataagtacccagtctaaggcaatgtgttgtagcggccccaatggactgagacagccacccactggtgtccactggattagcacgcgtcaaatctcaatgtgcacatgagccacctaggagtcttgttaagatgcagattctgtttcagtagctctgaggtggggcctgcgattctgcatttctattgagcaatgctgatgctgctggtccatggaccccactctgatgggaaagatactccactgccctttcccttcttcaaatcctcctctgctctctcatctattgattctacaatgatctgccaatcccgggatgccagacagcatcctatgtccttccctccactgaattcccaaagccctcaccatctgcagcattcattaagcacggatgactcatggccttgaatgttggatttaagtcacagttttcatcttcaactagaatataagggccttgagagcaagccctgctgcctcattttttccccctaagtcttcatgcctgtatctaggtagactagatgtatttgtcaaataaagttaggctatgctgcagtaacaaacctgaaattcaagggcttcactccacaaagatggatttctccttacatgaagtctgaggcaggacaagatacctctctctaccttaaaggtaaggcatcaggaacatgtactcccaagatggctgaggcagggaagagaagggtgggagaggcactgggcttttaaatgccttggtccagaagtgacacatatcactcctgctcatgattgattggccagtcctaatcctgtggccccaatgtaactgcaagggaggctgggaaatgtaggaaagcatatggaatatttgataccaaccatgccatagtaggtatcaatagtttcttttttttctttttctttttttttttttttgagacagggtcttgctctgttgcccaggctggagtgcagtggcatgatcatggctcaatgcagccttgacttcccgggctcagacaattctcccacctcagtctccagagtagctgagactacaggcacatgccatcatgcccagctaactttttgtatgttttgtagagatgaagtttcaccatgttgtccaagctggtcttgaactcctaacctcaagtgatccaccggccctcagcctcccaaagtgctgggattacagacgtgagtcaccgtgcctggcctagtagttacttcttgattgataatttgagtctctttctcatggtctttcctagtttcagtagatctttcttgagagttcatcaccaagaccacaccagattccagtaatgtcttccctgaccaacctatttatactttaaactccttccctcactactcctggctgaatcgctgtttccctgcttagtttttctccatagcactaatcaccaactaacacacattacttcttttgtttattgtttgtctcccaaaaagacaagtcaggaggtaagttccatgaggcaaagtcttatttttcttttttctttctttttttttttttttgagatggagtcttgctctgtagcccaggctggagtgcagtggtgcaatcttggctcactgcaaactctgcctcctgggtgcaagtgattctcctgcctcagcctccctagtagctgggattacaggtgcctgccaccacgtccagctaatttttgtatttttagtagagacgaagtttcaccacgttggccaggctgctgttgaactggcctcaggtgatccgcctgcctcagcctcccaaagtgctgggattacaggcgtgaaccactgcgcctggccttttttttttttttttttttttaactatttttgtggctattgtgtccccagtccctggatctgtgcctagcacatagttgatattcaatcattattaatgaattaatgtgtggatcatggatttctgtgagaggaggtcatgcttttgttttgctttgttttttaaccagtgccttcctggatgacattggccacgctggagtagatgtagtatatactgactatcaaaagcttgcactatctaacgttggtggtgccagcaacttctcttggtcttttgctctgctccttcctttgcccatctgtacactcaagagtaggagaagaagagactaaagagaaagcgtcagaaatattggtgccaagccctttcatctcttaggtttgcctctggatggaccacgtccccggggcaggctgggcaaatcactggaaagcagcctactaaatcgagtttccagggccactctgggacactgctgctctctctgtccacctgaaaaagaaagttcaaaaccacaagttactctccaagtcaccaggttaggtgcccagtttccctctgaggatctgctgccctggcaagaacaatcaaatccctttcttgcaattggagaggcgaggctcttaggaataacttcagccccatgccttttgtttcatcctcctattcctccactccacaaagcgaaatatgatagtagcagagtttctgtagcttttctaagaaattcctctttgctggcacataaaaaggactctcttggatttctgccattggctgtggagtttt

SEQ ID NO: 9183 - DNA, 5528 bp, artificial
  synthetic oligonucleotide
gtttttgataaagctcacatacaacatagccatcttctacgtgtttacctgagtgaaataaaagtttacattcatccaaaaagccatatgtgaatatttatattggctttattcataatcatcaatagttggtgagtggataaacaaactttgggatactgctcagcaacagtaaggaatgaagtattgatccgtgcaacatagataaacctcaaatgcattatgctaggtgaaagaagccaggctcagaagcctacagaatacataagttcttttacaggacattctgaaaagaacaaaattatagggacagcaaacaaatcagtggttgccaggggctgagagttgggggaggctgactacaaagagtcaacagggaattccttggagtggtagaattcttctacatcctgatacggtggtggttacatgactatatacatttgtcaaaacttctagaactgtacactgaaaagagtgaattttactgtaataagttacacttcaatttgaaaaacatggagtagactgaagaatccattaaatcgatttgtaaaatgggacagtgtttaccacaatttatttgattgcgggaatttattttatgatagctttccccaaatgttagcccgtttaagttccatcacccaccacctcacaccacaatcccaaaataaattccatgcggattaaatacctacacatttttgaaaccataaacattttaaaagaacttttttcttcctatcttgtggtcaggaaaacctttctcagtgaagcataaaaactagctcccaggttttaactaaagtcagaatccctcctttctatcttttgaatcatggacatcacagaaacacctccctctccctccttttgttaatttaatagcactcttcccagtttggatcgtgtatttgaaagcgacttggcacgctcaggcagaaaagtggaaaaatgtgtttttcagtttcatctgagccgtcaaagcaccaagaacatatgtcgtgatgtcctgctctgagtccccacaatgatcacatcagccatggaaaatcagcttctttgctggctcttccttgcacctgagcaaactcactttgccatttctggaaggctgttcatggtaccaaaaacacagcagctttcctttccctgccaaacccgccaatgaaatgccacttatctgactttttctccctctgctgaacaaaatcatatccatagttagagtacaatctttttcttttctgtatttccaacatttcttttttctagaaaaatacacacacctggaatctgtgttttttgggcaagatttcttcacagacaaaatactgatgctggccctgcctttcttcagtgtttttcagtagctaaatatgctctatcccccttttaatgaaagtcaccttgcagagatgtgggagtgataaaagcagaagggaatccgatccgggctggcatcacgctgaggccctgtaaaagaatactcctgaaaagctacaaaatttggccactttttgttttccagctttgcatttgagctgtgaaagctgccaaaccaagcaatgtccagctcatcttagatcttaactaagcaaaattttatgagatgctaaatagagactccccaatcctttgaaaataacacacaacttgtcaataaacttacaaaattatttcaatatcaaacttaattgtattgtctatcaataattaagctcctaataaactgttaactgttgatattaataaagtaataaattttgtcacaccatgcatgcctgggtatgctcttagacttatctcttcagatagccaaagaggagttgagaaagattggagataactgcaacatctagctagtcttcccttaataaacctctactctccatcacccaccatctcaaaccctgatcaaaaaatgggttctctttccacgtatggtgactattaggatcagctacataatttgtgggacccagtgcaaaatgaaaaggagaggccccttgttcaaaaattaagaatttcagcattaaaccaagtgcaggatgcatgtccatgaagccagccctgctatcagatcatgtatttggctagaaagttggtaagaaaagtaaaatatttcgctattaaatgagtagtgaaggaaatcaaatcattttaccccaaaatatatttctttgacatattttgaaatagttgacatatttctaaatattgacgtatttagaaagccagccagtagagctaatgcaaagctgtccttggtgcggaagatttgcatttgtagagaatctgcacggatgtagccaggctttatcgaggtcctcccttgtccagatctaagagaaattaactgaggatctgacccctttaaaggtctgaaagaaacatttactgtttattctctctgagggctgccacctgtgaggtttcattgacatctccagaccatttttgctggccaagcctcctcttctccccctctcacaacctcttttaccaccataacctgtttggggccatgcgttgagacccctttctttctgtaacctcaagataatctacatgcttctgtaccccattggggggctgggggtaatcactctattgttctctccccgtggacacattaatacatttgcatgccttttctccaatcaatctgtctttgtcagttaatttttcaagcgaaccttcagggggcgaagggaaagtttcccttggcctttatagtagcaagtgtttttgcgtgcgtttgggggtagaggtggcaaagaggtattaaagctatacatactgtaaagtcttaggacctcgtctcccaatctcccacttttcctaaggttttcagcctgctggacaaaaagtacttccgtagggcctgccggataaagtgtggtccatggaacagcatcagcagccactgggagcttcttagaaatgcagacgctcggcccccaccccagacctgcgggatcagaatctcattttaacgggatccctgggggattatcgtgcacagtacagactgtcactgtcgaagcagccacggaaaacctgtcccctgcttcgtctggctctcgggaggtcagctctcttcttccccctcactttttatcgggtttcggagcctcgaaactcgagtccctgccgaaatgcgctcactccgagaccacgagccccctccttccccggcgtgctcaccccctggctccgggccgccgctccgtccctcggtgcccggggccacctgttcggggccgcgccgagtggtgccgccccaagccgtccggggcccgggcgcgttcgcgctccgccagcaccgccgcagcccgaccaggcgcgcggagccgggctcccgggagttggcgtctagcacaccacccgcgcgagtcaggctcgtggctcagtttcccgcgggttggggaaagtacggctccgtccgaaggttttggagacgcgcgtctccccttggagcctcctttcccacggcgcgcgggctcccccagtcggggaactagccccggggctgggagctacgcctccgcctttcaggatgttcccgggccccggctaggaacagcagccgggcggaaggcgcgttcgtcccgccggcccgctggcccgccgccctccggggctagacgctgcgcccgagcctccagcgcccgtggccggctgtgcgagtctgggtctcaggaccccaaggggccagacccgtcctggcgccgagcgcttacctgccgctcgcgtcctcggggctggctgctggcgccgtccggcccgccttttcccctctccggggctgcggccctcctccccccgcccgcggcctcggcgccgcccccgccgctcccggcccgctccgccgccagctctccagctgcccagcgcggcgtggcgcgtcgggcgctcggcggcggcgaggctgggcgcggaggtggggagcgggcggggcgcggagggaggagggggagcgggcagcgcggccggccgaagccgggctgggagctcggggcaggggcaggggccggggagaagcgggggcggcgagctcggccgcccaccccaccgcagccgggggccccgcagcgctcctgggctccaggcactgcgggaccctcagatgcccggcgtccagcccagcgagctcctccttggggaccccaacggaccccaacctccagactcagcggctcacctttagggctcgccccggtacccatatgcccgtttcagtgtcgcacgctgtaatgggtgggagccccgagggcgcacttctaccaagatattcctgaatccggagatcagatgtcagaccacttgagaggggaatttggagagagcagtaaacgagaaatgtcccagtaaaggattcagttcgatggttttcctggtgaaggactggaaatacaccgggttcccagaaaccgggatctcgggcgctctgcctgctgggggtcgaggtggagggggtatataaagtgagttgtccctggtcccctctacctttctgtctcagcatctctcctcctgcatggtcatagaataaaaactagatctggataggacttacagatcccctaagcaatttgtcaaagtaccctattttacagatgggaaaatggaggctcagttctacaatacgaattagttgtagagaccagggaaaaaataagcgctctgaattccctttccggctcattttactgcccccctcccccgccgcctttatagtcgaataacacctgtgtttgcaaaatgctttgtcgttttaaaggcatcgttctctttcgttaaacctgcgggagaatataccatttttcctttacaactagaacaaaattctggattctgaattgcattcacagccctggagacgcgatggttatcaagtgcagatctttaaggcatatcctggctgactctgccattttagacacatgatgggcgagatgtatattctgctttgcaggaggggttgaatttgttttgcaaacaccagtttattaacactcacaacattctaactgaataaatgaatggacagtcttttcagagagacttttaactgattggattaagggagagtagagtcaggaagctcatccaggttacataaattaaaagttttgatgaaggggaaaatggtgtattaaataaacacacccggtattactccaacgggttaaattggttccgtttgaatgaacttaacacgtatttttaacttacatataacttttgcatattaacttctttatttttgctttacatagacctcatacctaaagaattttcatacaccgctagtgggagtgtaaatttttacaagcattttggaaaactctttggcagaatctattaaagctgagagtacaactaccctctgaccagcaattccccttctggatgtacacacaacctcaatcagtgtgtatgtttaccaaaggatatgaactagaatatcataccagtatatttgcaatagcccagattggaaatgacccagatgccca

SEQ ID NO: 9184 - DNA, 2141 bp, artificial
  synthetic oligonucleotide
gatgcagggccaaagttaagcacctccagctgttaccccattaatggtacaggttcaaaggggatggaattccacatgcagcacatactgaaccagcagtgacccaccctcaacaggtccccaagagcaaaggccatacaggagtcagacccacgtgcctgatttcctgacccagtgttctgattgcctgagctaattatccacaagcagctgttcccagcaataacaagccataagaagtggctcgctttacttcaggtaccatttggatgttagtaggggaggaagatgaagtattgcggtgaaaatattgccgggtgtggtggctcacacctgtaatcccagcactttgggaggccaaggcaggcagatcacttgagcccaggagttcaagaccaaagtgctgggattacaggtgtgagccaccacgcccggcctggactccctctttaaaaggcaatgtctttcacatcactcatagatgcaaaaaagcaagatgaaggactcatttctcttattttaaggggtattttgcaggaactgatatgaacataactctgaggactaggacaggccttggcaaagttaacaagcccacctcacttgaagaaaatcaatttcctctttagtactctttgtgtcttctaggtgggggccattcccaacttgtaggtgcccagtgacctcatactttttcactggctctcaggagaaggcctcgcatggaggcccatcgaccaggttctgtgctcatttaaattataacactttaaaccaaggaaatgaatctctaattgtggaatttcagatttcagccagatcaacagatgagatactggtgggggtggggagatgggggtggagtcatgcacagttattgctgtggacttgtgtgtccctcctgccaaattcatattttgaagccctaacccccagggtaacctgtctctccctctccctctccctccccgcttcccccacctctctctgccaactgaggacacagtgagaaggcagctgtctataaacccagaagagggaactcaccagaacctgaccatgccagcatcttgatcttggacttctcggcctccagaattaagagaaataaatttctgttgtttagaccactcaatctatggtattttgttctggcagcccaagttgactaagaaagttacagggtagtgtcagaggcatttgagccagagtgactccatcttgaatagggactgggtaaaataaggctgagacctgttgggctgcattcacaggaggttaggcattcttagtcacaggatgagacaggaggtcggcacaagatacaggtcacaaagaccctgctgataaaacaggatgcggtaaagaggccagccaaaatgcaccaaaaaccaagatgacgacaaaaatgacctctggttgtcctcactgctcattatacgctaattataatgcattagcatgctaaaaacactcccaccagcgccatgacggtttacaaatgccatggcaacatcaggaagttaccctttacagtgtaaaaaggggaggaactctcagttccgggaattccctgccccatcccagaaaactcacgaataatccacctcttgtttagcatataatcaagaaataactctaagtattctcagtcgagcagcccatgccactgctctgcctacggagcaaacattctttattcctttactttcttaataaacttgatttcactttactctatggacttgctcctaattctttcttgtatgaggtccaagaaccctcttttggggtctggatcgggacctcttttagtaacagtagcagtcacctagccatccacccttattgttttaatagatgttttaacattaaagctagccctgttgataccacgtgtactctcaaaataccaaatccaaaggactaagtgtctaattaggacccccaagatgcccaaacagagaaacaggagtctggcctgggggcagcacagcctggcagaggtatgcaaaactgtgagacatccaggacagtgtgcccagtgaggccaccctcccaaacatctctgcctgctgtgggttccaaagatgagacaaaccatagaatggggaatttcaaatacaaggtcttgaggggaa

SEQ ID NO: 9185 - DNA, 6183 bp, artificial
  synthetic oligonucleotide
tgggtgaaaaacaccaatcctcagatttaaggagcccaaagaatctcaatcaaaagaaataaaaagagatctacacctagatacatcatagtgaaaatgaaaaaaaaaaacaaaaacaaaaacaggaacatctgaaaaattgtcagaaatacaagacagataaccttcaaaggagcagctgttaggctgggcatgcagtggctcatgcctgtaatcccagcactttgggaggccgaggcggatggatcacttgaggccaggagttcgaggtcagcctgcctaacgaggcggaacccccgtctctaccaaaaatatatagattagccaggtgtggtggcgcccacctgtaatcccagcaactctggaggctgaggcaggagaatcgcttgaacctgggaggcagaggttgcagtgagctgagatcacactactgcactccagcctgggcaacagagcaagacttcgcctcaaaaaaaaaaaaaaaaaaaaaagaaagaaagaaagaaaaaggctgttaagaagctgctgttagactgacagctatcttctcagaagcaacaatggaagccagaaccagtggaagtctatctgcagtgtgccagaaacaaactgccaacttagaattctgctctcagggaaaatatctttgaagaatgagggcaagatgaagatattttcagacaaacagaaactgtgatgttgttccctacctgcaaatcattactgaaatcaatcctaaaacatgtatttaggcaaaagacataagaactgagatgaaaggaggaatgaggaacaaagaaagtggtgggtttgtggccaggcccatggctaacatttctaagatacagatcaagagtttaaaagaaggctttgcccttattcttcccctaaggcttcattccaagctgtaagaggctttgtgcacactcatgtgatcaccacagcctgcatacccctaaccccctctcctgcatgcatgtaccccttggtcatcccttgggtctgggggtacgtacacctgcagcatggcttgcaatgaggaaggggagtgcccaggtcctggaaattggcacagaatgtttggattgggaattccagggtcccggattcccagagtacgatctagaagcaagggtgaggggaagagggaggtagctccgggtaggcatgacttcttggtgccacagacttcttgccatttggagaagggtggagctagagaagggccagagaggggactctaaatcacaagtcacaggccagaggccccaggtgcccagaactaggggtagtactctctactggcaaatccaaatgaacttttactatataaaacagtgccagtcatggtggctcacgcctgtaatcccagcactttgggaggccgagatgggcagatcacttgaggtcaggagttcaagaccagcctggccaacatggtgaaaccccatctttactaaaaatacaaaaattagccagatgtggtggctggcacctgtaaccctagcttcttgggaggctgaggcaggagaattgcttgaacccgggaggtggaggttgcagtgagccaagatcgtgccactggactccagcctgggtgatagaaggagactgtgtcttgaaacaaaacaaaactactatataaaacaataacatcttgtagggattagtgaaacatgataaaataaaaacatatggcaactacctcatatatataaacataggagacaatatatgcattatatgtaatataagtaaggagatgacaaaatgaaattcaaaaattaaagtctttcaaggtccttggattatactagaggaagctaaaggtattgattatctttacacattgaaaagttgagtagacatgttgtaatttctacaacaggttgtaatatctttagtaactaaacaacagaaatgggacatataacttcctaactagtggaggaggaaaacagtttctaacatattcagtcagtctgaaaaaaggcaagaaagaggagaaacagcaacaaagaatggttaggaaaaatagaaagtaataaagatttaaaaacaaatgcaggccggtgcagtggctcacgcctgtaatcccaacacttcgggaggccgaagcgggtggatcacctgaggtcaggaatttgagaccagcctgatcaacatgatgaaactctgtctctactaaaaaaaaaaaaaaaaaaaaaaaaaaaaattagccaggtatggtgtcaggtgcctgtaatcccaggctacttgggaggctgaggcaggagaatcgctagaacccaggaggcagaggttgcagtgagccgagattgcgccactacactccagcctgggcaacaagagtgaaactctatttcaaaaaaaaaaaaaaaaaagcagatcaatgattcatgaaatataaatggactcaatgattccattaaaaggcaaagattatcagactgaaaaaaatacaaactccaattatatgctatttacaaggacacaaatagaacctaatgattcagaaagtttgaaagtaaagagatggaaaagatatgctatgcccacactaatcaaaagaaaattaatgtgtttatactaatatcagacaaattatactttaaagcaaaatactttacctagaaataaaaccgttcattcataaaagattcaattctgaattgaagactgaagaaatttacatgtgaatgcaactactatagcctcaaaatacaccaaacagcattgacagaatataaggagaaatagaacaaatccacaatcataatgagagatctctatcagcaattggtaaaaattaaataagaaagtcattaaggatatagaatatttgaatcacacatttaaccaacaacatgaggaccatatctagaagcccccattcaacaactgcagcgcgcataatcttttcaagagcacatggaatgtctgtgaaaaccatccagaccaacagaaaagtctcaaaagctttttaaacaattggaaaacagaaaagcagcatgttctttgaccacaacacaattaaggtgtaataacaaaaagttagatgtgttatttaacaaataacccatgggtcaaagaagtcacaatgtttattagaaaatattcgccaggcgtggtggctcacacctgtaatcccagcactttgggaggccaaggcagaagggttacctgagcccaggagttcgagcccagcctgggcaacaaagtgggaccccccctccatctctacaaaaaaataaaaaaattagccgggcatggtggtatgcgcctatggtcccagctgcatgggagtctgaggcaagaggatcgcttgaggcaaggaggtagaggctgtagtgaaccatgatcacgccaatgcactgcagcctgggcaacagagcaagaccttgtctcaaaaacaaaaaagataaaagaaaaaagaaaatattcgacttgatcaataagaaaaacactgtatataaaacacataggatacagctaaagatagagtgaaaattatattttaaacatacaaattagaaaaagagaaaggcttaaaattaatgaattaaggttcttaagaagtgtgaaaaagtacagcaaaataaacccaaagaagaagaaggaaggtaataaaaaaaaaagcatataataaaaacagaaaaaagacataaagattaacaaagccaacgttgctctttgaaaagacaattctggcaaaatcaagagacagagggaggggagggaaaaaggggagaaaaagagagaggcagggagtgaggaagtagctaataagaggtacggaaaaagcaacacacctgtaaatgctataaacataataaatataaaaggctcttagcaaaaactgtcttcaataattttgaaactctagatagaaagggacaaatttctagaaaaaaataccaattaccaagaaggaatcaagtggaaatggtaaacatgaatagtaggtataaccattaaaagtctcaaaacttgtcccacaaagaaaactccaggcccagatggcttcactgatgattctatcaaatatttaaggaataagagtttcaatcgcacagaaactcaagaaaaagagcacatctgaactcacttttacaaggctatcataaccccgatgccaaaaccagacaaggaaagtccttagatttttgcccattatataaatcaaatgagactgttttcagatttctccaaaatgctcacagaaatgtctagaagcaatttcaaatcttgtaaattgaggtagtttgaataaatattggacaaaaggaactattctgaacttcagcaacaaaattttttgaagataaggtcaccaagaactaaagccagtattaccgtagtaagagaaacaacatcccatatgccaaaaacaaccatgtcctaaagatgacagaaactaggttaactggtaagtgctgaataggaactctaaaacagcagccttgtatgttgtttgtcagagcacaaagtaaagccaatgctgagccatatggcatcattgcagtgtgaaacttacacatctctagaatcaaatggaaggaaatgatttggtctttacagtgcaaaaatgattttcttaataagcggtaagtgctttctgatgcagaaaaaggaagctttattcaataaaacaagtgaatcaatatcagacgtgcaagattagaactaaattgtgcgcttaatgtaaacatacactcaccaaacctggtgaggggtgttctgctttttgtctggtttggtttttgtttttttttttttgagacggagttttgctcttgtcacccaggctggaatgcaatggcgtgatctcggctcaccgcaacctccacctcccggttcaagcaattcttctgcctcagcctcctgagtagctgggattacaggcgcctgccaccacacctggctaatttttgtatttttagtagagacagggtttcacccagttggccaggctggtctcgaactcctgacctcagatgacccacccgcctcggcctcccaaagtgctgggattctagacgtgagccaccgcgcccggctgaggggtgttctgttttttggctcccttgctcatctccagatttctccactctctcatacctgcgatctaccatactcttgattagccatgtgtgaattatccaacgcaaggtgaaagcctacttcatctctctcccctcattcttcagggtctgcccccaatgcttgcagtatgtttaacacacaataatgagcagaatagcataggattcgggagcatgcatggtagagccatctgtctgccttcacatctaagctccaccacttatagtgtaaacttgggctgttccttaacctctctggagtttaaattcttcatctgaagacgtggaagtaatgctaagacctatttcacagggttctgtggggattaaatgaggtaatgtaatgaaagtcttagtgtagtcaagaagtgttagctatgattacaagcataattagaagacaagtttttgggtttcttttattgttttttggttgttgctgttgtttgcttgtttttttgtgacagggtcttgctctgtcacccaggctggagtgcagtggtacaatctcggcttgctgcaacctccacctcccaggctcaagcgatcctcctgcctcaggctcctgagtagctgggactataggcacacgccaccatactcagctaaagaagataagtttataatacactccagtacaaactgtaaacagattttggaattatttccaaaataattgacattcattcatctagttgacgaatgtttattgaagttctattacaagcaagattctatgccagggacttgagataccacaaaaaacaaggcagatatctttcctgccctcgatagcttaatagccactactcagattcattggtcattggcatggccaaatcaatagtgattttttttaaaacaacaaacaaaagatactttctcttcatggtccatcagactcgactttgcctaaaaacaaaaacaaggaagcagaacacaatagcctctcctatataggcttgatctccacctcacccccacacccacagcaggcactcgacaaagattttttcattgatttggtccagaatctactgctgcaaaataattctatcaatatgtagaggagagaaat

SEQ ID NO: 9186 - DNA, 523 bp, artificial
  synthetic oligonucleotide
agtaattaatgcccattaaactaagggtgggacaagattaatgctaaaatcactctccccagccaccattttctctcttgttctttgtcatgatattgacaaggtcaaaagtcaggcagtcagcatgaacccgaggaggagaagtccttgccactttgaggctgaatatgaacagccccttctttatgactcaccctatcagctttgctcctagcgaatgttcatatcgtggttctccgggacccttgaaagtgggactcctatgtgaggaactagttctataaacaactacatgctagtaaaaaaccattaagagggttggaattaggcatagtcctgctgcatagaaatcctacttagttggaaaaattgtatttttaagttgcctctgttttgaagccacgttaacccttaaccttcagaaaatccttagccagcctttatacattggtagctcctgttctaataatgtcttctcctcctattttctttggcttgtcatgagctttgaaagtttgatctg

SEQ ID NO: 9187 - DNA, 3154 bp, artificial
  synthetic oligonucleotide
ggaaattctctctttcctctcctccaatcccactccaaccatgctttcatttcttcaaagtggcagagcttcacatgaagttgggatgagaggaatccagttaaagaattcattctaaggcggtagttctcaaacaggggagagtctgccctccaggggatatttggccatgtctggagacatttttggttgttacgctgaggagggtgctactggcatctggtagagagaggccagggatgctgttaaacaccttacaatgcacgggatacccccacaacaaagaatgatccagcctgctggaagtcaagagtgccaaggttgagaaaacctgctccaaggaatggtagcatcaggcaaggtctggaaggaagaagggaaggaccatggcaatagctgctaactcctcaagctggcaggagccattcctccgtaactgtgctcagagaccacctcctgggctcaagcgatcctcctgcctcagcctcctgagtagctgggactataggcacataccatcatgcctggctaattttttgtagagaccacgtctcaccatgttacccaggctggtctcaaactcctgggctcaagagatccacctgcctcggcctcccacagtgctgggattatagtcatgagccaccatgccccacctacaggtcaccttctttctgggggttcccctatccctccgctgcagtccggtttaattgctcctgctgctctacattcagagacttagaacatccatcctttggtaccctatacaagccaccttcagtgcaggggttgcactgtattgttatttgttgcatcttgtgtcttccccaccagattctagagccctggttctcacaattagcctcatgttggaaacatgccaatgctgggtctcagcccctaaatactgatttgttatggagcatgcctgggcactgggatttttgaaagctcccaggtgattttaatatgcaaccagggatgagaaacattgctctagacttggtttcctatctcagagagttgggtttatccctgtggatccccaaggccgagcacaaagtaggtgttcaacaaatgcctggtgaccttaaatgaactcagttctatttctagtctagtaattaagagtaattacaagtatgccaagttgtattctaattgtaaatttgtgagttaaaaaaaaaagttttggctgggcacggtggttcatgcctataatcctagcactttgagaggccgaggtgggcagaacacttgaggtcaagagtttgagaccagcctggccaacatggcaaaaccccgtctctactaaaaatacaaaaattagccaggtgtggtgcacatgcctgtaatcccagctactcgggaggctgaggcacgagaactgcttgaacccaggagggtggaggttgcagtgagccgagatggcaccattgtattccagcctgggcaacaaagtgagactccatctcaaaaaaaaaaaattattctattgcccagctaaagtttcagatccttccagagcattgatcttttctgctttacatttcacatatataaatgaatagttagaaaagctagatttcatcaggaggtcaaagaataggcataaaggacatgaataacaccccaccccactcccagttcttactagttgaacttcttaaccactacaaactgagtaggccctagggatgtttgctatctgccaaatgcttctctctgcctaggcattgctgaatcattagatgtagccaggtcaaaaagctaatttgaaagatgacccataagaagagggatttgttttgttttgtttttaaatgaaagatttttcttttcagtgtcatcacagacactacagcagatttgcttcaaaagtttataacaatctcatttgtgaggcagtagcaatgttgagagtagatgaattttgtctctgatgctgcttcactggctgctatgagggcataaacgtgaagttgacccttttggtgacggacacagtaagatcatctcctggcctaggccatcctggtggctgacattttgacttactgtttaactgggggcactttttttttttttttttgagacagagtttcgctcttgtcacccaggctggagtgcaatggtgcaatcttggctcactgcaacttctgcctcccaggtttaagcaattcttccgcctcagcctcccgagtagctgggattacaggcgcccaccaccacgcccggctaatttttgtatttttagtagagatgggatttcaccatgttcgccaggctagtcttgaactcctgccttcaggtgatccacctgcctcggcctccaaaagtgctgggattacaggggttagccaccgcacccggccaaggggcatctgtttgtaatgcatttctcattgtctgtgcttgtccttctaagcccaggtctacttaacaaagacttttctctgacttatgaatcactgatgcttcatgaaagcatcaacaaatcatatatttggagtcccaccttggactcctctttcaaccatgctggatatcaaatcatattaaaactcaaatgctaattcaaatgaagctgttatataacttcagcgcatcaaagagcctcatggggataatagttgatgtgattatggttaatctgcaaggaagtcaagaaccaattggctctataacctttgggctggtctctttcccattctcagttttcaattgcaaacatggctcaaaaagtatccttccatagttgatgtctgcagtttcaaatcaaacggcagattactcactttaattcacttagagacaggactccagttaaggtgccattcgttatatgttgattctgttagaagcataaaatcattaagaatataacaaacattgttttgttttttcactctctaacagtaagttgttcttcagttttatcagccactcaaataactataccccaaagactgaatcctaactgtaaggaacattgtctatctaaatgatcaagctgcagttttatagaaaagggagggcaaaaagtggttcttaaaagttaatccatattggctgagcctgtttttgtttcatgttttctttaaaaaatattctaagtcagcagctctgatgtgctgatttctgtctttct

SEQ ID NO: 9188 - DNA, 1833 bp, artificial
  synthetic oligonucleotide
attacatatgactgtgaaggctgctgtgaagtattgctgggttttattaggatgatagcaggagtcaatatgctgattagatcctccgttttctaggagcattccgttttccagttcacttagcattcccttagggggctttgtactcacaagtcatccggtgaaccattggggaatttcccataggatccaagcccatagttatctggggatatagtcaggatgatggtcacaaccacagctggtacccctggaagatgggaaacattggtcacacctaattttttttttttttttttttgagacggattcttgctctgtcacccaggctggagtgcagtggtgcgatctcggctcactgcaacctccgcctcctgggttcaagtgattctcctgcctcagcctccctagtagctgggattacaggcgcgtgccaccatgcctggctaatttttgttttgtatttttcgtagagacggggtttcaccatgttagccaggatggtctcgatctcctgacctcgtgatctgcccgcctcggtctcccaaagtgctgggattgcaggcgtgagccaccgcacccggctggtcacacctagttctaataaccaaagtgggtgacaagactagagatcacatcctatttacatcttgtagcagagactggctagctgttcaccaggctggtttcttttcctctttggcacatgactggatgctcccagcctcccaggcagctgggtgtgtgtggccacatggctcactttgggcccatgggatacgggcacaagtgatttgctccacttccaggcctgccccatagaaacctcctgtgagatcctctactttctttttgcctgcaaacttagggcaaccttgaggcagagtcttcaatagcttggatccctgaataactgcaagaccagggactcctctgcccctgctaactagactgtaggtgagtgagaaatgatcttctactgagatttcaaggtgaatctgttacagctgccagtgttgcctttaactccccaccccccacccggcccccctctgtcacccaggctagagtgcagtggcacaatctcggctcactgcaacctccgcctccgcctcccgggttcaagcgattcttgtgcctcagcctcccaagtagctgggattacaggtgtgcaccaccacacctggctaatttttgtatttttagtagagacggggtttcaccatgttggctaggctggtctcgaactcctgacctcaggtgatccgcccacctcggcctcccaaagtgctgggattacaggcatgagccactgcacccagcgttgtgcctttaacttatacatgtctggaatgtatatttaagagtcagcaactcctggcaaatctttcattatgaaaccaaaagtcctcaatttgaagactttgagacccagtgaaggatggagggttctgtcctggctgatccagggggtggtgactgctactatgctggctctgttgagagcccacggacacttcccttcagagaaggtaccatgagaagggtcccccaagtttaaaatggcttttggtggggaaagaatcctattcaccactgcacaccatcacccgccagccccatgccaccgccccacactctgcacactgaccagcagacgtcctatctcaaggctctggtaaagaacaaacaattccttgtcacagaccagttgcagtgcctggtaaaatcaaatctaatagttcatttaatgcctttgcgcttgtaccttctggtgaccctgacatatgataattttctaagtgagacactttgttaaaaataaaacattgg

SEQ ID NO: 9189 - DNA, 4337 bp, artificial
  synthetic oligonucleotide
tgcataaatgttactgcactacgatcatttattcttgtaaccccagcactttgtagagtgctttgcatataacagatacaccacaaatatttcctaagtgaggaaacaaggctaagaaattagttaagaagggaaaatggtcagtgccttggaaatgaccatggctcccaacttgcaggtcaggcctctaacccctgaatgccacttccttcgttgactttgaaggccctataaatagttgctgttgattgagggcaagaaacatagctgctgtcttcactaggaataaaaatagttcagtggtcttacactgatggacccacacataattttagcccaggaatacaaagcatagcaggcaaattcatacctcggaccacatgggcagtgtcataggaccctgtgagcttgggagcctttgggtctgacctgctacatgcagtgacctttctagcctcacaattttcttatctgtaaaatagcaaccaaagtagcccctaagggcttcccaggtgggtctctaccaagacagctcatgggagggacggtagctgtcgccccacactgcagagtcctgcgtaaacttcaggagcttcttcactcctgtctactgttctcattcagtgtagtctgtccaaaccccccacacctcttctcgtccaaaaaaagcagagtcaatgcaaaaagaggcagtttggacccgggcacggaggcggctcattctcatcctgaacaatggccaaagaattctgtgaaaagtagccgtagcaacagttaggtcccctgaatcttaaggagcacggggtggcaatggggtggtaatcactggctagcaaggactagattcaaatagcaaactcttaattgcaaggtctcaggtcacaagagggccagacctgggaaggagaatgagttacatgagagggtagttccacgcgttccctgggggcggtccctccttacctggtaacacaggatggtttgctgcaccagccgcgcgtacccgtccaagcggaccccggaattgctcctgctccgcatctccccgaggctcccaggccgcagcgcccgatctgccgcgtgggcgcgggacgtcggggctgtggcctccaagcgggtctggttcccggacactcacagccttagtcggttcttgggatgggaccgggccggaggaggtcgagacttttctaaacgctagccccaaagtccggttggaaagcaagccaaccagagctccgcgcggcggggaggcgcgggggcggggacgggggctggagcgacgaaggtcccgcctcggccaggcctgctgggctcccgacgctcgcgggagcagcgggaaaccaggttccgggagtggggcgaggacgcccctgccaagccccttttacgtcccggcggtcgcgaggaggtcccccgggcgcgaagaagacgccagcccaccccagccgccggggagatcgcccaggccgcgctcagccccgcccctggctctgcccccgccgcggagcggaaccctccaagtcgcggcctgaggaggaaggaaaagggggcggcccgggagagccgctgcgaaatcagcaacgggcgggaaccaggttgcctccctgagtcccttctctccccggccggctgccaaccacagccaaggccagagaaacaggcccttctgccgcggccacctgggcgccttggacccgccctccggactcgcccccgcccctgccgcggagtggaacgtttggaaccctgaggggcacaggtaagggggcggccccgccccgcgccctggaacgacctcacggccccgcccacatccccgcccctggccccacctccgccgcagagcggaaccctcagagtcgcggcctcgggggggacgaaaaaggaggcggcccgtgggagtctaggggaacccggcttcgggcggcggacgagttggctttcctgcgtggtagtgtggagccccccgagacgggtgccagtcccactcgaggccggagaaagagggccgcctaccgcggccgcctgggcacccctctgagggccaagattgtagtcccacctctggccccgtctccgccgcctagcggaactggagtagcgggacccagcccggaagaaaaagggggaaggcccggagaggtgccccagcgacacctctggcgcctgtgaccccgcccctagccacttgggcgccgcttcctcgggcaggttcgcagttcatctcccacgggtctacagcttgaaacttggcattcattataatgtttcgtggctgctgataacctacagttcacaatcttcggcctggtattcattgtccaccaaaatctggcccacataggaatttactggacagctagactaatgcaatcaatttccgcaagctcttttccagtctccatgcatttactctatgcttgaccccttcggcccttcttcctcctccttgactaactgaagcctatctttcccttaacggccagctcagctcctctattagccttccccattttctgaatttctgtagccattggtttagtaagagcttaggacttagagtcagttcattttgagttcaaatgtcagttctgtcatttacaagtcgtatgacctttggcatcccgttttacatgtttgaacttaagtgttctcatctgtaaaatggagataatcatagcacctacctcacaggatgacttaagatcaagaggatgaatataaagcatttagcacaagcctggctagtagaaaaatacttaataaatcatagctaatttcgttgtcacttggccacaatgtattgcctcctgttgttatttatgttttcatgtgtggatgaggcatattttcctaattggaatgtacgttattcattgaaacagtcttttggtatctcctactatgcctggtacagtgttgagcatatagttggagctcaattaatgttgctcgcatgagtaaatgaaatcagtcctgcttagctgcgttcccttatgtttggtccttaaccaagtttatattagatattccagaacataaatctatggctttactctgtcactcaactaaagcaccaaaccccacatcagctcacatattacttcatataatactttgttttcttaatattggcttttgaattatgcagtgatccatgtgatgtgcctccatgaagaatttgctgtggtctaggggtgaataaaactagacattgttatcaccactaaatgttttggaatctgaatatgtactcttgctagaattttcatgtattcatctccatctaaaagctgggatcattgcttcttttcattgtggcttttgtttccattgggtccttccttaggagttgattttgcagccatatgggaaataactgatgatctttgctccttatctggcatttccacctagtatagaaacattttcagtttcctgacttcattcttcgctaattctgctgtgcacatttgcaccccttttggtgtataggcaatctacattcttcggctttggtctatgcgattgcatagcaatatataagctatgttcttcaataagctcaaaattctgggataaaaccaagaaggaaggctactccgttttagcttttaaatttttaaagcaaattttagtgattcattttggaccagaaagctgtactatataataaatcagtctcacattttagtatcctcatatccctgaggtgcaaaacctccatatcttggtccccatatccatgaagccattctctggttatcaccaatagaaacttgtctccaagtcatttctcaaatatttgtcaagaatcagatatagtataatgatagggaatgttattgtttctgaagctgattcatgatctccataaaaatgaagacccagaactggaccctggggtagcaccatgtatgatttttctgaccccagccagaggatctgccatcatcctgccacagagacttcagcccaggtagtttccagagagccccatgttaacatccaaggtggaaaccaataaatgtttctcttgtagggttcaggtctttggctctaaagaaaatcactccatctttgacccagaaggtcaattctgaatgaatttgctgaaaatgaccaattcaccaaatttagttatttctatgataatttagttgactggaaatcattttttcgttacattttaaagaatgttgaatttgtctctgctccagcttcctgtagctcgtttgaggctaagagataaagagaggaaacaccagggaacataagatttcttcacagtgaggaatatatttattaaatatatttaaaagaatatattctaa

SEQ ID NO: 9190 - DNA, 1667 bp, artificial
  synthetic oligonucleotide
ggaaggcagaattctcaagatgcggcttttttcttttctttgagacagggtcttgttctgtcacccaggctggagtgcagtggtgcaatcacggttcactgcagccttgacttcccaggcttaagtgatcctcccacctcagcctcttgagtagctgggaaaacaggtgtataccactgtgccttgctgattttattttttgtagggagggtttcacattgttgcctaggctggtctctagctcctgggctcgagacctcctgcctaggcctcccaaagcgccaggattacaggcacaagccactacgcctggctggatgctgttttttctaacctctccctcagccgaggcagtatgcttgcctgagaccttgaagtggcagctagtggctgtttaaaatcccttttggtgacaagtagaagcctctacatttagtttccaaaagagcagaggcagtggtcccagtgacagtgcccagcattgggggtgtctgtggtgtaagtcctggggtatgaacctgggagtactggagaatgacatgggatcttggtcctggctagggagccgcttagcctggtgaccatgtgacctatccaatattgtttaataaacttcccacttaacccagccacagttggtttctgttgtttgcaaatgaacttcgagacaatggcagctggtggcacagagattagagccagttactgggatttctctttggcaagtccatcctgggtttgcatctgggaagatctttcacaaaaggagatgtggaaggcacaaccatcccctcgtgcccaattcagatgcagcttaccctttgcagagcctggcaccttggctatgccagctgcaggggaaaggggtggcggccacctgcaagggttgggccaatgctgcacaggattcgggctcaagacaccaacaccctgctaggccagcgcagggaacactcaccacgggagcctaggggcttcctcaggggccttcaagcacaaaaagagatacttttcaccctcccaccccccaaccaggctgtatgcctgcctggccctcagtgggcatggcagaaatgctaggattcgtgttggattcatgcatttttcagaatagtttaaggactgcacgaagacagagggacgaatcacatgacttcagagttcattggttccaactattccagctctcctgagaaggcatgttttgccaaaagtgcacatatgttcctctaaagaaaaccatggtagttttttgatggaattttttcctctcccaggcatcgtcagacgtgcccagcactcgactgcagagcagcctctctcacagtttccactctcatttctcaaagaactctcttggtacctcaaggccgtggctttcctaagtggctttttgagggagacagcagggactgggctttaagggggccacagcgcagctttcttttcccctcacaggcagagctatcagtagccacgtcgggtagaacagaaggcattctgggaacgcggtgctctcacatcctgcaaagtacaggcctgcagagcagatggcagggacttcaaaagctaagtcaccttgaaagataatggcacaaagggcgattgggggtggggtgggtgggaggcttttgtacccttttgcaacaaggaagcagaaaagacaa

SEQ ID NO: 9191 - DNA, 1955 bp, artificial
  synthetic oligonucleotide
tctaatcaaagggtgtccagctctaagcagcagcatgggggtcaaaattctggcccatctgacccctgagctcctggtggtgacaggggcccgggaggtagccaaagcaaggtgttgagaccttaaacccaatgctgcctgtgtcacaattttgccaaaggctaccatctgggaacagtccctagggtggctgtgcccacatcacagcagaggctacttaagggctttgtgggctccaaagcatgagccacatttctcctgaccttgaaatggactctttgagagaggcaggggggggacctggtgtccttgcttcctagctgggacagccagcggactcggaggagctaagagacttgccactgtccacggtgctgcatccccagccttgctgcaccacccagttgcaagcgtgacttctatcaccctgggctgaatttagcttcctaacccctgtatgctaagctgagaattcccttccccttcaatatttctcttcatatctactatccaaaccttgaataaactgaacaaatgagtctctcttctgaggtaaatttgttagagactaaagcaaggttctttgcctagatctaggtaaacatggaggccggaaatgggcttctttctgatctgccactgacatgtgtgaatttctgaaattcacaagccctcttgagtctcagtttcctcatctgtaaaatccaggtgctaacagcagccctaactaagcaggcatagatgatgatcacgtgctcttcagcacctgtggaatgtgtccctcagctggagccacagctcaagtctttactctcctctagtttccaagacgcctgaggtttacaggtagaagacccccagaggacaaagtagctgattccagggattccttggagccaatcctcttggcctcaactatcccctcctatattccctctccccaccggctggggtacgtactccctggccagcctcctggaatgttccactggtccccacctcccagcacagtacccctccctcccgctagtggatgactcactacatttctttcttgctttttttccgattgtgctttttttaagtttaaaaaagaaatgtgtcaaagtcagcatagcacatctatttaaagtgcagaggaagcagcctctgaacaacttgcggtgtggagcctttagaacctttccaggcctcagccccaaagtctgtcactgttgctttctaaagccccaatatgaagggcagtggacgcttagggacgtcaggggagaggtaaggtgagagcaggagaaggcagggcggaggagggtgccctggggatagagtcccggccactgtttcctttgcccaccccatcccccgaggaaggtggcgccagcagatgcaggtatatggctttgtacgtgcatgtcggcttgaacgtggtgtagggaccacgtagggtttcaggcctgagacagcggagggagctgaggaagggaacaggcatcgcttctctctccctcttctgtcatttcatcacccccattttccagttactagattatctcccctaaatagcagcaaagcaggggctgctcccgaaggctgtcagctcctcaaaataggtggaaggaagtcacatggcctcggcactggctcccttcctggctccgcctctcacacatgtccctccagacctgcggtgaaatgaactgcttctcccctctgcctctgccatggctccactgccccctaacctttaaagcagatctctctgggcagggttggcaatacttgtcattcttcccagtgacttgggacaaaagccaaagtctggactccttggtggctccactcccgccccctgcagacgtgttgggtgcagtactgcctcccacgttcgcactggcggttccttgctgcccggcaccgtctcctccagctaaagtgaggctcaggccctcacttccttc

SEQ ID NO: 9192 - DNA, 11171 bp, artificial
  synthetic oligonucleotide
cagacccactttacagacatcagtggatgagtgagatataggaggtggacgagatgcaaaaagtgaccgtgtgtttttcattgggttgtggcaccacaacatagaaagaatcccacctgggactgaagtctctgtatgtggcagaataagcagagggttggactaaagcatgaatttgttttatagatgaaatctgtgctgataccaccaacggaaacaaacagagaccatgacactgactcgaagcacaataaagtaggtgtgacttttaatgcacatggaagaatcaaaacaaatggatctcctactgaacacttaacagagcatgaatgggaacaggtaggtaatcagggtgttcactgcagtggcaacaatgacactagcgtgcatgttgtcccttacaatatatagataaaaagtgactttacctttacgaggagaccacatgattctcttggaattcatcactatatttttaacagctttattgagatataattcacataccatgtaactcacccatttaaagtgtataattcaatggtttttggtatattcacagtgttgtacaactagcaccacaatctaattttagaacgttttcatcatctgaaaaagaaactacatacctattagcatcattccccattcccttctgtagccaccctgtgccacctaacagccttaggcaaccatcaatctactatctgtctttacagatttgcctattctgaacatgttgtagaaatggacacatatgtgatgttttgtgtctggcttctttcactcagcacaatgttctggaggctcatccatgttgtagcatgtatcagtactgaacatctatttgttgctgaataatattccattatatggatatacacattgtatttattcattcataagctgatggacgtttgggttgtttccactttttggctactatgaataatccttctatgagccatcacatacaagtttttctgtgcatgtatgtttttatttctcttaagtgtgtacctaggagtggaactgctgagtcataaactaattctaaaaaagtttaacattttaagaaagtcccaaactgttttcccaagtggctgcaccattttacatttccagtagcaatggatgaacgttccaatttctccacatcctctctaacacttgttattgtctatcattttgattatagccatcccagagggcatgagatggaatctcattgtggttttgatttgcatttccctaatgactaatgatgtcaagcatcttttcatgtgtttattggatatttgtagatcttctttggagaattgtctattcagatcctttgcccatcttaaaaactgagttatttatctttttattattgcattgtaggaggttttttgaatatattctaaatacaaatcctttatcaggtatattatttgcaaataccctctcccattctgtgggttgtcttttcccctttcttgatggtgtcctttgcagtacagcagtttttaattttggtgatgcccagtcaaaatgatatattttttctctttggttgctcgtgtttttggtgttgtatctaagctattgcctaatccaaagtcataaagatctattactttgttttcttctaagagttttatacatttagctcttaaatttaggtgtctgatccattttgagttaatttttgtgtgtggtgggaggtgagattccaaattctttctgttttatgtggatatttagttatcccagcaccaattttttttttcttttttttgagacagagtctcgctctgttacccaggctggagtgcagtgacacgatctcggctcactgcaacctttgcctcctgagtagtagcttggattacaggcatgcattaccacgcctggctaatttttgtatttttagtagagatgagatttcaccatgttgaccaggctggtctcaaactcctgaccttaggtgatctgcccgcctcggcctcccaaactgctgggattacaggtgtgagccactgtgcccggccaccagcaccatttcttaaaaagactatactttccttgttaaattttcttgacacccttatcaaaaaatcagttaaccataataaaagggtttatttctagactcttaattatatttcacaatctctatgtttatccttatgtcagtactgtacaattttgattactgtagctttgtgggaagttttaacattgggaagtgtgagttctccaactttcttcttctttttccagatcgttttggctattctgggccccttgaatttccatatgaattttaggattgatttgtcaatatctaccaaaaagcagctgggatattggtagggttgccttgaatctgtaggtcaatttgggtactatggctgtcttgagatgtctttccatttatttagatctttaatttcaacaatgttttttacctttcagtatacacgtcttgctcttgttttgttaaatttattcctaggtgtttttgatgctattgtaaatagaattgttttcttaattacattttggattgttcattgctagtgtatagaaatacaactgacttttatatactgacattgtgttgtgaactttgataaacgtattagttctaatggtttttagtggatttcttgagattttccacctacaagattatgttatctgtgaataattttacttcttcctttccaatctgtctgccttttcttttccttttttttctttttgcttaattgccttgtctagaacctccagtacactgttgaataaaagtgaagagagtagatgtctttgtcttgttcatgatactggggaaagcattcagtctttcatcaagtatgatattagctgtgtatttgtttgtagtggccttttattacattgaggaagtttctttctatgcttagtttattgagtgtttttattgtgaaagagtgttggattttgtcaaatgctttttctgaatacattgaaatgatgtgttctttccctttattctattaatacagtatattatattgattgatttcagagatgttaaaccaacctgacattcctgggataaatcccacttggtcatgatgtataatccaccttctatgttgctggtttccatttggtaatattttttgaggatttttgcatctatattcataagagctattggtctatggttttcttatgttgtgatatctttgtctggttttggtataagtttggcctcataagaggaattggaaagtattgtctcctcttctgtgttttagaaaagtctgtgaaggattgattttaattcttcaaatgtttgatagaatccatcagtgaagccatcagggcctgggcttttctttgcaggaagttttaaaattactaatttcaatatttttccttgctatagttgtattcaagttttttgtttcttcctgagtagtttgtgtcttggtagttgtgtctttcttggaatttgtttcatttcctgaaacaaatttatttcatgaaattcatttcatctaatatatctaatttgttgacctaaagttgtttgtagtacttctttatttttttttctcctgaaagtttggtagtaatatttccttttttttgttggtcagtctcactaaggtttgtcaatgttattgatctttttgaagaaccaacttttagttttattgatttttctctattgttgtctattctctatttcatttatttctgcactaattgttaacagtggagggtgtccaggttcttggcgtcttgaacaatgaattggacaaaacgcacaaacaaagcaaggaaggaatgaagggttttactgaaatgaaagtacactccacagtgtgggagtggccccgagcatacgggctgaaaggccctgttatagaatttctgggagtttcaatacccccagaggattccattggttacttggggtacaccctatgtaaatgcagagtttgaagtaaagttacaaagtcatttacagcataagcccaatggagaggatatttcctgtcatagctgaagtgtgaactggccttatgttccctgcctccagaccttattttcctgcctcataatctttatcatttccttccttctgcttgttttgggtttagtttgctcttctttttttcagtttccttagaaggtaatatcattgacttgagatcttttttattttttaacaaagatacaaatttccctttaagtactgctttagctccatcccttaagtttgctatgttattaaacaattgctgctgctttaaaaaaaatagttttgctatgttgtgcttttgttttcaatagtattgtctaaatatccttgtgatttctttaacttatctgttatttggtagtgtgttgtttaatttctacatatttatgaattccccatatttctttcgcttattgatttaaaatttaatttgattgtggtcagcgaacacatgctttgcctgatttaaattcctttaaaactttttttctttttttggtaaatccttttaaaatttgttgaggctttttttgtggcctagcatatggtttatcccggagaatgctccatgtgcacttcagaagactatatatttcactcttattgggtggagtgttttatatatgtctctttgaacatatttataatagttgctttgaaatctttgtctgctaagtcgacgtctagtcccttcaaaagcagtttttattgcctgcttcccccctccgctccccccaccccccgcccgtgtatgagtcatacttttttctttgcatgtcctgtaatcttacattgtagtaaccctaggtagttattcccatgcccctctggggcttgttgttatttgcttttttgtttatttgttgagtgacttgtctggactagtttagtgaagtctattccccttcagtgtgcagcctctgatgtcactcttcacagagtgctgccttgggcatgcatacagtttctcccaccaccagggctggtgtggatttaattgggctctctttgactgtctctttccctgatctctcctttaagcttcggacccatctgcctctatttgaagcagtcccagctgttagccttcactaattgctagccgattgctctattgtttttaacaataacaatgccctggcccacagagtgctctacagtctgatccgattaaagttggacccctttgcaggggcagggctttaaccatgtttgaggcttactccaacctccacaaaggctcttttctcatctgtgtctttccccgattcagtctgttaaatttcttctagctggggtactgttactactagtatctcggcactaccatcctcctcgtaaatgcttattcccaacaatctccattgttttcaacagtgcctttaggcatgaacttccttacactctgtgccaaataaggccagtcccttaggaagagtggcagtgctctgttcttgacctgcctcaccccctgggccaaaccactgtgccatcgcactgcagctgggagcagggacagtgacccacttctcctccagtgacagccccattccacaagtggggtagtaggcagggatgatagctcctggtcttcttggcttgcccttcttggcatagcacctcctccttatgattgagcaagcatgggggcagttggggtctagcacctgcaggctgccatgcctaggatagggcttctgcccaatgagcgggagaagtgaccccagtcctctctgctgtgcttgcctggaatccagcttctgtaacgcagagctgaggggaatgagggatgcccatcagcttgctccttctggggcaaaaccatagccctctactgggagctgggggaagaaggagccccgtcttggatgcatccacttgaagtagagcatccttcatgctgatcagtgaagggggttagagtagatcatggctcaaatgccacagactctctctgttggtatcaaaatttagtaagttttcttaaatgtttctccatatgctgtatgccattaggacaatttccagtggctttaactattttaatttttttttaagtgattttccgctgggcgtggtggctcacgcctgtaatcccagcactttgggaggctgaggtgggcggattgcttgagcccaggagttggagaccagccttggcaacttggcgaaaccccatatctataaaaagtacaaaaattagctgggcgtggtggtgcatgcctgtagtaccagctacttgggaggctgaagcaggagcatggcttgaacctgggaggcggaggctgcagtgagctgagatcgtgccactgcactccagcctgggcgacagagtgggaccctgtcttaaagaaaaagatgttcaccagttaaatggttgtttcactggggagagggtctgccaagcccctaacactgccattcctgtcactatgttgtcattttgagaactgtactgagtatgtctataaacatggatgtaaaggcaataagccatgtactcatctttgtgacagcgtgcatatccagagctgcctgtctggagtctctggcagcttctggcatggagtaagatctataaatattcctctcattcattcatccattcaacaagaatgtattgatcactcctgagtactcttgctcatttgtcttggtgaaatttagcgtttttctaaatttccagtcctacattttaactgctttcttgtcagtttttaccctatatggcagggatgagttcttaagaacaacagctatgtgcattatctcattaaatccttaaagcaacctgatgacgtagataatattattcctatttcccgaaagaggacactgaagctcacataagttgaataatttgctaaatgatgggtctggttttgattccaaatttgttggactctacgcttctcatttttgactgctaggtcataccatgtctctcactgtaggaaaagatgttacaggacactgggttttgtttgtttggttggttggtttcctttttttgagatggagtctcactctgtcacccaggctggagtgcagtggcgcaatctcagctcattgcaacctccacctcctgggtttaggcaattctcctgtctcagcctctggagtagctgggattacaggcatgtgccaccacgcccagctaatttttgtgtttttagtagagactgagtttcaccatattggtcaggctggtctcaaactcctgacttcagatgatccacctgccttggcatcccaaagtgctgggattacaggcatgagccactgtgcccggccccagaactctggttttcaacttcttacatgggaatgttatgacctcttagaaaggacttttgaagacttttcttcaggtttcctgttctgaaagaaatgaaataaaattattggatatggactaacgcttaatgataaaagtgttcttcctgtagatagaatcataaccataataagtagctttcgttttcagatataaacacacatacatgcatttgcaatgtcacaagtacacatagacacgtgcccacatgatgttggttacatctgtagctgggaaacataattaaacaattaccaaacagtgttaaatttcttacttcccttcagtaattgttaaagaaacctctttttcttgatttgggacccttataccttgattgctgaaaatgttgactaaaatgtgatttctggtgtaaaatataccctaatcaatgaggagagagagaagtggggagacagactgagggagaaatggaattcatcattggctgtgagtccaaaatatttaaaaatcaagtaagcatgagaggcatctcatagcaagtaggaaaggatgcctccttaaaccttgacatccaaatcccaaagactgaaggttagaacaagctcttctaggattatggtgaataaagaagataatgttaaagaaattggagctgcacacaaagaaaattgtggcctctggaagcctagaagagttagaagagccttaagaagtgggagggaggagactggggctcattattccataacagagcctcccactccccaaacaatagagatacagcatcttgcagaccccacacacatgatcagagctgacattgggtaaaatgggccagaacctcatttctgatgtttaatcattttagttgtgcccctaattttctttcctcagttcctggtacatagtggatacacacacacataagttatgctagagccgaaatttccagataaaaacagagctgacaattactttatttcttaatatctatgagctattttgtataaagatcatatactctttattttgtcttgtagtcatggaaattcataattcttggcagagtgctatagtttaaattttcccttatgttcactgagatgtggggatatatttaatcggagttaagtcactatacagagatgaatatgatactctttaagacagacttacaaagagacagaggccagaaaggtttcaaaaataattttaattatttatagtctgaatgactcccctctctttattcattcatttaacaggtatttattgagcacctactatgtgtcagacactgttctagacttctgggaaatgtcaatgaccaaataaagatccgttaccttgcagagcttacattttagggggaggagttagatgacaaacaatacagtaatgagtaaatgatatgatatcttaagtgatatgttcttttttattattattattatttttagacggagtctcgttctgtcgcccaggctggagtgcagtggcgcaatctcggctcactgcaagctccgcctcccgggctcacaccattctcctgcctcagcctcctaagtagctgggactacaggcacctgccaccacgcccagctaatatttttgtatttttagtagagacggggtttcaccatgttagccaggatgtctcgacctcatgatccgccctgcctcggcctcccaaagtgctgggattacaagcgtgagccactgcgcccagtcttaagtgataagttctatgggaacaataaaaactagagcagagttaaggagaacaggaaaactggacttggggacaaaattgcaattttttttttttgtttgtttgagacagagtctcactcctgtagtccaggtgggaatgcagtagtgcaactacggctcattgcaaacctgaccacctgggctcaagtgattctctcacctcatttttttattttttatagagatgatgtctcactatattgcccagactggtcttgaactcctgggctcaagcgatccttcctcctctgcctcagaaagtgctgggattacaagcatgagccacggcgcctggccaaaattgcaattttaaataacgtagtcagcagcattgaggaggctcccaagagggaaatgacttgattgaggtgtcttggctggtcaggaatgatagagtaggatttgatcctgaggttgacttgaatgtccatgctctttttctgaagggatagatgagagtgacaggcattctcaggaaggacgtgacctactttagtcagcccttattcaatgaggcctgaagggtggacagggagcaggaggaaggcatttaaagaaatctaggtacctggctggaaggtttgggctgagcacggctttttttttgagatggagtcttgctctgtcgcccaggctggagtgcaatggtgcgatctcggctcaatgcagcctctgcctcccagggtgaggcaattctcctgcatcagcctccaaagtagctgggattacaggcatctgccaccacgtccggctaatttttgtagttttagtagaggcagggtttcaccatgttggccatggtagtctcgaactcctgacctcgttcatgatccacccatctcggcctcccaaagtgctggaattacaggggtgagccaccatgtccggcctgagcatagcttttaaaatgacatggtctaggccaggcgtggcggctcacgcctgtgatcccagcactttgggaggccgaggcaggcggatcacaaggtcaggagttccagaccagcctgaccatcgtggtgaaaccccgtctctactaaaaatacaaaaattagccgggcgtggtggcgcatgcctgtaatccctgctactcgggagactgaggcagaattgcttgaacctgggaggcgggggttgcagtgagccgagatcacaccactgcactccagcctgggcgacagagcaagaccccgtctcaaaaaaaaaaaaaaatgacatggtctagctgggcgtggtggcacgtacccgtaatctcagctagtcgggagactgaggcaggagaattgctcgaacccaggaggcggaggttgcagtgagctgagatcacgccattgcactccagcctgggcgacgaaagcaaaactctgtctcaaaaaataaatgaattaatgaattaattaaaaatgacatggtcaaaagctggaagggaggatgtataactaagggaaaatatgaaagaatagtgaatctatagtattaatgttttagaagagaagcatttagatatacctttcagagctattaactctccctcgaagcacacttttggagtctggattacttagagctgcagacatgcgcaaggtccttcttgaaggatttattttagattgaggagatttaaaaggctgacacacaaatagatttttgttgaccaggtcatataaaagctgtaattcagtaaaacgttcccattttttttgtttgaaatttttcaggaaagaatgttgtaaagaattaattagtctttcatgcagtgatcaccccaaggatcctgcatttcagaggataatgtgttgttgagatgaaagagatggtttctactgaggaatttgtttcaccaacaaatgggcttttatgcaatttttttgtgagttctgcaattaatcttacgttaccactacgatctgggtaaacctagtcaagtaaatgatttctagacagaaaaaagaaatgcagaactcagggaatggattctgaaggacaagctcagttcttaaaaactgttaccccttatgacttagaatcaaagaaaaatgagtgtcagatatatcttcctcattcctttga

SEQ ID NO: 9193 - DNA, 608 bp, artificial
  synthetic oligonucleotide
catttgcatgtctgtctttcaccctgagcatttatgtggttggtgatagttgatctctttacacatctgcaagtacttttctatcaccctgagaacttaatgtcttggccactgtagaaatcttggttcaaagtcctttttcctctttaatttgtaaattttattctaccgtctcctacctcccactactatagatgagaagtctgatgctaggctgattcttttccttttgtaacttgttctttctctctggcctcgtctaatctttttaccaggtggtagggattttgtccccatcaattgtgtgtagaagtcgtgtttcaagcttcaaattgaagtcttttttttaaccatagaaaatgttctctcatatttttgtaattattgcctcttcatctgttcctttttcctgattttgaaatgcttattattggcatattaagtctcttggctttgaatgctagtctcttatttattcttcctgattttcatcattttgattttactcaaaatgatgagagtaagagatttttcatctgcttgctctttcaggccaataatgtattttcccaaccattctttcttctagttacctttaacccattgct

SEQ ID NO: 9194 - DNA, 636 bp, artificial
  synthetic oligonucleotide
ccttgctctgcagggctgccagagtttgtggctgagcgagcctcataaggtgtctgccttgcttgctgcccaacaagcaggctttgtgtctgtctcatgttcactgggcatgtgctttgagctgtttttccagtgaagtcagaagtctcactgggacagccgcacattctggcagatggcagatatagaaaatctgtaaacaaaaataacagtaatgaagactgtggtcctaggccagagttcagccatatcctcttctcatcatgctttgaacagctgaggttatagatgcttctcctcttcgcttaaagccttttgctattagaggattcattttctttccagttcattcgaattcattttaatcagctgtgtcgcacttgtgcctgggtctcttcttgcctggaggccaggccccttaaaggtacattaaatattcgctaatcctgctgcttcctcaggattcctctgccagaagaatttcaaaagcagagagcctttaaataccttatcattctgaatatgaaatgtcttgtttgaagaactatctgtcaaataaactcctatttaaaaaccaaaaccaaaccaaacataaagactctaccagccagcacaaagagaaatgtaagacacaaa

SEQ ID NO: 9195 - DNA, 944 bp, artificial
  synthetic oligonucleotide
aaattttctctcattcagatatttggaaaaaatatagaaaagcagttgaaaataatgaatactccctcatcattccactacccagagataatgacaacattctgataatttccttcaatgtattttttgtatattatagatttctgatcatcctaaatgttagttttttgtagcctcactttcagcactaaaatgttatgtaaacatttctcaagttgttataaatgctttgcaaacatcattttagtcattgctaagtattttatttggtgaataggccataatatgcttaattattcttcaaatattggaccttttaatactaatataaataacactttgaagaatttctttgtgcaaagccttttccttattttggattatttctatattcaggtgattagatatgaaattatcgtgtcaagggctataaatattttgaaagctcttgatagaaaatgatagatattatttcctgattactaaccatattccaaagagtgttcaacataatctacatatgttttatctaatccttgtaataaacctgaataaagggttattattcctgtttgtatagtggaagcagctcatgctcagtgtggtacttggtaagtttgtttttcgtttttttgttttttttttttgagatggaatctcactctgtcgcctgggctggagcgcagtggcgtgatctcggctcactgcacccttcacctcccgggttcaagtgattctcctgcctcagcctcctgagtagctgggattacaggcgcccaccactatgcccagctaattttttgtatttttagtagaggcggggcttcaccatgttggccaggctggtcttgaactcctgaccttatggttcgcccgcctcggcctcccaaagtgctgggattataggcgtgagccaccgtgcccagcctacttggtaagtttat

SEQ ID NO: 9196 - DNA, 1492 bp, artificial
  synthetic oligonucleotide
ctaaagagcagcttgggtggggttatgaaatgtttatggctggagtcctgtaaattttagctggcaaagcctaagaccagtaagcttgaaaacacgtatgctgtgtcaccagctaggaagagtttgccagggaaactgctggcagcgcggccgcgatcagtataagactctgtgaacaagaagaccaccactagattgcctcgaacatagcagaactgtggctgctggcatccattactgccatgggcactttgaattttcaagtatgtctttctcctcccctaaactcagcaagattacaggccaactttcctttccctttctgctgatgaagggaggtcattctcccttcacaggtaggttctccaataaggagctactgaacagctggtggagtataaatgtcttatgacccagtggctgctccctcaaacccacacctttctagaaccaaggaaaaatgtttagtttttccacttctcttaattgtaccaggttaatgtaacgttttctaaaaattatcctcagtttacctaaagagtgcttttctgctcttatttactgaaattctcttttctattttgtattgatggcagattatgcacacaatagcgtggtcctgcccatgcggagcctggtccctttggaagcagtcacgtggccgctgactttgcagcccattacttgagtgcatctccaggccaggaacagagcagggctggggcagagagctgtgctcacggccagtgcattgtctcccagattcgtggctctgggcttgccttcccggctgaaaggcaaagcagcctggccctgttctagttatttctttgtgtatatatgtttgtttatttatttaagcaagagctctctctgcagagtggggtgtgtgtgtgtgtgtgtgtgtgtgtgtgtgtgtgtgtgtgtttgtgtggggtgcttcagagagggctgaaattgtacctcttttctttcagccctctgcatttccccagagagaaggtttttttctcgtcttcatttcctttgaaacacctggggtgaggaaaaacctctacattggccaagcagaagaaacaggtaatatgtttgtttattcttaggcatttggggcaagcagaagtctacatcataaacatatatcgtgtggcaatggaacagggaatgtgtactccttggagtatatcttactgctttgcaatttctcggaatgattgttctcaaaaatgctggttgtaaatcagttgccatcagttgaagaagacgtacagatgacttggcaatctgaaggattgtggcctatttcaaatgaacttgatatttggaaaatctccacagtcacttggattgagagccagaaaatgagggaaggggtcctttgagaaacccttctaggtcccctcagggagtattctccaaactccactgcacaccttcatatttagaaatcttcctttagttcccttggcgtcttgtcgtcttagaggtttct

SEQ ID NO: 9197 - DNA, 614 bp, artificial
  synthetic oligonucleotide
ttaagctgttttcaatgtttgaccgtatgaacctgcatacacgtttttgcatgaatagaaaattttatttctctaggatagctacccaggagtaggattgctgtcgtatggtaagtgtatgttcaactttataagaaagtaccaaactctttttcagagtgactgtaccactttgcattcctgccagcaaagtgttagagttcgagttgctccacattctagccagcactggatattgtattaaaaaaaaaaattttagctgggcacagtggctcacgcctataatacaaatactttgggaggctgaggcaggcggatacctagagaccagtctgaacaacgtggcaaaacccactccctacaaaaaatacaaaaattagccgggcatggtggcatgtacctgtgatcccaactacttgggaggctgaggtggaaggatagcttgagcccagaaagttgaagttgcagtgagctgtgattgtgtcactgtgctccagcctggtgacagagtgagaccctgtctcaacccccccacccaaatttagccatattcatagacatatagtggtatctcatggttttaattttaatttctgcttccttgaatctggcct

SEQ ID NO: 9198 - DNA, 2172 bp, artificial
  synthetic oligonucleotide
atccgacccaaactgagcaaaaccagtttcaaacgaatctggtttgaaacttccgaaggtaagatttgatccagagactaaggatggagggctccggctccatttccctgccttttggttggcccttccccatgtatcaatttcaccccctggactggctcttctcatggtgaaaccttgctcagagcaccacactagggggagataagtgagtctgtcccagcactctctccaggtaccccgagattcactcataatatctttctttagctatacgcccaccccaaacactcctttttgccaggagaagaggatatgctgtcttaggcctgaattatgtgcttgttcctgaaaagttgctgttgcttggggagtgggctcggataattggcttaagtcaaccagggcccgcgcttagagttgggggctgcgtcagtcccatgcaaatcacttggctaaaaaacaggaagcgggggtgatttcgaaaaggaaaattgtgattctattacaaggaagttaggggactatttgctagccacctggttagggaacagaatgctggcctaatgataataataatagctaacatttattgaatactatgagccaggcaccaagctgctttatagttgtattggttagagaatgtgtttggctgcctgaaataaggtaaatagaacaccaggggcttaacacagagcgcttggttttcgtcccacatgatacgaagccaggagatatacagtgtcacattgtcatccaggtctcaagctcgtccctccatcctgcatccatcctgcatcatggtttcgctattctcagtgtgaggctttcttcctagtgtgcatgagatggctgctcctcctccaggcattgtgtcctggttccaggcagaatagggggaaggacaaaagagaagaggcttatgccagctgagtcttttcctttttatcaggaaaatagcttttctggaagcctcagcccatagatttctgcttgtatctcaagggctagaactgtgtcacatgactacccatagttgcaagggagcctagcaaatcaagttttgttgcccgaacactgccacctagaacaaaacgggggttttattagtaaggaacagggggagaatggacagtaatgatcagtggctgctacaatgtgtgttaacccattcattcgttacgtcaacccagtgtgattggtgctatctgtagcctcgttttatagttgaagcaataggcacagagaggttatgtaatttgcccaagctcacacagagctgttaagtggttgagcaagaacttgaacccaagcaagctgactctagaatctaattctattatgtccctagacacatcctgacccactggccagaccacatttcttctctaggatgtatatccacttgggaaatgcaggcctctcctggaaatggtagctaatacttgtttagcactttatagtttacaaagagattgccacttaaattattctctttaaatattcttctttttttttttttttttttttgagacagagtctcactctgttgcccaggctggagtgcagtggcacgatctcagctcactgcaacctccacctcccaggttcaagtgattctcgtgcctcagcctccggagtagccgggactataggcgcacaccaccatgcctggctaatttttgtatttttagtagagacggggctttaccatgttgtccaggctggtctcgaacttcagacctcaagtgatccacctgccttggcctcccaaagagctgggattacaggtgtgagctacagcgcccggcctattctcatttttaaaatgaggaaactgaggtttagaggagttatgtaagttgcctaagatccccaggttgaaagtggcagagctgatatttcctcaaaattataaaaacttactccagtttccctttcttaatcttcctgttcttctctgcacagaggagttcatttctagtttttttaaatggcaatatttcactttaggccctatattaacttcataaccttctcacgaaaaccaaaccagagaaatcttggctctctcgcctacttgttttcacataggccaccaggaggaatgtgccacatcagtgggaactgtgacagaagtaagtaatggaggcctggaaagggaggtgg

SEQ ID NO: 9199 - DNA, 1547 bp, artificial
  synthetic oligonucleotide
cacatgagccacatttcaagtggccgccatattggacagtgcagatgtgaacatttccatcacagaaagttctattggagggtgctgctagaaaatgccacttgactcatcgcttttgagtttttatcctttgcattttgacattttgaaaaggcccacatcacacttacatgttccaaaggtatccaaagtagggctcaagtgaaaacccgtgcttggctcaggagttgtaagccaaaacttaaatgtgtattcctactttgatacaagtgatgagtacctttccaacttggaaaatgtttttttaaaaagacataaaaacttggccaggcgcagtggctcacgcctgtaatcccagcactttgggaggcggaggcgggcggatcgtttgaggtcaggagtttgagaccagcctggccaacacacagtgagaccccgtctctactaaaaatacaaaaaaattagccaggcgcagtggcaggtgcctgtaaatcccagctactctggaggcggaggcaggagaattacttgaacccgggaggcggaggttacagtgagctgagatcacaccgttgcactccagcctgggcaacagagtgagactccatctcaaaacaaaacaaaaagacataaaaactcgaaggaagattctggaaaggggagggtggtgccagagtaaagagaaagggggtttgcttagtgtttttaaggatgtaacataaaaacatgctgtgggtgtttgacgccatttccaaagaaatcattctttgccctcttaccaaagtcatggtgctctgcctgatgccactaggacatttcatctccttctgggattatctcctgaaaatatctggctgttgcatttggccccatccatccacaaaacgggaagggcctggtctgccatgttcttgcctttctccgcagtggcaccgccccacaccaccctctctattgcagtttgtctttgagcctattcaagtcaggagccaggtgaagagaggggagggtggaacaggctccaccagattgcacaagtgcaggggtgaagtgcctctttgcaaagaaccttcaaggccttcagaagcacagggcttgaaaaacttctcatgtcttttgaagaggccagctaataagaataaaaatgaaattaaatgtccaagtatcaagatggtttttcctcttgtgttcaaactccttggaacaacccatgaacgtcttggccgtacaaattgtcatcagagacttacaaagccttctgaatctcagctgtacatgtctacttaacctgattaaatgttgaaattagcctggggaactccttactcttaggcaaaaggatgtttaccatttccaaagagctagggagtttttaattcatttttattcatagcaaatatatatatatatatatagtcaggagtctactgcgtttagtcaatggtgaagaagacttctgtctcaatccacaaagattaataggatgtagagttgcccaaaggtttaagttcgtctgtgtttgtgctggtgaagtccttttaaccatt

SEQ ID NO: 9200 - DNA, 1205 bp, artificial
  synthetic oligonucleotide
aatcctattgttcgtttccattgtcttgggcctgctaaaaggtgcatactttggaaggagaccagagttactttataggtgttggagaacttaaattctaggttagcatccttagaaaatctttcatagagccatgaggcttatatttagaagcaagcaacagcctggcagattggcatgatttttaccaactgctcaaaggcatccgtggctttcagctgtgtctcccgaaagaaaatgtctttgttttttattcaagtcatttaatagctctttacaaatattagcatatggcagaccaattagaagcaaaaaagtccgtattggtggttgtgatgtggctgttatagaagtatttgtgctgtatgctttggttaaatctgttttaaaacatgctttaagattcaccttacgcagttgtactttaattctaagctcagagctatgctgtcagtctctagtcacgccatgtattataaagtatgttgtggttgtagagttagccagtttagcatgttcctaatctgagaattagtggactatactaggaaatgctatcccattttccctttccagcccctcttagttaagatcatagtatcctcacttcttaaactagtctttagagtaaataaggaaaaaagccatttattttcttctagccatgtattattgagaatgactcatagtacaactttttttcaaaggccagaggattactttgcaagtgtgtagaaagatctgtctatttctgttcacctgggacctggtggtgactgaactctttcagcaagggcaatggctcaatgtgattcggtgctggagctcagctgggactcagtaaatctgcacgttctctgctggtcagaacatgtttcctggagagcattgcttttctatctagaagttcgttacctcctgcatgatagtgggatattgagatgtgggttctaagatccacagactcatacttttgtgaactttggaatgtggtagggtacactgaaccaagtcagaaaatagtgaaatatttccttgcctccttcagttcatcactaagaaagtgtgtaggcagagaaaacttacttatggtttgaagaaccacaattgtttttgaaaggggacatagaaaagacagtacaaaggttgtaagtgtcctgtcgctaattcccagggccagaatctcacaagaagatcctctcaaa

SEQ ID NO: 9201 - DNA, 1720 bp, artificial
  synthetic oligonucleotide
cttggcaatcaaagttgattgttttcttattgagacttgacatttttgcactgtattatgtctctttctgaaattctttacaactatcctctcaacagagccttttctacattcaacagaatctccaggaatagaagaaatttaatttggatgacagagaacactttaagcctttctcaatatacttcttatctatgtgggcttatattaatgtaaaaactttgaagacacaggatttgtttctctctggggatttaaagatatgcataaacttaggaaatgggttttggtttacttttaaatgttgaaatttgtaaataaccatcattccttattctctcctggctggttacagaattcctacgttgccaggtgtgtttctgagttatatagtcacaaagatcgtatctgggattttagggcttgcgttagaaggaaaatatgtttgccttttgatcgcgctgtgggttggaatgcaccttatctcctgggagccctttgcctgaacaaagagctggctccatgggaccgttcacatcacttcactgaaccacccaagcaaggatcctgctggtttagtgacatgagaaccttggggaaacccggcctgtaggacagcagcaggagtagttcttcccctagatgaggctgcatcccccttttctttatgacaacttcaaggctaaacaaggtagagttagccgtttttatttatttatttattttagagacagggtctcaccctgttgcccaggctggagtgcagtggcatgatctcagctccctgcaacctctacctcctgggctcaagtgatctcccacctcagcctcccaaataactgggtgcacgccatcacacccagctaattttttgtatttcttgtagagacagggtttcaccatgttgcccaggctggtctcgaactcctgagctcaagcaatctgcccacttaggcctcccaaagtgctaggcatgagccactgtgcctggcctagttagccattttgaatggttttggttctagttttacttcatacgtaatttattcttatttatttgaagaggaaaaagacacaatcaaaatggcctgttcagatggacttcactgatttcatctataagtttagtagattagacccagtgtttctgaggccctttctattatgaaaattatagaattatgactcaatgggaagtagattaggtagatgttcatagcaatgtgtataaataacctgaagtaagcatttttatctcacagatgttctagaaatgttaacaaataccttcctagataatctttctagatcattctttcacttgcttgcttgttaaatttatgtatttccttataaaataaatatgagttcattatagaaaatttgagaaaaagaaaaagatcgttttaaatcttaataccctaccacaactagtattaggattttggtatattttcctccagctgtttagcctatgcatatgtttgtggcaagaaggtggggtttttttttgtttgtttgttttttaagttttaaattagagcaatccttttagtacgattttgtattctggcttttaacagtttatctatctatatctacatgcacagaatatgtatgttactacaaatactttattatcttcaatcctaatggctgcataatatttctgaagtagtcattaaaaaaactgcccatatttttaactgaagcttacttt

SEQ ID NO: 9202 - DNA, 1644 bp, artificial
  synthetic oligonucleotide
tgaagagaatatgtttgggattaagtcagtgccagtgggaaacggagtggatcttctactcctcagaagtagaaacaataggatttgtgatttgaaggattgaatataggaaaaaggaagacttcatggtttcttttctaggacctcctttttggagtgaaagagagtagttttgaagtcacctaattcaaccccttcatttcacagatgagcatgtcgaagctcagagaagttgggtgagttgctccaagtttacccaaccagctcaggatggagctgggattatgaggcaagctccaggtgctgaggccagctgcttgccactggtgtcttgcggacatgttgaatttgaagtgaccttggcctctaagcagaagtgtgctctaagaggctaaaaagatggtctggcacccaggtgaaaggagaaagcaagaggtgcccatttgcagaggctggaagtggagtcagaggaatggtcagaggagccctgaggagatgctgtcgggagaaagaacctccagagcctagaaagatctggcagcttcctgcagaggagacatggaagggaaaattgggtaaaatgtgctagcattcagcatggtataaaatggagaagaaatcggaaaaacaaatagctttttaacttagaaaaagtaattgctctctgagaattccaggaaaagaatttttgtgaacatggtggtcataaacgaattataaacagttactgtgggctaagcacagatctgttacagactgtgaaggccagttcaggaggtacagtgcccagctgcaagaaagtacaagtttaaaagcacaaagataccagaaggctggaaaagtaacttaagctgtgagtgaatcctaggaatcactcccatgcaaagtatcgggccaccttgaaaagcacagagactcttactgagtttatattagatgttaataatttgttttcttaaaataatttttgtagaggcctttgtaaacagtacaggtggtaaaagtcaaatgagacattttcataaaatagaaagaaggaaggctatgttggatgaattcctgcccagaatcctcagagtacatttggagaatgagagggagaaaaataatcatattttaaatcttaaataaaatgtttttgatatgtcacataggcttaaggtaatgcccttttctgtgcataatatacagatatacgatgcagcgaactccttctaatgacttggtaattttcttccttaatctttttttctgatgatagaaaatgctgtgttttttcccctcggtgaacaccattgtggaccgagtactgttcttagcttgtgactcacttccttgagagagaaagatagtggtatgtctttggagatgagcactatcatgatttggcttcagaaaatacatgaaacataagtgctgttatcctagagaagattaagacaagaatttaagcacataaactatagtagttaagaggattttaacacaaaaaattattaaaaggacttactctattccttgatatattcaaaaatcatttattttcatctgactttgccatataagtcctgcatgaaatatacttttggaactgcacagttcattttggagaactcagacttaaaatctgctagagaaatttca

SEQ ID NO: 9203 - DNA, 1237 bp, artificial
  synthetic oligonucleotide
ctagggaatctgtccttaaaaaaaccgaaatgtggccagcttacgactgtaatcccagcactttgggaggccgaggcgggtggatcacaaggtcaggagtttgagacaagcctggccaacatggtgaaaccccgtctctactaaaaatacaaaaattagccgggcatggtggcgtgtgcctgtaatctcagctactcaggaggctgaggcaagagaattgcttgaacctgggaggcggaggttgcagtgagccgagattgtgccattgcactccagcctgggcaacagagtgagactccgtctcaaaaaaaaaaaaaaaagaaagaaagaaagaaagaaaaaacccaaaatgtatatatttgcattctgtgttcttggctggttggtttttccttatgtaccaaggaatgtctttttcttttaaaattatgggaggaaaaagtgttaggctatggtagaattagtaactgatatccaaagagaagaatgagccaggccaacaggatatatgttttacattggcaacacaatacagtaagatgtttggactagctgttctccttttttgctgagcacattttggaccagttgcatttatttctcaactacaagcttgcagtctagtagtagagtcagaccttgatcaagtgatcatgtaaatctgtaaaggtggaactttaatgcaagttataaagaagaggcgcttgctgagagaacaccacagggccttcagatctcatcgaggagccgtgggaaggctcctctgaggaagtgaggattgattgagccaggatctgggggatgagagagggttgagtgggcaagggagggcaaagcttgcaagaacaaagggaatagaccctaaggcagtagagaacatggcaaggagagatgtgactcagcaagcaaaggagacctagggagaggaggtggaagagctacctggcctgccatgtggagcagctgcgacggagttgtcaggttagtggagttagggagaattttaaggggaatggtggagcttgaaatcagatttcctttcccaaggaagaacctggttgctgaggggatgaacatatcagaagggctgtggcagtactgaaggtgaaagtaccaaaggcttgaccaggggtaggaggagcattcaggtacaggacagtggacccatttgaaaacaatgtaggaggcaaaacccaacagcacttagtgatagactggatggatttggtggtgcaga

SEQ ID NO: 9204 - DNA, 252 bp, artificial
  synthetic oligonucleotide
attcagatttcaccaattttatctgcactcctgtgtgtgtatgtttagttatgtgtaatggcatcacttgtgtagattcacatgtccaccacagtcaagctacagaacggttttatcacagggatcccttgtgctgcctttttatagccacagccacactcttgccttcccctctttctaacccctggcaaccactaatgtgtacttcatctctataattttgtcatttcaagaatgctattttagtggaat

SEQ ID NO: 9205 - DNA, 2278 bp, artificial
  synthetic oligonucleotide
ttttggtcatttgtatatcttctttggagaaatgtctattccaatccattgagcattttaaaattgggttgtctttttggttgaattgtaagagttattcatataatctgaatatagattccttatcagatatatggcttgcaaatattttctctaattttgtaggttgccttttcactttcttaatagtgtgctagatgatgtacaaggtttttaattttgatgaagtccagtttattttttcctttattgctcatatttttaaaaccattgccgaatccaatgtcatgaagatttatggctgtcttttttttaatggtacagtagtatagttttagctcttatgttaggttgttgatccattttgaattgttgtttgtacagttaaaaattgttttaatgaaattttatttttatatatttaaggcgtacaagtacagttttgttacatgggtttatttgcgtagtggatgaagtctgaggtttttgtgtaaccatacccaaataatgtacattgtacccattaagtaatttctcataacgtttgtactgtttttgtatatgttgtgagatagaggtctaacttcattcttttgcttgtggatattcagttgtcccagcacctggatttgttgaagagatcattctttccccatttactggtgctagcacccttgttgaaaatcagttggccatagacatgtgggtttgtttgtggactctcacttttattcctctgggctatgtgcctgtctttatgtcagcacttcactggttcgattactataaatttgtggtaaatattgaaattcggaagtgtgagtcttccaactttgttattctttttcaatactattttgtctatcaagggctccttgcaattctgtatgaatttgaaattttttttttcatttctgggaaaaaaagctgttgaaattttgatagagattgcagtgactctgtagattgctttgggtagtactgtcatcctaactataaattcttccaatccatgggacctttccatatatttaagtgtttaacttcttttagcaatgttttgtagttttcagtgtgctagtcttttacctcattggttagatttattcttagatgttttattcattcggatgccttttttgtttttgaggcagagtcttgctctgttgcccaggctggagctttttttttttttttttttttttttttgagacagactttcggtgtgttgcccgggctggagtgaagtgttgtgatcttggctcactgcaacctctgcctcctgggttcaagcaattctcatgcctcagcctcctgagtagctggtattacagatgtgcaccaccacgcccagctaatttttatatttttagtagagacagggttttgccatgttggccaggctggtctcaaactcttggcctcacgtaatccacccaccttggcctcccaaagtgctaggattgcaagcgtaagccaccgcacctcgctgctattttaaatgaaatagctctgttaatttcttttttaagaaattttttaaagatttttttaagctattttaaatgaaattgctgttaatttctttttaagaaatttttttaagattgtttgttgccagtgtatagaaatattatcgatttttttttttttttttttggagacagaggctctgtcacccaggctggctgtagtgcagtagtgtgatctcggctcactgcaacctctgcctcccaggttcaagccattctcctggctcagtcccccatgcagctgggattacaggtgcatgccaccacacccagctaatttttgtatttttagtagagacagagtttcaccatgttggccaggctggttttgaactccagacctcaagtgatctgcctgccttggcctcccaaagtgctgggattacaggcgtgagccaccacacccggccccagtttatttttttttattgtggtaaaatatatgtaatataaaatttgccgttttaactatttctaaggccgcagtttgacattaattgtattcacggtgttacgtaaccatcactactatgtatttgcacatttttttcattaccccaaacaggaactctctgccaattaagcaataactctctaattcccctatccccagtagttgtaacttccaacctactttctgtctctgtgatttttgcctattctagatattttatataagtggaatattacagtatttgtccttttgtgtccgatttctttcacttagcatgatgtttttaaggttc

SEQ ID NO: 9206 - DNA, 238 bp, artificial
  synthetic oligonucleotide
agtttgaaattaaacaaatgaaaagctccctaataaaatgctaaatgctatacttttaatgacttgcctttagttataagtttctgaagcttaaaaaaaattcctgggtggatattacttgggagaaataggttattagtttctaagttaaatttgactttttcccgaacataaaacctccttttatacaatggctctgtttatgcaacattgcaaatggaaacttcagttcttactt

SEQ ID NO: 9207 - DNA, 2654 bp, artificial
  synthetic oligonucleotide
atggttttcttctgtatgtggatcttgagttttaagatgctttccaaccatttgaactctcttattataacagaagtttagtcatgtaccaaatgtattcctatgcaattttcagtgacaaaatggttctctcatttggatgtgtaaaaacaatgccaggaacaaaaacaaaactcatgattcaactgattttgtactctctttgggaagaagaaaagacccgttgagatgaagattataatttcagtaacaaagaaaacattcaaggcccaggcagctcttaaattcaatactaataatctatgaaataaattataagcctacgtttctgtcagttctttagatacctgcttgtttgctaatacagaaacattgcttaattttacatgtattttcttagtgtgagtcaaatccaacctaaaatgcatttggttatttgtttacacagttagtgactggtaatcaaaaacgcaaacaatttttgagggagttagaatcttcactttagtaggtaccttagagggcatctagtttagtacaggattcctttctaccagggacaaactgtttacagaggccccttcctgcctcttgcgaggttcctccttgtctgttctgcttcagatatacaggccttctgtgttccttgaatttatcaaactctctaagactctttgtactgccttgaacactcttctcatagccctggtggcttggaatttttacatgggacagatttctctgaaatactgccttctcagacaaccttccccagatctcctacctaaaggacctctccccttcccaactgccataactctatcataagactctgttttatttccttataatacttgtcactgtctgaaattatcatatttattgtctatctcctttagctccatgagagcaggagcatggtccatgttgttcaccgctatatcctgaagtatctacaatagtggctgtcccattgtaggcatctgacaagtatgacaaaaatgagaatgaatgaataaccattgatgattgatcattttgttaatgttaaaaccaaactctgtaaaatattttaaagaggtttattctgagctaatgtgagtgaccatggtctggggaacagtctcaagagccctgacaaaatatgtcctaggctatcagattgcagtctgcttttatatgttttagggagagaattgtaggtaaaatcatcagtcagtacttggaggatgatgtacattggttcagccaaggtagtgggggatcataggtggattaaaggattttctgattcgcagttggttgaaagagttaagctttttctaaagacttgaagtcagtagaaagaaatggtaaagttaagataagggggttgtggaggccaaggttcttgttatgtagtaaagcctcataggtagcagctttcagggagaatagatggtaaatgtctcttttcagaccttaaaggtgtcaggctctcagttaatgtctcctaggttgggggaaaggcccagaaagggaaggcttggctgcactatggagattctgttggccccgtgacagttattttaaaatatgtcaaagaaatatattttggggtaaaatattttgattgccttcagggtctgctatttgtcatgtgatgctataacacagtcagattggaaagtaagccacattatactttatactaggttaatcatctctgatgaggctttatggtttgtagggcgtgacttaacccctgctttgcctgaccttaggtgttgtttataatttgttatcttattgccacagtgtctggtttgccagtcttaggatcgccatccaaaaagagggagtataacgaggtatgtctgacctctcttcctggctgggaattcagtttttcaggtttctctggggtgcccttggccaagaaggagtttgttcagtcagctggggggtttaggatttttttttttttctttttgagatggagtcttgctctgttttccaggctggagtgcagtggcgctatctcggcttactgtaacctctgcctcctgggttcaagcaattctcctgcctcagcctcccgagtagctgggattgcagacatacgccaccacccccggctaatttaggattttatttttggtttacatgttccaatcactactgagctgaaatttgtctcctttttgcttctactactgaacttagttctgtcccctggaataaatcactggctcgattccattttttccaaagtcttcagacatttggatgtcagtcatctctcactgaggccaaactcacctggtttccttaccagttcctcatctggcatggttttaggtgagtggtcactatccaggttatcagttgttggcaatttttggttttgttgttgtgatacccagcactaaacatagtgcattatgtggtgtcttgaacttccgagagagagaacagttaaactttcttgtttaatgtgatactgcaatgctttgtctttgataaaaattattttttaataccatataaatgacgaaggaactatttatatatgaaatcattatcagaaatattctgaggtcttaaaagcttgttttataatggaatataacaacgtagaaatacattaaacataagtatatactctaatgaac

SEQ ID NO: 9208 - DNA, 1394 bp, artificial
  synthetic oligonucleotide
catcgaggtgctgggaggctggtgtgctctgagaaggcacggaaggcctgtgctggctccccaacccctcataccttgccctgtgcatctcttccatttggctgttcctgagttgtatcctttataagaagctggtagtaaatgtaagtaatgcatttccttgagttctgtgagtcacgctagcaaattatcaaacttgaggagagtgagttgtgggaacccccaaatttgtagccaagttggatagaagtatgaatagcctggggacctgggacttgtgacaggaatccgaagtgagggcagttttgtgagactgagtccttaaacctgtggattgaattgaaggatactcagttggtgtcagagaatcagaattggtgttggaaaagataccacgcatttgctgtctggggaaaaaaaaaaagccctcaggtaggcacatgaatcttcagcttacaaatggaaacgtaccaaagcttcaagagactgctgagctcatcattaaggtagtatgcgggaaagctataactcaaaagtgctcttaaccatatctttttaaaaaattgtatcctctttgagggaaagaatctatcttttcttttttaaattgttattatttattagtcagcttctcagatctctttggaatttaattgaatgcttttatcaattaatggtcttgatgaaattgcttgtatttttgactattatttgtatggccaaagtaattttacgtacccttctgaagttagcagcacaaacaattgaggaagtgcaaagattttcgcttgatttttcttcagtttcttctatattttaaataggacacaaatatctctgtaaataaaaataacttccaatacatttggaaaacatcccagacttcctgtccatgcctcgcaaagttgctgctgtctagtcattattactatgttttttccctttgacataagtgaccctcacaggaatagcttcatcaccagctgtttggccagtggtattccacttactttgtttttcctgtttctctgaaatatgctgaaagataatcactccgtgccttcccttgtttagaatgaatttactcaattgctctggaagcttaccttggtaaatgatttggaaccgtaatgaaaaaagagggtaggctttatatattttatattggtgccttaggaattgacatttatttattgaggatttttgtgctcattttcaatttgaaagggtcctagtgtttagaattaaattgtgggacttgaaagctaaaaaggaacttggagatcgtccaactgaggagccttattttttaaatgaggaaacaaaagttgtcaagatcaaccataaatctgatagtttggcttggtgaaagaaacctaggtttcagaaaatct

SEQ ID NO: 9209 - DNA, 1452 bp, artificial
  synthetic oligonucleotide
ttgccatactaagtttgtgattgccttggtgattgtgtgagcattcattcaagtctttcttggtgtaaagttgttagctcatgcctgtaaagaatacttttgcccactgttcctctccacatatacgaagaataactgcagcatcacctctttcaaatagttccttggaaatctacatagtgattcaggcttgaattgagttcgcttttgccatgagttattttctttcttttctttttttttgagacggagtcttgttctcttgcccatgctggagtgcagtggcgcaatctcggctcactgcaacctccgcctcccgagttcaagcgattctcctgcctcagcctcccgagtagctgggattacaggcatgtgcccccacgcccggctaagttttgtatttttagtaaagacggggtttcaccatgttggccaggctggtctcaaactcctgacctcatgatctgcctgccttggcctcccacagtgctgggattgcaggcttgagccaccatgcctggcctgaagaggtacactcaacaggcacttaaggggactgggaaaggaaatgactcttgagtgcttgtgaagagtcttaaaggaagtccagaatgtcaggtgcaggtaaagggtttacaggcagagggtgcattaaaagacaaggatctggctggccgcggtggctcatgcctgtaattccagcactttgggaggccgaggcaggtggatcacgaggtcaggagttcaagaccagcctggccaacatggtgaaacccccgtctctactaaaaatacaaaaattagccgggcgtggtggtgtgtgtctgtagtcccagctactcaggaggctgaggcagtagaatctcttgaaccctggaggcggaggttgcagtgagccaagattgcaccactgccctccagcctgggcgacagagcgaacctccgtctcaaaaaaaaaaaaaaaaaaaagacaaggatctaaggatgggcatataaagctgggagaattgcaagaagtaatgtttatttatgtattacatgctttgctttgatgcttgtaccctagctatatcccaggatcttttctactgtaagctccgtggaggcaaggagtgttgactgttgtaccctcagtatgtggcacattgccttgcacataggaagtgctcaataaacacttcccttatcaaaggtgcccctttttgcccccccccccgccccccaccatttcctcatgtctgtatcttcttccttgtgcagtggtatatcaggtgcctatccagtggatcctcctctctgcttaccctatagttatgcctgtcctgtgtctagttacctgtgtaagatatgtaattgttataattggatccacactggtaaatgagtaggtgctaatagctctctgtggggctccagaatcttttctaccaacatttatggtatggcagatga

SEQ ID NO: 9210 - DNA, 2879 bp, artificial
  synthetic oligonucleotide
ctaagcagaaggtcatatttgtgtatatgggatggcacattataaggcatctaatattactacttaatactaaattggacctatattaacagatgttcagttattgttttttctccatcttctcaatctatacggataattaatttgttacttccggttcaccaggtctaaataaaattttaaaaaattattcatttgagtcaaaggtaatgctgctgaaattcctagtacaaaggctctgatatacagggatgaaaatggagtgattgccccaggagttctggatccacgtgggtgaagctagaggtcacagcactgttactttgcatctggaggaggcaggagactctgcgaagccctctgttgttgcctctgactccattttccctctttgctaattcattgctcctacctgtaaaattttctaatatgcttccactttcatttcctcatcaaatattcaccgttatgaaaaagaaaatcctattggcttggtatcaagtggccaaactgagcatgctgctacatattgttaccagattcactacaggaatagattaagtggattttatcccaaatatctatttcctattacagtactgcatctttctaatttggtggcagctatgacctcatacactgcctattttccgtgcttttcctaaccagaagagaccctatttttctcctttgcttgttaaagcgaaaataattatgcagctttccatagatttgtccccaatgtctttttaaaaaaattttttttctttattttctaaaagtagcattggaaatgttatctccttcaatttcatcacctcttcatcctccttggaaacccgatccatggtgggtattaagatctttacatttgtactggttgggcgatgacttcattgctttcaagccagctgggggatcttgtgtggcagagcatcggaccgaagcggaggtgtgggtcgttgctgctgctgctgctgctactgctgcaacagctctttgcacgcgcccagctgctgtgtaaggaatcctcaggctgctaggtctttgcgcctaactcacccaagggaccgcaagctgctggatgagtgtacgtgtgagtgtgtgttgtgtgtgtgcatatgtgcgtgtgtgtgtgcacacgcagcggcaacagttgggcagcagcagcaatggacttcgatatcatttttaccaacaacagagataaaccatcctccatcctgtatttctcagctcccgccccgagtatgttctccccctcttctccgacttcccccaccccagcccccggcacgggtccctccggagggagggcagggtagctgcgctgcaggcaggattccctcttttttccgcagtgacaggcggattccggggcctcctcgccacctcctacccccgcagccacccctttctcagtcacgatctccccaccccaccaccgtcgaccctctccctgcttccccgctctaccccccggcgtcgactccaggctcgggccccgcccctctcagcctctccagcccaggttgctagggcttggcggggcaaccaaacctggcgtgccaggaggcgcggcgcgcgcgtgagcgcgcaggcgagcttgtataaggaaccagcgttcttcggcttcggagactcgagcacgagcggcgcgagcccgaaccccaggacaagcgcttcctcctcattggctcctaccagaagggggcggggtaaaggcgggatcgggcaaaacctgaggtgctttcccattggtccgaacgggccggctggggcggggcagttagcaaaataggctgcgcgttcgcttctgctagagggcggggccggaggtttcgattagttgtctctgccgctggggaaggtaaagcggcgacggcgtcctcaggagctgtggggtcccctgctagaagtgggggactcggcggggtgagtagtcgcgccgccacccgcccgccaagccttcttacccttacatcggccccgcgtccacccagcttctcctgagagtggagacccacccagtccccccgggcggacaagagaaggggcgggggcgccggttcccccggaacggggcgacgcggtgaggacgtcccagcccggagtagcccctcctcagcgctcccctgcgcctctggaagggcttcccccgaggggctggggctgtcttttggggtgtggggaggcgaaagggtgtgaaagaggggcggcgggtcgagcccgccccgcggggttcccctcagcggcgggtctgcggcgtccccgccccgccgctcccgcggcacgagctccccggggcttgcggcgaggtaagccccttcccgccggcgccgaggaggggcctgcgcgccccagccccctgcccgagttcggagggagcccgagactcgccaggggccgtcagtcgcggcccgggcccttctgaccttggctgcccgcgagggtgggctagcgaccgggcgccggccccgcggctccgcaacctcccccggacaagtttcaggcgatgctgtgaagttcacgactggcatagtgcggggaagaagaatggccccttctcagaccttcataccttttggaccctcatagaaatcggattctgggatttggaaccgtctcccagaacgaacaggtcctccttgcattgacacgttttgtgcccacgttggggaaaaaaataacctgaacatatttcagtgtaaaggcagatcttccttgagggttttgtttttcgcttcatttgagtgttaaagaacagatgcctgaataagaaaagcctgaccttagtatctctacagtgagattagacgggtgctgtgatatttaagtagttgcagatcagtattctgttagcacaatctattttaatt

SEQ ID NO: 9211 - DNA, 1723 bp, artificial
  synthetic oligonucleotide
aatcacactttgtgatgcttgacaaatgtttaacaacctctttttaaaaaataaatagtctcaaatgggagcctgtaagtaaatacttgtgctgcccaaacatttggggtttgggggagccgaattacaagtcggcccaggaagctatctatgtacaaccttgaggcgcaaaatcgagcaaattcgcctagacccattctccctccggctcttcacacctggatggggcgcaagcacgatacaggtggaaaaagcgagaaaggtaagaaaccatttcgagactgtttctaagtgacggcagcaactttttttcggtcaggccgcgaggccgcctctccgcccctcaggaggcttagagcccctcctcgcctccccgccagccccggacgggacgcgcattccggtcccgctgcaccgctagggtgagccaccggcgcccccagcccccgccaggagcccggcggcgcgcaccttggcaccaggatttgcgcccgcacgccgccacaggcgcatccttccgggccgacgtttccctcccaaactccaaaagttatctcagcccagaccaggcaaagtctacctccttcctccgccccgccacccaccgtgatgccccccaggccccagcccggccctacccacggcagggaggatgcgccggagggcgctgtcggcgctgcaggcgaggggacgggtggaagctatcggccgggcgcccaaaccccgcggcggcgaaaaggccccggggcggcgtgaggggaaacgcgagatcggctgaagggcgtccgcggaaggcgccgggggcgggataccctatcgcgaagccgaactgagatgggacataggcgggatcgtaagggggcgttcctcgcacgggacgcgcgctgatggcttctacccgcccgcccacggacaacggtcggggtccgggacacacctccgcctctccattccttacggggcccggaatcaccacgtacctccagtctcgtcggtgaaaacaacgaaattctgtcccaccgatcgcgcgagccggcaccgagcttcacaccgccgccgccatgtttgagaagccgcgcgcggagccgcgcatgccccgcaaccgccactgccgccccgccccccgcgcggccggcccgcgtgccctgcggttgccgcgagcacgccctttgaccgccgccgcgtgcggggcccgagccggggtcaagccgagcgccaccgcaggcagtggcggaccatgagacactgtgagcccgggaaagcccttggcactttgcctcctaccccccacgcctacgccaaatgaaaaaccagtcgcagcccaagcacccgaggccgtggggagcccctcgatgggaccccgggttccacgtcaagttccatcccgggaactcgctccccttcactgtcgccttcgaatcctggccaccacccaccctggccacgcacccaaaaagcaggcgcttccctcggaactcaagcaagttcgaggagcagggagaagcagctggttacagcagcttgaggaaagccactgcttggcgggttgcagcatagtccttgaaactgctttttttttttttttccatgagtttttgccacgcattcacctcccagcttcactctctggatttcgttcttcctctaaacccggggttgagctaacgggaactagatgaacccgcagggggaaatcacttgcttactgactcaggagcatccc

SEQ ID NO: 9212 - DNA, 680 bp, artificial
  synthetic oligonucleotide
cagctagatataaaatcagaagaacaaaacaagtaggaaactgagggacagaagtgttgcaggtaataacagcacaaccagcattggaaccctggcaatgcgtctctggagtgtgcacactgtgcactatgccaccctgactctcagttgttcattaccattattactattattttgcaaacaggaacattgaggcttagagtgatcaacaacttgccaagttcccagtttcaataaaagacatcacgagatcccaggtttgaagcactgacccccagttcttcctccactcttctcacattgcctctacactccctcatgtctccctcctcacagaatctggaaagatccaaatgtattatcttgtcaaggagtaaattttgttccaagtacaacatttcaatactcagatccttccagaagcaaaaccgtctcctcttcactttcaacccggcttaattgtcaaaatgagaagaggatattcactaatgcaagctgtcagccaatacgtggtggactcaatccgctggaggactccagcgttttcagcatgtttgtctttggcacccatgtgccataagatacagagggtgagtagaacacagaccggaatgaaacccatgtagaaatgtagccggcaaatggctgatagaaggagatttaaaaaaaaaaaaaaaaaa

SEQ ID NO: 9213 - DNA, 1582 bp, artificial
  synthetic oligonucleotide
aatatatattctcttctactgagatgggctcaaatcgacttcctttagaaggaacctgataaatgaagctgccagtacatgcagagaacaggaagtgactgaagtctcgttatatgtcacagacagatgctgtcaagaagccagaggccagagggcaagagccaaggcaagcaggggtagcgaatctgctaggtgagagacactaatgagagcaagattccaccaggccagagacagacagcagcagttattcaggaccctggagagctcttagcccacgattgctaagaatgtttattctgagaacgccatcaggtagtttgcccttttttctgaactccctagttcataaaaggggcttgtcctttctatgaatgcctcgatttctatgaaacaagagattcattctcatgctttctgagaagttcagtgtctatgtccagtagataggtggaggctgtcttatctagctttactgagggtcacacctcagaaaatctagaaaagtacataaccagaggtcatcattctctttgattatctatgttctaggagctttctcctttctaggttagaggctggtgcttaggtgagtctggttccaaacatgttaccaaggaaaattttattactatgtcaaccatttcattagccctttgaccctaacaggaagattgccaaaattatagatctttttctttctgaaagtgtgttctcaagcaaggtaacagatattccatgaaaatggattctatagtaaaataagttttggaaagctttgaattaaattgttaaatatttacagtgcttatatatatgttttcttcctctataaagtacaatgtgatgaacattttcaagtatataagtttattttcctcttaggatcttgtttcctttgtagatatgttcctccaagtagaattactgagttaaagaactagaacaatgctatatcactatacaggtatggccaaatccaagtaggtttgtataatttcacttccatcagtagtgcatgaaaacatcaatttcaattttaattgtacttgattagtaacttgacttatattctttgatgactagtacctagaaaattaggtagtagtcgtgctagcactacttctataaagtaccttgaactgtgtctggcccctaatagatactcaataaatatttgtttaatgtcagaatgaaaggtttaacactttctcacatatttgtctatttagcacagttcctcattgggaattgtctgtcttttttcttctttattatcagggtagtaatgtttttctttttcatttggttaagacattaagcctctgtttctcatatttgttgaaaatatttcccctgtgttgtttaatttcttaggtacacaattttaatttttatgtaatcagatttttcagtcataataattgtgatgttttatcactttaaagattatgaaacttatggcaaactccagagacctcataaagttcactgtttttccttttgaattaatttcttatatataatttattcatttggtattgtagtgtgagatgtgggtctaaatagatgtttctctaaa

SEQ ID NO: 9214 - DNA, 619 bp, artificial
  synthetic oligonucleotide
ttgcaaaccacacatcaaacaaaaggcttgtatctaaaatatattttggacacaggaagaggaacatcacactctggggactgttgtggggtggggggtggggggagggatagcattaggagatatacgtaatgctaaatgacgagttaatgggtgcagcacaccagcatggcacatgtatacatatgtaactaacctgcacattgtgcacatgtaccctaaaacttaaggtataataataataaaataaaataaaataaaaaaattttaaattcaacattgaaaaatacaaacagcccaattataaaagggacaaaatatatgaacagacatttcactgaagagtacatatagatagcaaataagcacatgtaaagatatcctgcatcgttagccattaaggaaatgtgggttaaaaccacagtgagagatcactacacacctatcagaacgtgtaaaacaaaaaataatgataacactaagtgttgacgaggttgcagaaaaaactgagcactcatgcattactgctggaaatgtaaaatggtacagccagtatggaggaatttccttataaaactgtatgcttgcatttaccagacaacccagaattgctcatatc

SEQ ID NO: 9215 - DNA, 902 bp, artificial
  synthetic oligonucleotide
atgaatttcagaaataacattatgctgagtgaaagaagccagatccaaaagaccacatattgtatgactccatttctattaaacgtccagaataggcaaatctacagagacagaaggtagattggtgattgcctcaggctgggagtgggaaaataggttaaattgtaaacaggcatgagagatcttctgtgggtgctggaaatggtctaaaactggattataatgatggttgcacaacttggtaaatgttttttaaatcactaagttgtgctcttaaaatgggtgatttttgtgtgtaaaatatgcctcaatacaattgtttttaaaaaaatagaaattttaacagagctgcattttatacagcaccagcccctcattcctccagctcctctgatgggagtcccttgtgatcttaacccccatgaggtccccagaatccactaagtcccctggagaaatggcagagctaccttcagctgcactggccaggtttctacattcttaagtctgaatggaccttttgcagagatgccagttcctccaggagacaatttccaccaaatgctgaatcacaccatggcagacagaaaattcttacacacctccaggttgcactgggagaggccccttgggagtggggataggggttcctgtgggaaggggggtgttctctagacctctggcagttaacaacctcttcttattcatccctgtttgctccattttctttctcaaataaaagatactttctgaatagtcactgcatgtaccaagcatgatagatagacagatagattagatagatagatggatagatagatagatagatgatagataaataaatagatagaggcacatagatatataatttaacaaacacttatatggcacttgttgcctga

SEQ ID NO: 9216 - DNA, 1117 bp, artificial
  synthetic oligonucleotide
tgcatgcaccctggaaagctatactttaccctcttttatggggaaaatgaaaggtctggggctccctccttggccaatgttaaggatttgctctatttctaccaaagttaggattccatttattgggaatgaatttgcacaagggatatttctgcagctctacaaggcagcatctgtggttgagagtcacactattcagagaaggggcagatgggttgatcctgaacaaaactttctcaggactaagagagttctaagacctatcatttaaagccctagaagaaaggtcttaggcaaaatgtaattttacaaaatctttttctaccagcttctaacatctacaagtggtatgatttgagtggcatcaaaacatatgccccccaacagacaccaaaaagtatagccccactagcctgtcgcaatgcctgaaatttcaccattaaaggctcagtctcagatgcagacaccccagggagcgttaagtgcttttagtcatcaacacgagtgtgactttgtttaatcagctgctttaccctaacagctagctgagtagcttggagggaaagaaatgtgattctaattgtagcaaaggaagagtgaatttgcaaacctggggcactgcacagtgttgctccaaggagcactcttggaagattgggcacctgttagacaagaggagacagacattctgcagaagaaggaagacctagacagggaagagctaaagccttgaaaccatacaagctgtcttcctttataccccgcataaattgcagcaaaaatgctgagcattatagtcaatgcttcatgaatgatgaaattattaatgacaatattcttctataagggattttttcaaaagagttacaaccggacagaaatgttaaattttaccattgagtgttcctaaattctcgtttgcttttctgtttgcatcccaaaaggattactagtcccccaccataaacttgcaaagtaatttatattcttcacaattaggttcccttaagaagaatcactcagtaaagtaattaaaaatgaaaaccttaactcctcatcttgaaaatgcagtagtaacatttcctggataggatataacatttcaagcttcttttta

SEQ ID NO: 9217 - DNA, 3925 bp, artificial
  synthetic oligonucleotide
gagaagttgacaatggagtcttcctgaaagattcttgcagtctgtgtcaaacattaacatagaagcctttgtttttcttttctaactaaaaagctctgcccatataagtcaggaattattgcctgagatattgtacattatccttcccgagcaggttcacagcttccaaaataccatcaggaaaagatgccatctaaggaggcaggttttaggggcatattttctgtccactgtggaaagaagggagtaggagtttcatgacaaagaagattcattttgtcccatatgccgtggactgaatatctaataagggaaatcaaccacttacagtcttggaagtttggagcccatgaatcgattttgcatctattcccctttctcaacaagggcatttgtatcacaggtcacatgacaaagtaggtctttggatttcattcctaaacactattaggaatgacctgcagagagtgaacaatgatcatatcataccctttgacacaaacctaaaattcacttcctcaggaaaggaaggtgtgggctttggagtataacagacccagatttgaatgctgtctctgcctcacactgactatactatagcaatagttctcaagtgtggtggggccatgtcaatcagttagttatagctgcattacaaaccactccaaagctcagtggcttacaacaatcatttactagcactcagacatctgcagagggactgggatgcaactcttctaggtgggtctgcctcaggctgcaatgactggggaggtgggcttgccactgcagatctatgagtcatctgaggtggctctgttccacatctgtcacttcctttaaccaacaggctagccaggatggattctccacagatcattggcagaggagcgagagaacgcgtggaaacctgtggggcctcataaggcttagactcagagctgactcacatcactcctgttggcattccattggccatgagaagccacacgtggctaagcccaaggttaagaggccttcagaagaactacaaagtcacatgataaaagatgcagatacaggggaagatgaagacttggggccaagaaaggaagataggaatcttccctgaaggccaatcttccacttattactctcctttttttcagaattatcttatttttactcatttacttttccacataaaattttaaattattgtattaaattatcaataatgtctcatgggaattttgattgggattgtgttgaagatatcaattaatctgggtagaatcattattactgtttgtaatattaagtctttccatccaagaatatcctatgtcttcatgattcattcaagtgtgattttatatccacagtaaaattgtgtggtttaattcaaataggtcttatattttatgaataagaatatttccaggtatggaccaagtgactttacgctcctttctggccatagaaattagtttctcgccattgagtttttaatatgaccactactcagtgtttaaaactcattgtctctcataaccattctagatgatgaaacttaggtttgttctctttgagatgtacacaaacaaataagctttctttattcaattgactactatctacttaacacgaaccaacaatcaccccatattaaaaatagggatgatgtgaaattttagtttaataataccttatttatagaacttagagtttacaaagcactttccatatagtatctaatatgtttctcattacaaccctacaaatgagaccaagtggctaaatatctcagtttttcaggtagaggcagtgaggtgcagaggaattaaatgatccccccggggtctccaagacagtgataaagagcttgctgttttggcttatagtcctattcttatccctttactcctagccttcattgaattcctccttgccctttaatccttggcagctgactctcccactttgaggacctctcagaatctaggataaaacccaacccttagagcaggcctgcactttcggtgtacatgtagaattgtgtggctctgaagcaattcttgctgcgtgtctgaaaaggagacaatgagttccaagggaaagaacttagactttggagccagacagacctgttttgaaatcctcctagtctacttgctacttagaagctttgagaccttgggcaaattgcattagcatttgaaccacagtttctttatttttaaaatggaatgaaaatacctaccttgcaagaatataataagaaaagagtttatataaataaagcacccaccaggcaaggggcatttagcaattgttgtaatgtggcacagtaaccgagtccatatacacatgggtattacccaggaatctcagtggcgggtttttttcagggtttttttttttttttaagatgaattttccctctgtcattcaggctggagtgcagttgcacaatcacagctcactgcagccttgacttcccaggctcaagtgatgctcccacctcagcctcctgagtagctgggactatacacatgaaccaccacacctggctaattttttaaaattttttgtagaggcaggatcttgccatgttgcctaggctggtctcaaaaccctgggctcaagtgatcctctcacttcagcctcccaaagtgctgggattacaggtgtaagccactgtgcttggcctgtttttttcttctttaaaagatttgcaccttataggccctaaagaaagaaatctggactgtctcagatggtatggggaaaaaatggatttgcaatgaaatatactaatcaggactctgaaaagtttgccagcttttccaaattcatttgacttcagttcattcttttcctgtccaaaaatttcatataaaacaaaatatatatatgcattttgcagacattaccatgtaatgacagaatcttacaattctctccaatgcttgactgtcttagataatgtgatatgctccacagagaataggagagcccatagggacaatcgcaccaccatgagtggaagtctggacagaaacagttgggggtttcattgatgtttgcctcaagtcacctagtgagtatgccgctacaaaacctgttcttgtaaagcatgtacccccgacccacctcatctccacaatgcctttctctttgcctgtgtctacccagaaaaaaaccaggccagcaatctaactggctgccaaacagataaaacatgcacaagaatggatgagtttttggttgttacagttggccagacacttcgatatcatgctggtgctgcttatatctatatcagcactgtccaaaaagaaatatatgatgtgagccacaaggagaattcaaaattttcaaataaccatgttataaaaggtaaaaaggaacaaataaaattaatcttagtgacatattttctttaacccaatagatctaaaatagtatcatttcaacatgtaatcaatattgataaattattgatgaactattattttacattcttttcttcgtactaagcctttgaaatccagcatttgttttactctcacaacacatctcagttaggattagctgtcacatttcatgtgctcaatagccatatgtggctagtggctgccacattggacagcacaccaccaaattgttcatccctgcagagagcaaggtgacacgtagcattcatccagcctcctgtcataaagattctataccaaggtaaacaagagtccagaacttcagctagttttttggacacatagaactatcactttttggtttttgtttgcttgtttgaagaggggtggggagaaaccctagctttctcaaactgaaagtgtgctattccaacatgtttttggattttttattcttgcgatggatttttcccccatttggaaaaaaaaaatttaatttaggggac

SEQ ID NO: 9218 - DNA, 1972 bp, artificial
  synthetic oligonucleotide
tgagtttctcaccccttagaccagcgggctaagctagtcagagtgttgttgctttttttcctcatggagaatgtaagatgtgcagaacaaacctaatcacataagcatatttcacacctccatttgcagtatgtctggtaacagtttattggccaaagcaagtgacatggccaactccaacatccacagggatgtattctctgcttctagtggtaggaactacaaagacacacagaaaagggcatgaatgcacggaggggtgaagaattggagctatgaagaaatctactacgggtggtgagtgactgagtgagaatcagaacccacagctcttgactcccagctgagttccacagttctgtttgtaaatagtttttgtttctctgtcttaggagctgtttctttaagctaatgaagggtttgtaaagttccaaatagaagtggggggccagcagtgagaaaaagtaaagatggttccactctctaggataaagccaacggagacactgggcaattccttttccatcttcttggatgcagagtccaaggcaagcagccaactttgtatccatttctggtagtacttagctctgtgcgcagtgagttgggctccctaatagctgggagtgatgggctgtgagttctgattctcacttggtcactcaccaactgtagtagatttcttcatagctccaattcttcacccctacgtgcattcatgcccttttccgtgtgtctttgtagttcctaccactagaagcagagaatacatccctgttgatgttggagttggccatgtgacttgctttggccaataaactgttagcaggcatattgcaaatggaggtgtgaaatatgcttgtgtgattaggcttgttttcctgcacatcttatgaactgtgtagacagtatgggctccagaatcagacagaaatgagtgtgcacctgagccaccactgcctagttgtatgacttaggacaagtcactctgtctctctgagcctcaggttccttccatacatcatcatctatgttctttcctcttccagcctaatgcagacaagctcagtgactttgaaagtcattctaaggaaacataaagaagcttgcattcctgaagccctgcttggaatacccagttttaactttatacgggcaagtgttccattgtgtgtgagtcatcatgcccatctggttttttcttgttgcagcatctaccatcgccctaactgatgcagtcttattattttccctgctttgtactgatgaggaacctgtggcttaggttaaataacttgcccaatgtcatacagctattaagtggtggctctcagttatgcatccaaatagtctggctccagagcacctgatcttaatcaccacactcttctgattctcattaataatagtgtcagtctcacgggttggatgtatggaataaatgagctaacatttatcaagtcctcagcacaatatctgccatatagaatcacacagtaagtacaggctgtggatggaatatgatgttcccaggtaatatgtaatgtaagatatgttcccttgaggtcgggaatagaatgacaggaagcctcagaaacacttccaataaatattttctgttgagagtattttagatgataccaacataatttcatttgatcttcacagtcaacctgtaaggtgtgtcaagggtgtctcattgcccctaaaccacggacacaggttctgaggctcaggggagattcacatggtcagtggcagagcctagattagaaccagtatctcccagttcccactctcaggttcttagtcctaaaaggacttgaatcaaggaaccaggccagggtgaaccaacattgttatgctctatctgtccaatagaaatacacaagccacaactgtgagcctcatatgcaattgcacattttctagtagcctcatttttaaaaagcaggtatcaggtgaaattaac

SEQ ID NO: 9219 - DNA, 1685 bp, artificial
  synthetic oligonucleotide
accatctggctaaatccagtctggtgtcttggagacacactaaatttgatgtacactccattaaggaagataatgaaacagtcgtctttcaaagattcaaattaagtcattagttaagagctcatccttccaatttgatgggagagactttcaaatctcctgttccaaatagttttcactatcggctatattcaacaccttattctgaagggatcagtgtgaggcctttttttcaatctacagaaagatggtgattgaatacctttgatcccttcacttgtgttcctctcttgcctttctcagtgtggaagcctttttttaatacagggaatgtgtagcacacactgttgggagatattcaatgttcattccacaccccttctcccttctccgtcacagcccatagaggttggaaaaaatcggagactcacattccagtttctcttttacaaaggtcgccattttacctaattctgatgaatgagagtattgggaaaatttgctggaagtctttgcaaactgagaggagagaagtatctgaggagatctccttcactgcccacctatttctgtatagatataatggttggaggcttagttgccatcttgtgaccatgaggggagactctaccaggaaactgagaatgggcaagagagaaagtggaaagatcttcggtcattgggatgccatcaagctgacaaatcaactctgagaccacccacctccttgttaaataaataacgaatacccttctggtttaagctgccaaaagcattcccaacagatatagtagatttttaaggtaaaatttttattgaaatataacatacatacagaaatatgcacaaattgtaagtaggcaacttgaagaattttcatggaatgtttttttgtttgtaaatcgccattacccaagtattttggaaacgaaaatagtggttaagagcgcaaactctagagccagattgctgggttccaaactcatctccactacccactaatttgatgaccttgggcaaataattgaatctctctatgtctcagcgttatcacttgtaatgcgggaatgacaatactacctatttcacagaatttttgtaaggattaaatatgttaatttttaaaatttatacacctggcacatagtaagtgctgataaatatttgttagatatcagtaatgttaaccagggcacaactcagggtggggaggtagagcaggaaggatctgggagagttaataggtatttgagggcctgagaccatcttggaagctaaaagtgcctaatgagctaggaaatgctaaaactattttacagcctagagttgcataatggagctacagacctctagaacttgggtgcggctttgaaatctcctgtatggcagttcttaactgggatctgaccatgtgcccctggaaacccgccacccttcctgtagcatacaagggtgatgctgtacatcaacaggcatatatgtgtgttttgctatccagacttttcatcagactcgtggggcactcatgatccccaaaaggctaaaactccctactagttcatctccctgacatcatagctatggcccagagaaaggccatctaatacttcaactgaattgtcacatttggctttaggtacatgtccccagaagaaaatgaggtcaaagaaaacgtattctattcc

SEQ ID NO: 9220 - DNA, 1022 bp, artificial
  synthetic oligonucleotide
agtccaagtctcactaatctctctcttctaagtttcgcctcagaaagaaagaccctagctccctggactatttcctaaacctgtgtggagaagtggatttgtgtgtctaccatggagagaaagaatttgactacccagaaccatttctccatcacagtcccctcaagcctctcaatcaaggtcacagagattcggttcttacttgagatctccatgctggagcacatcaagaacctgtcttccatacatcccctctcctgcccctgtggaaataaagttctgagcccctgatctgctttgcctccatctccttaatatcccccctaggcagagcattgcccttttgacatctgcttcgactccttcatctttctcttctaattattctcctcagcactgactcgcaacgtgtgactattttatcctaagttattgtgattgtggaaatcgtgtatgggggtaatgcttcctatatagcactctgattcaagagagctatttggcaagcatttctattgagacagtttcatacagaatggcaaaggatggcggagtgttatgcactctgttgattgcatattttaaaatcctaaacatacatgacccttctcacactactcacaggtccacaataccacagctgggatcccactttactctagcttgtctttagagttcagtgtaacagtcacccagaggcacttgcaataaccatgtggctgctgccaggtggagtttgtcttgcgtctgtggcagtgatgtatgggcctggagcccagctttcccaagttcaccctctccgtgaccatttgtgacacttgccacctgcccccagtcagaaactgtgtgtatgtgtgcaagtctgtttttactggggagggggatatttatttggattactctctgtggaagtgaagcagtttctcatggtattgctccatttctagatctcaatgctaaggtaattctccctggtccaggcaactgcctctagttgcctcctaggaactagagaaagagcg

SEQ ID NO: 9221 - DNA, 2872 bp, artificial
  synthetic oligonucleotide
aatggtactcggcatcggcagaaggtataaggctgaagtgctgttcagtggaaaggaattctgcaagatgacaaataatgaaatacaagtcattaaggttgtaactccaagcttttcgaggtacatgtatacatccccagagggttgtgtctctgtaggagatgagcaaagagaagagcttatggggtatgcagccacagattaagcatggcacatcatcccagggtgtaaaatttactggaagatgggaggagagagggaaagcaagtaaataggttagttcacaatttcagccctggctattcaaactgtgcatagacctttatccaggtgcctggaggcttcctagaaattcagaatctcaatctctccccaagacctcctgaactgaaacctgcattttaactagatacccaggggattcatatgcatcgaagtttaagaagcacctatttaatccattgtttgtaaattcacagagacatgaatccattgtggaataaaatgtaaagtttacataacttttaaagataatatgagaaacttgagagaaatttctcactattaattggtggtttggggccacacctctggatggcgggaaagatgtgagagctcaggctctgctgtccttagtgtaaagatgggagtgtttgagaagcattactctcatttgctgacagcaaaaatgtaaacttttcaagtatttaaagttaatgctgaagtcctcatcatcctccctcccacccaccacctcaagtttttgttttatttttgtttttgttgtttttattgaatgcaattcaataatacactctctgacctgaataatgttccatattaggtgactgatggaggtttcctgacaaactcactctctagaaacaaaaagtcttgatttgcagcatttgccaattacaatggtataaatactttcaccatggcccatttcaagctaccaaaggtttaacaacgagctcacaaaattcctcaatatttagcaatctctagcaagcaggtaccagccagctccaacacatcattggttccagattctttttccactctagctgcctgtctcagatccattgcagcttgtcagcctgccatggtctaagtacaataacccagacagagtctggtaggtaccaagtacaatggaattagccttctcattatactgtaattaatgtagtccaagatcacattcaacacttggcagccatacacacttttggctcatgacgagtttacaataaattaaaggtcctaagactccccccaaccaccactacactaatgttaatctatgtctctttcatactgctctcgcagaatttaatttttaaacaaaagtacatgcatttacatgcatccttattgcatttaagcttgttcattttaactgttcattatagcttgctgggaaccctctgaattctgagtctgccattggccactgaatctactcatctctatcctgcatctcctacaaacttgctgagatttcatcataagtgcttattatagcctttgagaaaaagtagaataggaaagggttaaggagaaggtcctcacaacagtattgaagctctccctcaaagatgacattcaagatcaagcagaattcatacacctattctatcactcagaccacattcttggcttctcatccacaaaatgtcataatagccctatcaaataccttgttgagatccagatacacaatatctaagcattcttcttactgacaattttattaacagtatccaatgaaagggaaagggggattgagtttggttttagaaggatttcttaataatcatcactttccatttcaagtgcttccaaatcaactagttagtaatacacttataatttttccaaggaccaatgcccagctcaatggcctgaactatggtgtttttactcattactggaaggtttcactattgtgaaaatgaacataagattattcccagtcgtaggaagagaggatggaagggcagcaaactaggcagatactgaaatctttaacctgtgagcaactgaatgccatgccaattcagaaagtcagattccagagtcagactacctagctcaaatcctggcttcaccacctactaactatatatctttaggcaagttcttaacttctctgtgcctctgttccctcatctgaaaagtgaggagagttttagttcatatcttataaagttgttatgaagaatcaaccagtcaacatatgtaaaacacgcaggaccagaatctagcacctagtaagttctatgtttgctgctagtaccatggccttttcaagtcggaaaatccagacatgccaattctccagcatctcttcccttctccattattttcctggtaaccaattgtggtcctattatctcatctgcatgttctttcagtgaccccagatataacttgcccaggctttgacattttaaattattcaaaacaattaggggctttaaaaatattgcttaatatttctacactttattcttaagtagttgaaggccttgtaccagaatactgctgaagccccacataagactttgtctttgctcttcttgctcctgttttaagatggcttttcttaatgaaaactgcagaagcaaaataaaattgagatttggggtaagctgtcaataagatttcagggaaaaaaaagaaatagaaaaattctcaaagtagtgaaaagtagccttaagaagtaatttaaagatctggcttctagtcttgctttctgacacagcagtttgattgcagcaaatggcttaactcttctgaatgttgggtccttatttgtcagagagaggtattgagtaggatattctccatgcttgctctgtcc

SEQ ID NO: 9222 - DNA, 2773 bp, artificial
  synthetic oligonucleotide
tcatattttaataataatttatatattcctatccccagagttaatttagatatttttatatcaaaatgtacaattaagaaaagacattcttttcattagttctttatatttgtctaattatttgaactttcttgttgttgcgcttacatttacttcggtctgaccaaatttcccaccaatgtgaggagttatgattatttaatggctactccagatggcattttcagaagaaaattttgttcttattacttcatttttttcaattttcatcagctgttaacatctccaaaatttcatcacagacattcttcagcgactctgctttattacgggattaccgggttttattgataaatataaggaactgtacaaggaaaatcattatatatacattaaaacaatgtaaaggtagggtttaaactacccacctaacttctctcctccttaacacctcttaacatgtgcagaaagatttaagaaatatgagtactctgtgcacatgtacactcatactttttcatcacttagtgattgacttcaactgctgatgtctatatataataaatgaagataaatttatcttcaagtaatactcttgagaagtgttcatttctttatttcaaggcagaaccatgatgaaaagatgtcttttggaagccttatccattccagatgaggctgaggcatgctcagcttgggggtgggtttctaaagaaacaggaggtgagaggctaggttgaagttggaaattttcaccttaggggaactaaagacagcaaggtgaggaaagttgaattttgaggtccaagaagcagggaagggagaccagaagattgttcaaactagaggagcccatttgggtctcagagttggagaacaaggctagagattcatggctgggggaacaagagcccaagtgtctgcaaggtaccatcaagacatgcactaaaccccaaaccaagctcttttgcatggctgctagagaagtccaggtcctattggctgaatactccagggcattcagtgagctgagaatgaccctcagacatgaaatctgaaacacaaagagggcctcagtcattcatgctgctggggccctggctgccccaccttccatgactccacccctttctcaccctgccctgtgatgtgcagccccagcttcctgaccttgctgggtctgtttccagcccttaccactcatcagtactgtttgctccttagtcagatgggctgaggtgctttgtattcttcttcctgtccatatacgattcccttatatctattccctgtaccctcttgaagcatcacctactaaccataatagttaagggaagctatggtgctattacaaagagcctccaaaaattcagtggcttaaagaatcaaagacgtttttttttctcttagtattggtctaaagtaagggttctatattcataggcagcactgcctcatggagtcattcaaggacccaggttccttccactttgtagctccccaaaaccttagggtaagaattcttaacctagggttcatggatagaactcaagaggttcatgaacactgatggaaaaaaaaatcaccattattttaactaaccttatatgcatttcccattgctgctgtgacgaatggccacaaacttaatggctttaaataacacagatctattcccttatagttttggaggtcggaagtcttaaatcagtttcactgggataaagtcaaggtattggcaaggctgtgttccttctggaagctctggcagttaatcaatttccctgccttttcctccttctggagtcttccttgcattccttggcttgtgacccttcttccatcttcaaaactggcaacatagcatccatcattacattgccttatcctcatctattatccaatctccctctgtcttcctcttataaggacacttgtgataacatttaggccccacctgaataatccaggataattttcccatctcaaaatccttaacttaatcacctctgctgtaaagtcccttttgccatgtaaggtaacagtcacaggttctgggattcacacatggatgtctttgggggctattattcagcctaccacaaatctctaattgaaatttagcatttccttacattagaaatgtagacaacaacctatagtaggagtacctggaactttgtcaccaatagaaatcacagacaataaatgttcatttgaattgaaaaaaaaagagaaatcacagatattttccatattatattacagtttttgcagatatctcaaatttatgtaagtcattatacctaccaccagatcttgttaatgcattactaaaactgtacatatagtgctgtttcaaagatttgtggtttatttgtttttgttttcatttttgagacagggtctcactctgttgcccaggctggagtgcagtagcacaatctcagctcactggaacctccacctcctgagtttaagtgattctcccacctcagcctcccaagtagctgggattactggtgcatgccaccacacccagctaattttttgtatttttagtacagacgggatttcaccatgttggccaggctagtctcaaactcctgacctcaagtgatctgcctgtcttggcctcccaaactgctgggattacaggtgtcagccactgcaccaggccaatacaaatggtttttaaaaataatcttatatattttactgtatgcattcgaaacttaaatctgagactctttagcttcatcaaactggcata

SEQ ID NO: 9223 - DNA, 1795 bp, artificial
  synthetic oligonucleotide
ttttccaaaaaccacctgcctctcttataacaattaaaaaaaaaaaaaaacagaaagctgctaaacatatgccagaaaggatgccaaaatactaaatcatgcatgtccatgaaattgggattctctgaaactgattcttaggaatccagactggggtgtcctacaacttctaaaaaggagtgtgtttcagagctgagaacccacctccacagagtcccatagagtcatcagcagacacacacagggtgacctttcagcatcacagtgctgagactctacagaaaacttgatcttgcccacaaggtgattttaccttctggcttgagtggacctctggggtgtggtgagatggacccataataggcactgaatacttatcaagttgaattgtgctgaaactccagttcttcccctaggagactggggggcggggcagggagagattctggaaatatccatggggcactgatttaagtttagaattgtttggggttctatcctctaagattttgtgtaatccagtgattcttgcccttggcttcctgttagatctcttgaggagcttattgaactaagctagaatgattaaatcaatccctggaggtggggtccaggcatcagtattttctttcaagggtctcagatggtttgaatctgcagccagggttgagacccaatcgtctaatccaatgtctctcaaaccataatgtgcaggccacctgaggatcttcttagaatatagattctgattcagcagctctggagtggagcctgagagtctgcatttctaacaaactcacaggtgatgcttatgctgctggtccacagaccacattgtgagcagcaagggtttaatttctacccaaagggtttttagagccaaaccattaaagcaaaatctgggatgggccaagatgatctaactcataatgcatccttctggagaatgcgaggaatacagcttcagtgtgactgtgaagcaaataaaatggttaaacacctaaacgttttgtaaaaactagacttcgacttcccatagacttgccttaaatgtttagaagatttttcaaatcacaaaaatagcatggctctcattccaaagagctcaccgtctaatgtactcaaaaattttaaaaagaattgtctctccattccctgtttcttgtcccctttatatttattgattgccttgaatctcactgcctctgtagttagcctgccagagtacaatacctgtgtttggtgttgtttttgcagctctagcttaagccaattaattgcacaatccagggagggtgcagaagaagctgcgtcaccaacaaccagcaggtctgcaaatagcataggcagctggaaaggaaagggcaatctttaaatgtaaacaaaggaataggctggggctcattgagtggccttttcactacacctgcataagcggatagtgactgacatcagttacagcagcttgattctgaaggatgagcgagagaattttgcaaactcagaaagaaaagaaagcccaagccactacccacagagcccaaggtgcgagcgcctgtgaattatgttatcagctgcacagcaggactgcagaaagcacaaactatgaacaatatataaattacaggggtcattctatgagcggatcaagtgcaattaaaatgcaaaagacttttctttttacctgactcaaaaaatgttgcaacctctctggatcacacaagagggccttcagttgtccggaagagcgtaaagtagagcagggggagaaaaacctgattactgcactcaaaaa

SEQ ID NO: 9224 - DNA, 1632 bp, artificial
  synthetic oligonucleotide
gctgcctctggtatatggcggcttgccttagcatactgtgaacttctcccttgattttaatctttgggtctaatcctgtaggtctaaattagaaattagagacgctttcttcaaacagaatttgcttcagcagggaatcagggacacatctgaccaaagactacatcagccgctgtgaagatccactgtatataaatctcagagtcagcatcccaccacaatgctggcccaagtatcagtattcccataacagtattgttattggtatttgctctcaaggcaccccccccccacacacacccccacacatacacctattccttgcagtttaaagcttcctcctctggtacgggcttggattggtttttattttgtggattgcagttgtggaagcctttgaaaatctctccaaccacttgcaagtccagaaatgccttgaagagtgtcttgtatccaggatatagctatatatctgctatgcagtggaagagtccctcagagcactcccccgacccccaacacacacacacacacacacacacacacacacacacacacacacacacacaccccactatattgctagaaggagaaggcttattgttaaattttgaaacacactgttttagaggaaatcgggttttttaaaatgccattattcattgttgcactgaatatgccaaatatacaagttgctttcttctttagtcactatttatcattcttattgttgagaatggctatggacctcaagatgcttgcttctggcatacaaacttgatattttggcacatggtacccaaagatagataggtcctgtcccataagtgagttcatctctggaggtggcactggcgatcctggtcaggaaaatggcattctgcttaatcttacatacacaatcttagaaactgttgatgcttcaacaccacatgaagatattatttaacattcatagcttactgtatacttgccaaatgctttacagcccttttttggtaagtaattttttgctaccactcagagagaaaatcaaggtgtcccttctagatccaattccgtatctggcacaatccatctttgtggcatgattcaaaccctacaaacttccatccctttctgctctacatttattgaataactaaatcagctgaaatgaaacactggctgccacttccccctgtttcctgatatcatttctttctgattaggcatcaggaaaaggaagttgatttgacaagtttgaaaacaaacactgatacacaggtttttctttggacccctgctatgaaatgatgcaaaggggaaaccttagcacccagcgtcggtgctgtggacaggtgcctctctgcatggctcttttcattactaggcaaactgcttgtcttcaaaattccccaaagatatatagagtgtgctgtcagagaaagggcaggaagcttttaagtaggtggccatgggaaacgttccgaaggttgggtggaaaatatatggaaagcattacaatagttatgagaagactataaggcccctaggactatgaaggcaagaagggagattcacatttgttgaactcctatgatggacctagtacttttgtttcttgaataaactatgaaaaaaagataaaaa

SEQ ID NO: 9225 - DNA, 1121 bp, artificial
  synthetic oligonucleotide
caccaagttactctctattcacagagttgaaatcaattttattctgtaaagggaggcaggcctgtactttacttgggaaactgcaataggttcccgggaacacagcactgtctttatcaagaggctggggtcctctgaaattgccagcaccttgcaaggggaggaagacctgttgtaagaggcaccaagttgtcagaggatttggctttcagtttatgatgagtaaatgtgagggggggaaactcctgaagcttaaagagcacaaaaagcttggaatcagaatatggataaatccacacattttctaggttaaagcggttttatgtttgtttacacacaggcttaggaaatgtgatcgtattaatgccagaatatggctatgatttagaagggatcgatgctaaattgggaaacaaaatgatgttacatgtaccaagactaaacactattttcttattcatgacttggtatcacacctttatggcatcttttaaatatgaaaaaaatctgtgagaatgtaatgaattaaagctgtggaaattttctaaagacaacagtgctctacattttgaggcattacatcccctggatatttctatttgattttaatttaagggtcaaatttttacggttgggtaaacagcggagaaagattccatcagctgcttttgaattataataatacgggagaacctagtatacctttgctatttaaaagcttttttaaaagatcacaacatgtgttccacttcatggtatcaaacatagagcaaaatggttctaattgagaacatacttggcatacgattggattaaaatgactgagaattataaatgttggaaatgtctatttcaggcatgagtaggggaaatggcactaatttctagagtatgcacataatgattaaattagcctacagagatgaagagtatatcagccttcaccctggagaagaaataccatatgaataagaaaagagccaatcaattctttagtgggcagcaatcaccatgagaaagtcctttcccactatcacatgtttccatatctagcccatttttctacaattccattagcctcccctgtcgtatccaccaaactaaataaaatgctgtctaca

SEQ ID NO: 9226 - DNA, 1318 bp, artificial
  synthetic oligonucleotide
aagggtgcagttgccatttaacggagagggagaagtctgcaggggagaaggtttgtgggagatatcagtagctctagtttatacattaagtttgagatgcatatcagacctccaagagaagatgtttggtgggcaggtggatatacaagaatggagtttagaagagctttgaactagaaatacgtatttgggaagcattgctgtataggtggtgtttttagccatgagcctggaaaaaattacttagggagtgacagggagtgagatatgtgaagactaagtctgggggcactccaaagcttacagactgggaagataagaaagtgcagtaaaggatagtaaggaggcgaagccagtaaataaaaagacaaactaaggggataatgcctcagagaccgaatagttttaaataagaaacactattgctggtgaaccaagtaagatgaggactaagaatgaccataggctttggcaacatggacgccattaacattgttgataagagcagtttcagtggtttacttttgacggaagcgtgttcccatttggggacttgtgagggctatcaggccagttcaaccgtcccacatcccagttaggtgggtctatttgttgaagcttttaccccaagctgaacaacagttgtcaagtttggctccagcagcctggttgtcaactggccaggaaggacttccaacccagttgaccctctgagactgagtaagctgagtaaactcagtgctccctgaggagcccatgaattatcccagatattgggaaacaccccattagctcaccctcatcaaccatttcacactttcccccgtttcttcaaaccacaaacacttctcccccttcctcactctcacaggaagaccttgtttcttattccactagaaaactagaagcagtcagagagaaatccctcagcttcccaccaccacatccaccaacctacctgcaactgtgccttcccctcttctactatggatggaccgtccattcctagcttaggccaacccctcacttgtgccctggatcccatccttccttgcaaacctggctacccagtacaaaagaaaaatctagacaccttactcaaaatgtatcaagaattttgagacatcaacatcagagcactaaagcaagcacgggacccttctgaacacgagtcacatatccataaaactagtcctgtctatggctgggtttcttgctctcctgtttcttgaagacaggtcccagcctggacccaacaaaggatgcctggtttttggggtagcctctccctcagagggcaacctagccttactcaggc

SEQ ID NO: 9227 - DNA, 1852 bp, artificial
  synthetic oligonucleotide
agagaaccatggaatagaaaccataaacccctttttccccagaggagtcttacaatggattctctccctctgctctcacaagatatctagcaacctggttgcttttttttttttttttgagatgggatcttgctctgtcacccacgctggaatgcagtggcgtgatcacagctcactgcagcctccaactcctgggctcaagcaattctccagtctcagcttcctgagtagctgggagtatggcacatgccactacacttggctaattgtcaatttttttgtagagaagggatctcactctgttgcccaggctggtcttgaacgtcgggccttaagcaaccctcccgggccagcttcctaaagcattgagattacaggtatgagccactgcacctggcccctggttgcttctttaacttctctttggacatcatggcattgaagagcaaattgccttatagatgaaaatgtcaaaatgtggggttcatgatgggtaaagaggagaggaaataatacaaatagatggtattgaaaggaagaggctctgatgatccagtgtgcagcctttatttcactggtggactctgagagaggatgaggtatatctcatgatttttggctgtgatgttctccatgttgaaaagggttgttttcccagggagtggggtgggggtaggtgggcagccataaggaattactatttggtcacattgatttttttggcttgccatttagtgccctttgtcttaagtagcctgactgagccaacaaagtttgctaaatcatgatttttctgggacctgctttagtcattaataattagcacatcagtagcctgtatcaatcatttatagtgtctccagaatattaaaactcaagaagtgctagagataggatcatgagccatcaatgctggtattctgtttgagacatgagagctagaggacaaattttggaacgacgtatccttcttgcagacttcaaggctggaaaggtactaccaacacatatgagttatgtttagtcacctaaccacagccaatcaacaattgctgagtagctgtgctagggctttggtggattgggcaagatggaagggagggaagcagagaagaaaagagaggggagggagggagaaaggaaaagagaagggagagaaggatggagggagggagagagaggaaaagagtagggaaagagggagggagagtgggaaggaggaagagaggaaaggagaagggagggagggagacagagagaagggagaaggaagggtgagggaaggaggaaaggagaggggagagaagggagagggaagaggaagggtagaagaagggagtaagggaaagagagaatgaaggaagagagaaggggtggaaatcatccttggctttcttacaaggtagctaactgtaagcaaagctgcacgtggtgattgccaaataagataagcaaacatggaagcatcttaagagcctggacaaaagctgtggggatcagggaagcatccagaaagaggtgagatctgagctaaaatggatcatcaaacctgcagggactgttaaattggattgcgggttctcatcaccagagtttctgagccagcgggtctggagtggggcctgagcatttgcatttctaacaagttcccaggtgatgctcatgctggtgatctggagaccacactttgagaaccaaccacttctctgaaggattttagatatgtagaagggagacctacgtgaagggttaagatgaggaagacgttaagaggaataaggtggcgaaaagaggaagacctgtttaggaggattctgaaatgaagggattgtataacagaagagcgagagaa

SEQ ID NO: 9228 - DNA, 887 bp, artificial
  synthetic oligonucleotide
aaatataattgtgttgagtatcaagtgttattataactaatgttttaatcattaaatataatttataaagcttgtaggaaagatagtctattttattcacccagatttctgctctttctgttgttctttcccacttcttgatgctccaagattttttcttttataatttcctttctgtttgaagaatttcctgtagacaatatttaagggtaagtctgatggtgacaaattctcttggttttccttcttctgcaactactttgatttccctttcattcccaaaggatgttctagatcggcagttctttgctttcagaactttaagaacattgtattacttccttctggcctccacggtttcagatgaaaaccccattgtcatccaaattggtgttccctgataggtaatgcatcatttctctctggctgccttcaagatcttatctttgctttagttttcagaagtttaactatgatatgtcatgatatggattggggggaggttatcttgtttgaggtttgctcagcttcttgcatctatgtgtttcttttgccacatttgagacgctttcagtcattatgtctaatattctttcaaccccactctttttcctctttttctggaactccaattatatatatgtttgatcttttgttattgttccacaggtctttgggagcctgttcatttttttccaggctatctctctgtttttcagatcgtgtgaatcttcttaattcatcctgaagttcactgattctatctgctgacatatttgctctactatcaactccatccagcaagttaataaatatggagtattatacttttcatttataagattttcatttcattattttttataacttgtatttcttttctgagg

SEQ ID NO: 9229 - DNA, 6352 bp, artificial
  synthetic oligonucleotide
aggtgggagggagaagtggtaatcagaggcattctccaaagacaagagctgccaactctacagcaaggatgtcaccctgatccccaaatcaagcttaattcagaatcccacgcaggcttttgtgtgtgggaagagtgcaattagccatctttccccctcattctctgaggtctccctcatattctgttcagggaggcagcattgaggagctcctcatacatagattcaaagcccagctccctcggtggctccagaatttctaggagtttgaagactaccacctggttggaagggggctacggggcttgctttaacgatacatttgcatagcaagttccctcctcattttcctatagagtgtttgtttatttgagacagtttctagttaaaaatacctcacccagcctttggtccctcgtggactttgagttagttgcttaacctttctgagccttagtttcctcacctacaagatgggaataatcttgcccatctcccatggattttgtaaagattaaactggggcttgtcagcatggagctaccaagggctaaaactggaatatgacaccaggaacttcaggcccccaaccaaacgtacaaatctctggatctctccttgctgggtctcccttaacaatgatctacagccccctccccactgccattcactccatcagtgccatcatttagtcactcaactctcatttattaagcaacagttgggtggtggggactccaagatgaaagggtacagtctgtccatctgacacagggtatttcggatctatctacttggcacataagtatgcactgtgggtgactgggttgcccactggtgggcttccaccttccccccaatccccaccaactgtgtaccagattttgccaaggtggaggggctgaaagatccagcaggaagagatccagagatttgtatgtttggttaggggcctggagttcctggtgtcatactccagttttagtccttcgtggttccatgctgacgtgtcccactttaatctttacaacgtctatgtgagatgggaaagattattcccatcttgtaggtaaggaaactgaggttcagacaggttaagagaaataaataagagacctggagcaggggaatagggacatgttgcccctttaaatcataaccaccaaagtctgaaatcagatacacaactggaaatttatctgagcctcagattccttatctgtaaaataattcttccatcacagggtggctgagaaggtttaccacatgtgaagtgcctagcagacagaggccaacaatacatgttagttcccttcccaatttatttccctccactaccatcctctccaaaattctaagcttaggggagaagccagagaacagacgtttcctattttcttatcataaatttggagcacgctgtgcagggctttctgcacatccagagtatctccattctggatcaatggatttgggaggccagtcctatcctcagcttctgggtcattacagctagagcactcccagcaacagctcctcacacaccttccagtctttgatttttctttcttgtagttcagatggtcctgtttcagggactctgtattctggatacaagattttgaaatgtgtcttacagttcttccccagctgcccaccaaaccgtgttctcaccccagcgatcggcatcgcttggaaaactgtcttttcatttgttcctcagatgaacaggttttcctgggcaaaacatcaccactggaggtcttggctttttttcatcataaaggaaccccctcgggtggctgaatggtcccctgggctggtgccaaagtagtcactacccccaagttccagtctgacttggttcatagtgcctgggctgccctggggatgcctctagtgggcatctgtcaggacgagaagcgagtgcccatttgaaggagactgtgtgtatgtgggggtgtgggggcaggtggcttctctgggcttgtaagaggcagagaaactgggatgccaccatcttacaattctctgccttccagcccacccctggcttctcatgttcccgtttgagaagaaaactagcctccatactgtccccttccgtattgtccccctcccaccttgccacccctctactgtaacaaaggcatgtccacaccacattttcaaagttgtcacaagtctctcggtccaccaacaaccaattctgatgactccaaaggagcaagagagacatccagaaaacggtgggaaagattccctgggaaaagcacagaaaaccttgcctgatgcttgcaaggctaagaattgttttctccctgctggctgcttttctctctgttctaaagagaagcttccaagaatcagttaaataaagggatcacaccagaggatgcgagataatgctaaaccaacaaaaacaaagacccaaatgaaacagacagagccatgagaatacgcggttatcaaaactttgtttggccatatctatttatcatcgctgcacacccgggctctgcggaatatcattctgttgatgtcacttatcctcagcaaaatatttacacatccttaaaaacgccagatgaggggggccggcccgcgcactgccgcaagccgcccctcaaaccccatcgctgggttctgaacagcccacgacataggggcacgacggtgggtggcaccagcgggcacaggtgagagctaccaacagttccgggaacacggtcacccagacgctgcgccgtgccctccccacctctcccctacctgactctgcaagcagcagccacatacccgatatggtgtcggcgcctccttgtcctcctctcctgcctttttcattgattaagttctcaaaccattgttaaagctgggttgctttttccttggaaaactgggctaaattcattaagcttccctctgccacaaaaggaatattcataaaagtttggcaggcagaaagggagactgagtgagtgccatggtgtgggtaacaacccgctcctccaaagccaccttcttcttccgtgccccatccctctctccatccatccgtcgtgccccaaacctactccaaggacttctgatagggaaacacaaagcagcagctgtttggcaacatttctacccctcgccagcaactgtggtgggatgccatttccccacccaggcggagcttatcctgaacaatagtcgggctttaaatggcaaacaagcaaacacacagagcacaaccccaaccccgaaaaagccaccgcggagagaagcaataactccctccgcagcaaaaggcgccactgaaacgcacgcaaaaatgcagcgagaacgttgctcggtgcctaacatggcagaaagcccgagctggtgcggccaccccggggctgggcattggggggcaccggggctcccggggcgccgacgcacactcacccggctccgggggggatgcggggctggccgcgcgtcacaaagaggagcccggcgcaatctggcaaaacccaactttccaccaggctcgccagggccgccagatacgtcaacagaatccatctttcgaagggcctggaaggcgccgggttttccgggccggggcagaacggcagatccggagactgcccggtgcggtgcctgggcgcggagtccgccgtgcaccgccctctgcgcccgatgccagtgcgggcggcggcccgaaacccacttcggggcccccgccccgccggccggcgccgcctccccggcagtccccggccccgccggccagtgcgcggcgccgggaacgggagcggggccccggcgcgccacacgggcggcggcctcggcccgcgtccccgcccccgcccggccctcccagccggccccggcctccgggcgccgtcctgcccccgggagcaggcccctccccgggcgccgggccccgccaggcgcgcccagcccggcgcgccccctgcgtcccggtggcagctccgcgcggggagggcgggggtgaccccggcccgcacgggggcgccgcggccactacctcgcaatcgcggccgccgcctccaggaagccgcggggtggtcgagtgtgctggaactctccggtctggcctcgccgccggccgcctgaagggggtgcgccgcggtgggagccgccgtcgccgctgtcaccgagtcgctgtcgccgccgccgctgctggttgtgcgtgagcgtgtgtgcgcctgtgtcctggcgagtgtgtgtctgcgtgcggcgcccggcctttactatatacaccaaggggtgggaggaggcggggaaggggagggcttgggggaggcggcggaggagggggagcaggaggggggcgaaagggtacccgaggaggcggcggcggaggagggacaggtgatctcgcccacggggagggcgtggccgtgggcggcgcggggtgccaggaagaaggggtgtcggggcggggaggaggaccttggggggagcgccgggggagggccggaggagctgggaccctactgcctcccggcgggctggggaccattccagaccccaggatggagaagagcgaggaacagagcccagaagggaggaagtggctggctgatggaagcgggggaggtgggaagggctcagcgatcacccgaaaatgccaattgtgataccggtggaggatgcttctcacaaggtgggagattaggaaagatcaaattagtccacctacgtaatgtaatttccatccaagaggtgattcatgtatcaatctaacctttattaagcgcctagtgtttgccagatactgggcaaagaactggagttacagggacggtgactgtatgattgctgaccagtaaataagtagtaggtgtcagttgtactattgatcattttaaaactgaaaacaataaacccttagaattcttgagacagccaaggaagcaaccaaattggtttaatgattctccaaagatgtaaagatttttttctattaatcaaaacaggatgaagatatttgagagagaatagcagagcagaaattatttaatcagagcagagaataaaatgaatctagttgttcttggtagtctcgagccccctgaagttccaatactgtgtgtattaaacatgactttcctcttatcaaatctgagttttataacacagtttataattagtatgggagcctgaacttgtgtttgaaaggctgtattctaactatgttgtgttgcaagcataaggtggtagtaactgaggctgaatgatgtctgtcttgagcacttttgcctttgtggactccttcctccgtagaaagatattacaaattacattttacaattgcatttgtgtaaagatgaatataatagcattatatattaaaacagtttcttcaacctaaaaattcattttttcttctgattttaaaagaaattaaaagatttatgtgggtccctaaacatgagccccaggcactgtgtctactatgcctaagggagaagtcagccctggtagtaccattccttgatactgaatttcctcttttgaaaaagaagagttaaattaagaagtacccagaccacacaggggtggaaagacacacagtgcaagtttaagaattgataataatgaatatcaacagaaagtgtcagtttctacttgtttcaatcaggttttggggggtttaaaatcagccccaactaattaatgatacctgtggaaatatttatgaatgtgtcttcaatcatttcagcaaccaaagacttcctctatagatctcataactgttctaagttcttggataaggtatgtgaggtctcggttgccaagacctagcctgaatccaactaaagacacagctgggcaattataattgggcaagttcatggatgaaagatccataaaggttttgtgtgtgttgagggggtatgtgtgtataaggtagggattgatatcctggaaggcaattactagcctatttcttttgttggcctcatcacaaccctgggttaatgtttgatcctcactggcagttgtgattcatatttgctgccctttgaggtgcttatgttttcaggaaagattatattgattcagattaatgcagaagaaataggcttcatggcccccattcccaaataaacatacagtggcacccttctgccttttcatcctggctgcccttgcaaagggaaggaaaaaaggttcataaagggtgggtctggatttgtgtgtgcgtgtggggtggtgctttgggacagaaataggacattaatgtggaataattttgttcatacagttaaaggggtgcctaagaaaatggagggaagaaggaacatgccgaaacagcaggaaagaacaacctcaaaatcttccagga

SEQ ID NO: 9230 - DNA, 4486 bp, artificial
  synthetic oligonucleotide
agccctgatgacctcaaatccagctgctcagcctctatgagcacaaacaaagcttggggtttctggtgtggctgtgtcgaacatggaagggcagggcagaattggccttttctaaccttcttaaaatgccagtgatagaccaaaaaggatcttagaacaaatggccccatattgatattttcacattcaataattttatatttggtctagagggctagtgattctttttttcataaaaggaaattgcatccagagctaattgctcaatctgaaatggatctggacattgtttagatgttggaaaggaaacggtaacattgtagagctttcacaaagaggggagcattattttagaacaaaatttaaatggaaattaataggaaatgtaactctgtatggttttcaaagctttgatgtgcatagtcgaaagagtatccctattctgtgctttccttgacatttttcttgtttataaaatgcaataggaaattcatcggcacaggctcaatccattcccatccattgattgctagccaatcaatgaccattgtaatctgaaaaaaagtaacactggtttctatgaccctttccaagcacagcactgtttagctaagcttaataaagagaaaaacagcaaggaccatctggaaaacactcttccggagtctcgaaagatagtggcagcctctgcccaacctgctataaataagtgtctcagaaacaaaacaaaacaaaaaaaacacccgattttcaaatctgtttctacttaatacagctgcaatagggtttatttagcttttccctatagaaggaagactgtttgcatttttatgacaagttcctaaatgtttttcacagccatttccattgccattattttgaggaacaacataccactcagatctgtctgtttgcttctgcacacacagcggtggccccagtggcctctgcaccacgaaactggcctccaacgcccagatttatgatcctatttcctctcccagtgttgcaaccatcacctgaatcctggcctgcaacggactggcaacttagaatgtccaagtgtcacgtgctacaaatcaattatttatccgcctgagcccagcacactgtggatccctaccagcttgttgcctctctcttcatggcgacaaggaagacttcaactactcttcaagagatgctggaactcaccaatgaagtgtcgctggcttgccaaatccctcaatgctcacctttccatttttcctcactggctagtatgcaagggaatcctacacatgacactctttggaaaaggtcagcctaccttggatggctgcaaaatgaagtggcctatgttgacttctgcactgaacaactgcccctatccttcaccagcatcccctgctcccatatcactctcagaggctggcaggggagggctaactggggaacactttccctgtataatgagtgatccacttctctgccctctccctgccccccaaacacccattccatttccatgtatgggcagggcatggtttgcccgcatgacaccttccttgtgtaaggcatgaccctcctttctagcctttcaagggactaccagaaagaatatggctgagggcttgtcctggtggcaacatttcatctgctgttgctgcctgtaggcattaccaggtgctagctgcctgaaggagaattgcttcaaggaaacaaatgtgtgtaaaaggaaacaaaattgccaggggtgatgggggctacctgaatttcaatcattacgaaaaatgatccatctaccgagaaagtactgttgactttctctctcaatagtactggaaaacatggaatttagtggtgggtaaagggctgctacaatctgaaatgagtccattacaatattacgagcagagctctcacaagtacactaaatggctaaatcaattggctcgggcttaagatgctaccggagaaatgacagtggggaggggctgggggtgggggaagatgcctgctgactttgaagtcatgcctggaatcaggtgcatatgaaaaagaaattagggaggaataaacctgttctctttatgaaaaaccagagaagccactagttcttacaatgtgccccccaatcacctatgacttataaaattgcctgccttgaaaaagtctctatgcttatacaatcttatagacccttccaccaaccttagaattaaatcacgcacatgacccacttccaaccgttaattaatcatgcccatgaattgtatttataaaagtcagagggggaaaattgtgtcttttattatgtcaaatggaattttccaaaaaaacacaaagtacttattaaattttggtctagacaagtggtcttcaacagggctaattttgtcccagaggggacatttggcaaggtctagggtaggaggatgtggtgttaacggtatctagtgggtggaggccagggatactgctgaacatcttaaggtgcatgggacagtcccctgcaacaaacaattctctggtctaaaatgtcaacagggccaaggtgaagaaaccatgctccagataaagccaaatatgcttggcctttaacattcattttttttttaaaaaaagggaaaggatcccatttttttcaaaatctaaggcaggtttacatatatgttgactaacatatttactccttttccatataaatgaaataggttctccatctgaatctaggaacattaaagaaatattgtgatgatggtgggggtaggtatgggatattttaaatgcatatttcatcagtctaaatgggtggaaattaatatctcataaaataaaatgattatctagttatgttccatacaaaaccaaaatcaatacactgtatcttacctaaactgcaattagagttttaaaaaaactaaaacaaggaaatgctattctttcccgttttttgctagctgggcacacacttctgagcatgaggcattaaaaaacaaacaggcagacaaaaaccttatttttttaaaaagacatatttttccagagcacaaaaagcttcctgaatctttccttgtatttactgtagattcaatcattccttagtgagcaaaacatgcagcccattctcttggttatgcttgcctggctttccaaatgccctcaaaactaggatgatgaatcacatactttggccccattgtgccaattaatagtaagcaaaagaattccacacggccaagataggactttctgcctggttgtgcatacgggggtggggagggattcttcagccaattgctttcagagaatcttaagaacaggtgtttcagttccctaaaattcctttcatcctagaacattctatgtggttctgcagtgcccccactttggggatgggctttgatcaggaaaaacctatgttcatacagtcagcctggagcttccaggcttaaagcacgaaggaaagaatggctgacagctacaccatttcaacccttccaggcctccatttctttctctgaattataagggaaaagtggccatacacacaaaggcaaaaataacaacaacaataaaaacgcccaaacacacccagtcttggctgccagcacggcccgattctgctgctgaaaaagaacagttgctacagtgcagctggaggagcttttccagggaactggtaataccctggctgttaatgaattatttttcgccagaatgtcggattcttcctgtgctccagtaaacagtctgcttctgccatgtgaaacaaaaccaactccttctgaggagcccaagggggtcagccaagggtcccctgtgagggcagccccctcaggagccagagccacaggcgcctgacctgtaaatcactgcagtcccaagttcattatcccatccctttccgtctatttatgccatgaccagtgcctagggaaggacccagaaatgatgtgatgtgatgataccatagtgccagccaaaatccttcttctacctccctgaactctcctttggccaggtttcttcatctgctgtgctatggttgtgtgaaattgaccttccttgcatttattctgtctccctcgcagaaattttatttatgtccttgctcttgttctcatcaagctgtcaggaaatgacagtgtgcattctcttttttattttctctcctttaaggctggccctggccctaaataacccactgtcagcatgagggtgtctactggcgacattactctccaagcacaaatccctgggatggatagtactttaagctgctactagagcaggtgtcaaggaattctccgatggacaaggacaccggcctgtggggtgggtggggtcgaggaaaggaaagagccatttcattcaagccagtcctgcctgtgcccattctattgggtttctgggtcccacattcctcatagagcatgagactgagccaacatgctcatggctagtttccacggggaacctccatcatggcacctgagctact

SEQ ID NO: 9231 - DNA, 2828 bp, artificial
  synthetic oligonucleotide
tcagaactgagggctcagaataggattgcctaggccataccaagattttctgactactcacctaggcctggctgcagggggaggggaggcccagatacccactctctcccttcttctgagtttcctgacccaccagggggcccaaaagacagaaaccagggtgctgtcatcatttagtctgtctatcagcctaatatgatttggctatgtccctatccaaatctcaccttgaattgtaataatctgcatgtgtcaagggcagggccaggtggacataattgaatcatgggagtggtttcccccatactgttctcatggtagtgaataagtctcaagagatttgatggttttatagatgggagttcccctgcacaagctctctcttgcctgccaccatgtaagatgtccctttgctcttccttagtcttccaccatgattgtgaggcctccccagccatgtggaactgtgagtccattaaatctctttcctttataaattacccagtctcaagtatgtctttattagcagcatgagaacagactaatacaaagccatcaccaagcctcagagaggcagcctcctaagattctttctgaatccagccactagcctccccatccgctgcactcctctacttcggttcttccttgcctctctttctgggttactgcaacagggcctttttggtcttcattccctccaccgtccccatcccccaccctccagtacatctccactgggaaaaagaccaaacacataaactaggtcacctcaaaagcctcctgaaaactgctcaggatgaagtccaaggtctttatcaaggcacacaagacccattatgatgtgggccctgcccaccttttctgctcatcactcagaactggcccttttgctgcctctgtttcttcatcccacaaatgaaaatagctgtttctgaaagtgaccgtgtagttgaagtgaaagcacatatattaaagccctgcagtggttcaactccatcttaggtttggagaacatggagtcctttgcccccagccacagaagtggtcaaaaggaatgaaggggaagggtggagcacttggcatagccctctgcagaaagcaacgaatttgaaggcagcaaataagtatccatatggatgggggaatgaagagcttcctgtccaaatatccacagtggagttaacagcgggtttggctgactagaggaaagcaggcctcagcccctggtgatgatggtgacaaagaccagagagggccagagctctgggacccactacatgctggtatttactgagccgctcatgggtagatggcagagagctaagtggtaggaaaatggaagtattaaaagcccaaggaatttacatttcaacaccaattaatggggacagagcctctataataatgcaaaagaggacttaacttcatgcctttggagacttacttttggaaacagacaaactgagggaaacttgtgtgttagcacttttttgttcaatctattatcagcatctaagtgctgccaggagccaaggagggctggactgtcatagactgtgattaaaatgagctttaggaagtgctgcctggctcaagagaatgaatgttggtttgagaccaagccacaaaaaaagacacatgatttctgctctcaaataaaacaaaaaatgaaaaaaaaaaaaagggtaggggagggagagacagagagaaaagaaaaaagcttagtctctgtgggggaaaacagaagatttgtgcatactcagaaaaaaatattccataccactctttcattttacaaatattcataagaaaaacagctcaacagctgctttggtgagtaacctcaactacttctttccacctgtatctaaaaaaaaaaaaaaacaagaacattcttagcactgctgaaatggagatcaagtgttaaggtggctgacatcacaatctccttccagggacctttccagaccttccctggcctcctggccactcacaccccctcacctctacccctgccccagggaggctggcttttgccctccaaaatggacaaagactttaattagggtgaagaaataagtgtaggggcatggaggggtgggggaaaacccagcttcattatctgtctgtctcactctttcctagtcaacttttctgccctgtttaattacagagaacagcaaattggacagcaaatgggcctctctgcctgggcttgccctagattgctagggtggtcaggcagttcctagagcccatgcttcttccttcacccgcaactggctctccaccctcttcctcccaaaagatcccaaattaaaatgaatgcattcaagaacaattgctaaggaagtgaccaaatctaacagtcgcccaaataaagctgggatgacgacgagagggtaagctcttcaggacagcagtgggaaggaagcttctccctgctgacttgagccagcgaccactgctccctgaggtacagaggcaattctaatgcacacttgcccttgagaactgctggctacaggcctctgagaaaaagcagagctgtgttttgtctagagggaggaagagagatgtaaagtctgcagagagcagacagacggaatggtgcggtgaaacaagcatattctagagctgctaccaaagtgtacattcagtaaaatccacttcctcagccacttacttgtagctagtggctaccatactggactgtgcataacatttccatcattgcagaaagttctactgaaccacgctgtacagaatcccagttccacctcctgtaagtggtgtgatcttgtgtaagttactaaacgtatcca

SEQ ID NO: 9232 - DNA, 3958 bp, artificial
  synthetic oligonucleotide
gttcagcattttctagctatggggtctgggcatgtgacttcgccttgttgaaccttccttttatccatcatcaacaagcctcattgagagcctactcaatgccaccctctgtgccaatcctggggtgacagtggtggacaaaatgctcatccccttcctacttggagttgcatctatcggtgtaaaataaggaatctttgcagggctactgaaaggattagtaacacaaacaattccaggcacataaaaggcctttgaaaactatcggctgcttaaaaaaaaaacccaaggagcatgacttagttaaggtaggataagttacctagtgaattgctcctaacttgtaattgctcaataatgaaagcttatgtcttgtttatgtaactgtctagggtgggggctccagatctggcagttttgttccatgaaatggccttccctaggcagaagaggctctgccatctttaactgtggctttcaaggtgaccttgggacttcactccatcccagacagccagtggataagagaagagcttggaggaaaacctagaaagcttttatggttggaccagaggtgcacacatcctttctactcacatcccattgaccagaactcaggcagatggccacacatacaactgcaagagagactgggaaatgtagtctatctgggtacctaggaagataaacaaaacaggttttggggactaaccagcaatcactaccgtagtgaattagagagggaaacaaatccctatgactttgtttgtgagtgtttatttgtggccagtctgcaaatagctgatgctcaaagaagtctttgctctagaagttcagaagcttttttttttattatttttttgctgaacttttagttttttggaagaactctaagaagacatctgtttaagcctcttttttatcatcaaggttgtcctgccaccgtctgagatactactaaaaaacaatgccagccccaagctctgactttcacaagatttgagatgctgtcaaaaataaatgccagctcctcagattctgtgtgaaagagatgccaacacgcatctaactcaaactaaaagctgcagacaagaagctgtaccatgcatacattgtcactcctactccactaaagaacctcacatgcgaaccagtgaatccatggattaatcatggcaactaaaaggaaatatcattttttcccttaagctcgcactttgcagaaccagtacttatatgtctgtctgtcagaggcttacatcacaggttcagaaggcttacgatttaattctacaatatggtttgcagaaagtccatgtgtgtggtcgagatagggacaatacgtgtacaatacgatactattcatttgttcatttattcattcatccattcaatcaatatatattgagtaactcctcaattatgagcactgtgggtcccgggttgaggataccaagatgcaagacacattcactgtgtcgtgggggagtcagctgtgtgaacacacaattacaatgcagccagacacctgctgcagtggaagcacgtgcgatggcagtagaagaagcacaagaaacagattattaaaaaggccactcaattcttggttatttctctgatttacttggcacagaagcatcaagtaactcatcagaaatcttcctatggctcattagatgaaacgactggaaatgtgaagagaaaggaagtgctctagggccccaagggctctttatttatgctgtcattagaaagaaagtgggcaaagtactagcagctgcagacgttggatctctcctgtgtactaggcatcttgcatacttgtcactcatcctgacaggcaggtatcactgccacccactgtacagttggcatctctgaggccagagagatgaagacactcgtcccattatgtagtagttggtagacctgagaatttggcccctttgactctaaagggcgatccctttccattgcatccccttactgcccacagtccatggaaaaccagggagaacagacccagtggacagagggaggcttagtctcactgcgagggagaggcagcaaaggatggtggaaggcgttagtctcaggagctgatgctcaccccctgggagtaatatgaggataaactgtcgtcattcattcattgattcaacatttatattaaggaactgctaggttccacatgcttgggggatatgacagtcagtagaagaagagaaataaatatgctaaaaatttctttgtcacccatgagaagtaataaaacaggtaccttttcatttttgatgttaatgattagggaaacataaatgatcggcaaagttttgagaaaatcaatttaagcacaagaagactttgaattgtaaagctccaaactcctggagaagataaagaatatatgtataggaaaaaaaaaaaaaaaaaagactgtgaggacatgaaccaaaatggtgatagtggcaatctctgggtggtaagaatgcgaatgatatttattctcttcttgctatcttctcatacttgtaaatgttttaaagtaagtatgtctacttttatgatcatagaaaaacaagatttactaccaaggtaaagaaaataaaactccaaaaagccagaagagaaggattcctgtgtttcatccctttctctcctggcacgtaggcggtgaccagcatgtcagccagacagctatgcctcactcctatagtaacacccaatgatatcttatttcaacacactgcctgattatttcagaactcactcgcaggagtagccacaggaggaaatatgcactcatcactgagatattagggactgaatcctgaaacttgatttttcattagggcattatgccatttttcaattaagacaggttcatcttttttttttttaaagtgctgatgtgtaaaatctcatttccttccttagcacacttgcctgtgggttttgtttgtaatgcatttccatgcactccaacgagtggcagagaaactgagctcgtgagctgtgttgcgacagtgctcctggtgctggaaaggaaactgcagctctgtgagaacaatgctctggaaaatctgtaaaacccagttgaacacacctaaggtttgcatgaaagggcagacattactcatggcagctttgacagtgagaatggagacagaaaagccatccaacccttcagcaatgaatgtgcctggatgaactgatcaggtctaatctagaagccaaggaagaactgtctaatgtcttgatacagtggattcattgcattatctttttattaaaagtattttccatgttcttgaataaaaaaaaagattctgaccctactccctcaagtattaaatctagaaatgaaaatatcctcactcaaactaacagggtctgtgaggggcttaggttcttaacataagattctatttcctgctagaaatattgtttcagaaaaaatagaagctatgatagaagggccacaggaaacatctgtgtatacaaacaggccagctcactaggaataaaaatgcattatgcatcacgaaagtctaaatatttttattaacatggtttgttaactaagaactgagaaataaggttccctaagagtaccccatcaaatgctttcttcaatatttcattttattcttaggagagaagttgcttgggaatcttatcttagatttttgcaatgagttttctattaaaacttatttcttttccatttcaggcagagcaaagctctgggccaagagggttagggaatttgtttcataaaactgacagcttggcgagtattcaatcactcggcactccacagcccaggagaacaaataagtcctttgctgatgccgctccagacacattacgatgtatgttccatagcttgattcccaccttcccactttttgcctcctgcagcaaaaagaaaaggaggcagaatgcacatagaaaa

SEQ ID NO: 9233 - DNA, 2888 bp, artificial
  synthetic oligonucleotide
ttatgcccccaacaaatcaaaactatttaactttattgttttattttttacaggaaacaacctatcatggcacagatacaatttttgtcttttccttttcacactgtattttatgataagccattttcctcagagatacagagtatctgagaatcaccttaagtaacaatacccacccctcaactcccacccctgcaacccctgtatcttaaatgattccatttcctcacatctttttggagttacatgtctatcgtgcacaaacagtatcgggagtgacaaggacagggagcaatgggaccaagctgtctgccctcattgtagcttgaaaattaagtactacagatgctccttcacttacgatagggttatgtcctgtcataagttgaaaatattgtagtcaaaaatgcatttcatacacctaacctaccaaaatcatagcgtagcctagccaaccctaatgtaagctcagaacacttatattatcctattgttgggtaaaataatctaacagcaagcatattttataatacagtgttgactatctcagtaatttattgaatactgtactaaaagtgaaaaacagaatggctgtacaggtattcgaagcacaatttctagcgaacgagtatgacttctgcaccattgtaaaggtgaaaaaaattctaagttgaacatcgttaagttgggggccatctgtatttattatggtcctcccctgagttggcccctgatcacaagcttctccacagcaaagatatctgacgaaggccttgctgaaccccaaaccaggcgatgcagacagtgtcatggaatttgcaaaatccccagacaaaattagtgtatgtgccagaaagcatttttccttggggaggagcatggttaaatttggattcccccaaaggcagaccctgtgaccaagatctgagtgcatacagtgtatgtaaaaggggaccacaggcagcacccatggaacaatagagaagtgaggcaggaaaggaaggcaaacaattcaggatgcgttaataagcagctgactgccatgagcaactggggctaagtcccactgggagttaacctcaggtttctccctactgagggagagaaaacagcggcatctgtcttccagttacattgcatcatcagttgagggctgctcctggtgacatatgctccagagcctcttgcttgtcctgtgcctgggctaagcatgcttccagggccagtactgaagtcttggaggagagagctgcaggggttcgaagtgagcacacagataggtggaggtgagtacccaggaggtaggggtcagccaagatagcttccactatagagataatcagtcgaagagcgagctgctgcagacacccaaaagaccaaagcccaccagtgtgcaggtgcaagcctgtttgtttctctttcttcactctctgaaatccttactgacatcctgtggatgggcaacaggctggattttcccaaggtctgagttccctaaaagtaaattgggtatctttagaagttgtctgcacccagccttacagggcttctaatgggaaatcttggcattggagcccaaaacacagctcacaaatcctgaagcagccagtgaccctaccaaagatccccacttaccttccaaggagtaatttaatcactgggaaacctggatcataaactctgaagttctcagaaatgatgtctgtttggtagtggaattctgtgtccaggcaagcctgccacccttcttaatgtgatcctcttcccccaaaggagagaagtcaagacaggccttatgcaagttgactgcttcattcttcctgggaagcctgctgggttaagttgggggttttgttattgttgttgtttgatttttggcagggggttattttttgcaagctctatctttgtcaaatgctatcacaggcaacattaagacagatctacatatggacacaaaaagacatgttcaagaatatttgtagcagctttatttgcaatagccctgaactggaaaccacccagatgtccgtcagcaggagaatggataaacaaactgtaatacatccatacaataagatactacacagcaataaaaaggaaggaactactgacacaaccaacaacatggatgaatctcataagcattatgctaagtgaaaacagccagacaaaaagactacctatactgcatgatcctgttcatatgaaactctagagcagacacaactaatctaccgataccgaagtaagaatagtgtttgcctttgggagatattgactagaaatgggctcaagggagctcttcagggtgctgggactgtattctattttgatctggggtatgattatacgggtgaatacacatgcacttaaaacccatcagcacataagatttgtgtactctgtgactttactgtatgtgttacatatacacctctataaaaaggtaagatagactaatataacaataagttgaaagaataataaaataaaataggacagctctagagaatactgtctctctctgtctttctctaactgtgaccagtggaaacttaagcccttgcctagagcttggtctccttagggagaaaatgtttgagagggttctcttggtgaagttggcatttttgccacaggaaacagagaagacagaaggaaaaactcaacatgagcccagaggtctttggtgcgcaacatgaatagtttgggggaatttaatcaggaccgcctcaaacacacacacacacacagcacacacacacacacacacacacacaaaacacagcacactcatgcattgaatcacatccacacacactccatgcccaccaccctgcaacaccacatgcactcacgtcccacactgctgctgcaacacacct

SEQ ID NO: 9234 - DNA, 1724 bp, artificial
  synthetic oligonucleotide
cgacaaccaataaacatttgttgagtggctgtatttaacagaacttcttcacaatactatttatgttttatttacaatacacttttatacacagtgcttactgtgtatacacagtgccaggtactcttctaaatgtttacaaatattcaagcctcacaaacacccccaaaagagagatgctgttattattactactttaaagatgcagaaactgaggcatgcaaagaacagggaacttgctactcagttgcagagctggaacgtgaacttattgtagccttggctccagaatctatgctcttaaccaccagcccaagctatcaagagtgtctactgccacagcaccagcaccatgtaccaagaacaggtgggtgggatggcagcatgggaaaagggtgaatggggcaagtgggtatttaccctttaagagatcgctgggttaagtctcacatacttcatataccactttttggtgccacctctgcaggctgagggaaggtggggaggttgaagcttgggggtccatttccaacccagtatccctacccctgcaggagatctctttttcccttcatgtttctactatagttctaggccagcaattctaaacctggtacaattctgtccctgttgccaagaggacatttggcaatgtatagggacatttttggttgtccctaacttgtgggaggtggggaggttctactggtactgagtgggtagaggtcatggatgctgctaaacatcctacaagccatgggacaggcccccgcagcacaaaataatctggtcccaaatggtagtagtgctacgggtgggtcaccctggtcttggtccagagactacctatcagaaaattaataagaaaggtggtaaggccatcaaaggcaggcccatctgtgaatcaccgagaaatgccagctgctccactacaaaatctgcagggaagaggcaaagaccttcctgcttgcctccctctctctcctgattcctggaaccacagcctctccctcctgccgagaagctaagaacagctctggcccacatggcacataacagaggttgctaatacccgcttcctttggcagcttcttaatgctcttggcttggcatttggtattcctcaagcccttttgcctaattacattctagagatgaagggaaacctatgtataattcaaaaatgaatggccctacctttgattcctctaaaacatgccaaatcagagtagaactgtgctactcctccaaatagattatggggatctctggagaagtaagcggaccttgatgagcccaagctggaccccagggcagagcacaagagaatttagaatgctctttatggatgataaaatgaagaaaactcaggatcagatttaggatgggagcgagtgggggaattacgtggtatggtaaacccagaaggcccaggcttgattgctggctctgtccctgagctttgtggcctgggattatcactccgcttttcccatgtgtaaaacggggtttgagacacccccataaagatactgggagggttggtgggggaggccgtcaagggcctcacactgcatgtggcttagagtagagccttatcaaatttttgtttgttcacttgccaatgttcacccttttattcacttatcaccatttatccttttaaccatctcgacacccgagggatccaaaagctatttatgcctctagctcaccaactcagg

SEQ ID NO: 9235 - DNA, 1823 bp, artificial
  synthetic oligonucleotide
tagcctgttcctcccctgcagggagtctcagggaagcatggggaggagaggagctggggatggtctccctaccggagacactggggttgggccttgcagagtggggaaggaagaggcacttgccagggaccaggggacaatttcatgggtcagtttctggatgagagccagtgggccagtgatggtgatcaaatcatgccttgttgtcatggaagctgagaagggacaggattggaagagattttaaaaacaaaccaataaaaaggcaaagaaggaaggcactcatgtggagttggcactggggacaggagagtcaataccagctagagacaaacagccccttccctggacagcctggagggcatcgtgtcatctcagccctggccagttgcccctgctcataacaatgacccagtcaaggaaaggtttcctttgccaagatgcttaatgcattttgaaaagtttcccattgaaaacacttccaataaaaggattcagagcttgaagaattggccttccattatctggctctcacactgcctgttgagtggtattccccagacacacaaagaaaacaggctattctcctccacgctcaagtaccttaggagcacccattcactcacaatagttgagatcctctttaccaataatgttatcagtgtgttaacacgatttccccaaggacttctaccaggcaagaccttgttagctgctttccatctgtgcctgaaatcacaaagcctcattaaaaaaccatcagttgttaacaaaaaatgattaactctgtatgctggtcctgccaccctgaagactgaattcctgagcgcacttgtcattccaatggtctccattgctatgatggccaccttggggactgacacctgctgacatcctgtaaccagagaccaagtctttgttttgtggggacagtgcttgaatgcttgactgttactctgggcctcgatctcccttcagtggaagggaaggatggtcaggagtctggtctcctcattctgagcctacaggtcattagatcacatgttccctaagtgtcctctttgttcctggataagatgtaaagcaaaatagtggaaggcacattgccctgctgtccagagccctgacagggaggtgctgggggagggagggggagatggcataaagctgcagtgcttcaaggccctacagggtgaggcaccagacaggtgggactccagaccagagtggctgttgttttgtgatttttctttttacaccctagtctgcttcaagagagtttgtttaagttaagaagcctatggcctaacagagtttgaaccctgacagagaaatagcaaggaccaaactgagggcctgggaaggtctgttcaggggaaaccacttaggggaggggattccagattccaagaaatgagccatggaggattacattccaagcaaagttgtgacagccaagaaaacctgggaaatgaggaggtattaatgggcatataatcaatcaaagatggggggggcaatggaaaatggggacatagtaacagagatataactatcaaagatgggcagtaactattcagttttaggaggatttgctggaacccatagtcagttcccaatttctatctgggattcttttgttatttcttaaaaggtaactttattgagatataattcacataacaatttacccattttaaagtgtacagttcaaacttttaaaagtatattcacagagttgtacaaccattgccacaatcaattttagaaccttttcatcacctacctggagttcttgattctacaaagtagatgaagaaatt

SEQ ID NO: 9236 - DNA, 1664 bp, artificial
  synthetic oligonucleotide
gaccagagcattcgaagggtgcctttcctgtttcctttctcggcattgaaacatcaagatacggaatccagaagggtcaccagaacctggccctctgcaatctggactcgaggctgcagacttgctgttgaactgggctgggcaggagggcagagtgggcaccagggcccaccttcctggggccctgaaagggtgggatggtgtgtactggtcccctcacccaaatgcaggtgtgggaggaggacatccatcatgatgctacatggcatttgcttcaccaccaggagagaggtgagtgagagctgggcccggagtcgtgcgcctcgcagagatcagagtgggccgacggtgtcggaggagactacagcccaggtcgtgcctcactaggaggcttcctccaggtggaggtgctgctgccttctaccactcctggggcacacttgaggccccacttcccggacctcctcccggggtctcagtgctagactcagcctgggagacaggctgaagttctcaggcaaattttactctaccaaggccacccttttgtaggtaaccaccaggagcatggacatctctgggctcaggctgggcatcaggcgtcctgacagttcctttggtgatcctggggtgcagccggggtagggaacccagtgtctggcagagtgaccaatactggctgtgtcgtgggagcgcccctggcccaccctccctgcttgctcaagggtagtggctgccaggctaggcctgtgctcccaccaccgcttccgtcccccagctcccctgagtcgcattccaagatccccaacattcccctgctctgttcctatcgtccccagaaatgtcgaggtcactgcttcagctctgcaccctgcagtgtgctgtgtccccagctttcattttagcttgtccccaaggctaccaagtcccaggccagcgatcttctctctccctggctttgctgggacacggtttcccattaatgaagggtgaggtggttcttttctgaaaatctggacccttcaggattttcagtctgggccctccccaggggtgtctcaagaggctcacagaggaggggtgtatgctaggtaggtgcccgtgccaggaccactctggaagattcctgaggttgttgctgtgatctgccagcagagggcgctgtatcccagcgcagatgaagtgggtaagagggtggtttcttcccagtaggtgggtggagaagcagggctgttctgactttttgaattcctttgctgcaaaaaaaatcctcttcccgtggtggagaggtcagcagctcataaatggcatgagcaagagattccttttctatgctcacctcacaaacccttttctgtagttatttcaaatacacttgcccccaatttatatagcagatgtgttcttcggaagttgcccacatgctagatcgtgtctcaagtgcactcaagaaacctccctcattcaaaacagaaactgatgttatctcttgtaaagcaaactttagatttctaattcaaataacaattcatccactctaaggcatcacattcttgtaagaagagtttgataaagggggttcagctgtataatttacttttgaggaagcctcaacccccctgctcaccaggttgcagacttctaaggctgcatagcctcttggt

SEQ ID NO: 9237 - DNA, 1058 bp, artificial
  synthetic oligonucleotide
tttggtgagtttgaaatgccatatttacaagtagcactatttgacctatatttatcaacatccttgatgcaaactagtggaagctgttcgtttcctattttgagggctggttttaggtgatattcagaatgatgactaacatttattcaatgcatattatgtgcaaggcactgcaccaatcagctgacatgcctcttctccacttatactcataatgaccccatggttttggcacatttattacgccatccccacgatcacagagctggtgagtagcacttctagaactctgccccattgtgcttttccaaatcttctatttttatttaccctttccctagataaataaaaaacactcctgatatggcaagagcccagatggtagggaagaaagggtatgtttttggctaattcacacacacaaaaagatcaaattgtgttgatggtcctggttggagaaacaaattttcctaactaattacaaaacccactttagtcatcacacactaattttagggagtctaacactgtgggtgagtaaaaggatacttgtcagtacacaaagaaatttcaacacaacttagtgtagagcatagctaaaactttctgaagtatgagcagttaaactgtctcatatctcagttattttttaaacatataaacctttgaccaaaatctctattactatgcaattaaacatgaaagaggaattaaataaaatgttagttacttctgacctagttcagcagaaaataatcttgttttcttcacaatgcacattagcacttaagccacgagagacaggaatctaaaaagtaaagcgatactaaaaataaccttattgaatacgtggggaagatttgataaaagtactaatttggttcttaaagataatggggttgttattgagattcattgattaaaaggaacaaatttaagcaattataaaactgtaaatttggagaatttccattatattttgctagtaaaattaacctaatctagatagattaagagagaaattccttgaaatacttgaagagagtcataggttaggt

SEQ ID NO: 9238 - DNA, 1118 bp, artificial
  synthetic oligonucleotide
aaactacatgcaggaccagcaggatactaccttagtttattttggaacatctggctgaccccaacagccctccttagtgggaagaagtagaggagaattttcaaacgtggagacctatccattgtttctacctctaggaatttatcccatagaactacttgcacaggtgcaagactgttctgcagtgttctttataagagcaaaactttagaagtaacttgaatatctatgaattgggggctgtgtttaataaatcatggcatatttacaagatagaacactaagaagtcgttacagtaactacagtagacctaaaagtactggtttggaaagactctttccaccacaggttagttttgcctgtttttgagtttaatatcaattgagtcatatactgtactcttttgtttctggctgtttttaaacccaaggttatggttgtgagattcggccttgctgtatacagcagtagttggtttattcttattgctgcgaagttcctttatataaatataccacaatttaattactgatagcctgtataagttttatggtcagaaaactcaaatagtttaaaaagtgaaatttgattgaagttacagccccaattagagaggtattttataacttgatacttctatgcaacattagtctgcgtttatctaactcgagttagttctcccatcttctttatcccttttgatttctgtcttttgggttcatggtcattagtatctccactatagaatgaaagggaaacaggaaagagatgaaacctgaatctcttaattgtgcctctcattactgctctggttcagaaaggatagggtagctctttcattaacgtacccttcccagtaactgtgatgcagacattcaaagcaaatttctagtacaagatataatccgatactcttgcagccagttttctagttccatagtaaagtgactcagagccataaccaaaccttcctaattttagattgtttggcttacctttcacatccacttatttaggtttaatataaaatttaataaggcaatcctaacttgaaagttgaaatggaccttagagatcatctcaactggtgttcgaaacctggtggatgaggaggtgg

SEQ ID NO: 9239 - DNA, 1212 bp, artificial
  synthetic oligonucleotide
acattaaaacaaactaaagcaaaatttagaagaaagaactacacatatgtaaataccatatttttgataaaaatgtgtaaatagatttatcaatgatgagtggacatgtggtcaattatctactgcacaccaactgtttatagaatacacaaaaataaaatgtaataactgtattctgtgaataccattttcatatcaaatgccatatttaaatgtccaccaatatgatttctgagtggtaaacctcaaatatgaattttaaactggtgaactaaaggaaatcttgaggtcatatactgaaatatgaataaattaaaataatgaattcagatctaatcatttttatgacaaattgcagcaccaaacaaactaatagcaacccatggctgtgatttgttgtgtggtaatttggacagaatgaaaagcatgcttttgattttttttttaatcagtgagagaagtcatcattctcaacacaaagccctgaacaacagcatttgacagtgtcctttagattttaattttttcaatggattgctttaaagagaatgagtagggaaaatagtagttaattttaggttatgttttatattaggctactggggacataaacggtcataactaatgactgtaatcattaaactccttaaacagtttagaaattagctccaggttcttaaactaacaaaaataaaacctaagcatgccacagagctattgattaatcagtaagtacctgtaatgagttttcagtgaagctttctctctgtgctgatgagattcatgctacctaaaaattaacagaaatgacactgtgaacaatgtagttggaaaataggtatgtgtatatgcattatttatactcattgttaaactgggaatggggaacagctctggttcacaatactacatacaactgagtttttgtctggttttactatagtgtctgcttgatggcaaaaggggagggtggagggtgggagaggaaatgtcagggcatgtgctctgataaaataaaggcagggaaacaagctgaattacttgaaattacttgaattttcttgtcttaaaactgaaaaaaaaatgtagttacacgttaaaatctgcaaatggtttttacacctctgattttaacatgaacttatactaatgtttggaatcttatgtcagaaatataagcagctatgtacttagaataggttttgaatggga

SEQ ID NO: 9240 - DNA, 1620 bp, artificial
  synthetic oligonucleotide
aattccagctttacagttggtatagaaggtggatccatttaagtgcagaactggggactgccttgtatgtttattttatattgaaaagacatctcatgctaaaccagaaagcattcagtttagtaaatagaagaaagtagacagagttgggtgatgatttaaaaaaacaaatccttagactgttgagtttcctcacagcaaaagaggtgtgtgtgtgtgtgtgtgtgtgtgtgtgtgtgtgtgtgtgtgtgcgcgcgcgtgcgcgcatggggaatgcaagaaggtttggaccataagagatggagggaacaaaacctcacaaagacggcttttaatgaagaaatgggtcaggatatgttagctgagctaattcaggttatcatcctggctgctgatttactatgcaaaggtatcagcttcagagagcccagaaatagatcagtaaatagtagtaactaaaggttataaatccttaaggagccatttctatgtgagagggattttttggatgtctttttctcttctctttcttttgatttttcttctttgcttgtttttgttggcagtgcaaactgttgtggagagctgcatttagaagtaaagcttaatgtactgcagcataatttaaataagagctgaataacagctcccttatatttgttcacaggcttaacccaaactctttccttacttcccgtcaaaaatatcactgtgttccaagtaaatgaaaatttgtttgccatttctaaagctaatgagacctatttgtgggttgcaggagttggctttgacagagaggctagtatacgctgctctctggttcattcacaatcggtactacagcggagacgaaaattgaggaggaggaaaaccatctcgggtatccccagaagagttcaacaagaaataggtgtgatatcaaaaaatgttaatggttaacattcctccgcctagtacagatgatagggagatgaaatagaaaaatgattaaacattttaacttgtagaggttttaaaatggtgtctatttgttttgtattcagcaagccaggtggtattactttttaactctttattcttgactgtgaagatttgaccttatagatttaggcatatacattcaggtcttacggctgaaatgtaatacttagctgatttttgaaagttttattaaggtagaaattgtgaataaaaagtagcaggagtcaatgaaagttttctttttggaaaattgtaacttaatttaagagagatatactttcatgtcattaattattttaaaaggtaaattccaggcatatgcaatgaaatattgaatattgataatatgatacctttggtgacaatgtttctgtttagtggatttaaaatatctctgcctatgatttttaaaaaattattagggtatcatctcttgcaaataagatttttatttctaataatgagacctatgatttttatttcatcatgtttatattacaaaataaaaatgaagagtagtggccaaaaagataaaatgtactttagtttttaaaagtagtcacttattgtggcaaattaacgtgatagtgaagagagggataattcacaaaagacataaaagcatatcttctcttggta

SEQ ID NO: 9241 - DNA, 1876 bp, artificial
  synthetic oligonucleotide
ttgatatcgatcacagtggaacaaacttgaattttcaaaacatgcgttataatgaaattgactgtacaggaaggaaaaaccagaaataaatgagatggatttccctacgggggatgagtgggagtggggtagaaagaatgggaggatgggatggtggtggcaggttcaagggggatggcatttctctgagtatattttttgggttatagctcaggtaatgttttatatatccccccataaataaataattatcatcaaccaggatgtgaggagaaccccaaatggaaaacaaacagcaccaaataaacctaactacattacaaatgaataacaaccaccctgaaagaggtggggaagaaaatagctaacctttaataactttggaaagcagtatttttgtttcattttaaccacaaatatttattgatagattaatgagtataattttaaatggaacagtaaggcataactgtggattaaaacaccttgcttcatgcctgtaatcccagcactttaggaggccaaggcaggcggatcacttgaggtcaggagtttgttcgagaccagcctggccaacacggtgaaaccccatcgctatgaaaaatacaaaattagccaggtgtggtggcaggtgcccattaatcccagctacttaggaggctgaggcaggagaatcgctggaacctgggaagcagaggttgcagtgagccgagattgcaccactgcactccagcctaggtgacagagtgagactgtctcaaaacgaaaacaaaaacatcttgctatacaaccaaaaggggaaagtcatacacttaggaattttaaatatgcaagtcaaagagcctttgaggtaccccacagatgactatcagataattcttcccttttatacaattcctatattacatcacttgatcacaaagttaaaattttactttaaaaggaatccctcattcattcacacttgagtcatcccacctggccactcccctgcttcccaccccttccccatccctttaaggtggtattctttagccattcccttcctgaataattgtgtgggtcaggcacggtggctcatacctgtaatcccaacactttgagaggctgaggctggtggatcacttgagctcaggagtttgagaccagcctgggcaacattgtgagacctctgtctataagaaaaataaaaaaagaaagaaagaaaggaaagaaaagaaaaaatagtcaggcatagtggcgcacacctgtagtcccagctactcgggaggctgaggtggaaggatcacttgagcccaggaggcaaaggctgcagtgagctgagatcctgccactgcactccagcctgggtgatagagcaaaactgtgtctcaaaaacataataaaaagaagaattgtgtgtccgttttccttcttaagcaaggaagcaagcaaacaagtaagcaatgagtcagagaaagtccaccaagggcagatttatgaatgaagagacttacacagacagatgttaggatgacagcaacctgattacttgattcagtgaagtctaaactaagctgactctagcaaagaagctgcactggcttgctcagaggcctatcattccacctcagattggccacaaatgcgagactccatgtttctaagggattaacagtggtctacatgagaagccaggaagccaatataaccaggcagctgatgctacaatacatttgatgctttagatctccattaggagctgactatagcttccagcataatcatttgccacatgtaaaatccttcaagatactgaggacaatctttaaatctcagataggatcaattaggaatttccttaacagtaatctatttgaaaatgtgaagtggaaag

SEQ ID NO: 9242 - DNA, 1399 bp, artificial
  synthetic oligonucleotide
aaggggaaaagagaaattgaaaatgccaagtgtatttcagtattactgctttttctccttctcagaacaccggagccggagcgatcgccgagagcaaagagcagctgcccccctttccattgcagctcctccactgccagcctaccctccagctcacagccagaggaggcgtgagtttaaggaccgtcactttttaacggtaagtttggtggccacctgcagccctatgcttgctgctgaggaaacatcagtttgtctgggagtcagtttcctgcctcccagtgagagaggctgggctggctaagagctcaaatcatgggcatttgggaacaaattaatttcccttcctttcattcctgaaagaaacgcctcttttttggaatacagacatattttttagttaactggtagcacaatgcagtaaagcaagaataattacagactaaaatcaggaaaaaaaatacatacttcaaacctcggttcttctgcttgcaagctgaaggattcaggataggttacttatgttctttgccctcagttccctcatctgtaatatagggatattaatagtacctggtttatagggctagaggattaaatgagataaggcatgtaaagtgcttagcccaatgactgactgatacagagtaagacctcaagaaatgttaaccacagctgccactactgttattactggtaaagtgacagcatggctgacttggtggggtgaactggtaaagaacttaagtgatacgaaaaattaccatttgaagagtaatcatgtcatcatttcatgctttcccattctccaaaggaggctagttctccagggtaacttaataccatggtgacgtcatcgcctctggggctttcagccctgaccagatggatgtggctgtaactcagcccaagccctcaagcatgggtcacagatgatgaagctgagcccatctcaaaacacctgcaaatactatcagcagccactacaaacacatcaccgcagatgtgccttctggggcctcagtggggacaactgagcactttgtgcctctgagcaggcatcattgaagtgagggactatggcttttgtgaccaaatcagcccacactgcctgtctgaatgtctgcattcctgctgtcttgtcattctggttcaagacccaaagtctaaagaagttacaatagtgtgggtacgagttaaggtttttattagaaattaaaattgcgtgtatgactctaaattgtgcactcttacggcttttacaatatgcaagagagatgcaaaatatttgggtcacatggtgccaaatatccagccaaaaacagactttatctaaatgaacccacatgatataacatccagataagaccttgagtgataatggacaaaatataaaaac

SEQ ID NO: 9243 - DNA, 1961 bp, artificial
  synthetic oligonucleotide
tttctaccctgaaatgaaatccatgggtaatatgcccaacccatacacataagaaaaaataatattatggtctaaatatgataataaagagaaattaaaaggaaattattgataataatatctatttcaatatgcaaatgctcaggcatgacctcactagaagacatcatgaagcagtcagatgtctgcacttgtcaaaagcaagtctggattaagtacagaccttcagaaactattccgaggggcaggagggcatgaccataaaaactggtacattcagtatatattagatatgggcaaaaaataaatactttggattagaatgaaaagggaatttggcttgactcataaataggcactaggtttttcccctataagagattctgatggaacatttaaaattgtgtgagacctgggacacattttcattgaccatcctctgcattatgggatggctgtcatctttggctcccatccaatcattgtaacaattagaatgatcccctagagggctcttctgcttctcttgagaaccagtgatcggtctaatgcccccattctttagtgggacacgcggaggcctagaaaggtgaggaaacttgctcagggtcacacatagcaggttaggtgtggtaccaggacccaacctaagcctctgaaatgcctgccagagctcttttcctccttgccatacactgtgtctcatggaaataggtactgatgtttacatgtctctcacagtcctgagaaagctagagataggctcatagcagtcaaaataggaatacagttttttcttacactggttgcttttcagtgccttaaaaccattctaattaggacaaggggaataaaaagtagcttcattgttttagagccccctaaattgggtatcagaaggggacatgtcagctttttttggcctttagattcttgctatggagatagatggtgtctacacattcaatgtctttcttccaaattccctacactcttttaagaaatggcattttgcaaaagtattaaaatgcaagtaaaatattttaatgtcattatcaaagtggagaaacaaaatggtgatattgttttcatcttatttattccacatttgtataactcctgccttttccccatccttatcttcaatagtttgttgccttcaattatcatcttttttccctcctcatcttttttcccttcctcatctttttttccttttaatgaaagagctaacctcctaatatccctaaagcaattgtttctaaaaattttccttggttattaggggaagacattgtgacacttacaatgaagagtgatgatcagtatcctgtagaagcatctttggcatacttaccattcacttcaattttatagttggctaagaagttcttttttaacttaagccaccttctgaaaatctttctttccacacttgccattcctttgcagcctggattaggcacccttcccataatatcctgtgcatcctcccatcctgccacttagaatcttataatcaaccactatgggcctgttttaccaaccaaccactaataagccattaatctatgagcaactcaagggcaaggatgatatcttattaatttattttattcaaagcacttagcatgaagctgacatatagtaggtcctcaatgaacatttgtggaactgaatcaagttttgcaaaaaactggttgaacattgagggcacaggatgactataaaggaatctgatcgttctcaccaaatcctttctcaggtcccatcattagaaatcttgggtaacattagccctttaggtataattatttttatccctttattttattaataagtcatccctgattaggattttatggattccaccagataacaccaagctgctcgtaaactatcacatttcactgctttgtcaggtttagacttaaagcagaactgaagaacagcaagtgccg

SEQ ID NO: 9244 - DNA, 1139 bp, artificial
  synthetic oligonucleotide
acccaagtaacacagcaggggagtggggaagtgagagggagaagggaaaggatctaagaaaggtatgctatcaagcagccaccgtgtgggtagctgtgcctcagtcctgctgaggaactctgggagatagtgtagaacacacttcagagttatcttgaccacagaggagggcatctgttactgctccagtgcgtgccctgtgtgtgggccaagcattctcccattgtcagaggggaaaaaatcacccttaggcagagggtcttggggaatcatgagaagcagccttctgactgttgaagtgaatgctgaaggcacattggcaaggcaagaagcatctgccacaacatcctctctaaaatagcaaccccatcacgctttatcaccttgttccactttctgacttcacagaatttacgccacctgacagtacatctgtatgcttatttgtcatctatctctcccagtagacagcaagttccaggaagacagagaactcatatgtctttcagtgcctcagacggagatagtgggtgtttggtaattatttgttgagtgaatgactattcagagaaagactgaaactcgttgacatcaatattatcctcagcacatgaaagagtgagagaagcagggcagaaatcagttgcaggaacgaacgtaagcattggacaatgagggccatagtagggtcttcaatatgaatggataagaacgttattccagtttcctggtctgatgtttctggggacttaaagatttcatctttgccatggccataacagctattattttttgacctatataccaaatggaaacaacaacaacaacaagagtttctttgcaggctgggaaatttaatatatccaaaagagggcaccctagtcttgatccactagagggctcaggccaaggacaacagggaaagaaatgtgaacgggacaaaggaaggaagtagggagagagagtgatggagaaagtgcggttcagggaagcaggtggcaaaggaagggcctaacaaccttggagtcctcactaaaaatggaatattcaactgggattttattaactttgagatgagcttttggggacctattcaagtaaacacaacccaccccaaagccccaaatcctcacttgtta

SEQ ID NO: 9245 - DNA, 4116 bp, artificial
  synthetic oligonucleotide
actgttaacaaccacctcattattgtaaagatcaatacaaaggagaaaagacagggccattttcattgctttgtggaattctgcagacttcattgtcaaggctctcccgtgatagagcagacctgaaaacctggagcaatgcagttcatttccttgggctgtgtgattagtgacttggccactagctacccatgcacttgccagggattgctgtcgagggcagccattttgctcaccctaatgtaaattctcatgtcaagacctgagaggtttgagtctgtacatggtgaggcttcctgtttgaagttgatctgagagcttgttaacatacagatggccaggcctcaccccagagtctgattcagcaggtctgggaaggcctgagaaggtgtatctctaccaaacccccaggggctgccggtcctttgagaagcaaggctaagggaaggacttccctttacctttgagaagctctgactggtattcccacccacttcacatctcccatcagtagccaatccatcaagccttcccaaagccttaggggtccaggtctgcccttggcagcagaactcctcccactgacccctcggtgacatttgacattataaatcacccagccttcttaaaactctttcgtccatccccctgtttctgagatggggcccttccccccttccatcctggtctcctgcttctctgagtaatgtctcttcctctctgatgaccttttcctttacccacccaccccttaaaccttggggtgcatggctgtcttctcaccttcactgggggagtggccatgccatctcctcccacctcatccttcctgtcccagccacactctgtcttccgggggacttccaccagattctctgtcgttgccagcagctggcagccctccaaggaggctagtggagaacagctaacccagactgacttgggttctaggtgatacttcatgtgaccacaatcattaattcacagtaatgccaattaggaaatattctttatttcacacacaggcaaaccccaagatttcttatgaccttggcaagtggagtgtttcacaattgtgaattctggagaagttacaggcctggtggatatagtattgcccacacatgcaaatctgcccagcgcctaaacatccctagttgaaaataggcaacccagtcagaaaagagtcaagttttccctaaataggtttcaaagacatattaccaaaaacaacatcccacaagtcatctttggataatttcattcactgggtttcttcttgttatgtatggtattaggatatatcccataagtgttgtctttgaagtggccctaaatggctctctgccttctgcattaggtcgctatatggagagcctaccaacttaagctatgggcacacactgccatggtttttaatcctggttcaacctcagatctggtttagtaaatcgccgctccctggagattaatacatggctgcaaaggcattgtccttgcagtgtttttcagcctgggcagggtgagatgtgtctaggatgcgaggtttcagcatccggagatgaatggggggaggggacgcaatgtcacatttttcgggtgctctagtcctgttatatgcgggcacatgctctacgccagtctctgtccaccctcttgcccgggctggaggggttggcacggtcggcgtttctgattccttcctctgctgttggccatagactagggataagggaggtgagaagagagccacgggggtgcggtgctgagcagctgcggtcggtccagcctgttggtgatgtgcggagcccgccgccactctgggcatgggtaacgcgcagccccagcggtcgcgctacgggagaaggaaacacagaggtacaagaaatccggatccgggatcctccgcagcctccggcttgtctaagctcacaggccgggctttgtggctggctcccgcgcgccaccgagtttggggctggggactgagtcctgcagctcactgcggctggcagcaggggacggattatttttagcaggttccctttagcccggtggagctgggagatactcgcagagccaggcggctgtccgtggagcattggtgcagccgtgccttgctgccccggaggtttggctgccgcagtcctctccattcactgagctgtaaatcgaagctgtctacaccgacaaggctctcgatcccagcgtggccccagggctacgtcccgcccaggtctcccggcacctgatttcccagtggtcaattaggtgtctcagcctgcagcattgaagcagtggaggggccgatgcccctgctttgatggagcgcgccgtgcgcagagacctccccagtcgacttcctcatcagaaggcagcatccattcataattctctgcctgtggaccgagttaggctggagctgggcatggactcctgcgatctctctttttgcatctgaaggagaaactaagataaaaggaaaaggaagggggaatgcagtcctaacgcaacaatgcgctggaaagtccccgagaggcctctcttttgcggggagagggagaagaggcagattccgagcccagcgccccagccagctgctgcttcgctgcggagccggcacgcatgcctacctcacctgacggccgcattcccggggagccggcgcggggcccggcggcgcgcccagggcgcacgggcggtaggatttctgcaccaggggaacgatgcacgggcgggctgcccagggccgagcctgagcctgagcgggcgccaggggaggctagcctcggcgtggcgccccaccgcaaccctccgggatgctccgcgactcgcagcccaggccatgcgggtgtgtgagatgggaccagcctggggggagggggtatgggcaagtgacatcattttaaactaatttctcgcacctctgggtgctgggtgaacttgggggttgggggaggctcgaggccagccgcgcgctagcccgagaggagatcccccttggtcgagatctgagagctgggtccccttggcagagctgagcgagggtgagctgacagtccaggtggaccgcgcatagctcgcaggggcaaagggaacagcgctggctttcaggggtcttttattatttttaaaagcatattgcagctgcagcttttaagtttgccgcctcctccctaccctgatcccgggttctggggcggggcggcactttcccacgctgcctaccctctgggtggaggggtctgcaggggctgcagcgcctggtgttgggtttcctgcagggggaatgaggattcgacggctctgtgagtggaagggcgccctgaggtttggccttttgagggcttctaagggctggggagaagtcgaggatcccgcttggtgccctctcctgttttcctgccctgccacttggtgttggatgacattttgcctgtgcaggggtttcactgtcaaggagctgtgatgctgtaaggcaaatggactgttaggatgagctggaagagaggggagtgagctggagcttttccttttgtggcagtgttaaccccatcgcccccacctctctggcgcacctgtcccctggggtcaccatctgtgcgcatgagtggggcagcctgacccactggccattccagggacagtgagccaaagctggacttgctcagggcatgctaggccaggaatgtgtgggcagtgaaagagcaacacccttcctcacccccctgcggggaagactcagcaggccccgccatgatggtgcacagtgttttgccatactgtggtatgctctggagttttggagctcttgttttatgaggcttttattttacagtttcttgcctcttggtgaccagtttgtttttcacagctgcttgtgagcaaggcaaagataacgagcatctaaaaatagccctgcagttggaggtacagcttggcttgaccccgctattagaggggtggggtctccgttaccagctccctgagggtgggccaaacttgggcccccagacagcctcagaccaggtccacacatccttcagagcaattcaccttcaggtctcaaggcaaggcagggatgctgagtgctggtccatgtgagaagggcagcag

SEQ ID NO: 9246 - DNA, 3912 bp, artificial
  synthetic oligonucleotide
tacaaaaacctatttttaaatgtctcccatctacaattggctatcttcataccaccatctgctttctcaaatttcccaaggccatttgctgtggataaccacaaagctgcccggggccaaaaatgccacctgttgactggaacagagaactcttggattcaatatctttttcccctccacctcctttcttgcaccttggaatgataatgcatgtgtctctgaagttccccacactagccagatgttccagtcatacaaaaaaattgcttgcaatttctcatcacatcatgctctctcacacacctacaggtctgtgtacactaaaacctctgaatgcttttatgacctattttacctggctatttcttcagtttagaagccttaagcatcacttttttgggggaagccttccctgaaattgcccagggtgatttagatatctccctttccatagcctatatgtaaaggaaagatagttgtgcctgtctatcttttagtggatggtagtgcttccaagggaagagggtgaaccagtacccctataaggacctgagccagtggtggagatagggagggataaagtcaggcatggctccaaacagtcttttatatcatcatttgaatttttttttcatagttgcatgcctcatcctaaacattcttataaaattagcactattatctatgttatgtaatataaaataatctctcctcaatcattgagtaaagctagtggtccaggaagatccttctatatttatcctgtggcttcctgaactgccaggcacgctacagtgtatctcgggagtatgcataagtccctctgaaaaccaggtataaaatagcgtctctcaaggcagccattcaatggtctccttcagagtaggccctaggtctttcatctctgctatagtattgtctagtggattttagatactcaagaaatattattttttggaatgagttaatctttcaagtgatatcagacataataaagaatcagtgtcattaatcttcaaaaagacagataattcatttgtagaccccaaagtctccatcaatctactactctttctctaattattcttgcattttatgaggtactggcatttaaaattaatttttaaaactatcttcttgagttatgttaacattggttactcactaccatgataccagtattattttccactcttcattgcaaatacatgttttccagcaatattatgggggaaataagccttgatggaaaaacctggaactctaaacaccatctgtagtttcttttccatgggaaaatatgtcctgaattaaaagggaaaactgacttagaaatgagcttcggaacacttcaaggctgaagaagactgcattcaagcatcagacccctgcatcctacagctccaatttatacagcttactgcccgaagcctgggggcctaagggagggagcctaaatccagagacacaaaatgacatcctagaactgctgaagtgggcagggaggacctcagtgtggtcccccgctgggctatttcagagttctatcagcatcatcactaggccatcttggatacatattgaccatcccagaaagccagaaaacttctttcttacaaatcctactgagatttacatctctgtgatcccaaaactgttccctcttgagacaagaaatatccgaatcatctgttttctctgttttaaaaagtcaatttttaaaaatattgtttgttaagaaatatttatgagagaaggagctcctgtgtgcaaagcaactttctaacacatggtccatttattatgaaattattctgcagaaacttcctgttgctttgtctttctccttttatgtatatatgtatgtatatatgtatgtatgtatctctttagagataggttcttgctcttctgacatccaggctggagtgcagtaccgtgatcacggctcactgcagcctcgaactcctgggcggaagcaatcctcccaccccagcctcccaagtagctgggattagccaccatgcccagctaattttttattttctgtaggaacagagtctcactattttgcccaggctggtctcaaacttctggcctcaaataattctcctgcctcagcctcccaaagcgctgggattacaggcatgagccaccatgcccagttccctttctccttttagaagtgaattactctgaaccaaaaccttacaagagcaagccaaactgtgccttgattctctttcatgtcaaagtctaggtggtaaaacatggataaggggcttttgacaagaacaggagacttctttacctggcttctctagtaaagcttctagtatctcagaggggccattgattctccatacctggtcatttctccatacctggtcatttctctttcctgctattccactcaaccctatcctcaaacaaggaaaccttccctcccaattgagtacatgatacttttatgtctcctctgctctggaaatgtcatttctgattctgctgggaaggcaaccaatggaggtctcagcctagagccttaatccactgtcctaggcatgttctcagactggaaaaaactgttgggaaacaagttcagaacctgaactaggtgagactgcaaatactggtatagacaggtttgttttaatttataaggttgctcagcaaaacatccccttttctggaacataattagtatgtttttaactgcagatgtagaaaaaattgtttagggtacagaccaatatattttcttatgtttataaggaaggtttccttctctctgtttctcctttatctactctttacgaaaccttgcaagagtagactaaaagggacctcctttcattacacatcttttttcctaagaagcaaaatgaactaaattagttcattcactcagtactgtaaataccaaataaaaaagtcatagacgtatagatataaatactgcttctgtaatgatttttttgtgtgtgtttgtataactagagggcactgggagaaagagaaaagaaattattcaaagttcaaaggctccaagatttactaagaaaataagaaaagggaaaaaaaagcccaagcattcacatgctaagatagctgaaggatcaagtaatatgttaccccagcattttcttcaaaagaaacggcttttgtagaaactggtggaaagtccaaatctgaacattttttctgattataataaataaagctagtaatccctgtagagattaagaatgcaggctttggagttgctttcactgtgctgaaattccaacatacagtcaaggttgagaacactgctttaagtacttagttgtaacttcctttctcagatagttcaatttggccctaatttggtttataattacagcattctttccttccttttgagagtctccatctgtacatttcccaagtgtgtggaaagggagggtggacatctctttccctctctcccacctgtgtctttgcataccttatcttcttaggaagacagcatgactattgttgttaaatacaaaactgaccccatattctaacaaatcatagttcttcttggcccacagcattactttttaatttcagtgatggatttctaggggtcatgcattggcattagcagtctttaaacacatcatctctttttctcttccttccatccactgattgtttcttgagggaggctctgagccattcaccttggtgattctttcccccaaaccatatcacccaaaatcaagctgccaagcccaggattggaggaggaaaggtggtcttctggaactgtatccataggaatcctttccgaactggcactttcatggggcatattgaagtattgtgaagaccttgagcagcgacagtatttggagccatcagaaaggatttacctttttt

SEQ ID NO: 9247 - DNA, 1270 bp, artificial
  synthetic oligonucleotide
cagccctaaactgagagtccccagacccaaatcccccaacctctcgtttctgttacatcttcaatggccttacacaaatctgttaaaccactgtggggcctgtcttgatttctttagccctctaagccctccttcactatacttctttatcacataagtttggccatgcaattgaaccctatttgaaaagcattgaactttttacagtattcttccaacactggggttattagtccttcagttgtaactcaggctccttaatgtcaaggacagtgccttactttcatttcttgctatgcgctattaggttgttctgcaggaggtggccagtgtgacagttgacgctggccactctccttgcctcagctaaaccccttcactgcacatttgcctccactgcctctgcggaggctgacacagggccaagtttcaagggtctcctattagcccaacagctaccaacaccgtgtatgcagcctttcttaatgaagggtttgtcctacctgctgtctgagaacactctctctgagctgcctttccaggccatgatgatggggaagcactgttgtgtgcagctttgttacttaagatcgctcaggagaagaaggaagcattcctgtgaaccaggcagcttccaatgggtgtcatggagcctctatcagtttgttcaggacattgtggtttctgaattttatggcagagaagttgttcaaatgcaagtccctaatatcatatatatttatgataaataaccattatttgatgggcaggccaattataacaattaaacacctcagaccaatcaaatcagaatctctgggagtgggtcccgataacagtgcatgtttttaaaactccccaggtggattccaatgtgcagccgtaagaagtaagaactgcacttccacccaaacccccaattcccctcagggaaccaaggaagacaactaagggcctacattcatacattttcatacagatcagtggattcaggagagagcgtccaacagccagatagtctttatttattaggcctgaagaactaagtaatgggagagtaccaaagaaataaggccctgccagaagtttcagtttaggctcaataagaaagatgagaaagcctttagaatagctcgacccagttttccctcaagacttgaagatccaaggcctatacgtggctgacagaccaggaagggactgggcgggggtggtggtggtgacagggctacttgacagagggctcaacttttttgaagctgctggcgtg

SEQ ID NO: 9248 - DNA, 4232 bp, artificial
  synthetic oligonucleotide
ggcaaggcagctccaggccacagccaggcctttaattttccacacatgttcacacatgtacaggaattcagcagatgggctgcaagcaagcttgggcagcaatccactgacaagtagcagtagctctgaataaatcacattggcctgggctgcaaatttagctccagggagtggggactcaggcaaacaaggagaaaaggcattcacccaactttttcctgaaatgccagaggaacaaaacaggtcagtggtgaatacaaaattagcttctggccaccctccaaagtgatctgacctatttgggactcatcaagaataaggcaaaggaagttcagttgcctgcatcttgatctgtcaagggagaagagagagggcacaaatcgccaggtggccagattccctgagttactggttatggagcatatgaatggatatggctggaactcatgagaagggctctgggacaatgactttgggccaacccctagcacaacttagcatgcgaatgataaccccggtggatgcattggtaatctagtgtgccagcttggtggccctggccactgaaaggattgtatcgcattctgaaactcttcctgcagtctaaggccataccaccctgaatgcacccaatctcatccgaaacccttcctgcaagttaaactcatatccaagacccttatgtaaaaggggaccttgggccaagccagcaaagggacattagagccctagcagagtgcaaagctgaccacaactcctagcaggttggagctggtagtggatgctgttagtgccctgcctacatctcctttacaagctagtgcatgggtcctccagctgctgtgagtgttggctgctaaatgctatagctgccctcttccccagagacttgctgttggccaaatgcaagccccatcaaccatctcacctccaggtgacaccagctctgtggtgcattttgtgccccagagatctccgtgggatcaggctggagcaaatatccagctgagactatactcctgctcagtcccttcccctaccatatccagcttccttcatgccccttctactaagagcactccctccatacattacttgaacaatagtgtcaatcttaacttagactttgcttctggataacccaatcttaggcagagttgggaggaggggcatttatgaatagtctcaaacctgactgcacctcagaatcacctgggcagctttaaaaatacagattcccaggccccacctccagtgattctgattcagtgggtctggagtgaggcctgagattctatagttttcctgagttcagtgtttggtaattttaatgcagctagtcctttgaccaatgagaaccactcattctagcccattgtctttatttcttttcttagatcttctaagaaacattcattgatcaagttcaggaacaaatcacacaatctgtcaaagacactaagaagcagagatttaagtcaaaagatccacagtctttggcaaatctcttggagtccagcatacgatgctgactctcagaactttctcagcaaattgcatctttaaatttttttcatgtgtcctgaaatgtaaaggtctatttggttgggaaaagggagagacttttgagacatcaagttaccatggagttttccaaaaagggatatttgaccaagtttagaatataattcatgctttccatcctccatgctcagaagtattaacctattaaccctcctttcactaacagacctaaatcttcattattgttggttgtgtggatgatttagtgatgaaattcaaagagaaacattttgttttgttatcagagactctatattaggaagatttatgaataggttctcatgaaagacacaattctagggatttttaagcaaatggacaattaaataactgaatgaaggtggctcagactaatgcagaataggggagtattctagattttgtaatgatattgatgataatagtgataagaacagcaacaaaacatgattgctaagatttgtttcagtgcttagtatgtataagaccaagcactaattatttgatctgtattatcttatttaatccccccagcaactgtttgaggtaaatgtatcagctggggatcaacaaaggctttaaaaagatgaaactttatttttcgcttgtgtaaaagaagttaaaggtttgtatgcagactcagcaataatgaggtaccgaggcttcttccggctcctagttccactatccctagactgtggccctcatcttcacagtctaagatagctgctggagtgccagtcatcacattattggcctaagcatcaggatgaaagaaggaacatgccccttgttttctggggagtctttctagaaatcctgtaccacagttgctttgaccacattgaccaggtagcaatccctagctaaaagggagacctggatatgtagaattttggttgtatggcatgggtacagttttttaaatgagattttataaatttgaaagagaaggagaatgtggaaggttcactaagaaattgacaacttatgccacagtaggtaatattcttatccccatgttgcagataaggaaaataaggcactaagagactgaatgagttggtgaagttcacacactttataggtggcagtcacagtaggacgcaattctctatgatcatccctctcctgactgctatttcatcctgtccatttttttttccgattttgtaaaacagttttttttttttagaaaaacatttgttcatttcctgctttcttcttggtgtgccttttaccacctttgcatagatcctagccattcttcaaagttcagctccaatgccccagaaagccctcccttgcacccacaactgctttctagtaaatatttattgagcacctattatgtgccaggcaccgttctaggcacttgggcttcatcagtgattaaaaaaaacaaaaacaaaaaaaaacgaagaccccggctagcttaatagttctgtgaccttggtcaagttctctgagcctcagttctacatgtgtaaaatggaaataataaaaattactgtgcagagttattgtaaagattaaagatgttactgtatataaagtgcaattactggcatatcattagattttgaaaaatgatgccttttagtattattattgttgttgctattattgttatactattgtactgtattattatattcccctaatgagaaatgctattccttattaggctgtaaacttctgggcaggaatagtatccaaagccttctggtatcactcaaatacttgatcaaagtcagggcttattaaatgtttgttgagtggataaaaagtgttttgatgtagagagaacttcctgcttacttatgctgtagatttaggaaacagtaataaacagcctgagacccataggaagggtttttgtttttttttttagcgggggcgttgcccaatttaaactgtgagtgttggtgagtggtgtcctaaagcaaaacaagaatgagtaataatctactcctcatactcttccggaaggcctcagaaagaaaatatatcctcttcctttcagtttctttttttcaccttcactgatagatttcatgttccaacaagtcctgctgatctctttttgtgttttatttctgtcttctaattctcttctccatctctgatctttgctacctatgggaatagggctgctggcctagtgtccacagaagaaaacttctggaaatcaggaggcattgtgcatccagggtcctagagctgttacattctagacctacggacagcaccccagcaagagctaaccagtgcttgcatcaaaagtgcacatcaggtttgttgagcaccaaactccttttattttgccatctcagcccagctttcccctcagcccttctgcaaaggtgaaaggcaagttcacaggatgcagggccttctttcttccctcacatctggtttgattctgggcagctaaatagtggctttgccatgaacaacaaaagctaattcactgtggtggtttttaaacaccaagtgcaaatatttttccttttcagcttggggtcactggaagggaaaaaacagggctgagagggagattaaccttttaaaacctattatgacttcccagaaaaaataaaacaatggcagcatttcctttcattcgcgacagtctttttatgagtgattgttgtttgaggcaagat

SEQ ID NO: 9249 - DNA, 797 bp, artificial
  synthetic oligonucleotide
cctaatgttggactcaacaagaattctgcatctgggtgcatgatgtcatttacaataaatctaaaaggaactggaaagcttctggaatttccttatctgaggtagccaagctaaatagacttgattggcatccatcaggagctcagtgagggctagcaccattctggttgaaatgatttcacgctaaatgacatgccaagactgaagttttcctgggctccttgttgaaccagatactctaacttttctgtttccaagcccacagtgcagagtgtcagaggaccaatgaccacacaatactactggctaggcacaaaatgcctttcaattaatacaatcaactcagaatcaggagttacataactaatacagcaactgtgcaccatcttgaatacatttggattggggaagccaagcctttctttagcattcacactaaaggcaccagagtcatcaagagatgaaccaaagttcaatctgagtgctagaactattagggacctcagtgatcatctaatgctgtctctcttttcctgaatggtcttgctcttaggaccattttaatgttctttctcttttctgggtaaaatacagttaatacagttttgtttttactaggatcctcatgcaatcttaggtgaagtgttagctagttctagaactgtagaaaaccccatggtttctcctcctctcccatgcccaaatcctcttctacctgctggctgatgcctctagttttaccattccaggttggtcctctcagcaataggcttgatttccattaaaatgcaaaaacc

SEQ ID NO: 9250 - DNA, 1226 bp, artificial
  synthetic oligonucleotide
gtagcttgttcctgatgaaggttggagtgaagtgctcggtcttccaagaggccttcacaatcttcccccagagacctggatgaaccacaggatataggtatgagtctcaactgacaggaacctagggtattggaagtgatagagatggcaaaaagtgatttcttgactggaaaaatatccccaggggcctgctggtgaggccacattcatgtcccttacatagtggtgccctctgtgaatcctgccctctcagtccctcctcactgtctccctcagtggaagaaaggaacacaacctgacacacccccatcctccatgctcttcttcctcatgccacacccttccttgccctctgtagccacaccctgggccttcactgtcagtgtagcctgcagggtctgcatagcacaatagcttgcgtcacatctggaattatcattggagttgtaggtctcaagctcaactgcctacgcagccaggcagccagcttcaacgtgtgacagagttggcatagcatactaaggagtagtggggactgagatgctgtgtgtgttgtaagcaaataaaggcattcaaagtcaatttaaatatacatcattgtactgtttaagcaggacagctccccgcaagctgcctacctccaaatgaaatctactattatttatttctcacaaggactaatgaaagggcaaaactacaagccatgtctaaaaattctggtttacccttttctgtgcctagcagagcatggtgtaaaaacaataattagtattcgatttctttttttaccctttgagtgatgtctaacatacatacagaaaagcatccaaatcatacaattcaaggaattattacaaagtgaacacactcctgtaccggctactaggtcaagacttaaaacattattagcttcccaggataccccatgagctgttcttcctccccaaaggaaatcactctcttgatttctaacaccatagattagatttacctgatttctaactttagaaaaatggaatcacacaacatgtactcttttgtgtctagcttttactcaacattatatctgagattcacccatactgcatgtgacagtggcttgttcattctcattgctgtatagtattccatggtgtgaaacaccagaatttctctatccattctactatcaattagcatttggttatttgtgggttttggactctcactaatagtactgcagcatg

SEQ ID NO: 9251 - DNA, 1117 bp, artificial
  synthetic oligonucleotide
ttaaatggttttatagaggcagaataattatttgttcatttggggtagattttggtgggaatctgatggatatttggaggggctaatagccctccaggtcatcctttagtgctgccattatgaagacttaattccaatacatcaagctgaaccttgtggccacattgcttcttgaagatcctgtttcaactacagagatttagctactggagttttgcttgttcctattggattgaattctacatctattgaactgtttctctcatgaatcattcacaggatatagccaaagtaatgtaactttgtccccgtttattaaggcttttattcccccttgtctgggcggtgataacacttgcctctccaaagactgtgagaagtcattgtatgcagtgaatttagataccttcctgggtctgtgatctgcaaacttcactccgtgtaatcacatagatctgtaaccactactcatgtatgatccttggtgaagtctgctaaagattacagcagatatgcccatttagaaacttttactggctactgttttgtttcaggatggctggcgggaccacaaattgcgcttaagatgaatcttgaaaccctttagccatgtcccacatttgattagaatcagtcaacccctttgaaagttatcatgaaacaaataggcagataaaagcaaaatgctgagtggccgaggtgaaacagaccccttgttttggttggttatttgatctcaacccatatcctgtcatttggcacattgtcagatttaagaactaattctagacttccatttatatgagggaagccagtgaacacaataagaggggaggggaaaacccacatggtttgttgcagccatgcctaccctccgctttccttttcctagttccagaggcacctttcctgcattcaggctcaaggctgtgcctgcacatatggacccaaatcagtggacaaaatgtgctcttagctagttgaaggcttttagccctccccctacggaaacataacatgtgattttctggtttaaaataaaaagttaaggggaagaactatcaaagggaaagaaacattttgaaaagtttttctttttttttttaatagaaacttg

SEQ ID NO: 9252 - DNA, 2006 bp, artificial
  synthetic oligonucleotide
tcagaaggggcataagggaagcaggctgtgactggggaaaagttctaagcaagtttgtggccttagctaaagactagctacagtgcaatctcactgcagcaggaattgcaccacagagttgatcccaccttgaagtagggcactggccttttgtaccatgctatcagccagtcattagctatgggctgcctctgggagaggaggaatcaccttctgagctagatgattcccattggccaagggcaattctccagagaagtgagttgcttttagcagccaacactcatagctggtggggaggaggattccaccagagttaaggggatctgggtggatatcaacagcagccactacacccaccaagctgctatatatgttcctgctgacatggaatatatgtagaagttctgtagggattttggctcttctcattcagatgcaggctgccttgctgggtgcagatagctcacctgcaagctcattctttgatcctgaagagtgggtaccaagcaaggatcctttccatgagactgatggtatagacactttccctacccattctttgtgagccatctgctgctgaagtcctcctctgtctcagctgagatttaatgtggcaacatctgccctagggttttgactttaatggcatttatcatgcacacttccctttgatgtaggacagccaacctcatgacatcttctgtcttctatctccaggttttatttctcctcttagtttagatgtccctcatattctctctaaactcctgtccaacccttccctctcaaatcttgttaatacttaacctggggtcaaggtttctttgggcgcagaacaatgaaaaggcaattagctagctggctttgagtgctaagggagtgaaaactggttatgactctaacttgagacattcctaagagtaggcctttcctgtatggtcaagactgaaagaaataaacggatgtgggcttttttcttgcctttagactttatggattagtcataggatcttgttgaaattattcagtccagaaataagtgattaacatttaacttctttaatgggcaattactcaacagctatgccagtgggtaaatatttacttatcatctattccaaggagtgaatgttaacttgagtcaaacagttacttgtgttggttctttaatagcggaaaagtgaatttatatggctctaggagttccaatttcccaccaaataagaacttactgaaggatgttcagagccctgggctggagttaaattacagacaatttgcttacctactccctccctccaaaaaaaaaaagatgaagattttttgtactcaccactatttattgaaatctggtagcttcaaatctcacaaagccaaacaaattcactcagtttttcagtctgtaggtctgtgacagcctctgtttaccacaaaactgcctgtatcttgtcactatggatgcaagtcaagacagaggcaaagtctggatgatgaatggcttgttcttagtaatgtgcttgtaattgttcttccttagaatgggaaggatggcttgggaggacctgtctatcatagagggacttggcagcttccaatctctttgcttgcttgtctacaatgcagccaatgggactaattcaaatatcccagacatgcccagatggatacacagagcatatggcttgaagactcagttatggaaataacaggcaccatttctgagactttcaattcacttccaacaaatatattttaatcaacaggcaggaaaccaaattaaaagttgaagcatgaaccaaggtcaaaggttaagggttaggatgtgggattttggtgttcatgctccaggtttggcctaccatgcagagaggtcaaagatgactgcacagggaaccattgggagagaggaatgtggtattccagtttgtagaaagtttgagagtctggaatttggtatattagtcagtgccagccactccaagtctcaggggcttcacacaaag

SEQ ID NO: 9253 - DNA, 2469 bp, artificial
  synthetic oligonucleotide
aattaacaagcagtaaatgaatcctagcctaggaaattctgtacagggctgtgtgaacggcagagagcttcctggagccacagttggaagagtggttttaagcaaataggttcttagagaaattgaccagtgaaaatcaagaattatttggtcatagcataatcttttaccaaaattgaatatcattggtggatttgattcagcaaatgtttgttgaagccttgtaaggctctataatagacctagggaacaaggatacaaagatgaattagatatgaaggatgtcctgaaagctaatgatcttgtgaaagacagaggcgagtaatcagagactacagcgggatggcttttaacttcaaggacagaataccatagtaatggtggctccaatgataaagattgtcttacaaaatataatgcctgaatgtagatggttctagggttgtctcttcccattcttttgcttggtcattctcagcatgttggctttgtgttcttaggcttgtcttgtgattgcaacatggttgccttgttctaagcatcatattccaaaataacacggttcaaaagcagtaagcaagtcagggtctggggaggggtgcagtatggtaggagatctatgctcccacatagcattcacaaaaataagtcacatggccactcctagatgccagggttggggagagggtgcctggaaatccagtctggctctgcagctactttccatcagcagctcaagactatggaagggattaaaaaattttgttggccagttggacatctctgctacataatacagtaagcgctgtagtacagatgcatacagaagacagagacagtcaattctgccttaaaaataatgggaggttttgtagaggacctgacagcttagctgagtcatcaggtggatgacagagagaaatgtgcaaagcatagactcacgaaagagcttatcaagttattgtgctgtttgtgggggattttttttttttgccctttttccccattttttggtcaaacctcacgacctagcaagtcatttaactcatcagggtttcaggatcttcatctgtgaaagtgaggcagttggactctgtaaacataaaatgatctccattgttctttcatcccttttttgtttaaaccttcagagtagaagttacatagatattaacagtctcaacatttcttgtacagatatagcagggttctttaatcttatctcctctataaaaatacatttcaaaaatttctcagggaggcaatgtggtattgtaggcagagcatgagattgggaatcacggatctgcatttgaagccaaactttgtcattttcttgctgtgtgaccttgagaagacacaacatctttaagtctcagtttcctcacctgcaaaattgagattatagtacctgtcttccaggtttcttggaagatttagtgataattgtttttcaacacatagcacagtgttagatacttactaggttctcaataattcacaaaagaagaaatacaaatggccaatacatgaagttttatttttattttttaattttttatttccataggtttttggggaacaggtggcatttggttacacaagtaagttctttagtggtgatttgtgagattttggtacacccatcacctgagcagtatatactgaacccaatttgaagtcctttatccctccccaccttcccactctttttactcctgagtccccaaaatccattgtgtcattcttatgcctttgcatcctcatagcttagctcccacttataagtaagaacatacgatgtttggttttccattcctgagttacatcacttagaataatagtctccaatctcatccaggtagctgcgaatgccatcattttgttcctttttatggctgagtagcattccatggtattccatggtatgtatgtgtgtatgtgggtaacattttctttctccactcgttgactgatggacatttgggttggttccctatttttgcaattgcgaattgtgctgctataaacatgcgtgagtgagtatctttttcatatgacttattttcttctgggtacatacccagtagtgggattgctgtatcaaatggtagatctacttttagttctttaaggaatctccacactgttttccatagtggttatactagtttacattcccaccagcagtgtagaagtgttctgttttcactgcatccatgccaatgtctattattttttatatttttttgattatgcccattcttgcaggagtaagatggtattggattgtggttttgatttgcatttccctgatcatcagtgatgttgagcatttttttcatgtgtttgttggtcatttgtatatcttcttttgagaattgtctattcatgtccttgtttgagagcaatacatgaagttttaaatgttcaatgagaaataactctctgtgtgtgtgcaagtgtgta

SEQ ID NO: 9254 - DNA, 1417 bp, artificial
  synthetic oligonucleotide
cctaggtcaagtcacttggccttcgtgtgcctcagtttcctgttctttaaaataaagataataaaacccagattgtataagtgtgtgctcacaggcagacattcatacccatacacatatgcacacaggtatgtaaaatggatgccaagttaggaggggccatagccagctgtgagtctgagttaactgggtcaggatggtatgggcattgaagccctgccttggctcccactgggaccatatgccaacctactgattgagtcattggtttggtctttctatcatgagttggagtttaactgctctgggaagaatctggatgttttataacttttggggtagaacattccaccaggctgtttctacatgtcatttggagtgccactttccaatgatcttgcatagctaatcaacaaatatttcttggccactgtgtacataattctaggtgcaggagatacaggggtttgcaagtcagataaggtccttgagctcagagagcttatatcctagggaagagagggagataatgaactatgtcaggtggcggtaagtgctatgggaaggatactgcaaatccatcccataacaagtaatgcctccaactccattcattcatttggtattgatggatcctctgaggatgatgtaacgagcctcccaacttccaggtgtttacacaaatcaatcctctctccttcctccctaaacaaggtatcttgtgttcaagggaatgatctggagtagttaatcttaagcaaaactaattcagccttgaaatgcccaccagacgtggccacccaaacaaattatttccgccaaaggaatgacacaggtgaattcggaagacctagatttggactggctgttgcgaggaggaattccctcagcagataagcaactcccgaaggaaacgaaggaaagtcagtcttcatgccatcccaccttgcctcaccctgccccacttcacgtttaagccagagatgtccacaaattattgtaggatttccctgtatactttcctttgttaggtttgactggggataatatcatagctctagtgaaagttttctgctatttggtgggttgtaaattgaatcttaatgaggttttagaacaatgttcatgtaaaaatatatttaggccatttccaaaatggagcttattaatccaattatgcaaatggatgtggcaaccagcagatgtccctgattcttcttcctctctctctgtctctttttcctgctctgttttctgagagggttgggagttggcatagaggaagccctgatcgaagtggataatttgtttgctgagacaggcagtcctgtgtctctgtaagaagaccagaagctttccttatgggggtatgatgggcagtgaggagagtttgagctgccgagttttctagattctc

SEQ ID NO: 9255 - DNA, 716 bp, artificial
  synthetic oligonucleotide
ttgctattttctcatggaccaaagcaagttgcaagaccaagccagaatcagcataggtggggaggacccaagggccattctgcacacagtttttgcttgatgtaatagataccagatacattctggaggcttgtttccacaagggggctggctggctagagggaggccaactgtgaaggtgtcaaggacatggagcttgataagaaaaatggtgaggccattaagagccaggaaaccagaaggaagaatagatttgacgaatgagtttttttttttcccatgcagattggggtgcagatgggtctcacaccagtgctatctaacagactgcttgaagtcattcagcacatttttcctgggctccatctatgtgccagttttgtggatccccagggaacagaggctggggtgggggtagtaacatagtagaatcatatgagttcttgacatggacatgatgggagaaaagatgaatttactacaggagagattcaagactgctagaaactagggccatgcatgtatgcacatgcaccacacacacacacgcacacattcctgcatgcacatacacatatagacatgcatgtgcccatacacatgtatgctctctcacacacttgtacacacatcttcatgtgtacatgcttgtacatgccacatgtgtatatgcaccacatacatgcatgatcttccagacagcctcagaggactca

SEQ ID NO: 9256 - DNA, 791 bp, artificial
  synthetic oligonucleotide
acaaggtgctgttacccctacaaacaccatagttcccatatcagttgggattcagcccagagaagagcaacatgccaattattttaacagagaatttagcagaaggcattggttaaacagatcttagaggatggaagaggcagaaagtgtagcagagatgggaactgcagaaagcagagaacacccttaagactgggctgacaaagggaagggattaaggttatgagaactttggagttaataccctgcagagctgagacccagacacctgaggaggaagtgctgcctggctagtgctggtgtctcagagggggtacagtgagactggctcagggactgccaaaaaaagggactagattctggggccaattgccactgcctgaatgtagggctattattagggaatgctcatggaaacaggaggaaagggaggcacaagccccttcttcttcctccatcctgccattctctgtctcattcccctcctggcagggccaaacagggtgcagctggcaaaacagaaatgaggtgtgcagagtcccagccctagtatcacagggcagagtatagaaaaagtgggtttgaaactgagagacaataacttaaaaaatggtgcgggggctttgtttcaagctcacacaatttatgttttggctacatggtgcaaccacagtggagcttcaaggggtcactcacccagagaaacctctgagtatgatctattcattcattcattggttcactgagcacataactgaatgccaggcatgtgcttggtactggagatagag

SEQ ID NO: 9257 - DNA, 1565 bp, artificial
  synthetic oligonucleotide
aacttctcaaaaatcagacactttggaggtgaatttctgtaaaaggacaaagttgaacttcaaaaaagaaaagtatcaggtccccccaaaatggaggtggcctgttggctcagcagagtggctaagtcaagtaggaaatgtggtgtctggcctagcagtgacaggagactatgttgcattaggggttagacaaaggtcagcaaagccaaagggtttaaaagaggcgggagtggggactgtcctgctcagcttcctgacccgccaggctgatgtcagagggtttattcagatttgagggcttttgtttggggggattggagtgattcctaagagacaatgcccgactggaggctgggggcacgcgacgcctgaattgaatttgggcagttgctgagcagatggggatcagaggggaaaacaaaagggaagctgttcccagcacatccacaggaagggagaattgcagagccagccacgggcaggagggcttcctgctcagcctggctgtggaggcctccagtgcccccatcttgcggaaggccaagcattcccagggctagtgggactttggctctttcgcagagaggagagagggtggaattggaggcaggtcaggagcatgaacttcttgagttcagatttcaggtttgtgcatttcctcatctgcaggctggcaaggttcctggactcatatagtctcacaccctcattttcaggtgcgggagctgagacctgtaaaagtgcactgcctttcctggactctgtcagtgtcttaggttggcttcctctaaaagcagacatgacatgaggaatggagcaaatgctctttgctcaggggggtcctggaagcagtggttagggcctggagaggtaacacagggacgagaaggaagctgacataggtgcactaaagagtaggctcccagcgtgggcaattggggcttcgtcctgttggggacctctgggaaactaagcagaacacacgtcagagtttcctgcctaggaggtgaggaagctggggtgttcttcataattcctgccctttgctgattgctcccagagatgttgagtcctggcacttctgtgctccagtgaccagagaaagccctcagggagagggtcataggtgtacggagcaagaagccatgaacacgtgcaaagtgggaaggggcttcaccggatagatttctggtcatgctctcatcaatttccttagcttgtggggaagccaacctttctgaggccaggaaagcatttctctgggtgcccaatgttgcacagacagatcaaaaccgcttttctttgctcttaagtggggcgtacacttctcttcttcctgggagcgcattagatgtccaggttggatgtacagtgactctccctctctcctgcttccctgtctagccactgcccttgtctttctgcctccctttcagccaggctttttggctttccattttatttccagtaaaagccagagtcccaagcacctacaggagtctacatgatgggcacatgccctctacccacatgcgtctctcatgacacctctaccatttttcctc

SEQ ID NO: 9258 - DNA, 1286 bp, artificial
  synthetic oligonucleotide
ccacctcacctgcttagtgcctcagcatcctgccaatggcccctcaagcttccccagggaggctttctctgaccttctccagccagtgagattcctttgttgttgaccctccttcttatcctcatagtgctttttgccctatgcagttatatatccaaagtgtgacaattggattaatgcgtgtctctcctgctagactgtaagtttcatggagtgaggacccattcatttgtgttgattcttgtctccccaggagctggtatctagaatgcacccaacaaatatttgttggtgaagccagtgggatcctttgcagctccatgcagtggttcacaccccacatagactcctaaaatatgacactggaaaatgaaaactttttaaaattgttttaaatatataagaattcagctctgaatgtctagataattggtagcatgaattggccctcgaggtcaggaagacttctttgctctggttttaattagtgcaaagcggaagccatttctatgtaaatgaatcaatccatcgaggcacacttctttagccctgattatatgccaggcactggaccggagccccaggaaacaaagatgaatgatatagtccctgcccttgaagggaggaaaagcagatggctggtccctggagaccttcctagcagtaaagaattcagtaacagtatggacgatggcaccagaagtgtgccttgagtttcgtatcaacctcagtgctcccctcactgtgcatttgaaggcttcctcctttacaaagacaagagcaaattcagagagcctgagacgtcaccatgagatatggtctatagaatgtctcccaggaagggatgagatcttggcccttcagtgaaaatgccaacattattggaagaaagcccagaccaaggcaggggctagggctggggttctggagtaaactaactggcatataatcagggctaaagaagtgtgcctcgatggattgattcatttacatagaaatggcttccgctttgcactaacctgggttcaaaccctggcccggccacttactggtgggcaacttgggcccttttcttaacttatctgagccttagtttctcatctatgaaatgggtataatagcttctaccagtagagccatggggaggaataaataaaatcctgagtgtgaggcattcagcacaatgcctgtagtatagagatgctgaatctattgttatgatgagtattagctctgcagagcagggcctaccaaagacctacgtggatttttctataatgaacaac

SEQ ID NO: 9259 - DNA, 517 bp, artificial
  synthetic oligonucleotide
ctgactctggaatccttgagttacatgtgaataactgggtcgtgcatgtcagcattaagaaataatcacagaactcctgattctggtttgctctgggtggcagctgtgctgggtttaccaatggaggaacttcatggctgctcatctttgactctttttctgaggaaccaaatctctctgggagtgctggctaactcaccccttcttcaaacacgctgtgtggcttcaggatatggctgctggctttaaaaaagaaggaaaaataaattaagacacccacactgcaagacaacccctgtgagtatatgttatactgggaatgccccatttctcaaatatttataaatatatggtctcttggagtgttctaggtctgtcatttgggaaggttagacagccctgggccactatcctttttcgtaagcacagggcactttcacaaataccagattgacagctgggtgatgccaagggaatggtgatgtgttgccctgtgtatatctgggatgtgttagac

SEQ ID NO: 9260 - DNA, 886 bp, artificial
  synthetic oligonucleotide
ggtgaatcacacacttgatcttaatgtttatgctcagaagcgacacaacccttctgctcacacttaattggccaaagcaactcatgtggcccagccaactctgagttcaacagagcaaagatggggatgtgtcaaccttctgcaaggataaggatgaaaacagtaatacaatctactacggtagcaaaagatgctgtagtaaagagagtcacaaactcccatctacacaaggagtgaacgcatggccacaacccaagttagctcatagctgtcatggcctgcctctccccgcccctccagttgatctaccagagttcacttttgccctgaacacaccaagcaagagcccttgggacatactgtaacagcaattcctgtcatgctggcctctgctgatctttgacctttccaaaatccttccatctgctgaaagatgcttgtttgctctccatgcagatttactgatgacttgaacaaagatctaggatgggctcagcctttctacctggcggcaaggaagcatggtggctgggaacaatggttctcaaatttggctgcacaccagagtcacctggggagcttgagaaaatactgatgactgggtcctactctctgagattctgatatagttgatcttgagtgcagcttgggcttggatgattctaacgcaaactctgagaacctctggttaaaagcaccagcttcccagccagctgagacctgggttcataacttgactttcccatttctcagctgtgttgcttttgcccaagttactgtatttctctgttgcttggttttctcatctgtctctatgtcataggcttttgttgtgataattagaggagggtgaataaagcactaagtgttgtgcttaggttctagt

SEQ ID NO: 9261 - DNA, 2823 bp, artificial
  synthetic oligonucleotide
tgacaccgggatcagtgttttttttttttttccatatgaggaagcagaggctcaaagagggaaagtgacttgcccgagccaagcagtgagagaacagagaatcaaaatcaggtttcctgactcaagattgattgattgactgatttttctaaatcgcactgtctctccagcaggggtgagggtgaaaatattgtgtggatatgtgtgtgtatgagtgtgtgtgcatgtgcctgtatatgcatgtgtgtgcttctgtaatggggaactggggcctgaggagggaagatgactgaatgtaggatcttttcccttcttctctccactagtcccccttaataccctgaaaaagaatcacatttgagcatcaggtgctttcttcaacatgatcagatttaattctcacacccagcatcattcttcctcatctgactctcggccaaatcctcactttgtggatcccacagaaatagaactgaggaatatggaaataagaggccatgtgtgaaatttaagttagagccaagtcagaactttgtcacctcacatttctaaagcactcagtcctagaatcggcacccacaggctgcttttcttatctcttattcacacacaccccacttaaagtcaggtgcacttggctgggtgcggtggctcacgtctgtaatcccagcactttgggagaccaaggtgggcaaatcacctgaggtcagaagttccagaccagcctgaccaacatggcaaaatcccgtctctactaaaaaatacaaaaattagccaggtgtggtggtgggctcctgtaatcccagctactcaggaggctgaggcagggagaattgcttgaacctgggaggtggaggttgcagtgagccgagatcacaccactgcactccagcctgggcgatagagtgagactctgtaataaataaataaataaataaataaataaataaataaataagtaaataaattcaggtgcacttgtcctgatggtactgagagacttcagggacttagaatctttgcctctttctccttgtgactgttggtaattccttgagagagagggtaactacagaaatgtctgccttttaaattctcaacaagatagtggattggcctctagcatctattctcacatccttccagcatatcttcctataatatgctagagaggctggaaagctagaaatgatgtttttcagactcccttgcagctaggttccagttggaaagtagattttgttaagtagatgtagctacttaatccactggcagatttttcaggttcactggcttctagggcataaatctgtgacatatcttctccctggccacatttaaggctggggaaaaaaacaccagtcagattagatgactaatcttgctaaaatggagtatagtttgaaatgtctacttttcagattccttactaccttttgtagttgacagatttttttccagtctgtatctgggttgtattacaatcccattggccagtcttattaggcttcttgctaaagcaaacaatccctaagtagccaacaaacaaaaacaggacaaaagtttctactcttcctttgtaaaaggtgacatcttcagatgccatatattatgggcttcataaatgtatacttagttcatggatcattaacaatcatgaaatgagtggagagataatgttactgatgttttgacatctggggtatttctgtggtgagatattttctgttgtaacttgggtgctcctgtgaacttgtctgtcacacctttcccgcccttcacttgtgctggagttttgctttgagatggaaaaacacaaatacctaaaaaaacatacctcaccccactgtaatgaagatcaaagtgaaaaaatgaagaatggcaagacatcccaggtgtgtttttaaattcccagaaaattttgcctctggggattctccgtgcttcttgccagaaaaggttttcccttttagaacgtaaggcactgttgcttatttttcagttacagatggggatttttagtaaagacctggccccctctcaccattgtttacccgaggtgtctgatcactttctttattggcatattgcccaagacatagacaaaactgctaaagggttttggatgcattagctgagcaaaaggtgtgtgttcctctgtctctagagcacaaatttgattagccctttttattaggagtcaagaatgacattcagtcttaacctagctcatctctcacactgtggctttggtgtttcaccttctttctctgaaagatgggggcaagcatgataaaggacagcatttcttgggtgtttactctgccaggcatagtgctaaagtgttttgcatatactatctcatttaatcctcatagtaagcctgaggttgttattgttattattattattttggaattgtatattttttcattgaggcgaaatttgcataacaaaattaaccattctggaagtgaacaattcagtggcatctagtacattcacaatggtacaaccattgtgatgaactatggtacaaccatcacctctagttctaaaacattgtcatcaccccaaaaggaaatcccatatctggtaaacagccaccccaccattcccatttcccccagccccctcccaccaccaatctactttctgtctctatggatttgcctattctggacatttcatataactggaatcatacaatattcattcttttgtgaccagcttctttcagttagcataatgttttctaggttcattcacattacagcaggtattagtatttcattcctttttatggcagaataacgttccagt

SEQ ID NO: 9262 - DNA, 2199 bp, artificial
  synthetic oligonucleotide
aggtgtctcgcagtgtggaagttgctgtttccattcactctcagctcatcatttaaagatattgggagagagctttttttttttttcttactgagaacaccaaaaccgatgatcaccacaggaagacttagttactatcacagctcagcctcaccaaaaattctttttcatttttttaaatgtttatttatttacttacttacttactgagacagggtcttgctctgtcacccaggctggagtgcagtgacatgatcatggctcactgcagcctcgaccttctgggctcaaagtctcctcccacctcagcctcccaaatagctgggactacaggcacatgtcaccatgcccagctaatttaaaaaaattttttgtagagacagggtcccggtatgttgcccaagctggcctcaaacttctggactcaagcaatcctcttgctttggcctcccaaagtgctgggattacaggtgtgaaccacctcgcctggccttaatacattttttaaattgaagcataacatacacatagaaaactgtaccaaaattaacagtatagcttggtgagttttaccaacgaatattataagcaccccagaagcccttcctgtctctgtccacctgccctgcccccaggatagccactcttatgacttctaaccccatagattaattttcttgttttgaactttatataaatggaatcatacagtatgtgcccttttatacctggtctcttttgttccacattatgtttgtgagagtcaaccatgtcatggtgtatagtagtggttcattcatccatattccattccatggtgtgaatagaccacaatgtattgatccagtctgctctctatgggcatttggatattttccagtttggggctattactagcagtgcttctgtgaacattcttgggtgtgacttttggaaaacatgcgtttgtatttctgttgggtatatatccaagggaggaaattctggatcattcaagagggactattcataaatctcgttttgcttttttcctccatcttctctaagagagggtagttataggatttcaggactggaggaggccccacagaacatgtatctggctggtgtttttctgattctgcctcaatatcctctaaggagttcaggcatcttcagtgaggggagaggcgagcttgtgtggggctctggggctctgcttcaaccagagcaatgcccccttcatctgattcatagacagtggtgaaattacaaagaacatattgtttcaagaatgagttctataagtttgtttgagtctcactgtgtcacccaggctgcagtgcagtagtgccatggcgtgatctcgactctctgcagcctccgcctcttgggttcaagtgattctcgtgcctcagcctgccaagtagctgggattacaggcatgcaccaccacgcctggccaatttttgtatttttagtagagagacagggttttgccatgttggctaggctggtctcaaactccttacctcaggtgattggcccgccttggcttcccaaagtgctgggattataggccaccatgcccagccatttttgcttgtttgtttgttttttgttttttgtttttaagagtttgaaaagagatgatttgggtttattgttttcacttgagaaaggggcaagcaggcctacacagcagactggggtggattgatgtacgtggggggtgctggcattttatgggtgctcttttactcaaccctgcaaatcaactctatgagagaggcgtgttcttatccctatttacagctggggaaactgagggggtgaagcagctaagtgacattcctaaggccacccatctaaacgaggcagagctgaatccaggtggtatgactccagggcttccccctgctcccttaattatccaaaccagagtactctactcccacgcactgcccgtttcacaatctccctcacagactgtcaagggcctacatgagccattatggtgacagtggtttactctttgggtttttgtttctctggtatgtaaagctattgcccaagaagccaaggcataatatagagacaggcccacatgaaactgactcccccacttaagttcatttcaaagcagaatgtaatccttcgtgcttaccctttcacatgcccgatgttatacgattgttgctggaaccctgcgagataagc

SEQ ID NO: 9263 - DNA, 1339 bp, artificial
  synthetic oligonucleotide
atcggcaaagtgctttaaattcctgggaagaaagatgtagaacggaaggtgggaacttgcagccagcttatgagagccattaccatggccagcaagtcactgatgcacaaatgtatatttatgggggcagcaaggagatctatgtctccaggtaagtcccttagagtgactgcaattgtggattgtaggtgtctggggtgctgagtttgaccagagctcagaaacttttggatggttttgggaagagtgcaatgatactgtggggcaaataaatggatgcagttggctgcttgactcataaaagtcttggtaaatgccccaaagcaaaaatatggaaggaattaaagaagcactttggaggcctcgatttaaatttcttttctgtgtatcatatgtggtcaagacagccgcagagatattaaaggaaaggactctttatgcccttgttggtgcagggctcagataagggtgaggttgttctttgttaatatttataatggtatttgtggagatgaataaaaaatgaaattccctttggctaatttctcagattgctggaggagtagatgaagaggcaagaatagggttgcatgcatctcagaagaatctgctcttccaggacaaaaaaaaaaaaaaaaattactccttacataatggaagctagagtctaagagaatgttccctttctctgggaacacatcatttttgcttttcactgttttatacttttgtgtgtggcaatttctatttgccctgtctatgttaaagcatcatattcatcagtgtgtggttctactttatcatgtgtaatgtctaacatgccaaagctgttttacatccattgcctgaaagagcttaaatcttgctgtgtgctcacccagcgacaccctccttgcccctggggaagcagcattctgccagtctattctttcctctatggcctaccttcgttatataacggaatttgaatgtctagcatatggtgattagctgggacactgggtgtgtaagcatgccctgcaaaatgatgtgcatctgcatgcatgtgccttcctacaaatgcaaacagagcacagatcacagatgtggttattgtggaggtaattatacatttggtctgaaaccaaataaagttttgccctcctgccctgtcgggcatcatatttacctcattgaccaagagagagctgcagtggggcaggcaagagggtgaggctggagagaaggagatagagatgccatatggaagtggttggaaaacagatgggggaagtctggaaaaatccaatttgttgttctcaggtgtttaaaggaatgtctccatgttaggacattagaa

SEQ ID NO: 9264 - DNA, 1108 bp, artificial
  synthetic oligonucleotide
ttaaatacattccattctatggatatactacattttatttgtccatttattcattgatggacatttgagctgttcccacctttttgctattatgaatagtgatgctatgaatatttgtgtgcaagtctttgtgtggacatatgttctcatttcttctcttatatacctaaggagtggaatttctgggtcatatgataactccatgtttaacccttggaggaatagattatgcatttttgacttgttattgtcccatgaggtctgaagttaggaaaggtagggagaataacttcttatggggtagacatcaatggatctcagcagtgcccaggctggcagtgccatttttatgagtgtaacaagtttatcttcttcagccctttgaggcctcattttccagagactactggccctcctgggtctgtgaccctggccagaactaggattttttatttttaacctctcataagggattcctacgaaatatgacccactagagtgcttggtggactgtcaactctgtatctgtggggaacaaaatccagctgttcagcttggttagctgctgtctcatctggaactgcctttcctaggtttatttccccaaacaatggcccaagttgtaggcttgtggttgccagccccctttaatttggtccttagttgcatagtctgttatttgtgctgtgactggctgtgattgaaggggtatgctttttcctaaactcaacagtgtagtaagatgcttggtggactccaataattcatctatcccatggagaatgtgaggagtgtgtgtagtgatggtgaggggcatggcacactgaggggaaagtacctttaaaacagaatactgaatttaatatcagatcaggctgatgttaaacctctgctttccatatgagaacactttcccaggggatttaattgtaaaatgacaaaagggtcttagtgcaatttcactgacaaatggccttctggtgtggatttccatgacgcaagcagagccaactaagagcttcgtcacttatgttcctggagcacatagaacaattttctcccattttgttgaacttacttgaacttggggtagaatacctccctggac

SEQ ID NO: 9265 - DNA, 3946 bp, artificial
  synthetic oligonucleotide
ttctctgtggcccggccagcctggttggatcaagctttgcatttttaaatcttaggttcaaggtttgttctctgagggactggagttttgtcatgatcacatgcttgtgttcctaacctgaatgaactttctagttaagagtatatctcagtctttgattctctcagttccaccacttaccagctgtgtgaccttggacaaattcttacctcagtttgcatatctgtgaaatggagatactattggtactcattttatagagttgtgtagattaagtgattaatccatggacagtgccagcagtgtatggcatatacacagtatacatactatgggctaatacatgtaagccattgatagtactacttttgttgttgttttatcattattattatcaagaggcttgggtaaaggatgtaggtataaaaatggataaaacccagccctgtgacttctgaaccagtgtaaacgttttggtcagctggatccatggtgaaatgggaagagaagaatgctgcccattttctgacttggctcgtctaactcatgttgtgaagcactgcaagaacaatttagcatctggctgccatgacactctcattcttggggagtgtgtacttctgctgatgggtggaggaggtctggatgtgaatatttgccatcatggaagtggtggtgtagaaatgcaagcacccatgcgtttgctttgtgagactgtctgtatcttttcctataatgacgatatcctctcctataatgacatgtcttctctttgtagtcagatatcaggcatggaacagctagcagaggggagattatggatctggcatggcagagaatgcctaggtgttcaccaactccttcccttttgctcctgggtgcatggctagactacatttcccagcctcccttgcagttagttgcaactttgtgacagagttctgtccaatggaatgtggaagtaataattgctccaattgtaggaaggccatataaaagctcctaagcaaccctctgtagtttgtttctgtagtttgtttcttccccactctgctggctgcatgcagagggttcaacagatgattccgaggccctaagggatggtagggccaccgtatggaaagagcctgggttcctgaatcaccacatgaaaggctatctgccaacacttgatttgatttcatgtgaggaacaagtaaacttttattgtgagatttaggggatatttgttacagcagttagccaaccatgactaacacagaggtacagtgctgggagcaaaaaggaccagttttcctgaaaatgcgcagatgacaaagttactccaaagtatttgatgttccttctctgaataaaggatgtactaaactgcagagttttcttttttgagagatacagaattcctatgtgtgaccggaagccatgtaacagctttccttgagtaagcaaatggaaataaaaacttgttagcagagttccagtttctagagaaatgttgctaccaaaagaattcattctgcctctctccctttctctctctcttcatatataagtgatatagattgatttgtgacatgcttaaaacctaattataatgcaaataacgaatgtgcacaaatcatgtgtgtacagcctcaatgaatttttgcaaactgaacacagatttaaaactagtacctgggacaagatacagaacattttcagccctctagaaatcctgccaatgttctcttctgatcctgccttcccaagggtagccatcatcctgacctctgacagcatagattacattggcctgttttggaatcatatagtatgtgccttttctatatctagatttctatatgtaaattatatttcatgatccattcatgttgttgcatgtagttgtagttcatttattttcattgctgtatagtattcctttgtatgagtataccatggtatgggcatctggataatttccattgtgggctattttgaataatgctgctgtgaatattctagttcctgtcttttgctgaatatacctacacatttctgttgggttaaaaacttctttccttgaagttttacaaaactttgttcctcaataagacatttcaaggctgtgacaatgactgttcttattccttgctgtacctagactttctgatctacaccaagcaaaagctttgatctgtttttctgtaatgtaaaagattatcactgatgtttaataacaaagttctggtgcctaaaatagcgaaaacccgatctacttaaaaggaatccccccagctttaaaaaaacattggagcatagttgtggggccttttgattcacagacagtggctcctcacaaagccatgtttcaaatcacttgcaaactctgtgtaattggcgtttgacattggaatctttattggcactgcttcagctcttcctctgtgaggagaatcctcttggattttcaaattgcatcctttccttggggaaacagtggaggaggaagagtgatgagttctctaatcacttggttggattagccttagagttatcgggagttgccttctgtaagtgcccctactatcaaggtttcatggaaaatctaggcaaggcagaacttcctcagaaggacaagagacaaagaagtggggaggccctcctatccatagctgagagggtttattcttgtggttctgctgtcagagccttggatgtctgatctgagatggagcaaccccagctagacagaactttgtagatttgggggtttaaaaggcctcaagcaaattctaaaactttctttgaaccccctggcataggctcagtttccctgactccgttgctgagtttgaaatactggactcaatgaatagtacgacattccgcccccccaccgcaccctcagccccacagggtccctcactgtttggtttgaaatgaccatgattggagaattgaggggtgaatgttttagtctgagcctttcccttcaagcatatcaggaatatctgaaacatctttgaggccaaagcagaccgaaggctgccttgtgttttgattgaacgtttagttcactttgggcttgaggtgtgtgatgcctttacagttaagtctgaaaaaatggtcgtgaaaagcccctgggggacctggctgctgagtgacacacagctgggcctttgaaagtgggcttttatgataaatttgaacatggttttagaccttactataagtgcttcaatttttttcccctaactacagaataagtgagctgatttttccatgagggaattgctttggaacattaaccaagattttcttcaaatatagaggtgactatgtaatttgcttgtgccttttaaaaactgatggaggcctagtgaggcatctctgtgaagtcagaagttagacaagggatgcttttcttcacttgccaggtgtggaatgcaaatgagcttcatgcagaataagaggcctttaaaaatccaggttgcctttgaggacctggtaactcttgtttcgatccactgcttctcccaggttgcctatcttttctgtaggtgacagctaagaccatggcctacactttgttttccttcaaccccctaacttcttcctatggccaaccccacccccagtttttggaagatcgctgattttttgtcttagatgactgagtgttatcaacaggattctaaatgtgttgaggcagatacgaaacaaattcacacataccaccccgacatttcgtgtgtgactgccttctgctagtacaatgtcacgttatttcacaagcccctcaaaattctgtgatggaaatattataatattcttttgatagatgaggaaatgaaggctccactagtggctttaagaccacagtgttaaaaaattgtctggtcttggattcaaatgtggttcttgcatcttcagtttgggcacctcctctgctctaccctgc

SEQ ID NO: 9266 - DNA, 4013 bp, artificial
  synthetic oligonucleotide
ctcacccaacgtgcaatgagtttcgtaagcagttttctggggattttgctcattggtggtttgggtctcattcacgatattctatagagcccgtgcccaaaacagggggccacgtgatgcctgggaaggggtataaacagcactctggctgctctggccacatggagatgcgcctacgccctttgccctccccagttgtctccttgcgttcatagagcccggggatctccaaggagcagcccagttttccctgtaagaacccaaaggtcttgtacagagctggaattcggcgaaaaacttgctccaacacgccaaatctgccgcatcctcaataccccaccctcttccctctgcgcttactgcccacacccctactcccaacttgaggactccccgcccccaccacgctgacagtctcaattccaaccccttggatgtgaggaagtgtctttgcgcctgaacgcgcccagcacggcgaggccaccagtgactcccagcggccgcacagggcgctgcgcccccctcgccccggcctcccccgccctgcgtccgccccgtcacccccgcgcggcctcctgcgcccgggctggaggcagattcctctctccgggttttcagagcgcctttccgaaacctcctccccgcccagccagggagagagatcccgggcgcaatcgctccccggagcggccgaggggcgcgcggggagaggcctgcgccggggtactttcaaactgaggcgcgcgcacacactcacacccacccacccactcacccacacacacacagacacacgcacgcccatttatataggcggcggcgacggcagtggccggggtggcgacggcgagcacagaaacgatggagttgagccagtcgaccctggttggaagcaagtgagaagagaccaggcgcacccctaaatttctgtgcggagcgcttgtcatcctccccagggaacggtgcacccaaaggaggactggctggactgatttgctagggagagggcggggaagaggaggcaaggtgagcagagaagccccctgcgtatccggactgccagatcgcgcttttgccggactcctgccccctccctgctcaggtgggcgcgcccggtctccagctcacaggggcgcttggaggagaccagaaagtcgccgcctggctgcgcgggatgcctttcgccaagcggatcgtggagccgcaatggctgtgcaggcagcggcgccctgcgcccggcccagcagtggacgcgagcggaggcagcgctgagccgccgccgcccttgcagccgccgggccggagggacctggacgaggtcgaggcgccagggccagaggagccagcccgcgccgtccctgcaccttcagggctgccaccgccgccgccgccactgcccgcgccggccgaccagactcagccgccgcacggagaggcgtccgtggctggcgaggagagcacggcggggatcccggaggcggcgcccgcagccggcgaggcgtcctcggcggcggcggcggcggccgtgctgctcatgctggacctatgcgcggtcagcaacgccgctctggcccgtgtcctccggcagctctcggacgtggcccggcacgcttgcagcctcttccaggagctcgagagcgacatccagctcacccaccgccgcgtctgggcgctgcagggcaagctcggcggcgtgcagcgcgtcctcagcacgcttgaccctaagcaggaggcagtgcgtgagtacccgcgccgtccgcccgccaggctatgggtttctgcgccgcaccctcgcgccctccccagcagcggcaatcccagccccgcggcgccgctccggttgcagcttgcaccttactactctcgccttcccacccttcccatcccctgggacccaccccaatcctcctggggctgagtggctgggctggaccccgattcagtgatgcagacgtggacggtggaaagttaaaagggcgacctctgaagtcgcaggcagcgtgggctgagaaggagcagaaagggagcgtttatggggagcacaggaggcagagagggtctgtccttcaccaccggggctcgcctttcacgtccttcacggggcgtagggaggagggttgcaactcctgtggtttccagaagcccagccctgagccctgtagcccacaccatgcatgttcagggttgggggttccaggagtagtgagtgttcttttgagactgctgcagcaccgcggctgtttcgtcactcgctgtgacctcaggtgctgccccgagctccgaacttgtgccttgccctcgtgtgcgacgtagcgtggcgctgctcgcctcctagactgaacttcgtagtgcttctgccgaaaacccttgtggcccggaggggccgcggggagggtcagggagagatgagggtgggagtgtcaggggccccggggagatggaggagacccctgggcatcttttctgctctgaacagcccagggttcctactaaatggctctgtgccatctgcccgcagaggatcccacagactatcttcctcctccccggtgcactgtcgcccaaatttactggcacgtggacttaggtatgaactagtctgctaggcgggctgcagggaaacgacgaggaaggaagtctgggagacccctgggcgtctttgctgtccgttgacttcgcttttacgacacccaagggctcccaataaatagtcattctatgtcatctcccttccaagggcggtccccttggctccggatcgtccaaatctggcgacggcagaatcatttaggaacgacccaggaggtagacaggggcgctgggttggcgcgacggtcctttggcgcctagtcaggctgcgacgctcgcggcgaaggtgatgtcagcggctctgacttacgtaagaagcttcctaggttgctgccgcagctgcgccggtgcgcagtggcctaggagcgcgcggggcggaggcgctttggaggcatccttccctggggatttccgggcacctctgccccacagcccagctcagcctcccagcggtccctgcccgcccgcgtgttctctccctcttcccctcctcctccgaaaaaccctttgaaccccgtcccgggaattcactgcttttctgcaataacaatagtaataagcgtaatgaataaatgatgtgctcgatcggttttcgcagctataaaagacccggagttgggttaatgactggttgtttaaaagggcaattccggggatgagttctggaaagaattaggactgccgtaggccaagtcgtattttacttttgggacttgaaatgagcgctttaatcctgcctcctttttaccccaaaccacacagcagggacaggcccttcactttcaacagcgcaggtatctggggagtgcggttgtgggagtggtgatttcacttcaaaagaactggagggaagttttgcagactgttgagtggtgcatacatttcccgtgtgtgtgtgtgtgtgtgtgtgtgtgagacacacctctccttaagttagatttcacgcgaatgaaactcactgccagagcagaatgtgcccacttctttctctctttagatgcagcagtgggcagttatgtacctggaacgtgtcagagttctttcaagtccttttaactgtttggggtacaaactaatagttagtagagataagagaggatcttgagtgtgtgcatatagttggtgaatatatactctatacatatttgtacatgaataataaagatggggctgatttctacctgggatagatttaaaatctcatattattttaaattttattttctaaaatgctatctccacactttatgtccagatctctctcttctcttgttcatttaaatttgggatggcattgtttttgtttgatgtcataaaaggcattacctttgggagaaaaaacacactattatgtgtcttggtttaggtttcctagaatgcagagcctgagacaaggatttcgatgcaattaacttatttgggaa

SEQ ID NO: 9267 - DNA, 1557 bp, artificial
  synthetic oligonucleotide
tacagcttgtctaatgcaatatcatatattattatccaagtgagcatcttacggtgatgttaacttgttatacacccacataaaatatgttattctctggttttcttattagatttactaacatgtcattgttgtaccattaacatttaacagcctaggaagaggaaagaacatgctatattatacaactcttggcaaagccaacactgatatagagaagtcattaagcttcaggaagtttttactttcttgtatgcaatttcttatcattaatatacagtttgtattcctcccaggccccctgattttgtaaaggaaatagaaggagagaaaggcggaggggagccaggaagagacacaaatgagactgagccatttctagtgcctgcacttacatcagtgattaatcaaactaatggggagttctaattcggtgctttgctacccttaagccctgtaattgcggtgtctctgaacccaaaggaaacacgttgcgctctgcatgcccaggcgcatagcttttaaatcttcataactctgtaattactacagtgctttccttcaaatctggctcaatttcacttccttaatgagcaccacaatcttgataaagtttgaagtttgctgcctctgctgttcacaaggactcaaccccagactgataatgtgagttgtagattttactccctcaagtttctctccaaaagagctgatttattacaggaccaccacagtcaaaagcaattcctctgagtcaaggccagcactgggtgttttcatcacagaagggtgcttggggaggaaattctgaacagttaaaaagtggggggagcttatgaactcctggagaatggccgtttagctttattagcaccctatgccctagagactgtggttcatcctacctaattgaagacttttcttcataggaaatatattaaaaatcttccacttcctctttataaactgagccctgccaaagagtgaaaattataaatcagctattttttaagagaaaaaaaccaacataatttccacattatttctcctaccgcctggttttcagggtttttaaaagacttgttgggaatgccatttaatgattatagtcaaaagcacattttctcctgcagctggttggagggtgtcttaattttagccactgttttgtttttaaccatgtagcgctgcctcgtcttggctttggtctttccgtttctaacctgtgagaaccagcgccgaagcttgcgttgtctttagaatccctgctccagtctatgttcccccaagacagtgttaatcgctctgggattctgaatagcacttaattcttatctctattatagcttgcctggcgttgcactacaattatttgtttacgtgtctgtctaccccactagacaacaccctttgagagcaatgtttatgtcttctttccttttatatctctggcagctcacagaggcctaagcacccaataaatgtttgcactcagtaaatggaagcatccggtcaatgtttgttacatcaccaaaggaacgaataagtgaatgaaac

SEQ ID NO: 9268 - DNA, 1406 bp, artificial
  synthetic oligonucleotide
tgttctacaataattcacaatgctgcatgtttgtgtttcatatacttgtctatatgtgtgatctatttcattataagaaagtaaaaaaacttcctcaaagtctaccctgagaaacattggttatgagattttaatataccttacaaaaagagttccatgatcaaacacattttggaagcgctgaagtaaatgaagaccaacaagactttaatatgtcaaggtatactgtgaaattcccagaggagtaaagagtgtactgtgacttgtaagaccacagaacccattttctaagggacctcttacagagcacacacttaggaaaagtaggtggaaaacaacatcatagaacaagtccctgtttcatgagccatttgagcttgtccaaccaaaggcttcaagagccttatgcaaaacaaaatgccaagtagcaagtagcaaacaaatgaagttttaggtggtgctgaattggaggcccttactattcttaaaatccttatcatttcaagtgtctactcagttgattccaaacactgagtggtgagaggtcagtccatacccatacccctgcataataaatctggcccatagccttacttatctctctagctatatttgttctagttttcatagtgaccatgttgataactgtttttctgtgggtggatgggccattccatatttgctcacttcctgctattttatgtcgatttcaatcacagctgtttataagtaaaatcattctgacggaatccatcatctgctctgatgctgttgatacaattctgttctcactgggacatgatatcagttagctctcactgtgtaacaaaccaccccaaatctagtggcttaaaacaacaacaacaacaataatcctgtggtctgacaatttgggttgggctctgatggatgagtcttctgctggtctcagctgggtgatactcatgtgcctgcaggcagctgctgggtcagcaaggatattggctgggtgttagctgaggcagccatttgagttccagccatggatctctctcatcagccatcaggcagccctggatgggcttgtttacgtggcagctttcacaaaagtcccaagaataacaagagagggatggctttaatgtggcaagtgcttttcaaatctttgttttcatcacatttgttattgtcctattggccaaaaaaatcatatggccaaacagtatagagtcagtatagaaggagactacctaaggacaagggtacagaagacttgaacaaattgggggccattactgcaacaatctcccaaagggacttctggtaccataaccattaattgtcaaaagtatatctcaaaccgagctgacttatggtagcctctgatactagtcaagttcaccactcagttgtatttttaaaaacaa

SEQ ID NO: 9269 - DNA, 1119 bp, artificial
  synthetic oligonucleotide
attgtgtgccccctagagaagccatactaattgggtgattttagaacccccaaaatggagatggaggttgccaatcattcattaagtcagtcaaccaattaccagcttcggtggggttgagctctgtgtatgaagtggacaaggtgacaggaaagtaacattcttccataattgccactttcaaaagaaatggctgcctaatcgtggacagaagacataggccaggctcgacaatcagtgctgtaggagttctagggaaggggacttatggtggactgaagagactggggaatgcttcctagagcagtgatatttcaaacatctcttatcatggctggctagatagcaagcatgaagaggagaggagaggttaaagtctcacttccaaaaacccgggaggaccacctgtcgagtactatgttaactatttgggtgatgggttcactagaagcccaaacctcgccattatgcaatatacctgtataaaagccctgcacatgtactccctgaacctagaattaaaaataagataaaataaaaattaaaaacccaggagatgctttaacctccaaattccactgggaagggtgtgtgaaagttggagggtggggatgtgtctcactctccctttttctggaacacacacaaagccacccacagagttagtaagttgcaccataaaatatggcatggccataaatgaaattacaaaggaatcgcttccaaaggcttcaccttgaaaccttaacttctacattgagagcacaccatttattaccactgctgctgggaaaaggagctgttagtgtaatacagagaagagaagacaggcaggctaaggagcagaaaatggtaagatttattgtgggaataaaaccctgagcaaattgcctcttgttaaatgtgggtgttgggaccattgtcaaagcagctgactccaggcaaacacaatggtcttgctggaaaattctcttcactgctctgcacctctctttctctctttgtatgatgtcatggtaagtgatctgataagaaaggattagtgagcaggaagatactttttttccctttaggttccttggtccaactgtccctttaccactttatgcatgacttctt

SEQ ID NO: 9270 - DNA, 1062 bp, artificial
  synthetic oligonucleotide
cttaaataactaataatattcagataatattcatcagatattattcaaataaatattttgagcagtatcctctcccagccacacctatatacgcatacctacacccttttctaactatctcccatataaccagatgaaacttgaagaaaaaaaagtaatgactccacagagtttggaaaatgctgggctagctctgcctttctggttattccacataggtccaaggccaattatagaagcagttggttaaggaaaatatggtgccatggggagttggagggttatagaatgcctgagccaggcaaattcttttcaagtggagcttacaataattgaaaataaggaggcttagaatgtaggaattccagcattttaggtgccatcatgaaacattaggagcagccagggccccaagattcaggcgagctctccgtttgaggcttggaataaaaggcatgttgctaactgtgacgaagctgaaaggatccacgcacagcctaggagcagaaaggatctgcccctaggctgtcagactgtatttgtgtctgtctgaactgttctgaaaagatcctcctttcctgaatcactaagacccccagacaatagaggaacggagtggcagcgctccctgtgctaagcaacagattggagatgtgggagtgggagtgggagcttttatcttggctctgttacttacagccaccactgaacccaaggctaatggcctcagcttccttggctactcgggtggaggtagtccaagacagtaagtcacaatgcgatacgctgccccctccagtttaagctactatcatttcacactggggttttagcagcagcctttcacttggtctccttgcttccactcttacctccctatagcctactgtctacccacaccaaagccagagtgatcctcacaaaatacaagtcaaattatgtccctcctctgttcaaacccctccgatggcttcctagtattcttactataacttacaaggtcctacacaatctgccccacacccccattacttctctaacctcatgaacgattaccttctc

SEQ ID NO: 9271 - DNA, 1455 bp, artificial
  synthetic oligonucleotide
ccagaactaagatgagaactcagggtctgacagaccattgcctatagcttggactacatggaagagctttccaggcaagaatgtgaccagtgaaatatatcatacatggttgaccattgaggcagtttgatggatgggttagaagatggattttggagtcagacagatctagattagaatcttattccatcacttcctaaatttccgttgttctggcagctccccacctccagaacttaaatgtctctgtttctttcctaagggcattcactgacatcactggagactgctcagccacaagtaggtacaattcagaatcactgggtgggttaacacccctgggggaactctcaaccaatgaggaatgggagtcagtggatacatgctgcagcctctccatattccagtgagatgattctgaaggtttttttattccaaaaaattttgatttctcaaaggatccccagcagaattgagcctctgttgcccagagctctaacccactcattaacgcacttattcattggtttttgtcccatccctatgtcactattaccaagttgcttaattttcttaagcctatgaaattcaaatcacgccgtcatcacagagttgctgtgaggatggaaagagctcctatgtgtagagtggtctgtacataataagcattcaaataagaacatggttattattgattccttgttttcagcggttaagctccatctctgcagtcccagttcctccactaggtggcagaatatcaacattcattatccatggacggcatgtctcttagagtaagtaaaataattagagactctgagggaccatggccagtgtgacataagaagggcaagcctatgattaaaaacaacccaaataaagaaagtggtgccctgaaattccagcctcagtcagatcattgtctgatttacggctttgaaaggtagagactgttggatgaattcccaaagcaacatggggaacctgtatgagagaagcaggtggagtctgtttacaaaaaattactgggtgccattttcccatgcctggggtaatcccaagtcatgggagatggtgggggaatggcaaagagccaaggaaaacccaaacaatcacacaaacaaagtagaacttggaaagggtcagtgtgatcctgtggtcagttttggggcaaaaaccttacaggattatttgttattccttttggtaagatgtttgtatcactggacaaatcatactagctgaggattcatcaactctccggttaaagagtgggaaggacggacctttatccactggcttccatccctccttgggtgaaggtttaccctggggtattaacttcaccatacatgcaaggagttaagatgcaggcatttaaggcaggaagctattggcatgttagaaactgtctaccacacctgctgatgaattaggtgggaagatgagata

SEQ ID NO: 9272 - DNA, 284 bp, artificial
  synthetic oligonucleotide
tctgcaaaatgaggacaatgatgatggtggtgatagtggtaatatatgcccaatagggttgctgtggcatttgcacagtacttggccacatagtaagcacttccctagtgctacaattggatcagagcaccatcatgaaatgtaatttggtcattcatctcaacatatacgaagcacttattatatgccaggaactgtatactaggctctagggggcatgaaagtggagaagatggagaagagggcagaagggctattcttagtagagagaacagtaagagaaa

SEQ ID NO: 9273 - DNA, 778 bp, artificial
  synthetic oligonucleotide
gtatatatttgatgccttctgtcttttcatgataatgtgctaacaagttgtgttaatattttactcagccagagtctcattcatttgctaagcattgggaacattatgtatattgaccttaaacataggtgtcctatatttggattgtgacttgtagactcaagctaaccttactgcctctttttcacacttgttgaaaagtctgtgaagaacatagttaaagatctccaactttggaaaatatacatgatgtgaaactggggtgctatgttaaaaataaatgtatgataactaagtgtgggttttatggagtcttggtgtcgatatattgtggtttgcatttgttctcatgtatttaatgaaaatgatgggaaaaggagttgggagtctttccaattaagtcaaagtctgagatttggttgcttttacctcctggtgatctgagacaggttcttaaatacctgcacacagtaaacacttggcagtcatgggatatcatggctgactcacagtgcattttaaagatctgctaaattgaaaacttggctcaatgtggggccaggttatttgctttatcttgtcagtgttcttttgttcaaaaatattcccatcatgatgtccttagctggagttggggtgatggggaaggatcagaaagagttggcttgaaatctcgaccaagtaatctggcaccctagttatagtttcttacctttaaaatttgaataatttggggaggcacctctcctattgggtgaggggttttattccatattgt

SEQ ID NO: 9274 - DNA, 877 bp, artificial
  synthetic oligonucleotide
gctgaatgaaaaaattgtgattcatttgtatataaatgtaaaagctactctagctgagtaattaatggtttatttaaacaatggcacttgacaggttctgtggccaagaacttcttcaccaaatcaaagctttccattccagaactctcctatatatggtaagtacaattaatgccatatgacattcataccatcatccataactcatcctttagttcctacctttgcattttttaaaggcttatgttttgaatgatgtttttaacagactacaggagtgaatacaactcagatttttgttgctgtgaaaattaaatgttatatgaaaagtacaatgaacaatgtctggcacgtattaagcactatgagtgttaactattattttaaagtaatttcctaattattatccccatctcaatcccttttcagtctaggcagttgtgggcacatgagacttaccatcctgtagatttcattttcagacttttctgctaggtgtgatacaagtaaccagaggagcttgacaaactattttttatattttataaggctgagtgaacagaaggttgaggaatattttggagttaggttagatttgactattctagctgcctctgagctttgcaaatttggctggtgtttatcagttgggccctaattcagacttgcagctgtggtatccactgcacctttatgcactctggttccaaaagggctatgctgggatggtccagatggctctatttgcattcatgaaaatgcttggtgctgctgtaaactctcggctgtgtgtgggctagttcttccccaaaactgggcaggagatcgcactgctataaatatataattaaaaacattataatgtttatataaagct

SEQ ID NO: 9275 - DNA, 536 bp, artificial
  synthetic oligonucleotide
tgtcagagcatctcaaaggccagtatactgtgtgcccatgaacccttactcccactcaggtgacgccaggtgtgaggtgggtcatggtgcccacacaaggctgccaggcccacctttgcagcagagcatgggaacgagcagtgccgtctgtcatggccgtgggtacggcaggtacattggaggatttgagcaggggaagagtgttctgggaagaagacaaacatcttacccctgaggagtgagcatgtgcagtcggaaagcctgctgagaggaggctggggtgcgaggcttctgaaggccaggtggaggaggtggacttttctgttaggcagcaggtcatctctgcaggcttttaagcagaggagttaatcacccccttctgttcattcctgatttctgttgttagagtagacctgagacctgcctgctaagaggccactaatgccacgctggagtgaggtgatgtcaagaggagctagaaagcagatggttatggcattgaggaaagagcacacatgggctgacagggacagcta

SEQ ID NO: 9276 - DNA, 1554 bp, artificial
  synthetic oligonucleotide
tggtggatgcctttccttatgccttgatcctaaccggtaccctcttagctgagcaggaagggaacagagaaattaatattctcttatattcctgcaggaactcttatggctatatggtgtgagatgactaaagccaatttagcagctacttgtaaaagtaataaaaatggaggggaagaagaaagattctgatgcaacaggctgtgaagactaattcaacatttatttattgagctactgagcatatagcaggcatagtaaagtatgagtcctgggggatacaaataataagaatataccctcgctttctgctgggcacttagggcatagggaaaggagatgggctacagtggagataattatcaaaataccaattgtgctgtgttgcaaggctagggatgtgttagaaagctagtaaaaagtgttatgggaatgcagagaacatgccatgtggaattgactacagtttcaaagataaggttggtcttgaggtgacttgaagaatgagcctggcaggcaaagaaatgggcatctggtgtgactaaagtcttaattagctgtagggtggggaggagagagacatgacgatgttggaaaggtagtttgggccagacaggagggcctcagaagccatgcttggtttcacaggaagggcgtgaagagtcccagaagccctttgaagttggagggtgatgtggttttgataagaggtcacggagggaatgtagaagctggtgtgtgaaggtgtgtgagtctggagacaggacttgaaacagtcgaggcgagagcaaagaatctggattttgctagctgcagcagagggagagtagaaaatggggtgctcttggagaattcttccagcccctcctactaggagtttttacattttcaaatctttctaaggaaacctttaataatacttgagagaagcttatttaaacctttgaacagttctgaaaatgtattacatttcagccaggaaagaaagtattatttcaggcaaactggaacatggttactcagcacagtcgcctaatcttatagaattaggtaggagggaagctatgttagtggccttcaaccttcttccagaactttgttcagatttctcccaaatggtcggtgaatttttctgatttgtatccagcatcccagccatttagtgtacatccgtaagctgtaaggaagttgatttaatctatttctttttttcatctcttgccttccacctgagaaaacactactccataggttcttattctgtattaggaatttgcacaatgtgtaacctaagatggatccagctgggagttggatccagctgggagtgttacaggtttggagtttagactaaagaagaggagtggaatcttttcatttttttcccctttattttgaggaaagcccagtgatttggattgtttgaaggatcaattatatcaaatatctccactaattgagtatctgggataaactttttttttcaccttattttctttagataccattaagcatttcgacccacaacttacagcttttccatggagattttaa

SEQ ID NO: 9277 - DNA, 2535 bp, artificial
  synthetic oligonucleotide
atctacatttctatctttgttccctctcacctttgttatcctgaagcaagtcgcaaacatcatatggttcatagggcttatctttaaggaaggaaccagggtgggcagaaggaaatggaaacatgcaggggtttaggttggccagaaaaggtacctgtggcctatggtcaaatggcaagactgatgatggttcaatactgtcaagcctttggctgtcatggagatagacgtgcttgagaactgatttagaatagttgggaaacctgtagggagattgaaaaagtaaccaactgaagaccaggaatacaagatggatttgaatattgttctagcttcacactcctaagtaggggctgtcctattttaagggtgtagacaattggttttgaggaaatcttgggttgtttttgctaattatttataactttttttttttttttttttttttgagacagagtcttgctctgtcgcccgggctgaagtgcagtggcgcaaggtcggctcactgcaacctccgcctcccaggttcaagcagttctccctgcctcagccttctgagtagctgggactacaggcgcccaccaccatgcctggctaatttttatattttttagtagagatggggtttcgccatgttgactaggctggtcttgaactcctgacctcaggtgatctgcccaccctggcctcccaaagtgctgggattacaggtgtgagccaccgcgcctggcctatttataactttaaaaagagggtttggttcctttccagggtttttcaaactttctgtttgtttcgtataggcaagtttctcatgttttgtattgatggcattctattattcatacctatctgttggtgggcaactaatcaacctgggttgcgcaggactgaaggatttcctgggggcatggaacttcagtcttcagacagtcctaggcaaactgggatggtcaccccctctcttggttgctgcattagttatctattgctctataatgaattaccacaaacttagcagcttaaagcagcacacagttattatctcccagtttctgtgggttcgggagtctggacatggctcagttgggtcctcagctcagagtttcataaagccacaatcaaggtgtctggagcttggagtcctctgtggaggtccaacacttggttgcagaattcagttccttgtgattttagaactgaggctctcaacttcgaggcttcctgcagttccctccacatggccttctccataggcaattcacaacatggctcttggcttcttcaaggccagcaggagagtgtctctctccagttagctcagacacctttgccatagtccattagttagaagcaagtcacaggttttgtctgctctcaaggggaggggattatacaaaacaacagagaccaggaggtgagaattttgcgggggacaccttaggatctttccaccacacttgctttccaggatttgtctgaagtagaaaattattctgttgagcctttttgtggccagaatatacatatgttttgctcagccactaatttagaattcctttatctttttaagaaacattttcatgcgtaattcatcctaagtagaactggcaaatatgtaacttcttaggtattttcaattttagtctttaggcaattgtttttcctcttaactagtaggaggcaggaaaaaaaagtggaaaagcagatgcaaatgccctgcctggctactcctgcacgcagtgctctaaagcaggccttctcagcctgggttagttcaggggtctgtgaatttagatgtggaaaagaactacatctttttttttttttttactaactgcccttcccccaactgaaattgagcacttccttctattatgcatgtaagcaaaaaaccacagcagtttttttttttttttttttttttttttttttttttgagacagggtcttgctctgtcacccaggctggagtgcaatctcacaattttggttcactgcaacctgtgcctcctgggcccaaatgatccttccatctcagcctcccaagtagctgggactacacgtgcatgccaccacacccagctaatttttgtattttttgtagaaacgggattttgccatgttgcctaggcaacagggttcactgctttcggtcaaatgacagcaatgctgctggcaagtccatggtcaggagtgagattccctcaggctgctgtggtccctcctcctccagtctgtcctgcaggaagctcagagtgaatggatgctcagctgtttcctctgagacctcaccagggacagttcctgcagtcccggctctgagctctgctcctgaccgttttatctggccctctcagctgtgcttcactgcaaaggaggaaggacaaggccctctggagccagtgccagctgcttgtggggcctgttttatttactactgctatctctacttcagagacttgggctaggacatagacttgaagaaaaaagccattttaacagacttgagaaactcagccatcctcataatacc

SEQ ID NO: 9278 - DNA, 1358 bp, artificial
  synthetic oligonucleotide
tttttggtgtgagcttgaacaagttttgtactaaaaaaaatgcctgttttactactaaaataagtgcttcctttggagagtgaggatcctctgttactgaggtttgtattttcaggccctagcatataaatctgctacatacgagatattcaactggttttggaggaatgaaggtgaacatggcagtttcctcatctgtaaaagcagggtttggacgaaatgatctgcaaaatgggtctttttgtactcttactactctagtatttacgagtaaccgatgttattccttataaagtctcaactcctggtttgagccatgtctgacgagggggcctaactccaataccaccctgaacactctggggtcagtgggaccctgtttgtacagacgtctgcgtcttccggctctttaggacataagcagtactgctatggaagaaaggaaacctaatttcccatgccttgtccctttctggaaagggcatggcgtggtgtgggcaccacacctgccccagccttctagcaagaaaacaacacaaccttccccgctccccgaaaagagcttctctccagttgggtctagatgcccccttcccaaccagggcggatggccaaaggctccgctcccttgcagggtaggcttggaaaggcacggggcccgccttcctgggcaccggagcctgtgacgggcggagggcgtgcggcgcgctgggttagttacctggcgctgggcggggcaagcgggaggcgggggcggggccggggtgacatctcaggctgtgattgggccgcgccgcgcctgtctccatgtgccgcgcagctgaggcacaacattcaagcccgggggtggggccggcgcgcgccgggaggaagcggccgcgcggcagctgcggggcgtgggggtggtggtggcggcggcggtggtggcggcggcggcggcggcggcagctgaggccgaggaggcggtggctgtggcggacgcagcagcaccccagctagggacagggctccgccgcgcccccttgctggccccatggaggcggcagcggcggcggcggcggcggcagcggcagcggcagcggcgggcgggggctgtggctccgggccgccgccgctgctgctgagcgagggcgagcagcagtgctactccgagctcttcgcgcgctgtgccggcgccgcgggcgggggccccgggtctgggccccccgaggccgccagagtcgcccccggcacggccactgcggccgccggccccgtggctgacctgtttcgggcatcgcagctgcccgccgagacgctgcaccaggtgggtccctccgcctcctgtccctgcgggtctgtggggcagtgtgtgcggg

SEQ ID NO: 9279 - DNA, 1606 bp, artificial
  synthetic oligonucleotide
aaaaaatccagtttatttgcagtgctcctgttcttaactcccattttagttaaagggtggagtctcacaaagataatacatcacatgtgaaataaacattctcttcaaaatgaacatacacttctatttcttcctgtgtgaaaggaaagcagtcattgtcatccagatgtgctgaactttctcatgaagtctcattctaaaacagcaaaaaattggactagttgccaggtatttcactatttttaaagagaaaggcatgccttaatattgttattttgtttcaaatttctgtttaatgttaacattcaaaagcacttagataccagagttgcactgagggcttacacataggaatgaacaaatggggctgcaaatggatttaagttctgggatacatgtgcagaacgtgcaggtttgttacatagttatacatgtgccatggtggtttgctgcacccaacaacccatcatctacattaggtatttctgctaatgctatccctcccctagccccccaccccctgacaggccctggtgtgtgatattcccctccctgtgtccatgtgttctcattgttcaactcccacttatgagtgagaacatgcagtgtttggtcttctgtccttgtgttagtttgctgagaatgatggtttccagcgtcatccatgtccctgcaaaggacatgaactcatcctttttttatggctgcatagtattccatggtgtatatgtgccacattttctttatccagtctatcattgatgggcatttgggttggttccacgtctttgctattgtgaagaagtggttgatatatttttaaaatattttgttacaaaaaatttcaaacataaaaaaattgagagattgatataatactcctccttgtacctaccactcagctaaaacagtggtcagcactttcaaaatcgtctttcaaactatcccctttctgcttttttgttttgtgcttgagtattttaatgcaaattcaagatatcatgtcatttcacccataaataatacagaatgcattggtaaatggtaagggtttctttttctttttttgagacagagcctcgctctgtcacctaggctggagtgcagtggcgcgatctcggctcactgcagcctctgtctcccaggttcaagcaattctcctgcctcagcttccccagtagctgggactacaggcgcgccaccaccatgcccggctaatttttttacaaaaatacatttttagtagagacggggtgtcaccatgttggccaggatggtcttgatctcctgacctcatgatcagcccgcctcagcttcccacagtgctgggattacaggcgtgagccaccaggcccggccaagggtttctttttcataaacactatgacattgtatgacattattacactttaaaaataaacagtgttctttaacacaattgaatactcagtccatattcaagtttccctcatggttaacagattttatttttaacttttttactattggaaattttagatatatacagaaatgaagagaatagtagaatgaacccccatgtacctattacccaccttcaacaattatcagttcaaactcaatgttt

SEQ ID NO: 9280 - DNA, 161 bp, artificial
  synthetic oligonucleotide
gcaaaagagaggaactagattgttctcttacccgctacacagtgctcttcatttgcttctacaaggaaataaatagggatgtggtagtggcatgctacgtatttaaaaacacttttttttattgagacgtaattcacatcccataaaattcaccattgtaa

SEQ ID NO: 9281 - DNA, 591 bp, artificial
  synthetic oligonucleotide
caactggaattttcttgaactgctggtaggaacttaaaatggtacaacatggatcacctgaggtcaggagtttgagaccagcctggccaacatggcaaaaccctgtctctactaaaaatacaaaaattagccaggcgtggtggtgggcacctgtaatcccagctacttgggaggctgaggcaggagaatcacttgaacccaggagatggaggttgcagtgagctgagttctatagtgccactgcactccagcctgggcgacagagcaagactctgtcgcaaaaaaaaaaaagtacaacaatttttgtcagtttcttataaagttatacatacatctaccctaggacccatgaattccttgcctaggtattttctcatgagtcatgaaaccatttgtcaaaaacaaacaaacaaacaaaacaaacaaacaaaaaaccccgcacaaaaatgttcattagcaactttcttcctaagagccccaaactgaaaacaactcaaatatccatcagcgggagaattaataatcaaagagcagtatattgatacaatggaatactactgagtaataaaaaggaaataaataggacacatg

SEQ ID NO: 9282 - DNA, 1678 bp, artificial
  synthetic oligonucleotide
ggggtgggcggagcgtgccgcggcaggaagttggcgatgcgcaggcgcgagggctcgcccggcgctcccagggccggccgcggaggcggatggggcgcgcgggggcggggcggatgagggcccgagggggcggggcggatgggggcgcgcgagggcggggctgatggaggcgcggctggccggctgagtgggggccgcgagccccggggcggcgagccttggggcccgcggggcgtggttgcttgtagcggcagcggtggtgggggtgagaggggggcagggaggctgccgccgcttagccaagcaaaatctcagagcaagaggggaaaatggttcctgttctcgagagattactgtgccttcaaagtctccctgataatcacggacatgcaattctctgcacccctgaaatgttctcctccagccgactggcctttcctggggcccggtcgggccgaggtggggctggtctcagacggaggagagcttttggagaggccgcgggcgttttctgcctgcaaaagccgccgggccgccctgttaggctaaatgtgcagcctgtggcggcacaggccgccggcgggccgaagccgatttacactgttacattttaatttgttcgatgtttgggtccttaagatgatggtttgcggcctcttcgcgcttcaggggattttgtccctgcactggcgttcctttctcatcccagccccggcccctgctgagtcatttttgtcacctgcaggggtcccagcgcgaccccaccccaagctggcggagctggagagagcagggctgaactaccctgggcctgcttacctgagccctgctctgctcaggaacttcatagcccctgaggagtgtgtcgggggaggagaaagctggctgcaaggccaaaagggaaatagaagaaaatgagggccaggagcagaggggacggagttgggggaggcgaccaaggtgcctgcgtgcaaagggaaccgaagtgtacgtccagctccgggagaggctcctcttgcaaaagcacccccggaacatttgctgccttgatacctttccaagtgccttcatgctcagatgctatcttgcagatgccgctgtcatgcccacttttctgaccgggacgcaaacccagacgttagtcagtggcagaaccagtcacattcccttctgtagatatttactgtgttgtttccgatacaataccgttcattattataacgccctccccccattctgggtcaaggaatcttgttagtgcctaaggctgagggggtggctagagagggaagagagttggaagggtgtttaagcaatacagccctcatattctaggacattagttggcaagactttttctaaaaggaccgagatagtaaatattttaggctttgggggcaactgctcgactctgtcgctttgcagcgcaaagcagccatggaaaatatggatgcatttggctgcgttccgataaaactacagacactaaaatcgttttcacgggtcacaaaatcttttgattttttttttctatcacttgaaaacggaaaaaccattctcagctcgagggtcatacaaaaacatgtggtgggttagatttagtcggaggactgtagtttgcccaccttgttctagaataattgtaccttatggctctgcttcaaagagaacctcgtgt

SEQ ID NO: 9283 - DNA, 948 bp, artificial
  synthetic oligonucleotide
aaccacagattctttttattctttacagactatttatttaactttgcatctgctgccacaaaaaagataactgaatcagttgctgaaacagcacaaacaataaagaaatccgtagaagaaggaaaaatagatggcatcattgacaaggtatattcaattatcttttggaagtagaaatgtatgaaattcattgtttcctcttgatggtttcttcttcttatgaacattttttaacctaagtagaatatcatattctgataaaaatgttaattgttgagatttttggttttttcctctctttgaataacaagtaagtatcattaaattacagtacttgatttaaatagctgtttttattttaatatattacaatcaatacattgatacttgggggttatactaaacttttcatgttggttgtttgtttgtttgtttgtttgttttgagatggagtctcattctgtcacccaggctggagtgtggtggtgtgatctcagcttactgcaacctctgcctcctgggtttatgcaactctcctgcctcaacctcccaagtagctgggattacaggcatgcgctaccacacccagctaatttttgtatttttagtatagacggggtttcaccatgttggccaagctggtctcgaactcctggcctcaagtgatccacccgccttgccctcccaaagtgctgggattacaggcatgagccaccacgcctggccaacttttcatgttgtgagtttaactttataactgtttgaggatatatttatgcctttgcatcatgcgactaaggtcctagcccattaggaacaacccttttaagactctaaggagtgagtttgttttttgcagtgggcctatggcatttcatttatgttggtagatatttgaactaaggaagtcatcaattaaaccttagatacattgctatttaatttgac

SEQ ID NO: 9284 - DNA, 859 bp, artificial
  synthetic oligonucleotide
ggggcggagcctttggacggaagtgacgcttgcgcggccgcggcggagtcgtcatagaggcggggctgcggcggctgcggtgttcctccgacttccggacatctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcagtgagtctaccctggctctgggaccgggaaggggggggcgcattcctcctctgggacggccctggggcgcgggcccgactggctgggggatgagggggccgaggtgggaggcaggggaggaagatgtgtctgtcggtcagtcctctccgggtcgggagagattggtgaggatctggacgaggccagagcttcatctagcagtcaggtcctgtccctgaagttcctggtgacaagtctacaaagtttgcagacattggaatcaggtatgcagtcaagcagtgtgacccgacgtcttcaggtttgacaaggaatcttttttgttcaactcgaaaaccttcatttacaccccccagatcggggatagttggcgagcttgaattggttgaaaaaataattttttgcccctaggtcagaacgtgttgtctgaagtaaactgacagttactgaatgtcaatgtctgccccggtcaaatgctttttaggtacagaga

SEQ ID NO: 9285 - DNA, 301 bp, artificial
  synthetic oligonucleotide
caggggaaggattcatcaaaaaagtagcatttcaactgggctctgtagaaagaaccttgaggggagcatgcaggaaaggggcagcagtgggcattcagaaagagagaaaacagcccaagcaaacacatcatgcccaaatgcaaggctgtttaaagaatgtgtacaccatgtttggggtggaatgtcaagtatgaggaatgaagagggcacacccacttcagatcatgaaagtctttggtcaccatgctgagtccacccaaggtcacaaagggagtaagaaggtgtaggagtcacagaatga

SEQ ID NO: 9286 - DNA, 279 bp, artificial
  synthetic oligonucleotide
aaaatgaaagcctgagttgatggacccatttattttctgtgaatctactcttgtcatactagggactaaacctcagtccatctgaggttgagcatcacttagtcctactcctactgatgtcaatttgttcttcaatgtaataacatagcatacgatattacctggatcttcagtttgtttttttcattcttcattcttctgatgacaactgtttcctttggcaatgagggagttcaggacacactaccccaaaatatggcatcttggcatattgcgtat

SEQ ID NO: 9287 - DNA, 1734 bp, artificial
  synthetic oligonucleotide
tgcattgaggtaatgctcacccttactgcggtaagagtaaacttaactttgtcttattaacaggttgttagggtagtattctcaggaatccagcattcaaaggcagtggaaaacagggttgggggtgaatatccttagataagaccatctctgtgagttcttggtagagtttcatacaagatgcgtagcatgccaggtgcagtggcacccacctgtagtcccagctacttgggatgctgaggcagaaggatcacttgaccccagggtttcaagtccagcctcagcaatataacaagactctatctcaaaaaaaaaaaaaaaaaaagagtagcagattttcatgacagatattagaagatggtagtctcctggaggggtaaagactcaaggtcagaagagcaaggttaaggatgcacaaagggatcccctgtgaagggtttcaatccctgagtacatttttcaaagaccatggaaataagacacaatcaatacacagtttgaaagtccttcccccataggttgtaattccctttagcattctttgacccttccataaagcctgaattacctacaaaactttgtgagtggcaaagtgagtggcaaaactttgtaaaggcaagtagaggacaaggtcatgagaggaaaggtaagtcttgactatatccctgctcctcccatctgaaaacactctggttaggggcagcagagtacatcaaggaggactgcagtttaatgcaggtcaatggcccaggccatgcccaactgaggtccatgagaaaacaggaaatcaataacacagcctttggagtataataaggagaacctcagggagcctcctctcttgctcaaaggtacctatccaagagaaatatcacatgagccacacatgtgagccacatgtgtaacttaaaatttcttgaagcatatattaaaatgtaaaaagaaataggtgaaattaatgttcgtattttattaaaataatgtattcaaaatattatcatttcaacatgtaatcaatataaaaagtattaatgagattattttcccttttactaagtctttgaaattcaatgtgtattttgcacttacagcacatttcagtttagccacattttaaatgctgcattgccacatgtagctcatggctgcagtattgaacagcataggactatggaaaggtgaccctgggaaaaaaacagaccctgggataacaacccctcattcactatgtttcatttagcagctgaaccagtgccctctatagaaaccagagaccaaaaccagcaggagtgagccatgggggaggaataaggaatgaaccggaagccagccctcctcttagagataattgtgtgtgtagccagctctactgtctgggctacacatctgctgtgtcaaaacccaatttggattctcactttctactctgtcaggaacaagttgtacttcctgatccctttattttcctctattattccctctgtaaatttctctttcaaaacaagaaaaaaagattctggctcattctgcttgctgtgctgtgagcaataaagtctttgtttctgatccgagggtcttatatcttctgccagtatccatgaaactgtggcaagctaacttgtcagctttcaagtagggtcaaatctcagacctttcacaattcttgacattatcattccatccttcaatgcctaaccaaggtctaactccaaggaggaattagaggcaccttta

SEQ ID NO: 9288 - DNA, 568 bp, artificial
  synthetic oligonucleotide
attcatgctaccataaccccaagatagtcttgtactctacagctgcaccataccaaatagctccaccttctgggatacaagcttttaacattttttccccaaatcacaaatttccagccaggtccaagtagttcaatgccaactcagttgaaatctgtgatttctttaaggcactgtgttgcagatgttaattcctctttattcctgagtcatatgtgcagacccaagtcctggctgattcactgtgcaccacttcctctctcagtagctctacaagtacaacctgcttcaaagccaaaccagtctgagtcacaggcattttaagtttgtctttgtagcctaaatgtctcattctcttggtaggatcatgactgacagcttgtgaacaacattttttagtatttatttctacaataactgcttttgtactcccagattaatttgtagcatcttcaataataaattatttgatctggcaacttctttatgaaatcaagcacagtcccacatatccatgacataccctctgggtttataatcctagacgcttaaacataactactttttt

SEQ ID NO: 9289 - DNA, 1841 bp, artificial
  synthetic oligonucleotide
aggggggagggagggatggagggaggaacgaagggaaggaataacaggtgggaaggtccaaatattaaaaacaaaaacaaaaaacaaataaacaatggtgccctggtttttcaagagaaaggctatgaacttcccaaactacagactgatgaatttgatattgattctaagccagagatcagcaaattattctccaaagtgccaaatagcaactatcagaggcttttcaggaaaaagaagtgaggttaacctggcactacttcacaacttcataccgtggttctcaactgtggcttcatattggaatcacttatgaatcccctagaaatgatgaacttctgagaccccatcccagggattctgatttcattagtctgggatataggccgagcaccaggatttttcaaggttccccagtgattctaatgtgtagccttgctaggctaatgtggtccttgctggcgctgaggaccactgcgttcatgcaaactcctggggatcaacacatctctttttaaggactcacagtctttttttcttttaagcctattctagaatattgcatctggccctccatccatttttgaatatcaagttgtgttggcacacagccatgctcatccgcatacacattgtcagtgtctgctttcacactcctgcagcagcgtggagtcgttgtgactgagaccatgtgacccacaagcctcaaatagctacttactctctgacacttttgagaaaagttggctgacctctggcttagaatcaatatcaaattcaccagtctatagtttggggaattcatggcttttctcttaaagaatcaaggtaccactgtttgtttatatatttgtctttttttaaacttttaagttcaggggtacacgcgcaggtttgttatataggtaaaagcatgtcacaggggtttgttgtacagattatttcatcacccaggtactaagcctaatacccattagtgatttttcctgatcctctccttcctctcaccctccacgtccagtgggtcccattgtctgttgttcccccgacgtgtccatgtgttctcatcatttatctcccacttataagtgagaatatgcagtgtttggttttctattcctgtgttagtttgctaaggacaatggcttccagctccatccatgttcctgcaaaggaaatgatctcattcttttttatggctgcataggaccttcttacctgttactctcctgaaccctctcctactcctcatgattacttagaaagcctggcaataaggtgattttcacagtatcacttatcacaacactgaagaagagatgtaatagattttattctgatgtatgaatgtatgtaataggaagccttttaagatcacctacagtagcatttcataattgttatatacacgaggttattgaccagaatgagcatgtgtttcatcagtgtttacatatttcctatctgagcatcccacatactgtatgcagccaagcttcctactctactctctgaagctgcaagctattaaaactcaagattatgatatataacaagtaatatttgatatataatgtctactatttaacatacactggatggtacataataggcaatgtacgtctgtgaggcagttattgttgctgtggcactggcttttggacatttttggatttcactctgcaggcgtttttaaaacttatgatcaatgatccatgaaaaatgagccctaaaataaacctgtgtttcactttaggcatgaatagaatatatgggaagacacctgtaagcatatccaccccacctgcctttacctagatccttctcatattgcataataa

SEQ ID NO: 9290 - DNA, 1780 bp, artificial
  synthetic oligonucleotide
ttttgtgtgtttaattatgtggtagtcccatatctgatttcagatggaaaatcaacttgatttatcctgaaattgtatatgttaggaataggtactccaaagttatatccaagtaaagaatttaataaaattgactttttaaaaatgtaaaacctgcccatatctggtatcatccttctgcagactttggcatttgatagtgtgttttattattttatttcaactcagtattcaagaaaagtttttgaaaccttttgattaccctgacagctgaaatggaatttttacaaggacagcatgtttggagccaaagatctggctgacacaatgaatgtgatgatgaaaataattttacatcagcccagcctaggatattgccttcatttaaaatttatattagacaggttttttttttaacatttttcctctaaaagaaaacagtagttttcaactctttccgtcagccaagaaaagtcctaaagctttggagatttggatagttacaagagtccaagaaacctatttcccagcatcctatcttagaattattttcagaggttttggaaagaaaagaaatcctaggggctacataattaagaaattagtctatttcgggataacagtatacccctgcagagatttaataaatggtgtttgaacacgtaaaaatggccccaataaaatatccaccctctccaaactgtgtcctactgggtattgacacagcagtggttgcaggttcaaattggagatcagatgcaaggcacactattggctttaattttcactcggccttgtggaagggcagaagacaggaaatagcatgtacagcaccttcatttcttcaggatacccgtggtaggcagaatcacagtgccccaaagatattcatgccctaatctgcagaacctgtgaatatgttacattacatagcaaggaggaattaaggtgcagatagaattaaagttgataagtcagctgaccttaaaacaggaaaactactctgtgtattatctagatgagcctgaagtaatcagaaacatccttaaaagtggaagaggttggcagatgaggaggtcagagcgatgcaatgtaagaagggctcaatcctccattgctggctttgaagatggaggaagggaccatgagccaaggcatgccagatgcctctagaagccagaaaagccaagagaacagattcttccctagagcctacggaaaggaatgcagccctgccaacaccttgatcctagctactgtgaaactgtgtcagacttctgtcctgcagaactataaagtgataaatttatgttgtttccagccgctaagttcgtgaggatttgttacagtagtgataggaaacgaatgcaatgcctgacagctacccaagtgcacagcttcttttgcccccacacccacacaggaaatgcaagtttgccacagaatgacatccaaagtgtcataaaatcaccttgacacagagaagccacagtcacagcttcccaacaatcttttatatggttccagtaacacaagccccaaaactgcatgtcagcccccagcagccccagtccagaagaggtcccacagagcagggcttcacagcaagcagggcaggtgcaatattccacatctgttgatcactgcagtttccaaagaaacaggactctgtggtcgatggttctcacaggcaggcctggatcagcccagtgctaaggttaaccctttactcacaattgtgatcccaatgtcataatatatatgtacattatagattgga

SEQ ID NO: 9291 - DNA, 2025 bp, artificial
  synthetic oligonucleotide
tgggcaatttatagataatagaagtttagttctcacagtcctggaggctaggaagttcatgatcaaacagattcattgactggtgagggctcaccctctgtttcaaagatagcatcttcttgctgtgcccttacataacataagggacaaacaggctccccagagcctcttttataagggcagtaatctcattcatgagggcaggtgacctaatcactttccaaaggcccacctcttaatgccaccccgttgaggattaggtctcaacatatgaattttgggaggacacaaacatattagaccatggcagatgatggaagaagatgtactgagctcatcttcaaagtttctaaattttcattcacgccattacgttgccacttgttctatgcattctcatgatgctctccatttgtaaagtgttttctccagagaagagtccccaaggaacagtgaggcacatggcatgcaagactccccataggaaataactctttacccacgtcctttgttctgacacccaaagcagctctgggcagacaaagcctcattccaagaagtatcttcacagcaactgtcaatagggacaatcaccaggtttcaaataaaggccaatccaggggcacctgacacaacccccctcctcccattgccacaagccagcaggtgggccttctctggaataacataaaaacctaaacagagtaactcatctgaaatgatttgtaataataaaatggtgcccaaagagccttgtggaaacatctgaagttccaaggcagaggttatcctaggcttgtgggggataactttggaaaagactggtctagttatttaagtcaagcaggcccagctgttttgcatttgagagtgcagactgcgtaaagaaacagatcagcagaataacttggcgttttagttcagtaactttaagatttttcaatatcatgatcttatttcaccttcctgagatgggaccaaagcacagctacttctcagcaccaaacaaatgcattgtgaagttaataggaaagagaataaatcactgattggggtggcagagaagaattccttacagcttacttcaaaaccaatatttaaaggatttttattagacaaaaagttttctagaaaatattattatgggggcctcatttactgtattctttttgtaatacaaaataaatgattttagctacgacctgactagggaaatggtgaatggacggagagggaatgttggtatttattagccatttggtataacggaaaaagcattgaacttggaaattaaaagagctggatttgttatgagttaatcatgaaaccttggataagtcacttagcccagtgaatctcaaactgtagtgattctgaaaaaaatcacacggagaacttgtttaaaacacagattcctgggatagggcctgaaactgcatttctaacaaactgccaggtgatgctgatgctgctgatctgggggccacactttgaggagtaagggagtcttaggctctactctccttatttttaaaaggagtctaccatgttagatgattgcataggtctcttctggccctgtaaaattctctgaggcccaattttgtttcacttgtccttctgaaagtgtctgcgatttttctttctaatggagatggctaatggtaggacataaattagatcactgagggaaaagctgtcttagggaaattttgctgttgtaaaggtattaaccattaggaacaggtgcctacttaaatattttacatgacgtttgagtctcctaagtgaaatggaaagaatcctctggaaggcttcagtttaattcttgactctgccacttcctagccccatcaccttaacctttcttagtttcttcatccataaaatgggaaaaccaattccaagtccttcctatagtgttggtccctagaatatgcactgaaaagcaccttgtaggttggaaggagccatgcaagcgtaagaaatggctgtatgccaggcgtggtaagcagagatcacaac

SEQ ID NO: 9292 - DNA, 1176 bp, artificial
  synthetic oligonucleotide
ttgacccacttgactgagcttggaagcagatccatccccagttgaactttaagataatcacaacctcagaaaacaccttgattgcagcctgtgagagttcttgagccagaggacccagctaatccatgcttgaactcctgagctacaaaaactttcatgtgataaatgtcttcagccaccaagtcgtggggtaatttgttatgcagctatagataacgaatgcaggcaatagcaactacatcatgaatgtcatctggctgatagcagttataaattgtcattgattgcaagatgcatctcaattttagtgatgataaatgtggataatctgtattttagaataaatggagaagttgagtagtttacttgtctgttgtccccattagcatgataactccttaaatgaaagaactgtgttttattcagctctgagtgtccatggtgctcaacgcataagaaatgctttatagatgttttctatttaccactggacaaagaccgagctagaggcaaatcttgagaataagaatttgctcgttgtcacggtttagctgggtatgactcataccttaaatgttccttttaaaagttccagtctatgctctttttaatataacaatgccactcatttcatttgttcttctggtactgagtgtattagtccattttcatgctgctgataaagacatgaccaagactgggcaatttacaaaagaaaaggtttaatggactcacagttccacgtggctggggaggcctcacaatcatggcagaaggtgaatggcacctctcacatggcgacagacaagagaagagagcctgtgcagggaagctcccctttataaaaccgtcagatattgtgagacttattcactatcatgagaatagcatgggaaagacccgcccccatgattcaattaccttccaccagtttcttcccacaacacatgggaattgttagaactacaattcaagatgagatttgagtggggacatagccaaaccatatcactgaggtttagaaataccctcgtggatgttgaggacatcaattgaatttggactttatgaataatatttctaatttaagaattacatgatatcctttcataattttgattaaaatcctataagaacatgtagaagattgctagcaaaggagtattctatacctta

SEQ ID NO: 9293 - DNA, 235 bp, artificial
  synthetic oligonucleotide
gactgtaactgttttaagaaagtgtttctgaacaatgaaatagctatctggtagaaggaacagaaaaaaacccctgaaatcttaggtaactcataatccaggcaggcagtgagatattttaagtctcattccctctgttggttgtcatttttacctagtatttgttaaggcccccaatggattggatgatgtttgacatcaaacgcaattgcctgaatcaattttaaaatctcat

SEQ ID NO: 9294 - DNA, 747 bp, artificial
  synthetic oligonucleotide
tatgagaagtgaacctccagcattagattttcaaaaatgaataagacattatcatatgcctcaaagagcttcaagtctcatagagaaaacctgcatataaatgcataatttataggcccaaaattataaagtgaaacgctggacgtgtaagtatagagttaacaacaacaaaaaagtatcaagaaaattgtggagggaggaacatctgatctgatcacgagtcaagaagacccatggtgaatagcaaggttgtgcgcagagttagacttaagggggaagggatgaaagaggcagaaggaatacaaaccataggaaggccagaaagagtcatatcatgagctgacatttgtatagcatttcccacatttcaaattataatcacaccccactatcctatttgatttttaatgaactcattgaagttaaactatagtgccaatgcacagaaatgtttcccagctgatgggaaacatcttgaaatgaatccaagcttagattatttctgctcaatgtagagcaagagttgaaaactgtttttatgtgagaaaaagactatatattagccccaagtgggaattgagaagaaaaatgttctatccattcaaattgtttctaaacataaatcaaatgtgacattggcccctgagatattatgagcagcatggtatcatccttgtttctaaccagagaaatgttattgttttaaaattctgccaaaattccccagggagcaatatttccttcgtt

SEQ ID NO: 9295 - DNA, 1211 bp, artificial
  synthetic oligonucleotide
gagaggatgactgattcctggtcccaaatatgccatcacttagttatttaacctagtacaggtcacttagcctctctaaacctcaatggcaaaaggagaaagttgaagaaaactttgtctaaaattctatcaaggtctacattctgtccaaagcttccacttgtaagggatcatgtcatttctactctttggaaaccctcattcagagatacatatcaaatgttattttagctcagaaaaagagaacttagaaagagagtaaacaaaatcaaatggaaaccaattttggattctttagatgagtattacagtaaagaaaggggaaactttaaaagtataaaatatagagaggttgtggacctaaaagaatatcaacataatgtactattttattttgaaagccctttaatgaacatccttggaaggaaaataaataactatgccattgagaaaggtagagtttacagtgtgtttaatcagaaaagcctgctacgaaaagctaaatcaaaacccctgcatgacagagtgttgatgacttgcaaggagtggctactgttagtagcagcagcaccatgaagtccaaagtgacaacagataaagtgtagctcatttggagtatggggttttggggcagaacatagagatgataagctccataaacatagctctggtcaataaattagggggaagctctactatatgcatcatgaaaaccagtgaaaagctctcgagtatattgttagcaatggaaaacatttgtggccaaaccaacaatcatatttaggatacgatgccagaatttctgccaggcatctttgaaagggaatgtctttttaaataacataatttcaattgactgaagaatgtgttaattcctgctgatggttctttgtggtgtaatgaaagtaatatcagcataataattaagaaaggacagaattcttcactggtagtcaattatatgtgagggtgtgatgttgtgctgtgacctcaaacaggagaaaaagattagaacataaaattaacgtatgatagttgcaaccctacaagtaggggccatgtttggattatctgttttctctcttcacccataaattcaccctttgagcaataaatagccagctcacatacaaggcaatcttctgattagttttcaccttgttcccccaaagccacataaaaaaggtaccactttagatgatgaagccaga

SEQ ID NO: 9296 - DNA, 446 bp, artificial
  synthetic oligonucleotide
gttttggttttacgtctgtgtcataccatagagtacatatgatcttgtcctctatgttttcgagagctctggtaacacagcatttcttaagatggtgctccactattgttcctgcaatttccttgcaagctgctgacactcattctgcaagtgctgatattggcacattcttgcctgatgaggtgtaggtaaagcttttggatgaacacgaatggcaaaatccagcagagtttcatctacctgtggatatcttcctttcctagataaccataaagcagttgcttgttgcattgaaagaaaatgtaaaattgtcatcattccttccatgacagatatttgtttcattaatatcaaatttacaccctgctgctctgtttctccgcttctctgtattcacattatcttaatgttttaataccaaatcatggaataatccattaaagata

SEQ ID NO: 9297 - DNA, 1255 bp, artificial
  synthetic oligonucleotide
acaggtagtttatttgggaggtgcagataacactggtaggagagtggggaaatgtcacaaaacagagaaggcagccaataaaggatgcattatcaagccagcttccactgtgggaaactggagcttaatcctacagggcaactctgagaagtggtgtgaaacctatgccttgagggtttttaacccaaggagagagggagctggggtatttatataccaacttctggcaggaattaacctctcttgggaggaattgtttcatggaagttccagcctgccttacatataagcagagtggccttccatttaaacattaaaagtagacatttgcagttgaaagttggctggggtagacttaagtgttaaggcctgagttatatgtggcacttatgcaaagcttgcccaaaagccttagtggaaacactgaaacttgcttcatttactgagctcctctgaaaacggctttccatctctaaaggttcacagcatgagctcatttacaagtagtttagcaacctacattcgtggcacacctgaattagtcccagcacttaggttcaacgtcaactcttgatatgcaactaaccaggcaaagtcatttaacctgagtctcaacttttttcatctgtcaggaagagatattaagttttgacctccctcacaggcatgaaatgaggctcaaaatcaaaatatgataatatgcatgaggtgtcaacaaacttttctaaaggtccagatagtaaacatcttagcctttgcaggccatgtgatctcagtggctactcacctctgctatttcagcaggaaaacagtctagacaataggtaaacaaatgcatgtggctgtattccaataaaacttgatttacaaaataaggcagcaggctaaatttgacctaccaatccatgagctgtgttttgccaacctcttatgtacacgaaagacttttgtaaactttagtgctatgcacattctctgtatcatttatccctcactcaataaatcattggaattcactatccctgtcatcccgggggtggaattcttagtttcttccttcatacagcacgtatttactgagcacctcttctgtggaaggcattatgctggccctggggcttcagtgctaataagacagacacagtccatgcccaacacctagaatggcaatcctaaacctgttctcccaccagtctgcacaaaatagttattcctttggatgaacaagtgacaactgcaactgaaaccctatcgg

SEQ ID NO: 9298 - DNA, 2264 bp, artificial
  synthetic oligonucleotide
ttaattaatcaaatatctataaatgcataaagtacagtatttattcttgatacataggttttgagtcaaatgtatttacttagatttgtctttgactgctacactgaatcagtagtttcactataagaaagaagggattgtatctgagtagaaatgggaacatgtttatatttaatgtatgcttctcctaacgtttgtgggaggaagtgaataaaatttcagtaacacgtattttttgtctgaatatgtataagaaagtcacaggggtcttaactttaagaactgattgaaaaacagctacagacttgtttctacttaagaagagtatttatgaaagagccatgtgcagaaaaagacttggctgaaatatttttctttttctaagtgagtttagttggctctaaaaagatttgattcccttactttagaaaccctgaatcgagttttttttcactcaaagagggcaattttgacaggttgcaaacatattaacccactttcaaataaattcaaattttacaaatgtgcccttacacattaaaattctaagacaattttaatttaggttttctctatccagatgagatacaaacagttggctctcattttcacatggcacatatgaaaagattcttgtctcttgatatgaagaagtgcccactgtctatggagctttaggagttgggaccaagacagaatgaaacttcaattctgcttgctacgtgctcgtctgtactgtacaaacctgctttgctggtagtccataattacattgaacagtttgaaaagcaagacagatagtatagcttaaagaaccaagatttctagcttgacagtccaactctgcctctagctatatcactctggctatcaatttcacttgtctagactcttgttttcatctctagactgagaagacagtgctaaggtcttgtctatcgctaaaattctgagtctcttcatcgtctctagttctgtctttgcagcctttctgtagcccatttggtcacagtagcctcacttctgctacgcttgcaacaacaactctttggaaatcaaccgctattctatatttgtgttcacgttagtggtatgaaaggagacagaccattctgttgcttcaaggggctccttggaatactttgcatgaaccctgatgttccgcgagcttgctatgttttggagttagagctgtaagagacataagaaaacatattgctgagtcttctcattatacaaaggatactcttcctattcacccttcttcaacctccatgaatctgttattttgaactagtgttccacaattttgcccttggctttcttcaaaacccttgaatataaatgactctatgcttagttagttgctaacatgtatagccttttgaatacctagcataactcgttcaggcatctctgatctacctgcttccagagacattttgggagtagagctcatcttcatgtctccttcagttaacatcatggcatagattgtgtgtggtcttcttcctagcttctggacaaagagtgaggagatagaggtctaagtgtagctgtgtgtccttaggcgaatcttattacttttttttttttttttttttgagatggagtttcgctcttgttgcccagactggagtgcaatggcactatctgggctcaccgcaacctctgccttctgggttcacgggattctcctgcctcagcctcccaagtagctgggattacaggcatgcgccaccatgcccagctaattttgtatttttttagtagagatggggtttctccacgttggtcatgctggtctcgaactcccgaccgcaggtgatccacccaccttggcctcccaaagtgctgggattacaggcatgagccactgtgcccggccaaatcttactacttcttcgagactcttaaatgaaaggattgaaggaggcctttgccagccagtgaccaaggactggtaaaactattctgtgaatcaactaatggattgacttagaccttcttaccaggaagggcatagttgggcccttctctagggaaatcaaaattttattattttattccacctcaagaacctaaaattacgtgagagagacccaagtccccacgtgtatcacttctctgccaaagcagagtgtggcaggggctggagctgagacatttcacgcctggcttccaaagataatcacgtttagcacttatgtctttggcaagaaaaaaaaatcaatttttgctgtggaaaaccatctgtgtttatt

SEQ ID NO: 9299 - DNA, 304 bp, artificial
  synthetic oligonucleotide
gagaagaaacataaagtttctttctatatttaagaaaatgaatgataagtatctaaatggtatttagattctattggacacatcacatttaaatgaatgatgtgtgttttatttgtaaacatccatatttatactgcactggtaattctattctttataattacttaagtttatgatgaaaatcttgagatgtcgacttaaaaatgggtaaagaggttacatgggttttcaaactccttaagtgatacagcagttaaattctgaagactatgacttttgaagggcagggatcccgacttagtta

SEQ ID NO: 9300 - DNA, 543 bp, artificial
  synthetic oligonucleotide
agttagaatttttacagagaagtattaatgcctctgagaaagaattttaaaaataaaactcagtgtgaaagtttttcttcttctagcaaatttggaacagtcagatgagaggtaaacagccagaacatttagttgctaatgatagacagtgagtccagacagcactgttctgaatgttgcaaatgtgatcatcagaaaaaagtattaggagtgaggtagtgcataacaaagagctgagctggataatttgccaggtgagtgtttgacttttttgaaaaaaaaaaaaaagaaaaaaaaagaaagaaaattggattcatttaactttaaaatctgtgtcagttttgaatgtaagataaactattacttgacagttcttcctacctaacagaaacccataaaaatgaattgagatgaaaatgctctagctcttttattcttttggttgaacatgtaattttcaacaatcctctcaattcttttcattgtttgccatgtatccatgggtatgtgtcaaggttaaaaaacttacttggagatactact

SEQ ID NO: 9301 - DNA, 1213 bp, artificial
  synthetic oligonucleotide
cctggattcaaatcctgctgccatcacttactaaattctgtggccttgtgctaattgcttacctcttcatttcacagaatcctcaactacaaaatggaaattaatcagagtacctacgttataagattgtcatggaggttaaaggggacaatacacataaactgcttaatatgtgcctggcacatgataattgctcagtaaacattggctaagattatgattattgtgattgctatatcaattttaaccatggtttatcatataagacccaagcatcagataatagattgggtttatttttcagctaaggccactctcaggccaaattctctgggaaaagttggcatctgatgttggtttattgagaaggaaagtggaagtcatatagtcttgggaaaaagaacgctctgtttctacattctaattgtgaaatgtctcactctccaacatactgatttgggggagtaagaaatagtacttgaaattggcatgctgaaatgattctcaaaatggcctgacacatagtaggtactcaacaaatgttaccttcttaccttatgtaacccacacttattgtcacttgcttgtcactcttatttttcatatgctcaaaccttggatttaatcaaactacagtcattgcattacttttctctatgctttcattcaccttattcctacattgaatatcctcaactgtctttccatgcttccaagtcctacacataccccaaggaccaagtcaagtatggtgtcctccatgaagcgtttctgagccacatgagcttacttacaggcaaagagaaactgagagcaggaactgtgtgtgcaagaactgaatgtatgaccttccagagaccccaaggtcaactgtcctttcagaaagaacaatgacaagacagcaacagtaaacccagaagaacttaggacaagatgacccaatagttgattacatcctcctcctgaagatgcttggctgtagtttttcacagtgttcttcaggttttggaaccagtgccagagaagatggggagggagcctgcgtggcagagtcactggattagaaagcatttacctggcatcatccagaataagttgactgtcagggatcaggctggaggtccacagtcaaaagtccattctggaaataatacttttgctcaagagaattttgaagactgtgaaactatgaaattccctgcctattgctaat
